United States Patent 9,328,346 (POLYCOMB-ASSOCIATED NON-CODING RNAS) - sequence listing, part 35

SEQ ID NO: 5915 - RNA, 168783 nt, Mus musculus
cagcugucgccguccaggcugcagauuccuccagucccucccccggccgccucucugcccggagcgagcgcgcagcccagcgcagcagcgccuacuggucccguccugugagccccggccccagccgccgacagcccugcgaagucgccucccaggccuaccggcccggccgccgaggagcgggaggaggacgggaccccggcccccaccccccaccccaccuccggagguaggucaagggccgaggcaggaggaugccaacucacccggggcugccugcgggagagcggaggaggggcgcgggccggggcgcaugacgcugcugcugcccugcaccccggaggccgugggggcggggagccggcccuccggacgcggcggguuucgcagugaggucgcuugcccccccggacgcacucgguccugucaagggggugcgugccgaaucgggggucucccggggccucuuccaggcucugcgaguaacgguguggggcugcgggcaggcgugguccgugcugcucugcagcagccccgccgcccccgccucgcccaguuccgcgcccgcgcagggcugggggagccgcccuggggugcggcgcccgcccuaacguccugccacugggucuucaacagguucgugcgggcucaaggacccucgggcccugccuagggaaggugggcuaggugcccucuggucaccggcucaccguagccucuccgagggagccuucccuuuguuuuggugacaggagaggugccaggugguaccaucuaaugaggggaggcuguacggaaagcauugcccuuuauuuuugcagucaagccggggcacuuagugaggaaagggaugugugggagugcuucagcagaagagaagauggauucgaugcgggcuuuuggggcggggauguguguuguuggcaagauggauggcuuacggugcccucgccgugaugcagcacaaugcagcaguaucgcagucuccgggcuucucgccgacggggcuuggcacagcuacucggcgccugcggcccccgcccggccccacccaggcccaggacagcgcuuuguuggcgcccagagcugcuaauaccuugcggugcugcuguggagagacguagugucagaguguuguagagucgggaggagcaggucaccuagguaugcgaggggcagccuuuggggcagccuucgcuuugggggugaccucuccggccccuccuggugggugugggcacccaggcgcacccugcagcagugaugcaggcaaaaucugcuggccugcugcugcagaaggagccugaugcuaaggagggacagcacaggagggaggggcugcagaagaacaccccaggcuguguggugcauuugguguggaguugccgauuuucugugcaucgcccauaaaccauagccacaaaccagauggacauugauuccauuauuuguggaaaguuagugcuuauuaauuagauggucauagucaugauguuguaguuauuucucuuccuuucauuauuucugagaaaauggauuuuuccuuuaggaaaccaucuuugaaaugaaaugauuuuucauuuuagaucauaugcuccugaaaacguuuacuaaauuuuggauucagcugguuguuuuaaaagaaauuuguaugagacucuuuuaaccugguuuuuaauaugauuuuucugcaagcaagcacaguuauuuauuuggauucucuauuaagcauuuuuugauaagugucaugauugauagugaauugguuuucuccagaaucagacuuauagguucagguacucaggugaagccuccagacaugacuaaugggguuacuggcuucguuuauggcugcuuauauguauuuuuguguauauauauuguauagauagauguggcuggggaggaggguugaggccucuacuguugagaugguucugaagaccauuuaagugucuucacaggaaaaugccccguuaagcugccaguucuguacuuuauuuaugagguaugagguggcauaugggauagauuucaaaugucaauucaagcuuucuuaaaauguacaugugagagacagacuucaguauacuaacuggaaggaaaggucagcucuccaaagccaggggugagccugcuuuuguuuuuuguuuguaauauccggugaaucuguuaguacagaauagaacagccuguaacugugggguguguagugucuguauauguguggaaugucugugauguguguggaguguuauguagugacuauguguggucuauguacaguguaucugugguguauggaguguguggggaauggcuauugaguggaauaugucugguauguguaugugguauauguggggaggggaguguuugugugugccugugguaugucuauaguguuugguaucugguauguguaugugguaugugugguauaguauauauguguaguauguuuguaugugugaugcgugucuguggugugucuguaguauguggugucugguaugugugugugguauguaugugguguauagugugugugguauguaugugugugguaugugauguguaugugguguauguaugugguuuaugucuguagugugugguaucugcuauguguauguggugugugugguguguaguguauguguauaguauguaugugugugugguauauguguguaugauguaucuauaauggaugugccuguggugugucuguaguguggugugugugugugugauaugucuguaguauguguuaugugugugugccuguaguguaucuguagugugugguauguguguauguugugugugguuuuguguguuguauauauguguggugugugugguaugugguguguguguguauguguacauuauuugggcuguucaaagaugggacuuuguggauuugaacuucacagcuguguuggcaaucugcguaaagauuuuuuauuuuauuuuuuuuuaguguuucaugcauggauuaugcagacauuuuagauuuacuaugcuguaaaaaaaaaaccugcugaugucacaggagguuuagcuguucuaacuuacauaccagcugaagaacucuguuggguuaagcaccugguaucaccacagugaccaaaacuuuaaucugccauaauggaaaguucugggcagcaaaagcaguguccugggucaucuuacauuggugaagagcccggggagaggucuaucagugauguaggaaugggagcauccuuagcagagaccugcaauuuauuuagacaauuugauuuuuuuuuugucuucauguaugaaaguguaaugguccauguggagguacuauuuugagacagaaggauuuuacuacaaaaaaaaauuuuuuuuguuuuuguuuuuuuuuuuuuuguuuguuuguuaaacaugaggggcaauugcuguugaguguucuguuguuaaaguaauugaaagcuuuucaucuuaagauccucauuuucacuuaguuguuuuugagacaggaaccacugaucucagacucgggcuuaagugaccuuccugucacccuaacuaaagagcauauuuuuagugacagucuuauaguccacguucuuguauuucuuuuaacuuauuaaccuuagugcucaguaguaauacugcuuuaauuauggccggacaacggauuccuuuuaaugagccuuuucuaauguucuguggauuuccuuauguagcccuggguucuccugcagguuauugggaaugcaaaccaacuuucugugaggaaagagccagugucuccguuaaaaaugcuaccacuguagcgcugaggauucuccucggaagcuucagucuguauguuuuaucuaagcaccuuuucuucagaaagaccaaguuuaauacucugauugucuugguaguaguuaugccauccauguucaagcuuauauaguguagcaauaacauuuuuuggaaauuaaugacuaaaacuuauuccaaauggacagacacauauuuucuauuuuaacauaucauuucaggggcuggagucauggcucagugguuaagaguguacacagcucuaacaaaagacagcuucaguuuguuuccagcacccauucuaggaagcucacaacugccuguaacuccaguuucagggaauaugacuuuaugagcacacacacaauacauagaauuaaaauaaauauuuuaaaagucaguauggucuuuggaaauuagcagagucccucaguagauuguuaugagugcauccucuugagcccacuccagaacuuccugcucacucucuguuuuuuaauaaaauacaugauguguuugagcauccgguuaaggaacucugcccugcuuuuccaaacuaucaaaagcuuccggacauccugaauucuauuucccaagcuguguaaugguggaaggaaaugagaagagaccagcaaaauuguccucuggccuccacaugugcacuuggccugccccuccuaucuugcacacauacagacuugagggguaaugaauuuaaaauuucaugguuuccuuuauucuuccuucaccauaaagcugaaguaucucuggcuauguguaugacauguguguguuuccugccacuagaugaagaaaccuggagaguccuauuuguuuuugguuaucuagaucaauaguguuuuacauuccuuccuagaagacuucugaaguuuaaaaauuaucaccagagggcuucaagagugaagcuggagccugaagcacacagacccuuuacagccucugcaucuaguccuacccuggcuccauuuucccuuagagcuguuucucccaaauuaguauugauuauugaguugugacuguaagcaguauuucucaaguacauguuaaaagaaucagaagccaaugaaccuaguucaaaaugaaccuuaugcuaccuugugccccgccucuggucccguccucaauuguauacuuaucauugccuuguuugucgguuagcuuucuuaaaucuugauuuuuguauauuuuuaucuuuauauaagcaaaauuauauuuuauauauuaucugacuuauauuuuaaaguaacaucuaaauuaaauaaauuuucucauuucuagugcuggguaguauucuguacaaucccagcucauucauucagucuucuguagucggauauguagaucgguucuagcuuucuuacugcuaaucaaagagcagcugugaaugguauaguuacuuguuucuucguauacauguggcaacauacacacauuguucaaaaaauaaguccuguuggaucacagaauauauugucauuaucagccuuggcagagggugccaaguuguuuccagagugauuugauggguggaagggaaacguguuuguucuugaaccuaagaucacuuccuaacuuuaaaaaaucuuaauccuagggggcuggagagguggcucagugguaagagcacugacugcucuuccagagguccugaguucaauucccagcaaccacaugguagcucauaaccaugaucugaugcccucuucuggugugucuaaagacagccacaguacacacauauauaaauuuuuuaaaaauuuaaaauaugaauccauuuaguauuuguuuaaaauuuuucauuuguaauuuucugauuacuaagauggaguguuucuguuauugaccauuugaacucugucuucugaaaugcuucuucagacuuugacucacuuuucuuuaaaauguuuuuuguggauuuguaggacuccuguagguagcuugcccacuauuaccuuguagaugauguguuacaaauauugccugcuuauuccuguuuuugaagggaaaucaaauauuuauuuauuuauuuauuuauugguuuuucgagacaggguuucucuauauagcccuggcuguccuggaacucacucuguagaccagaauuuuuuuuuuuaaugaauuaguaauauuaaugaagucagaauccaguuuuuuuuaggaugauuuuguugcugcagaaacaaaauccuuacccuggaaggaacaaacagaucugauccuagaucccgauguucuuauuuguuagcuauguuguaccuagccauacuuacuuucuucaucagagaacccaaauaauacuuccucauccaucagggaacaccaacucagggugcugagcacagaguagauguucagcucaugugcuuuuccuuuuagcaaugcuuaaccuauaugaguuacaaauuucuuugauauuucauggcaaaaaaauaaauguuuuuacaucgagagcuauuaaauugcauauccuaacaucuguuuuuauagaagacucugugagugaugggauuuauguguuaacgcaggcuguaaugagcacuugcuagaaacaaaccuuuaaucaguuuagguuauggaaugugaaaaacguaucuauuuacaucacuucgugaacuguccuuugcacccaggaagcauuuaugggacugauguucuccauucacggcuacucugagauugcuuggcguuauuacuuggauuugguaaauuguucuugaauauauucugcugggauuugaagauaugcugguagcauuggaugacuuaaauuuaaaauuaaaaaaaaauuguguguguguguccaugucugagagcacuuguaugugcacauggaaaucagggaacacuuuguaagagcccauucucuccucagucaugugggcucuggaacugaagucagauuaucaugcugugagugugugugagugugucugugugugugagugugucugugugugugugaguguguguauguaagugagugagugugugagugugugagagugugugugugugugcgucugugugugugagugugucugugugugugugugugucugugugugugugaguguguguauguaagugagugagugugugagugugugagagugugugugagugugugugugagugugugugagagugagugugaguguguguguguguguguguguguguguguguguguuuugaagaccaggucugaagauuaagaugcuguauguuuuucugaaauguucuuugccagguagacaguccugagguaagacauguuucuucuuauuucuguuugauuaaagggaaaggaaaaccuacauucuuuaugaaagcaagcuuauuuuggccugggauuguauuuuuaaucuggaguauaugaaagcuuuucuguagauuauugauaguauuaaaauauucuuuuuuuccucaccacuuuuuaaguacucucaauuuuuuauaaugucugcuaauguagaugguauauuagaugucucuccaauuguguguaaagaacauaugcuuucagaaaagcaugaauuagcauaaaucauuguaacagaaauacauaauauacagcugauagauaccuuaguuagaaaagugcuugcuaccagccugaaguccuaaguuuagccgucccuccaaacucauauaaaaaaagcuuguaaacaacaauacaaacuaaccaguauccccagagcucgugucucuagcugcauauguaucagaagauggccuagucagacaucauuggaaagagaggccacuuggucuugcaaacuuuauaugccccaguacaggggaaugccagggccaagaagugggaguggguggguaggggagcaaggcggggggagggaacggggaacuuucaggauagcauuugaaauguaaauaaagaaaauaucuaauuuuuuuuuuccauuuuuuauuagguauuucgcucauuuacauuugcaaugcuauaccaaaagucccccauagccacccacccccucuccccuacccacccacuccccuuuuauggcccuggcguuccccuguacuggggcauauaaaguuugcguguccaaugggccucucuuuccagugauggccgacuaggccaucuuuugaugcauaugcagcuagagucaagagcuccgggguacugguuaguucauaauguuguuccaccuauaggguugcagaucccuuuagcuucuuugguacuuucucuagcuccuucauugggggccaugugauccauccaauagccgacugugagcauccacuucuauguuugcuaggcuuguaauuucaguguaaaagcuuguaauuucaguguugagauaugcagagacagguggauucuuggugcauccuggcuauguagccuguccuaauuggugagcuccaggccaauuaaaccuuguuuaaaaaaguacagugugggcuagagagauaucucagccgugaaaagcagagaacccagguucaguucccagcacccaaauggcagcucacaacuuucuauaacucuaauucuaggggacccagcucccucuucuggccucugaagguaccaggcugacacaugguguacauacauacaugcaggaaaagcuauuuuaaaguacaauuuuagaaaagauggauggcuccuaaggaagacaccuagguugaccccuaggguguguguguguguguguguguguguguguguguguguguguguguguguguguauuuauauuuauauauauauguauggguuuuauuuguuucuguuuuuguuuuuguuuguuuuggagacagagccuuguuggguagcuugcuguccuaggacuuacuguauagcucagguuggccuagaacaugaacuaauccaauugucacagucuuccaagggcugggauuugaggccugaaucacuaugccuggcucaaagguauuuuaaaaauaauuuuauuaucaaaauaguagaugaauguucuacguaguuuggaaaaugaagaugaacacaagaggaugcagaugaucagguaucucacaacccagaagcaggcacugagcauuaacauuuugguguuuaauacccuccccccccccccagcaucucaccaaucaccguaaggaccagucaucagaucuuaaacuaggucacaggggcuugacagucuguguaaucacaugaugcugucguccaucucuacaaaagccuggcagcacagccgugcugguuacaucccauacaugaacacugucuggugcucuauucuuuuaaaguuaaagaaaggugguaacgaaacagaauccaaacuguauucaugauagauauuucucuccaguggaaaauuaccagacaugaaguucccauuaaguaaugugugcuuucuguuuuguuuugaaaggaauucccaccagaguugauugguucccuugagaggcaucuccagauggguuggacaacaucugauuuuacuuucuguccucagauuugagagucauugaagcgacuaucccauaauguguugcuaacagaauggauguggcuauacagucuggauuuuauuguaauacauuuuacugcauugaacuuaguuguaacuguugaaagugucgauuagaucuugguuuucuuagggucuuugaauuacuugacuugggaagauaauuguagaucucauuuuaguaagaaaagaacaauagauauacuugauagcuaggccagcuuggugaucccuaggacaucagauagaagaaggcaggggacuuuguugccuuggucuuguggcuggccccuuucugacaaacuggaauuaauuuccagggaaagaaagcagaaacccuuuuagcagaaaaccaaagagugucguuucuagccauuucuguuggcacuuuggguuuguuguuagucauguuugggguggugggccuccagaaaaauggcaaauguuguuauucuucuugacuuaaacaggaaguguuuuaaauggcggugacaauuccucucccaguuuuauggggacugggcuggugguggcauuggacagcacuggguagauuucuuucacacagaugcaggauucagaagcuuccaaccugacuggaaccuucuuagcaaauggcagaaacccauuaagagaaacccuugauggcuuuuguaucuguccuucuggacuggguagagaccucagccugaccuuuaggcagcuacaaauguuaagucuugacauugagguggcagccagcccaagcauugccaaagggucccaguggcccaggcuggaugagagcagggagcuggaauguggccuuggcuggaguucugagugcaugagagcaccugccacuauuuugagaagcaugugguguccagagagagguaucagucagguggcaucucagaaaggggucugguccgucucacagcacuugacagcucuaugcugucagcuguccacagauucccaguuuaucuuugggguggagcugaaaaaaagaccuuaauccagagcaaagacauuuaugugucauuugggaaggaaagaucccagaacaugaaaucuaccaguaugagguuaaccauucugguuuguuucugaagagaaguuuuuaaagguuuuguggucaguuuguuugcuuguuuuaagaucaaaauccauugcuaaaggaauucuugacuuuccuggacaaucagcuaauuucucacuuauauuuuguuccugacaguuugaacauuagcauucagaggaguucuaaaaaacuugcuuggaccuugaaagggagaagcauaacaagagaucgggccgauuuacaucuuaucuugaagaaaguucuuuauguauauuagucauuauuuuguauguauuuuucugaugaauuacuaguguuugugugugugcucauauuaaugguagcauauauuauugcugggcugccucuugcagaagcaaaugugauuacaugaaauugugacuugaauggaucaugcuucagaauuguuccucaauauuuucuacuuccacuagacauuuaauguaacacaugaauaguuggccucaugcuggaauguuuggcagcugagcaaaagucucaaaugugcucagaagauauauuuuuuuuuuccacagaauggaauguugcaacauguaguuagccauuuggcuuuguuuuugaagaggacuuuauuuuuuccccaaauauuaacaauuagggaucaaugcucaacuuuuacaagauguauuauuauguucaacuuuucuuucuugguaguaguaauggagcacguuaaaaacuagaauuaucuucuagacuacacccaguuaauaguguuuguuacaaggacaggcaggguccaccugccuagggcuaagcagcagagguccaaugucuuucuuuugauauggucuuucuuuuccguguuugcuccuuccuuauaguuggagagucuucaguuucugugagcaaaugcagaguauuucuucuaacaucaagcaacauucuaguauuuguugggcgggcaguaugaguuguauauuuggacuaagcugcauccacacagaggguggccugaguuuuuuuuccuagcaaggcuuuguucagagugaguugauagggauaaauggcaguguguggugaaauguagcagugcguuacccagugugucuuuagcgaugaaugggaugugacuccagcagggccggagagaagacauuggaauguguuggagcacugacaaaaagauugggcacaagcuguguggcaggcacuaaugcaacuuaggccugccuuaaaauagcuguagguuaacacauggucuugaaaguuaucguuugacuugagcaaaauuguuuguguaaaugaacuaccaggaaguagaggugauugccuuucucuauauuuuagugguuugcuuuauguugagguggucuuuaagaguauaaguaggcaagugaggauucuaauuuuuucucuuuuaaacauuggugagcacuaagacuuuuuuaagcaguaaggcaucacauuccccacucagaacaucauucugauauucauuugggguucaguguaaguucagucucuuggacuaagcugccuccaugcaaauggugggaugcaugguuuuccugggcucauugguaguaccuucccauacauuucacuugugguucugcucccacacuuacccacuuacuacaaaugcugauuuauuuaugauuuaaauaaaaaucgggguucuagcacuuuagauauuuaauaaagggcauuggguaccaugcuguagagucuugcuuuuuuuuuuuuuuuuuuaguuuuaaugacauauucauugauaauuuguuugcaguacguaguacuggcuaguauuguauuauccugguuaguuucuuguuaacuugacccaagauaguauaauuugaguagugagaacuucaauuaauguaggccagcccaugaaguauuuuuugggggguuagugauugaugugaaaggguccagcccacugugucuagugguccugggauauaagaaagcaaacacguucuauguuauauuaauuuugcaacuguguucuuucaguucuuuccaguagaaagucauauuuuuaaagccaaacuaguaaaaacaagguaccuuagggaguuuucuuuacgauggguccuguacaggugugggccuuuugaugccauagugagagcgggaaggaucuauaaagagagaugggaacugcccucgggaaaaauccaaauagcagguuguuuggggagucugcagauaaaaugcuuuuuaaaaugcaguauuuacaacaucugucccaacacuggaaguaacugggaccagcaggacccaggcacccaggaauucugcccuaacaaguggcucguguucuuuccgguguggguugguguccugagcagaccuugggcucaaacuccgaagccagucccacaaaacccagaggaaguuccacucccaggcacucugacaugcccaagaucauaggaucccaggaucccaggagcuuggucacaccaggaucucagggucccagaggcagcuugacuuccaggagcucugacacacccaggaucucaggaucacagaauuauagaaucacagagacagcugaacucugaggaguucugagacaaccagaaucacaggaaggacaggcuccagucagauauaucgagggcagguagcacuagagauaaucagauagcaggaagcaagcauaagaauguaagcaacagaaaccaagguuacuuggcaucaucagaacccaaauuucccaccauagcaaguccuggauacaccaucacacuggaaaagcaagauucagaucuaaaaucacuucucaugaugaugauagaggauguuaaaaagaacauaaauaauucccuuaaagaaauauacaagaauacagguaaguagcuagaagcccuuaaagaggaaacacaaaaaucccuuaaugaauuacaggaaaacauaaucaaacaggcaaaggaaaugaacaaaaccauccaagaucuaaaaaauggaaauagaaacaauaaaaaaaucagaaagggagagaacucuggaguuagaaaaccuaggaaagagaucaggaaucacagaugcaagcaucaccaacagaauacaagagauagaagagauaaucucaggugcagaaaauaccauagaaaacacugacacaacagucaaagaaaaugcaaaaagcuccuaacccaaaacauccaggaaaucuaggacacaaugagaagaccaaaccucaggauaauagguaauagaagagagcaaagauucccaauuuaaaggaccaguaaauaucuucaacaaaauuguagaaguaaacuucccuaaccugaagaaagagaugcccacgaacauacaagaaaccuacagaacuccaaauagacuggaccagaaaagaaauuuuucccaucgcauaauaaucaaaacaccaaaugcacaaaacaaagaaagaauauuaaaagcaguaagggaaaaaggucagggaacauauaaaggcagaccuaucagaauuacaccagacuucucaccagagacuaugaaagcuagaagauccugggaagaugucauauagacccuaagagaacacaaaugccagcccaggcuauuauacccugcaaaacucucaauugccauagacaaagaaaacaagauauuccaugacagaaccaaauuuacacaauaucuuuccacaaauccagcccuacaagggauaauagauggaaaacuccaacucaaggauggaaacuacacccuagaaaaagcaagaaaguaaucuuugaacaaaccuaaaagaagauagucacacaaauauaauuccaccucuagcaacaaaaauaaugggaaguaacaaucacuuucccuuaauaucucuuaacaucaauggacucuauuccucaauaaaaagacauagacgacuaacagacuggauauguaaacaggacccaacaucuugcugcauacagaaaacccaccucagugacaaagacagacacuaccucagaguaaaagguuggaaaacaauuuuccaagcaaauggucccaagaaacaagcuggaguagccacucuaauaacgaauaaaaucaacuuuuaaccaaaaguuaucaaaaaaagauaaggaaggacacuuuauacucagcaagaaaaaaaucuaccaagaagaacucccaguucugaacaucuaugcuccaaaugcaagggcacccacaucauagaagaaacuuuacuaaaacucaaagcacaaauugcaccccacacaauaauagugggagacuucaaaaccccacucucagcauagacagaucauggaaacagaaacuaaacagagacacaaugaaacgagcaggaguuaugaaccaaauggaucuaacauauuuauagaacauuucauccuaaagcaaagggaguaugccuacuucucagcaccucacaguaccuucuccaaaauugacuguauaauugcuuacaaaacaggccucaacaaauacaagaagauugaaauaaucccaugcacccuaucagaucaccacagaauaaggcuggucuuaaauaccaacaaaaacaagggaaagaacacauacacauggaagcugagcaacucucuacucaaggauaacuuggucaaugaaaaauuaaagaaauuaaagacuuuagaauuuaaugaaaaugaagacacaucauaccaaaauuuaugggacacaaugaaagcaguaagaggaaaacucauagcucugagugcuuccaaaaagaaacuggagagagcucacacuagaagauugacagcacaccugaaagcucuagaacaaaaagaagcaaauacacuauagaagaguagacagcaggaaauaaucaaacucagggcugcaaucaaccgaguagaaacaacaacaacaaaaaacuauccaaagaaucaaccaaaccgggagcuaguucuuugagaaaaucaacaagauagauaaacccuuagccagacuaaccagaggacacagagacauuauccaaauuaauaaaaucagaaaugaaaggggaaacacaacaaagaaauacaucuuaauuauucuguuuguugaauauuaacaguugaaaauauuaaaaucauauucuacaaacaacaaaaaaagaaaugugacauauaauaccuauuaacuucugguuauuuuaggauguauguuauaaucgcuauucaacuucaauaugaaguugagccuuggacuucacugaagaaaucauuuguuaauaaauucaagauggaaaugauuucagaagaaaaaaaugaucacaguccauuauguacauguaugaaaugucaugaugaaaccuauugacacaugcuuauaaaaaugaaaccuauuaauaaaugcuaauaaagauggaaaauauuuuuuaaaaaugcaaaauuuagugaauguagggagaaucagaacagggacuucuugugaaagcaauaaaugagcucugugggauuucagauaaagcaaacuccuaaauuuccuugaaauauauaagaugguauguguguguguguguguagaguuaaacauguaauagaaauuugauucuagguaaauuacaauuuuuaauuauaauuuuauagggaguuggaaucucuuacauauagcugcuuucucugugccuuuaaaguacucuaaaucuuguugcuuuuguuauuuucaguaucuuauguauauuccaaauauuccuuauuaaaaagcauucccacccuauguaacugacuuguacagaaauuuauuguuccuaauuauuacuccuuuuggucaauaaguugaauuuagauauacuuuuagaauagauaagcauauuuuuuuacaacaugggaauauggaagcagcuucuauauuuggggcugagugugugugguggugcuggucuuuguguguuugagacaaguagcucaaauagcuucauaugcuuugcauauguuuuugcuccuuuguuuuuaguuggaaaaugcauuuucucugguacuguugcaguuagaaagugaauggagcuuacugaugaccucgcuucuguugcuguguuuugucuuauucuugccuuccgguuuggaugauguccaaaguguccuuggaugauggcgaaugauuugugaugggaacuguaaucucuuacuuccauucacugaauauacuguuaucggaucaccucaggcccgcggcucccugcauucccuucaacccuacaagauaccccucgucuacuugcucuguaauagcauaagauauucuagagguaaaaacuguggaauuugcuugucuguguugggggucacagggaacaggcuuggaauguuccuugcccuuugugcagugugaaagcaaauggagcuacugaaaucugcaguuggcaguggcguggacaggugagggccacauggaagucaugccauggggaggcagagcaauaaguugguuuaugaaaugcaagccagucagauguucuuauguuucuucagcuguuaucagccagcuagaaauaaguggaacucguugggacgguaaucgacuuagaguagugccucagauaucuaugagagguguauauuacaacauuuuuuaaugcuagcuaauagcuaauagcuguugguaaauuaggggacaaacuaucacagacgcuauauaguguaguacuguagagugcuaacccugggccaugcugccugauguuggauucccagcuguacucaacugaacuuuguaaucuucauuaagccuuucugccucgguuacuauccugccuagguuuuauguuaacuugacacaaucuagauuuccucugagaggagggaaccucaauuaggaaauuggcuccauaagaucacguuauaggcaagccuguaaggcauuuuuuaaauuaaugauucauggugagggcccagcccauuauggauugugcugucccugggcaggugauccuguguuuuauaagaaagcaggugagcaaaccgugagaagcaagccaguaagcagcacccguccaugaccucucugcaucagcuucuuucuuuugguuccuuucuggauuugcuuaaauaauaaacaaggauauggaagaguaggcaaaauaugccauagcaucccaagucacuuuuggucaugguguuucauugcagcaauaguuaacuaaauuaauuaccuuucuuauacgaugguguaagacuuauacagaccagauaggauuguuguugggacaaauaaguuaauagaaguauuuagacuaagaccuuguuuagaaaugagaaccuuuuuaaaacaaaggggaaagcagaacauacaaugguuuaaguacuauguucucaacuauguagaaaauacaaaggaaaauaaauaagaacauauccgaugcuugggaccaagggaugagagaaauacuugggauuuuuguuuaucucuauuuuucucugcguucuaguauuuuauaacaaauauguaauuuuacagauugaaaaguaagcuuuuaaagugcccauaucucuugcaaacagaauguugacuguaagaggcucauacuccuucaaagcucaaggcuuuccacuuggugacagcuaauuuccuuuucauucggcgggcuuuuacaguccuacagacacuuucagaguaaugaaacucaaaaagguuuuaaaacuuuauguuuuucugcuaauuuagacuguuaguguagcagaaacaauucggacacagucauacgacuuccauuuguuuugguauuaggcaaauuaugaaauucaguaugaucuugaaccuguagaagagcuuugaaagggagagaugccagaucuucaucuacuggccaucacaguaucaagacagccugaaugcaucauuucccagggucuggcacauuaugaguacuuauuaaugauaucacuacccucaccgcccuaauguuuuucucugccacuaaagcuaugcaaagaaacuugaacacucuaaaauucgcuguuaagcaugccaaugucuucucuaaaccacaguggguucucuucugcuaucuucuuguccuccauauaucucucuauacaugugguuuuguugucacauccugcuaguaugccuuuuuauggaugcccaguccauugagacucaugucugugaagguggugacauggaacagcaaacaguaccagagucggaaacagacaggccgcauuagugcaguucuuacucaugccacauggcugucagaggauggcaggguuucuguuaucuguauucucagucagcaacucuugcugacagauguacaaaguuagacuacuuggucaaaacaaggcaugaacccagcccuucaaggagagcaggcagcaauaaaccuaaagaaacuggauauaugugugcuuuagaaacugcuaacaagaugugucaauaauacgauguaacugagcauuucccauuacguuccuugaaacacuagcuuuucaguauguuaacauucucauauauaaaaaggcuauuucauuagaaaauaauugugagugugggcugaauaaaauguaauguuucuugaaugaaggacuuuacagagacuguugcauuuuaacaggaagagucacauacaauguuuccuaaacuuaccugacauuggaauuauugguuauuuuaccauagccuauccuaggcauuaaguuuauaaaauauauacaauagucucuucucauauaaagcacaaguauuagaaauauauuuuaauauuacuugccuugggaagaaacuuugguuuugcuguuagaacaguugacuguuugaagagacuaauuuguucuauuacaaaauagacucuagacaggguuauuaaauugugggaaggcaaauaugggucaguacauauucaugugugugcagauacagaugcacauguguguaugugcuuguagaggccagaggcugauguuagguuucuuccuaaacuguuccuuauucuuuucggagcucacugauauagcuaggccagcuggucagcaggcccaaggaucccuagcccugaaauuauaaaugcaaacguccaugccugccucuuaggugggugucagggaucugaauucaagguccucaugcaggcauggcaaguacuuuaccaacugagccauuccccaguccccauguuaaugaaaacuuagucauaauugguuaugucuguauagccccccauuugaugguauuucuguucuaaacuuaccauugucaggaaaaagguaaacaaaaucaugacgaccaugauuauacuaggagaauuggauuuaacacuuagcccaacacauaauuuaaaugcuucuucuuuuuuuuuuuuuuuuuuuuguucucucugacuuuguaacaacuuuucuagaaauuuuaaaaugagggugcugauuagcugggaauacaacuuaaaauugucaagaaguuauuucuccaccaagaaguuuuggauuuuauguuuguauaaauaagaaaucucagugggaguuuucacuauguggcuauaaaccucacguaauaaaauuauauuuauaaguaguucugccugauuuguaaauuugccugagcaaaaccaaguaaucaccaacucuguagaccuuugaccuugugccaccccuccccccuuuccuucuaaccauaaauucaauaucugcuagaaauuauauacaaucuagacugagaauucagguguuuugcuuuguuuuuuucccuugagaguagagacggagggugggcaauugcuguuucuugaccacaagaacaucuuuagcucucccaguuaacucaccuuucuuccaaauuuuuuucuuccguuuuccauggaagugugaauaucucaucuucaaaggcagcagaggaaaccuugagagccacaguuccuagucuuguccuuuuuguugauuuuaguauugcaggaaaaaugugacacuccacaaaauccagcauuaaagaacauguuuuaccugaccuaggcuaaaguuuacaagugaaggaaacacgugagaacacucuuuuuuuugcuacagaacuggucagaaucauguuuuccaggggaggggggggguagaauuuuguucagugaaaaaauugugucugcugcugugugugugugugcaugugucugucugucugucugucuaucugucucugugugucuguguauguaugcauuuggagaccagaagucgaccuuaggugucuuucuuaauagacuguccacuuuaauuuuuuagguagggucucauauugaaccuggagcucacugacuggcuaggcuaacuggcaaggaacagcuucugggauccucaugcuguucuccucgcacaguaauaauggcacacaggcugcugcacugcacucuuuauagaggugcuggggauugaauucaggccuucaugccuguacuucaagcacuuugcugauggagccacuuuuccagcccagcuuguuugacuuuuguuucagggacuuauguguaacacaagcuauccucagacucauaggucuccugcuuuggcaccuucacccugugguguuggcaucaucagcaugacuaauguaggcauguugauggagaguuauuuccucacuuuuaagaccuugggaugagguuucuucaugacuguccuauggaucagcuggaauauuaacuguuaggacguucuguggaagacuagcauuuuucucagugcaagcugcagaucaaggucaaaaaagaauuguagggaagacauagaaguggaaauucaagggguaggcaucauccuguagauguuaaucugcccaugccauuguaucaaggagaaaagcucaaggcagcugaagucucauagccuaacacaguguaagggcuacaagucaauguccuucaucaaugggaggagaggcccuugguccugugaaggcucuaugccccaguguagcagaaugccagggccaggaagcaggaguggguggguuggugagcaggggauguggggaggggauaggggaugagauuuuuggaggggaaacuaggaauaggguuaacauuugaaauguaaauaaagaaaauauccaauaaaaaaaaguuaguguccuaugacugcuacagugcuggcucugauaggcaugucccucgacuuguuagggccacuuguguuacguuuuaaaauuaaauagauggggugagccuccuaagugugcucaugucuucugcuuccaugccauuaagucaguguuaaugguuaagcauuacuaacugugccaaaacaauaccaaaggcaagagaagcccaagagaauggcauggacaaauggcugagcaauugaaagcacugauugcucuuccagaggaagccgaguucauucccagcacuucccuggcagcccacguguauguguauaauauacacacacauguaacgcacaugcccgcgugcguguguacacacacacacacacacacacacgcacgcacaucggggcgggggaggagagcccguuauaucugaaaguuaaagcacaagcagcauaugaugcuuuuaucuuacagacaguaacagauaacucuggacuggcuuuccaggccaggcugaagggagaugaaggucauuccauauuaggaaaguggcuaguuaaguuuuauguugauauaauggggguguuuauuacuuuucagcucuguguuugaguggagacugaugggggaauugccucuguccaaaggagauaagaaggcagcccugagaaguaggacucuugagagcugccacuaauugggaucaguuuaacauauaggaugugcuagugaagacagaguggacccuguaccccuuguaacccaccuugcucaguggacagcaaauauuagagaauuacaguauuagaggaguguaucacagcagcuguauucuuacugaagccacacuggccacucugcuuugugguaaggccuuuaguaguaacuguguaaccagcugaauaacuaacauggggaacacuggaccagaacagguaaacuaagacugucuuagacaaacuauguuguguggacauccuaguuucaacaaguugucugaucuuggugucuugguguuuccacaucuuaaaacaagccuaauaacagauaaaguacaaaaaauacauguaaaguccucaggauguucuuuggccuauuauaauacuuauuauuauuauaguuguauaauuuagccccccucacccuacaccaccugcagcagucagaagagcuggcccuggcccagccaugggguggcauggguaugggggugauacccuauugcuuaccccuugucaccuucuguaguugggagaguuggcccugagggcaugagaguagaaaagcaaucucugcuccucuauugacuauacaauucaggagagcuucccuauacacuugcccaggcaauacagcaaaggcaagaugagccaaccccaggaugugagagcaggagagcugguccagccccucacaggcuacagcaauggacagagcagcacaguggagcugacacuggaggcaugggugugggugagccauccucgaggacgugauagcaggaagguugccccugcauccugcugauggcaacguugagugcccuagucagagcagugcuggagaguuuacucuggagguguggacgagggagagccaugcacuaaccaucucugcuacuaugcaggcccagauccagggcucugagaugacccacuucaaaaucuguaucaucuacagaugguuuggacauguaaaagggccaguccugcugauccaaagcuucaggaucuccaugacagggaaacaacaggauaaccagcaggaguccacaugaagaucuaggauugauggugucacagaagccagagaucuugaacccgaccaauaacucacugugauagugaugaacauuugcaagugaagauguguggacagaaggauauacugugggacacacugccgcuuccaugaugcgaugucuucuaugcuuuagcuuuguugugcuuauuuguuaguguguuauuuuauuuggggagaagguugcaagggugaggaacagauaagaggggcauggagaugagugggacuggggugcaugaugugagacucacaaagaaucaauaagagauuaaagauuaagucugaaaagcagauuuuagcuacuguagaacuuacuacuuaagacgugucacauaacagaauucuguauuguuuguuccuguugucuuuguuauuuuuccaaaacaaauuuuuguuucuaauuuuguugaauaauaacaucuaccaaucaguuacuucuuucauucaugacacuuacuccaacuuaacguuuuugaugaguccuuauucaggaaaguaaaaaauguaguuugucaguugcuuguguauuuggcacuuagguauauaauuagcacaugugguauacagaagccuaggcacucauuuaucagguagcaguaguuaauuaguuucugcagacccuaagauaauggaaugguugggugggggaguagguggggacagaagagugaguccuccuccucucagucuuucaccucccagcauagggauguguggaguugcaaacagggaaaucaaaacugaaacagaacagaaaacccauaaugcuugguuacauuugaaugucagauaaauaacaucuuuuaaaguauuucucauacagauuuuagagcuuauauugaaguuuauuucuaaaaucuaagaccaguuuuaauugauguccagucuuuaucugagaaucuggguuauguaggccaaagcuuuugcccuaucccucauaaugcaaauugaguguaggcuggaucccauugugagugucauuuuaaccuguuaaacgucuggauucugccgccuuuagaggugagcaguugagagguuaauggugcugcugagugcccacucaggccaagauggacaggaacucagucugauugccauggcaacaggaauucuauuuguucuguaaggaauucuuucuuggcagugaguguaaauggccacagccagcuuucucuuagaggggggaguuggcugguugguugguuggugugccucacugaagcuccugccaacuccagaguuggguucugugauuggaugacugugcacaguaacugggggaagagaguauaacuuugggucacauuuacuucacuugucuccagagagucuuccugcucagcagugcuacguugaaaagcuuuuuguaucagccuuggaaugcugucaacagccgcccugaagagcauuacaugccguugggaaaugcuuauuggaagaggagaggcuguagaaaccugagugucuuugggugcuccuuacaucauguaugacaccucuauaagucaggguuucuagcagaagcuucacgcgguuaaggagccauuuggugacgucaguaauggcgaguggagcuugaagcagugccugcuggagaagagcgcaccagagcaggacuuuacaccaguaccugcuuuuuaauugcugccauucaagaaauugaauguguccauugaaaaggcacagacuuauccuuugaagaaaaauacagaaugauaguaguuuacaauuaggcacagcgauuguggaagauaaagagagaaauccaauuagagauguuuguucaaaauauuagauuuucgguguaccugguuguugaaaggugaugcuccugauagguaggcuuuggcuggugguaauuauaugaaaaaaaaaauccucucuuuuugucuuuucugagagguguuuuuuuuuuuuuuuuuuuuuuuuguccucauuaauuuccuuagaggccaagcacuuacuuuacuuuugacaggugagcaucugccaugcaucaaaaguugauuuacaucuuaggugcaguuguuuggcuuaauuguucauauguuaguuacccuguuugcauuuguauggcugcuacucaagauauguuugagguuuagaguaguaauucucaacuuagucuccuacuggugucacugaagaaccuuaaaaacucucugggggcuggagaaauggcucagugguuaagagcacugacugcucuuccuagaggcccugaguucaauucccagcaaccacaugguggcucacaaccaucuguaauuggaucugacgcccucuucuggugugucugaagaaacugacaguguacugacauauauaaaaaggaauaaaauauguuaacaaauauuaaaaaaaaaaccugucugggucacauuucccagaguacugauuucauuguccuacaacauaggcacagggacuuagaagagcucucuggguguuuccuuccaugcagugccagccuauagucuauccucuggucuguucucagaauuaaggccuaaccaguauuguccaguaggcuggccacaagccugagguuucuaauuauauuuaaauuaaaucaaacauaauaaaauuagauacucucuucuuggcauacuggcugccuuugaaaugcucaguagcccguuugaguuugaggcuccauauuagacagcacagauagacaguuuuacaucauagcaaaaguuuguguuagacagccuagauccaggaugaccauagaauguuggcagaacaugggaggagcugugaacauuugagaagucugacacaggaagggcaaacuuaaaauaaagcuaaucgaguagguuuugcuccacaucugaaaccaccauauauuuucuaagcagucuuuugcucagugaucuuuugggcagcagaagcccuagagcaguggguacuauagauuguguaucuaucucacggaaauuucccauugaaagccagcuggccugagaaguguggccagaaccuaauggcaggcaaauguaaacuuacgugggccauggcaauaagugacagagugcaucucaccugauucugcuguagaaagacccccuuugccuccuuuuacuccuaaacccacuucucauuaguuagugggaguuagauagagcuaacacauguuuccagaaaagugaacuuccacuguagaccccaucuuuugaggguccagggaggugaaagaaaaugagucacauuuguuuuuagacauaugacauaagauucaagcacacuuaaggcuaugaaaagguggagggucagaggaaaggggauguaguaaagcaggauuaucgaggcugugccuuccucaggcagguccucugguaagaaugagaggccuaccauggagaggcuguccugaggucauugguuuggccucaaggcucuuugcugggccuggcucacacuuguauuuuggacauuagcaccuccuuagaaacuguuucugugguuuuuccugagccuaccaaaaaaagaagccaacaaguguugauggaacagggaguaaguaggcagagcucugagaguagacaggucacaagcaugcauccaauggugccuacaagauugguggugucagguuuuguaaguaacgugugcuuuuuuuuuucuuucugguuugauuuugucugcugucauacuuuucgauugcugugauaagacacagugacuaagacaacuuuaaaaagaaauuguuuaauuuggccuuaugguuucaaaggguuaauuguccacaguggcagaacaaaggcuuagcagcaggaacagcugaggucucacuuguaaucugcaaguaggaggcagagagaaaacaaacacuaggaguagagagagccuucagaaacuuuggagccugccuccauccaggcuccacuuccuaauccuagcccuggcuugaauucacuauaccacucgggaugacguuugucucuugaucugcuugacuccagcuccccaagugccauuagacgugguucuaugugcugcuggagaucagauccaggguaucaugugugcugaggaacaacuuguccaacuaugcugcagugcuacuuugucagucccaacuguuccuccccuucccauugccagggauuucugcuaacaagaacauguacuuggguccuuuacuauuuugaauuuugcccaucucucuugcuuuuauucugccaggcuuuaaacucuuccaucaagcuccgaaagcuagguaagaacaggaacuucugcaagcaggaacauggaaggugguuaggacagaaguucaaguucaggugauucugguaagcagccgaguugagaaccacuggccuuauuaccacaccgcaucuuucacaugaagaaaccaaaaaccagggaggugagcugauuucuuuauggcuagaggaggccagagguaagaguagaccagcgacuuuccaaagucccuuguaccucugagcaacagccauucucugguuucaccuaaacugcuguggcaucugacucguauugcagucuccuuccuaaaaucccuuucuuuuauguuuauuuuuuauuuugggcagcaaguuguggucuucuguuucaccccagaaacuauuucuuggcucauuugaaaaggcgacaugucacagguccuguguggccacacagccuggauaugggaguugagggugauuuggacccuuuuucucagguuggaguugcugccuuuuucuccuccugcugguuucuuugugauuuaguuuauccucccucuaauuaaaauaauaauaauaacaauaaucaacaacuaucucuugacauauuuuggcugcgggauaaauccagaugguacauuucuauagaaaaaaguugggcaguggugucacacuccaaguacucgggaggcagagguaagcagaucucugaguucaagaccagucuggucuacagaccaaagguuucaagacagagggaguuucaaaacagcaagggcuaccggaagagaaacuuacuggaaagaaaaagaaaaaccaaucacacuuuuccuacuuuucuucuuuaaaaaaaaaaaaaaaagauuauuuauguauauaaguauacuguagcuucagacacaccagaagagggcauuagaucccauuacagaugguugugaaacaccauaugguugguugcugggaauugaacucagaagagcagucagcccgcuuaacagcugaaccaucuagcucccuuuuuucuuuucuauuuuugauuuucaaagacaaggcuucucuauauagcucugacuuuucuguaacucgcucuguagaccaggcugaccucaaacucagagauuuaccuaccccugccuccugagagcugggauuaaagguauaagccaccaugccaggcucuuuuaucuauuuucaaaucuuaaauuuuuuugagauuuaaaauuuauuuuuauuuuauguauaugaguguuugcugcaagaagaacucaacuuucaguuuuaaugaggcuauuaaucuuacagagagaggauuuaacucuguacauggaguaauaacaagcacauugcuaggcaacuucucaauucagugugacaaaaauuaagaguauuguuaccaugagaagcuagcacaacaauuuaaauuuucuauaaaaagcuaagaaagaaauuuuaaugcuugcuuuuggcaagagacuaaaaugauuguacuaugaaaaauauggcaauauggagauacaagcuguugauuauuagaaucuuaauuuugauuugugagcuguuuuaguuuuuuaguaccuuuaugaagauugaacauccaaaagucucugguugauauucuucugugaaauccagcugagugugaaguuauguuuugguuuugcagggcugaggauuaaacugagggccucacgcaugugcgacaaguaccuuaccaccgagccucccuucacucuguagccccucagcaggguuuuuauuaguugcaccuuucaggauaaaggagaggaucuaugaaaacgaauacagacccaaaauauauucaaauucuagcuguauuccuagagcauacaagaauccuugaagauuuauagaaccacucuuaagagucugaucaguuuucuuggguuaauaauuggaggaaggaaaacaaauguuauagagguuuuauaaaaaguuuuucauugggggauuaacaagggagacuaaauuuagggucucaugcaugcuaugugugaguguccuaccacugagauacaucuaagcccucuuuucgcuuuuuauuuugaaguaggaucucuuaaaauugcccaagcagggcuugaauucccgugaauguguuuuguugcacuaaguugaccaccuuggcuguuuuguaaaagauaggugagagaccucaguuagaauguuaagcacauccugggaauuuguuaguucuggggcacaauccuuggcguguugacacagugagcuuaucuagguagaaaauggaaagauggguagcuaaugaagggagaggaggcuugcccuuacucuccagaaugacuguuagcuggguagauggaaaaaaaauggucaugaagugaggcaaugagaacacuguuucucugaggacuguucuguuacggaagagcagagaaagcugaagaacgaguaagcugagguaaggcaaaaagccuccuacucaaaagauggaggaggucauuggaagcuuuuaguuuaguucucuaugucuuucgagaccuguucaagggcuggaaagggggcucagugguuaaguaacugggccucuuccagaggguuugucucugaaccaaguuuagcagcucauaaccgucuguaacuccaguaccaggggaucugaugcccucuucuggccucuauggguaccaggcaucaagcagugcauagcaguacaugcacaaaauagccacacacauaaaaacaauaauaaaaauaaaauacacauauuuaaaagcuccacuuaagcuacaugacgaagaggaugaguguuucaauagcuuaaaauucuaaguagagaaacuaguagguauauguggcaacaauucagucaagaaauggcacggagggagguggaucacaccuuuaaucccaacaaggccagccugguugacauagucauauucugucuaaaaaaaaaaaaaaccaggcaugguggcaaacacauuuaaacccagaaguugggaaguggaagcaggaagaucucugugaauuccaggaaagccagggcuauauacaaagacauugucucucuauaaaacaaaacaaaaguauacaaaacaaaacccuuuaagaggcuauuucugauucauuuaaguacuuuucuucuucuuauagauauauaugaaaugugaguguguauguauauauauauauauauguguguguguguguguguguguauucauuccauguguauagagaaugaagaucacagcaacagaaagcagaucuuaguuauguguagacagaaggaauauacugauuacuuguuuuucauuuguuagguuuuuuuuuuuuggcuuuguaauugugguggcuauuucugagguauguguguaugugaaagcuuaagcuguauaauguacaauauagucuauguuaguuauaccauaauaaagcuuuguuuccuagagaaugcucagacaagcccccucuccacuugccuaccucuccugacucuauuguaucccacacaaccugcuuaaagucaagaacaagggcaggaguaugucagcagcugccauccuaugaggccugccaggguaagugcagggacugaagugugcagucagaaaugcucaaagaaguuagcuuguaugggcauaagagggacgcuugcgugagcauuuaugugagcaugcagggaggcuugugugaguaugaggggagacuugugugagccugaggggaggguugugugaaccugaggggaggcuugugggagcaugaggggaggcuugugugagcaugaggcggaggacacagcuguugacaugcugagccuagagacauuggggauuugucgcaggagaugggacucaugugaucagccuacacuucaggguucuguuuugaaagcuucaggucagcauggaugggugauaagcacucaaggcucuuaucucuaggagaaugagcaaucagucaggaauuugggguucagagcucaaggacuccucagggaugcuaguccuccaucugucuagaauauuccuguuuuggaaaaccuuguuaucuaagacaggucuguugugccagaguauugguguguccaagaaacuggauacccuguuggaaucuuaacugcauaaaugcuuaaaauuuuucauuucauauaaaacuucuuuauagaagaaacuaaaaauauauauauaguuuaaaaauaaggaauuuuaaauggucuucaauuccaccaccgaguauuagcuacuuuuaauguucuuacauguaauauuucauauuaagugcauauuuuaaaagaaaaguaaaaucauaagguucauacuuuacuucuuauuucuuaacuuuuuauugauucuuugugaauuucauaucaugcaccccaaucucacucaucuccuguccccccguauuggacuugugcuguugcaaucuuccucaaaaaauaaaauaacaauaaacacacacacauacaaaccaucucacagaagaagcuguggugugucaaugucacacaggauaccuauugccuaaacaguuacuugcagauguucauuucauugagucauuggugugguacaaggccucuggguucugcuaccauaucaauacuggauccucacggggauuccuuucugauguccuguuguugcccugugacaugaaggucuuguaguuuuggaucuguagccccagcaguucacagauggcauagauguuggggugggccaacucaaagcccuggaugauggugaguuguucagcucaccagcucucuccuacaccugcuccaucagggugagcuccccugcuuugcccaggcaggagugaggucagcuauccugcuuagggcagcuggcaaggggugggucuggcucucccaccaggauaccaggcccaacucuacuaugcuaaccagguaaggugcagggccugcucucccaaguguuguagccagugagggguggggccaucucucauacccucacacccucaaggccagcucucccaagcugcccaaguaagcagugaggcuagcucuccugagugccacagccaguggagccaacucugcagggccaacucagcccucagacauuaagauggcaccaggagacagcccagaccuggaacaucugcaugaccuuuggugguaacaugggcuauggacauuaaaaagaccucugcuacuucagagcccucagcagcagcacagacuacucacaucaggcuguucaucuccacccuuaaguuccucauuccuccucucgucauaguguaccauugugccucuuguucucuucucaacucuccaccucauacuugcucaucauagcagcaaccaccuacacacugccacacagcaguggacaugccuuuggguuccaagcaugugugccugcugucuugugguggauaguaugucucuggugucuuuagcauguccccugccaccuggcagcaagcugucucucuuguaacuuccuuucuuuuucuuuuucauuuuuuggcuauuuuuucuauugauuuauuuauacauuuuacaccccgauuacugcccaccccuaucccccucacaaagccccaucacucuucccuuacucuuccuacuuuaucugagccuuuugugccaugucuuauggggacauagaguauauugcuuuuaguuuacauauuggauaucuugugauuccuuuaauuaaaaucccuuuugggauuuggugggugaguugguugguuuuuguuuuguuuguuugguuuuugguuugguuuguuguaauuguuguuguuuucuaaagugucugggaaaauaaauuacuuuuuauuaauaaucaaaauaauuuguagcuaauuaagaaugguauugagguauauaauuucucaauuuauauuacauaaaaauggccuugaucuaguagaccuuucaaccaaaggaaaaggaaauaguuccuuugaaaagucaacauacagugguguuauugagugaucauuacaugacuucauuugugguaggcacaaaaauacacuaucauugugaauuggauuguauaaaucacaguaauagcaaacauuuuuaaagcuuuuguguuccauauauuguuagauguauguccauguguacagauugcuaguaggacauucuguuucuguaguguaauaaauuucugacagaguggugcugaugcaggccuuuaaacacacugguuagaaggcagaggcagaagcaggcggaucucuaugaguucaaggucagccuggucuacaaagugaguuccaggacagccaggacuacacaauuaaacccugucuugaaccaccccuccuccaaaagaagauaacuggagaauguuuuaguaauaccauauucacaaaaauacuguuguacauaguaagcagauauguguccuguagcagagauuugguuaaauaaauuauaacauauuuguagauauccucagaauguuacacaacuauaaaugaugguuuggccuguguuucugaaaauaauuguucagaagauaagauggggacaaacauacaguguggaauaaaggucugacaccugugugugcuccgugcuccuugcugagcacauccucuugaacacgcucguuuggugcuccuugcugcuagucuugagcccuucaggacgaacccagcauguuugcuucccuccacuguccuguggccaaagugaaaacucauccacugcuggcaaaucagguagauagcccauccauugugggucugugaaguacagugagguaccuuggcagucauugucacagaaugccucaacaggaggggagggaauuuuuucauuuuguuacagauaugugcugauuucauuuaacaggugcaacaagaaaauacagcccuagccugaaaaugaagcguccaggaagcuucuucgcucaguuuaucagagggguucuucuuccuacucauuagccugcuucuucaugcuaagggguggcuucuuccugggucuccuuucucucugguaauagaggcuggucauuuagauuuggauuuuauagugagccuaguguguugcucuuggaguaacugaacuuugacagcugccuuuuccucaagggaacaacuuacuuguuuguggaucauaggagucacacccuuuacuacuagccugcaacggcaccuuacucugagucccuucuucaugccauacaaugaaagaccaccuaauaccaccuaaaaaacguuccuuguguuauaggaagaacuuuguguggaacauuucuuacauuuugaaauacugcuaucaacaucuugagggugggggcuuuucguuagagucccaucugaaaugccuacuuaagcuuaagcuuaaguacaccaagaagauggggauuucaguguaugggaccaaauccaaaugaagaugcagcaagaaggugggcaaaguuuggccucaaggguggcuuucugcaccucugggcucuugagccaucuuguccuguagagugcccguggauuagaaguggcgucugaguacauauggcuggugggguugaaaagcugaauuuuaaaauuuauuuuaauuuuacuuaauuagcugcccaggacaugucaugaccauuuuguacaguauaagauagacuuagaagcuagaccaacugggcuuaaaucuggaguccauggucuuuugucuguuguccccuugggccaguucuuccuucagguuggcuugcuccuuccccuuggugcuuugcaguuggguuccucaggagaucgcugcucugugcacugucaucuucaguuugaucuacuguuggaaauauucauuucaugguguuucacuuaauuuuuauucuuuaaauaaaagcugagaagccaaguuggucccuccauuuauguuuaauuuuuacugauucaugagauugaaaagucugugcuuagaucaucuaucgccaucuggcuuauauaaaccuugaaaggacugauaaucaugggauucuaugagaacaagaagcuucggauccauaaauggcuugacgggaaguaaacacagaagagagguagcugcuuauuugugucucgauuuacuucagcaauugcuaaaugcaaggagagagagagagagagagagagagagagagagagagagagagagagagagagagaaagagagagagagagagagagagagagagagagagagagagagagagagagagagagagagagaagcucaaucugcuucuacaccugaaaaauguuaaaacauuauuuugguccagcaucugauauaagaaaaauuguuccacagauaagucucaaaaugguguucuaaaagcacaacauuugcaauuaucuaauuaaauuaauaaaggcugaugguaauagacuagauauggaagguauuuuucuggcagauggagaaaccuucccaucugaaccugauuaugagcccccucuugcugcuuggcucucccucuuccuugagcccacauuucucacuaggagcuaagaguguauaauaauaauaaagccuuggcuggcagccaguggagagauuuggcuaaccuuuccaguguuugugaaaguagaaaaagcaaugcagcuguuagacuggguccuuuccaguggaggacauguuuccuagaugaaggcacaaaugguaauugaaauguaaucgguauuucugccaucuugcuauuauaaugcuuucuacuuucguuaugauaauuguucauuucuuaggauuuguuuuuguuuuucucuagucuauaaucuacuaaagugagggaaugaaaugaaaguuuuaggcuuuuuucauuuuuuuuaaugacuaaguaguuacauuuguuggcugaaggcuuaucuuaaauagcuacacaauuaugauuaagauaccuuacuguaagacucggguuucaggcagcagaaaaagagaucuaagucagagugccugaauucuaaaacugguuggaggauucuagaauaggcuccauauucguuguacucccacuguucagguugaggcugcuagagauaaacuuguuuugcucagugcagagguggaugugugcagguaauuucuaaaccacugaccccacuggugcuugagaugugcugucagaaugcagugaccauccuaggccuuuauacagagcaagagugaggugaugggcagcuaagugucuuggucuauauccccugcuagagcugacuugaaaauggucuguuuccagaaggguucguuggugacuucucaggaggccuguagaguacgcacugcaaagauucauguugagcagccacagagagugggacuuugcuucccugguaaggaggcagacucacacccuguccucauccugucaggaaguucuguuuccccacaugagcuuacuacaagagguggagaaacucccuugguguucuuccccacuccucccuucuagaaacuaguaugucgaaguaguuaagauaguaccuuugguccuggguacuauuuauucugagauaagcaucucaaaauagcuggacuccucuacccauuguagaacccuuuuugcucccccuuuaggcaacaguacagauaauuuuggcaguguuuggcuuaacugaccauucccagcacuguaugaauugagguguuauccagagcagacuuaccuguucaacuuucuccuucauguuccuugguuuauugaugcuccuugauaguuugaucacauugauggcaauugguagcugagugucccuugcuggcauagaguaccaggguuacggccccaacuugacucuggggacucugggcaaagaaaagcauugaggaaggcucugaggaauggugggaagugagaacucuuuaacgcccucuuuagugaaacccuguuccuacuaccccacuucugucuucugaccccaggucucaucuccuccaacuucuggaagcugauggugaagguuuguuaggguugucagggaacaguacagaaccuaaggagugugucccacaaugcucaggugcaucccuuugugcucuggagauggucagaagggucuagauuugccugcaaaccccuccucuggaggauugccauauacagagaaggcugcuccugacacggcgccuguuucuggcaacagaagcagagaggagaugaaacagacuuccuacuauuuagaggaagagaaguauucaccuuggagaauguacugugggacuguguauacaugggugacagaucugcaggguuuucaccuagaaaaugauuaacacaguuaccccaucagacugaauguuaaugagaaaacugaauugccagaccaagggcaaacugccucucaagguuguuguuuccccauugcgcagugugcacugagaccauggggaagggcuuggcuacaucgcuguuaugcuguccuagaauuacucagaacucaggcuuguuggcucugccauuauagcaagagaagccucugugacauugcugccauguucucuguguuucaagggcauaggggagcuaaugugcccugccucuguagccgucccccuuccuaucacaggaauuaccuugguuugcuucgugaaugcuaagaucccaccacacccagacugaucuguuuuaaguuuuuuauaacuuacauuuggacaaauuuacaauuucauaaaaugaagaugcuuuucucugugauaguagaagauuucgugcagaaagcacucuaacacuuagugaagcugagaaacucaagcauucaauuuacucuuuaaauguuuacuaagggggcuggagagauggcucagcaguuuagaguacuggcugcaacuggauucuauuuccagcaccugcaaguuggcuggcaaccaucuguaacuccaguucuaggggcucugaugcccuucucuggccucugcaggcaacaggcauucuuuuuauuauuauuauuagauauuuuguucauuuacauuucaaauucuauccugaaaguccccuauacccuccccccaccccgcuccccaacccacacacuccugccuccuggcccuggcauucuccuguacuggggcauauaaucuuugcaagaccaagggcuucuccucccagugauagccgacuaggccaucuccugcuacauaugcaacuagagauacaagcucugggaggugcugguuaguucauauuguuguuccuccuauaggguugcagaccccuucagcuccuuggguacuuucuccagcuccuccauuggggucccugugcuccauccaguagaugacugugaacauccauuucuguauuugccaagcacuggcauagccucacaagagacagcuguaucagggcccugucagcaaaaucuugcucacauaugcaauagugucuggguuuaguggcuguuuaugggauggauccccggguagggcagucucuggauaguccuuccuucugucucagcuccaaacuuggucucuauaacuccuuccauggguauauuguuccccauucuaaggaggaacgaaguacccacacuuuggucuucuuucuucuugcguuucauguguuuugcagauuguaucuucaguauucuaaguuucugggcuaauaucaacuuauaaguaaguacauaucgugugaguucuuuugugauugaguuaccucacucaggaagauauccuucagauccauccauuugccuaagaauuuccuaaauuaauuguuucuguaaggcaaaagacacugucaauaagacaaaaaggccaccaacacauuggaaaaggaucuuuaccaauccuaaaucugauaggggacuaauauccaauauauacaaagaacucaagaagcuggacuccagaaaaucaaauaaccucauuaaaaaacgggguacagagcuaaauaaaaaaaaugggaauggguggguagggaaguagggggggaggguauggcggacuuuuaggauagcauuggaaauguaauugaggaaaauauguaauaaaaauauuuuuaaaaaaucuaauaaaaacucauaaaaaagaaaaaaacacagaaauaccuuaucuuaugcuucuacaauaagccauauuuucugaaagacacccuugcuuaugucuaaaaaaaaauaauaaaaaaauaaacuauucucacgagucaaaaaaaaaaaaaaagaaaaaagaaaagaauucucaacugaggaauacgaaaugacugagaagcaccugaaaaaauguucaacauccuuaaucaucagugaaaugcaaaucaaaacaacccugagauuccaccucacaccagucagaauggcuaagaucaaaaauucaggugacagcagaugcuggugaggauguggagaaagaggaacacuccuccauugcuggugggauugcaagcugguauauccauucuggaaaucagucuggugguuccucagaaaauuggauguaguacugcuggaagauccagcaauaccucuccugggcauuuacccagaagauguuucaacuuguaauaaggacccaugcuccacuauguucauagcagccuuauuuauaauagccagaagcuggaaagaacccagaugucccucaacagaggaauggauacagaaaauguggugcauuuacacaguguguauacaauguacauuuacacauuuacucaucuauuaaaagcaaggagcauucuugcauugcacauauauauguauauauauauaaacacucguacauauaaaauaaaccuaaaaaaauguuuaccucuguccuugguguguuaagugaucuauguauagugauucacugauggauaaaagaauuacccaggauucauaaagugugguauacaaggcaagauaauuacugaauaguuucacuaugggugagagaggauggacaagcauauguagcaggcuggggcuucagaagaguucuccagagaaaguucaggcugacuugguucucauugugugcuuucuuuaucuguaauagucuaagauacuaagaguuaauggugcuguugcuacugagauuccuuaaguuguaggauaguuagaaggacuuggauuggguucaguuuacagaaggcuccuuuagggcucacucugcauugguuuacugaagucacuauacagaauaccacucgguauaucacucaacggacagagauguacuuuugcuuaguucuacaagccuacaagugcaaaacucacaauacugucagagugaguucugaugacuuacugucuugaagauagucacuuucuuauugugucuccaccuguccuuuguguaugucuuuguguaugggauaagaugcagauagaggagaccacaguguccugcuaaggcccucuaguauaauaagccccauuuaacuugaaugcuugcccuccauguuccugacaugcaguuuaaccaugacugugagauaccauagcaacccaucuaguauuagcuggccagcccuuagauuuuucucugcauaaaucacagcaucuucucugcagacguccaggacccuccugucauccuguucacacuuuucucugcugcuggaaaaccagcugcuuugaaggcaucggaggggaaggaaaaacaaagagggagugauguagauauucagaaacaaucuuuucuauuaauaauacuucaaagacaugaaguuaugggcucaguuuuggucaggcagauagcggugacaugcagcugccaaaaucccauuacugaagagguuuugaagacauucagaaugaugucgaugucaggucacucucuccagagccuuugaccuuguugcugaggcagggcaaguuuuccauuucuuuuauuccuaaaccugauugaggucuucacuugauaagaacuuccuuucccuauuaaggucauuugagcaauagagugggagauaggcaaguuuaaaucacaugucccugccuguguggccauggacaggccuguguacccugugacauucugagaaauuagaugacacaucuucugguuggauuauggucuggucuuggggaaaacaaacuuaaaccaugucuagucaccuaccaaagaauccaguuagaagccuuccauaguccuaaaaguaugacaguauuuugggaccuuuguaagcagacuuuuaaacaguuauguacagaauuugauuguaucccauacugcauauauugguuuuuguugaacaauucuuuuagauugugaucauguuuaagcaauuguagaaacagaaguuuguuugugcuuaaauguuuuuucugggauugucauguucucucuuuugagugucauaggccagcuuccauguaauuuuuuuuguuaauuuacaagacuacagauuucuaccucaacuuggaaaacacucagcuagcacacagagggggaggcugagaaagugcuccgcucagcaguagguuguaugaguggcccuugaacaaagugaauacaguuuaaaccugaacauuugggcagccaauuguaccuagaacuuaagucauuuuguaaaggggaaauaaucuuauuuacaauaaaguauauauuuguaauaaauauuauaggcaaaucaaguaaaauuaguauuucuuuaguucuaccuaagaauagcccacccuacuuugagccgggugaaaauaaauuucucauaaaaauucauucuuugcuaaaugaaucugcauaaaggacaggcuguccccuuacacaauagcaguucauacugggguccaggauucauaugccuugggcagaaauaguauuuuuguguuuuauacuuagaagcuggguggcgacagucuuccaccugucauuucaucugagauuguuugugagcacuugcuaugguggggguagugguucuaugacaaugucuagaacagguaggaucccggaccucugugugugucagggacauuugauacacgguuguuguuuguggcaguuucgcaugcuuucauuugauauuuauuccagaaaauugaggugugcauuuuacuugaugaauuugcuccagaagaacaagcucccaaacagaguccacgcuguugaauaguguuacucugcuguucaggaaagcacagcucuggcucaccaagcuucagaacaaauaaagcacuuaaaugccuaacuugcugaagugcagggcuggcauuuuggcauuggcacuauauucugauguuauuuaaaacuguuugaaaguauauguaaggcagaaaauacuauaauggucagaaacacuacauugucugugaaccaugaugcuaggccuguucugaguuaaugauuucaguuuuaauuacucauuguaaguggagcagaaacaaagauagccuuuuaacuguuguguauauuaucauagcuaugcacuuuaaaaaaguuagucugguucgaauucagugacuuucaaggcugaugaaugacagaucagagaagcuaacucuuccuugucuuauuguuuucuuuucuuuuuucuuuuuuuguuuuguuuuguuuuuaguuuuuuguuuuuuucgagacaggguuucucuguguagcucuggcuguccuggaacucacucuguagaccaggcuggccucgaacucagaaauccaccugcaucugccucccaagugcugggauuaaaggcgugugccaccaugcccagcuuguuuacuuucaaaacagcugauuuaaaaaaaaaaaaagauuaggacuuagcaagauuauauuuaaaauguauauacuuaucacauauauaggcagagaaaaugaauaacagaaauagcaaaugaacuuaacucauacuuaauaucaagauuuuuauugaagaaacucaaauacuaaaugugcguaucauuucauuguuccuucuuuuguucucugugacauagaggaaggacagaggggagggaucccauucucuccuccuguauuuuuauagagcuuugcuuguggcuaugcuugugguuuuuaagugcuuuuaaauuuuuaauuuuaguucugugggugugccuauguguguaguguuuguggaaaucagaagaggaaguugaauucccuagaacuguguuucagacaguuguggacugcugauguuagugcuaggaacugaaccuaagguucaggaccagaaacuuccuguaauugcuggaccauuuucccaaccucaauaaguccuuaagcuaugaugacaagacuggcugaauguuuuaauauagaagugacuaagccacuggguuucuugcuggcaucuuuuuaaggguaauuucacuccuuauagaaccuggcugaauuugcuuaccuuaaaaaaaaaaaaaaaaacaagauuuguuucaaguaauaugcauaugccaauucccaguggcccuuuguaucugguaggaaagugaucucugaacauugggaaugaagguuuuugcaguugcuuucauuaggauauuguaggcagaggauggucaacccuucaguuguccuccguagcagacaguguagggaggagcagcccucuguugguuucuacaucacagacuguuguaugaaauucuaauuuuuugacaggaagcaguauguuccucaccuuccugucuucucaggcuuucuuucaagagcacauggaaguuuucuccuuagcuauuugucauuccuaucccccauucuguagucuuauagacauggcuuccauuauugcauuaccugccauauuucaauaucauacauguacugucuguguuuuugugcuuacacuagaugcuuacauagauuacauuagcauacauccacgaugaauguucaguccuucaggacagauaagaccucccauuucaaauauaugugcugggagaaauggccagacaagaugcugagcuaggcuguaauuauaccuuaauaagggccaguccacauccucauuuauuuaagauccucgaguuuuagguauaccucugauguggauagcuaaugaggguuguaccucagaagaaaagugaaggucauuuauuaaaauuugugguuuugcauugaacugaucacgggaucaccaauggaggaguuagagaaaggacugaaggagcugaagggguuugcaacuccaaaggaagaacaacaauaucaaccaaccagagcuccuaggguguaaaccaucaaccaaggaguacacuuggagggacccauggcuccagccauauauguagcagagaauggcccuguugggcaucaaugggagaagaggcccuugguucccugaaggcuccuugccccagaguaggggaaugcuaggguggagaggugggaguggguagguggguagggguacaccuucauagaugcaggaggaggggggaugagauaacauguuucugggggagggaaaucuggaaaggggauaacacuugaaauguaaauaaauaaaauauucaauuuuuuaaaauugggaauuugaauucaccgacugacaucugauucucaucuccauggcguccuauugucucuucaguguaaucaauagcaaaguccuauucaguaauuucuccuuuauuuuuugucuugcuuuguuuucugagacaggauuucucuauguagcccuggcuaucccgaaguucacuuuguagacuaggcuggccucgaacucagaaaugguuuuuugagacaggguuucucuguguagcccuggcuguccuggaacucacuuuguagaccaggcuggccuuggacucagaaauccgccugccucugccucccgaguugcugggauuaaaggugugcgccaccaugcccggccugaaauucacuucuuucuuaaugguuaugacauguagcagcccaugcugaaacucuagagcuuauuugauucauggaucuaggaauaacucauugggaaacuggagggcagcugguaccuggugaugggucagguuugugaagagguucagucacuugugagagcagggaagggguucaguaggagacuccggagccagaacaaaggaguaggcaccuaggcaggugcuacgggcucuggggccacaguguagcuuauccagcuuggucaguagauggcaccaaauagcuagaacuuccuuggugaaggguuugcccuguuuggguuucuccuugaguuggauuaaaucaacuuuucuauacuuugaaugauuauacuccaaggaguuaauaguauuguaaagguuuucuuuacuagagauaaaauauuccaagacagauuuuauaaaaggcugcgauguugcaguagucgugaaaauugaccaucuccaagguuacuagugugacuauauggcugguccuucccacgucuugcgcccaucccuguguuagaguugcuuaacuauaaggucauucagucaauagguuuuagcuguucauuugugguuuuguaaaaaccuguaaauauguuguuagcauaacuguuaaaugaguauaccaacacacuuguauuguuaggcuugauugcaucugucuggggggaauuucacuuccaggaaggaaugugauguuuaugcuguagugaaugaaugcaagagcagaugcuguggaucauuugucaguggauguggugcuauuuccucaagagcacauaggauauguugauggcuugugagagaacuauaaugguaaaagaggaggcaggggacguuuugggccacugauggugccagucaagacacaggugguucauuucagcauggagacccuauuguaguccuguauugcuggguggugaucuuauucuauuagcauacagaugcuaguaaugagcuaugcagacugaccccugugcacauucuuggugcacauugagugacaguugggccaagugagcauccauguacaaagcucuuacuauuaguuuuuuaaucuuaaugugagaagagagaaggagaggaaauaaccagcaccauuugccuugugaucuuucuaccaaugagacagaagcuaucuccaucauauucccuucuuagauuugcaguuaacuuacuuggauagcuuuguguaacugauugagccugagucccuguagugaaauugaacacauacaggaacuuaaccauagcaauagaauuaaccacagaaccuuagaaaugccauaggacuagccauauuguaccaagaugcauucaagagcccaaaaagaccaaccaggagcagacugccugggcuuacucaccacugacccacaggacgguuugcugaagcugcccugaacuuucaucugggcaagguuuuauaggaaauggcuagcaagggguggagguuucuauucuggcaagcaucugauuggggggcuguugcuguccguuaacauaauuggcuagugcuaggugucaaaccauaaacaacauucuuuucuccugauuuaugguuguuagaagugacguaucaagggcaggcuuguaaccuggagugcggauuuguuggagaauaaccaacuggugcuacacauaaguuuuguuggggaguaacuuggaaacuggugcuagacaccagccuguuaguuaaccagaguucagccuuaggucugguucuccaagauugagucugaauccaagccuuucauccaggccuuucuccaaguccugucagcaugccugacacauacccacgcacacuacuaccacauucacgucuacuacugccagugccaaaccacuuccaucguuggaguagccuccuagaaucuguuuccacauggcaccaagaacuauccuuuagaaucacauccaccaguggccgaugcugacucaaaggucaucaucagccaagucugaugagcuaugcaggggagcccugucuagcuccccuagccuugucucuccuuaccuuucccucugcacaccugacuccaacuauacugagcauaccuugguguaccuuugucuggugugccauucuucuugaucuggccaugaucuguaccuuuuagacaccgagaccuacacuaagcagaguauuuauuucugaccagucuaaaauagccaguuucaaauucaucuguuuguauuuuauuuuccuuaaacucucuggcuuuuguguguguguguuuuuggucucccuucuaugaggauguaacacuugugucauuuauuguucuccccaggaaucuagagcacugcugaucauguaguaauuccucaauaugguuggguucugcaugugaguaauagcuguauugaauggagaaacuguauuuaaaacuaaacauauuucucuugauccuccaagaauacauugauaaagugaagacuuuagugagccagagcuuauuucauaguuauuccuuaaaaaaaaaaaaacccaccauuauccucaagggcuuuaaaggagugggcauuacuauugguauugguccuagaauuuauaguaacaaugguauaaauaauuauaauaccuauugaguauuuacuaugcauggauacuaucuuuguugccauaugcuuccaucuuaaccuuaggcaucaauucuaauauguaaaugagacauagagacagaaugauuuguuaguuuuucuuauauaguagcuuaugaaggaaaaacuaaacgguaauagacaauaaaacuaagggaauucacuuaaaaagauccauguagaugcugauacagcccugauaaaacauuaaaccuucaccuuaaacuuuuuugguucauuuugcucuguuuugguuuuuuucaagacaugguuucucuguguagccauagcugucuuguacuccaggcuggccucagacacauagagaucagccugccucugccuccugaguacugggauuaaaggugugcaccaucacugcccagacacuuuaaacuccuuuaggaaagaacauuaauuuggcacccaguguuuccuucagucuucucccuccuccggguuuggggaaagcauuaaaguagcaugaccgaggucacacaugugcuaugaagcagagccaaaguucagaacuggccuuggcucuagaaggcacaucuggacaagcagugacuguccuaguuuuuccuuauuaucaccccagcagguguauagaggauguacacuuuguauacacaccugugcuuuuccuuuuuuacucacagaacucugaaaaguaacugauguggacaagcagcugagacagucaagaugacgaccacgguagccacagacuaugacaacauugagauccagcagcaguacagugaugugaacaaccgcugggauguggaugacugggacaaugagaacagcucugcaaggcucuuugagcgcucccgcaucaaggcccuggcagguaaguguccugauguuguaugucccaccugucaccagauguucuguagucccuugaacaucaaccauuucucuuuuaagcugucuugcuugaaguugaccucucccugcuuuaacauauccuaugagagcuugcuuacccuuuuauaagacauuuacuuuuggagagcugccgaacuuaaugaccaacauaguuuagaacacaguaaauaauguuuacagcaauuuagaaagagcugcuaagaguuuguaaggauuuuuuaauucuaacacaucuuuaauuucaaguguuuuaacauacuauauuuauauaaaauauccaacuuggcuguauacguaaugccaguggcagauuagcugaucuuuucggugagagguugguaaguaccuuguuacaagggcuuuagaucugaaaaguagcaguguccugugggaaggccauauuuaaugcuguuaaugaguagguuugccacugaucauucccauucaguuucauuuucuagagaaaaaccaugccagguagauguuaaguaguuauuccaauuauauucuaguuuacgauacaaagucuauuauaauaggugccuugauuauuaaauuguaaguuugucaguacuuuugacaugauucacaugaacuagaaacccacaagaaaguauucaggaaacaagggagcuaaacauuuauucugugucugcugauuggauucuuugaaaagaauccugaauucaugauuauuuuuagucaagucauuucuguuugccaagaauagagaugcauguacucugaauuaaagagauguguuugcuaguagaaaacacaguuguucaacauggacagagcccucauuucauccuugccauacaaaaacaaguaacagcagcagcaugugauagaauuaaaggagaauaaagggauuaucguaaaauaucagacaggggccaggugugguggccaugcuuuuaauccuagcacucaggaaacagaggcaggcagauguuugugaguuugaggccagccugguuuaccuagcaaguuuuaggccagcuaagauugaugugguaagacacugucucaaauaagagaaagagagauggauggagggagacagggaaaguggagguuggucucaugcaaagcaggcucaacaaagccaugugcuaacugcuauaggacaguaucucaguuauucuucauuuguuggagcccuccacuuaguaacugcgccuucauaauuugucuuacaccagacuugggugcaauguagauucaaugaaaccucagugcaaaauuauauuuauaauuuaauugacuuaauaacccaguuuccuuuuaguacaaauuucuguaagauugggugugguauugaaauucuguuuggcccagauauuuauauagcaggccauggcuagcuggagacuuacaaaugauugccuuuaaaagaggcagcuuaagacuggugcaauauugcccaccagcccucccaacccaaguuugaucccugggacccacauagugucaagagagaauugagucacaacaguuuuucuuugaccuccacaccaugccgugucaugugugcaaaucuuuccuucaaauuaaaaauaaauaaagacagacagacaggaaggaaggaagccagccagccagguagugaugugcauuucuuuaaucucagcacucaggugacagaggcaggucugaguuucagaccagccaggucuacagagugaguucuagaauggccagagcuacacagaaaaauccugacugacaaaaaaaaaaaaaaaagaucaaucagaaaaaauauauuugaagaaaauguagcagugcuacccagcggucugucugucuagaggugugguugguguguucagagcagauaauuuguagauuagagaaagaaggcuuuuauguuaacuuuuuaagggagauuagcauauucugcaugaagauaaaccaucugugaaaggaaacaaggugcaaauuggccccagaacaagagagacuuagguaaauaaacaagucucuuuuuagccuccuucugugagugccuuacccccuguaguggucuuccagauugcaggaagccugacugcuguaugcugagcgucauugcucaucccuucccuuuugccucuugucaaauucuaguuggaagcacugguguguugggauuggagggaggcuuugggcacugagcugugacugggcuauagcuauguuagaacacagagcccuuuggagauguucucugcaaaagcugguggcucucagggagauggcacuaaauggcacuaggcagcagaacagucaaguagaugcuuguuuucaacucagagauaacauuuuacaaaaugguaagauuacaauaaccauuaacuguuuuccuuuaagagaaaagaagcagaaguggauaccucucuuuaaaauccuggaaauucuugaagagaaaugaaccuuauacuguuaggccuuuaaaauaagccucuacugaagugcccaauacuagaacugcuccaggucugguuugguuuguucuuuacagugcugacauaaaaauccguguguuauuuaauaaggcaacaaaaacacuuaccacauaucaaaugaacagugggacuacguguggugguacaguggggccauacuuggugacacgcaucuuuaaucccaaugcuuagaguccgaggcaggcagaagucugugaguuugaggucagcuuggucuacaugguaaguucuaggauagccuaucucgagaaaacuaaaauaagaaaugaacagcaggcaccacguaugauggugcgugcuuguaaucccagcacuuguagggcugaggucugaggauuacuauugaaggccuacaugggcuucagaguaaaugccagguuaccaaggcugcaaaaacaaaaacaaaaacaaaaacaaaaacaaaacaaaaaaaaaaaacaaaacccugucuaaaaaagaaagcagggagaaaaagggggcugaaccacaaaccauagagcagaacacugaguauggcaacguuguauaaaggcgcuguaccuucugagauccugagcuacauacccucuggucaggaaaggcguccauuucuuucucauuaguacuguccaaggggaccgucuauguccuuaaaucugacuuguuugcugaaagccuguaaauucucagaaaucuaaaaccaugacaaaucaagugcugauacaugcuauugggugaaucugguaagaacuuugccacccagguuuaacuucucauagacuccuuagauuuuucgaguaugcaugugaaacugcucugucaccacagccaucuuaagaaaauggauggacuggagucugggagauguuggaaacuuugucaggucuuagccccucccuggacugcauguugcauguuggaucagccuguaaaucuuuaggaaaucccacugcucucuccugucuccagucuuaaccuauuaccaugaagcagagccauuuuucuguguaguucacgcugaacuuuucuuugauucaaucuccuuggucucuguuaaucuguauuauguauccuguggauuucuagacucaaguauuuguucaaaguaguucuauccauguuuuuuucucuagcugaugaaucaguucuuagagacaauggcaauagauaguauugcuuuuaccguuccuuuagcaccucauguaagucugaaugcagguaguuguugagcauuuggcaaacuaaauaauccguuccuagucagagcugcuaacuauugcuucauucgggaaaacugcucucuaacuuuugugauaccuaucaaacaguuaauuugauguguuugagacuuugacuuuaaaaugcacuaugcaauaauugcaguguacauuaugauugcacguacacacugaaacaaacccgaggauucugaaguggacaaugaguguuuucuuccucagacccuuucccacuccacucaaugaagagaauucuuuuaaaaguucugugaaaaccagacauaguuguauaugccuauaauccccugauagaacaggucaaggcaggaggacucagcaaguuugagccaguuuggucuuuauagucacucccaagcuaguuagaacuacauaaugggacuguuuuuaagaaagacccucuccccaaaacaaacaaacaaaagccaaauuggaugcaaaucuuuugagaauuguccauguacaugauuaaaaaggauauauacugaauaucuguaucuugcuuccuauucuuaggugaaacccuaguucccaauaugauaguguugauagguggaauugagggguaauuaaacugagggaggagccuuggggcugggacuuuuuaucuguucuuugaaaauacaagaagauauuuguuaagaaggagaaggccuucaccaagaacacagcugugcugggacccucacugagaacugagcaacaaauguguauugucugagggaucuggucagugguucacugccucagcaaccugaaccaacacaaauggcucccuugacuguagggaaaagagcagccucuggaguuuaauguuucucccaucauuuacuuggaucaguuaaacugugaggucagcagaggcuauuggaagcauuugucuauaagcauguauaguccauuacauugaagaucagauagguugccauguuggccucugccucuuuuuauguuaaaagugucuggcuuuugcacuugagguuaccacuggagaccuucgacuguuccuccauaaggcucccaucuuuuuacagccuucccaucuuugccucuuuaccuuucaaauuuccugaaagaaaaugcuucauggggggugggggggggcucacuaaggaacacucccccagaggcuaccugcucuuuaccuaucuuuucugcaugccuuauuagcaucuuagagguuugagauuuaauugauugauuuuucuugagaugggguuucauaacccugaaaugaacagagauaggccugccuacugcugcuucccaagugcuaggauuaaaggugugcaccucuacugucugucaugaguuuaagaauuuaaugguucauucuuacaaguguaguuacugucuuccucuuggaauucuccacugugacaaagacauuuggugacuauaggaaccaagcaugacagcaaugcaguguuguagcuggaucccuagaauaccucuuuuugcuacaguugaaaaaggccauuggcuacaagcagcuccagacuacaaucagaacagaguucuguugucacugauguuucagguacaguaugaauuaagccuuucccuuggggcugacaaccaucaccaccaccaccaccaccaccaccaccaucaccaccaccaccuaguaacuuccuaaguucauaguauaucagcuagccaccuuugcccacuggucagguuuuacuuuuguucucuaggcaggaaugugugaguaacaguuucauggguccugaaaauguuugugguacugaauuuggggaaacaauuuugcacacaaaaucacuuagcucucuaauuaucuacugucaacacacacaaguuuaugcccagaacugguugcucgacuggggauggcuuaugauuccauguucugcuaguuccuaagcacaccucucuuuggaacuauacucuggauccagacaucuaaaguacggccaguguuggcauggauacuuguaaauaaugcagaaguauucaagacugccuugagaaauacaggaugggaggggugguggagcuuaaggaugaccugauacuaaugugaaaccuaaaacccaacuccagugcuagcaggugugcaguucucuuugugcauuuaaucagcuguaaucuucaggcauucccaaguggagguguuuuuuaacuuuucccacucaggaagccaucuuaauuggcacacucaaacuaaauuuuacaauggaggaugaugguuuuuuuuuuucuaagcuaaaugaaggauuucagaguaaucaacaaugauuugguuaguaacuuucacuauuuugaaagaaacaauuuuugacuauauuaccaggaagaaguauguuuacauugguaaucucauugcuagauaaguguauuuuuuuggauauauauguguguguguguguguaccuaguucaaauuuaugaaguaguauuuacuaguacaucaugaacugcugugauauucuucuguucugcuuuuuaaaaugcuaguauugcuuggauaauuagauuuuauuaaugccauuaaacuauccuguucuaacagguacauuuuaaaggacagcaaaguggucuuuuuauuuguaagcuuugugaaucagaauguuagugguuuagucauuuauuagagaauggaaugaauggccuaauacucagugucugcuuucugacaggcacuaugguuagcauuagagaggcuggccaugagggcgagggagucuguggagagaggagcucugugcucacucaggagauacaaugucaauacaugggagaaaauuccaggcagagacaugaacagguuucacaagcagaaggagugggcagaaaagccaaagagcuuagugcuuauccuagaaggcugccucagcucagcagaguuuuuuguuuuuuuuuuuuuuuucaaauagaaaggaugcccuaguuguaacaaagggccucccugagauucccaccuucagagagccagagacccugagaguuaacuggagagcugcugcugagguccuggggacacugggauggcucccaguagugacagagagaagagagaggcugagggagagaaggcauuuaggaaacuguugugcuucucuagagggggacaguuccuuuuagauuuuacuaucacagugcuugaugcaacuccuggagugcagcagugucugguaaugagcccucucacccuggcauggaacgaucuuaggaaagcccaccuucaaaucuaaaauaguauuuggaggcacuucacuucucagucaguaacaggucuuaaacuguugaguuuggacccucagacuggcucuucaagggcuguggagggcacgagggagagaaggaccagggccuuggcucugcuuacaggcaccuaagcacacaagguguuaguuagcacaagagcguuuuuguggaguauucaggcaaauaaaucagcaaggaccacuguagggcuuugcucacaauuauuccaguuuuaggauuauaucucaucuuuaaauuugucuguacacuguauauagccuucagaaacuguacagacuuggagauucuucaucuaacugugccuuugggaaauucucuuauggccaaagcuuccaggccuuucuggguguggcaggcauccagaauuguucauuucuaggcggaugcuaagagagaauggccucagaguucugcuucugccuuacaucuccucccugccaauuacuguaagguaguggauaaacuucuacaggacaggaacacugucuugugggaucauuuugagaacucaagugccgccugccucugccucugagugcugggauuaaaggugugcacuagcaugccacacugaaaguaaaucuuguaaagagagagcucuguuucccuccucagggaggaguguuccauacugagaauauugccuuaaugcagguggcagaauaagaagucccugugggaaaccagaagcuuucaaagggcgcguguucugcuagccucuggugaccuuugcccuuguuugcaguggugcucagagggcauuugugacucaguccucauuccaggaacugcgaugaagcacaggaaaagaauuuuagguuggaauuuuuaaacauuuuguuuucuagcaguucugggcaguugagcccaggacuuguauagccuccuuaccaaugaggcacauacaucaagcuguauaccaugacuuuguuuuuuuaaugaaaacgaaucugugugaucgccauauuuggucuucucugauuggacuucuguuuuaggucuauaugcuauacuuagagugauccugcauguuccuaaauuugagagaaaacgauuugaggaaguauaacaaaaauacuuuaaaguuuugguacauugauuuuucucauucuaacccccaaccaaauaagugagguugagggagagggacauauccauguauaaaaacccuagucaagcaggcuaguucuugcuggaacaugcuggccucuggugggguaauuuagcucucaugugcauuccucuuuaugaccacagcugucgcuugguaucagaggaugauaaaaaaggaauaugagcaggcuuccaggauuauuuaucauacuuaaaacucgugggucacuaucaccuuggagaauauuuuagaauaaugcagaaguguuaauagcagucuuugauagggcuauuaauccuuauuuuacauacuccaaucaagauuuucuguggcugcuuuugugcgcucuaacauggguuaccagucguaagacucagaggcaaccaaaacccugggaccuuuacuugccuuuuccagcccucuuguaaguugccuuucuugguauuaauauuuuauacgucuccagauagccuuaauuucugagguaguuaaaccuuguaccucuccccacaauuguuaauuuaaaaaaauuaugaggaagguucugagauagcuuuuguagcucauuugggcaucuguaaugguugagcguauaaaaccuuucucaagagagcuaagcccugccacugcuuuaggaaagguuguacauugagaguuggcgcuuuccguguaucuucuuuuugugucugacugucaaacacagaagcaaagccaguuuaugggggguaaaggggcccuagcugaccuguuauuuaaaaaaaacaaacaaaaacauuuauuauaccauacaucugauagauaugacagaaugaauuguaagcuguggagggcugauguguuuaccugguaugcucaaggcccuggggucuacgugcuagcacuggggagaaaaacaaaaacaaacaaacagaaauaccaaugauuuuuggcaugagauaaccucaggaguuagcaagcuaacucuguucuguuaccaaggugacucccagcgucuucuacuguucuguguaacagugaggaguggauugugaguacauguugguaggugacaguagcaaccuuugcucuucaugagaauaaugaaauaagaaaugauuuaugaugcuuacucaagcucauggaaauuuuucuuuuuacuguuuuauguauggugagucagaaaugcaggcucuuuuagaguguuauuaacaagaacgaguguaacugauuauaagcacgugaaauuacagacuucuuuccugugcauugauuuuugccauucacucuuccauaaucuuaugauuuuuuuugaucaguaagaauauuggaccauugcuuucugagccuuuaauaccccaaaauuaucccuaacaguaucugggugggcaagucguaguauuucagagaaguugaugauagggugucacaaaaugcucaaaguggagaaaacuagucuaacacaugcgaagguguuuccauauuccuguacacacacacacacacacacacacacacacacacacacacacccauacauacacguacauuaaaggaauauacaguugccucaguauaauagguuacagugucugaagucacaguuggucagcuuuggaauaucagucuuagagauacugacuggaaaguacagaucuggagcaguugggugaagguuggcuuuguagaguucaccaggcccugcaguaacugggacugcugagaggucgucaccccgcagugcugcaugcaaguaugagucaguaacucauuuaugagaccuuuguuauaaaaaugagauuuggcaggauucccaguccaguucuuauuucuuaagguuggaaaaacaggacuuggagggaucggcugacggcuuugagagcacaugugaggagcaugugauucuaggucuacugucaguguguucccucuguuuuuauugaaaguuuauuuuuaauuauuuuuaaaaacuaauaaccaaaugugugcaccuuucauugauauuaacugcgagcacacugcuggguaacagauguguagaauguuuuaaucuugcaaaacugaggaacaacuaacuagacaguuauuucauugccccuccuccauccuccugacuguucccaggacuuagaacauguuuguuuuuuauuuaacguuaaaauuccaggauguuuuauuacaaaggugaauggaccuugauccuugagaugggcuuauugguaggauuucugguaucaaacaggggcaggguaucuuugaucucuuucuuagaggcucaucuacauauuuuugauaagccaccagggcuuuagaaaugggcuaugggauggcauaaauuugggucccaagaccacuacucuucacauagacccgaauauccacaccagcaaacugcuccuugcccagaaacagaagggcuccaggaacauauaccacgcugaguggcuugaucaucuccaggggacaucaguuugccuuaauaggccauuucccuuucgaagugcaccaccacuauggcugucuucuuggcucagaccugcucagacugcaguggacacuugaauggcauaggugccacuaugagccuauuuuucucguuuugacuggcuuuuugcacuuaacauaauaccuuuaagguucauccaugugcuggugugacaggcuugugacaugauuccauuuuuuaaagcggaauaauauucuagugcauguguguaucucauucuucuauuuguuguguaugaauguuaauguuuguggguacacauaugggcaugggugugcaugcacauggcugugcacaugugugcacauguguguggaggacagagaucaacccuagauguuugucuuaguuggggagacauauccauaaccaaaagcagguuggggaggaaagggcuuauucugcuuauacuucuagaucacaguccaucauuggagaagaaagcacaguaucuccagcagggcugggaccuguaggcaggaguugaugcagaggccauggaggggugcugcuuacuggcuugcuuacucuggcuugcucagugugcuuucuuacagaacugaggaccacagcccagggaugaaacacccauagugggcuaggcccucucgcauugaucacuaauugagaaaaugccuuacagcuggaucucauggaagcauuuccucaacugaagcuccuuuaucucugaugacuccagcugcgucaaauugacaaaacuagacaguccaguguaaaucuucaggugcacauaccuuauuuuuugagacaaagucuuucacuggucuagaacuugacaacuaaucugguagagcucuguuggccuaaacucuccagugcuaggaugacauauccacaccacugcuuugcuugcuuuuuaauguaggcuuugaggauugaacugaggucuccugcuugcagauuucguuuaucuguucuuucauugauuuauuggguuuguucccauuucuugacugcuuuguugaauguugcaauaagcaggauguguaaacgucacauuugagccucuguguuauuucccagacauggaauuucuaugccauguggugguucuggguuagaguuuugaagaacuucauauugauuuuaugugcugagauuauuuaccugucuccacuaguuuaaacaaguuccaggucccugaauauccuuuacggaaacuuuuauaagaugguuaaaaaaggguauaaagggaggcuacgguguagaccagugcuuuccuggcaugcccaaagccauaagcuggacccugagugucacaaacuggaagugacugcuuaugccaguaaucuuagcacuugaaguugagaacagaagaaucagaacuuccgggucauccugagcuacacagugagcuuuaggcuagccuuugcuacuugaaagccugucaguaauagaaaggcauuguuaugguuucaaaucauguuuuucugaguagaugguaauuuaaaagacaaguucccucgggacuuccuaagaacaaugcaggcaaggucaggucaguauagaaaauugaucaaagggaucuuugaagaguagggucucuuaggggcuguguucauagcucugcucagcaugcugagauggaaacugacaucgugguagucuaggccuuaguucuuucagcugguuaaaguucagcagaaagggacacaaagauuaucucuguuacuuuaguugguugguucucugcuggugguggaugcuggaagguagaugggagagaggauuaugaagaguuuucuagaauuucaguuccugggccuaccuugcugauggauuucugugagaagugucuaccccuuccuuuguccucagcuuccuguaacuuuccagacugugcuggcaaugugcaagugacaacaggaaccggaaggccugcuucccaaccuucaguaugccaguaacuuaguuuguaucuuuguguaaaagcuuauaucucaccucauuuuuauaaucuguagauaacaugauuagcuuagguugugggcuuugaaaaggaacgucugacaccuuaagaguucugucaucuaaaugugaagggcugaggcuguaccaguguguuaccuaagguagagcagacugcauuuaccuuguggggcuagcucuaccagagaaccauugauugcauuauccccauugagacuucucaagcagcuagaugguucuggauaauugcuuagcuacuggaguaggaaauaacauggacacuguuauuuaaugugucuuaauaauaauaaugugacuuggggcuggagagauggcucagcgguuaagagcacugacugcucuuccagagguccugaguucaauucccagcaaccacacgguggcccacagccaucuucaaugagaucugacaucuucuucuggugugugugaagacagcaacaguauauucauauacauaaaauaaauaaauccuaaaaaauuaauaaugugacuuaaguguacuaaaacagcuaagaacauuguaucccagagaccagagauuuuucuuuuucagaucuuuugguuuuaggggaaguauugggcaggcuaagaguucagcucaggauuacacagccagugucuaaagcugagaauagaguucacauuuuacuuuucuuggaucuuauaacuggugcaauucuauuauuucaacugaguagacaagacuuguacacaagacgagauaaguaauaaucuaagacugugauaagugccagagggaggcuggugcuucuaguguaggcuuucugagaaggaagaaaccauuuucauagcugcuguaaucugggaagccuuccugaaggagggggaagcuguaagauuauacaucuacagauuauaguuuugagcuguucuugaaggaaggaucauuccauuauagacugagaggagaaggaauaccaggagcagacuuggaaagcucgaggcagguaguaguugcugaguaggcuggaggaggguaggcugugagaagggcaggcugugaggagggcaggcugugaggagggcaggcugugaggagggcaggcugugccugcugcucugcugugucaucccagaagccugaggagggaaggacacccgaccauguacuuguuuaaggaagccacuuucuugcuacuuauuuacuugacaaccuauccucuuucaaacuggaaauuacguugcuuaaaguaggagaaaauaaagaggauuguaguauuuucuagaaguggucucagagguaccugauaguauuuaaaccuagagccuggcucccaccgcaaaggcagcuggugggcucugaugcuccugagugacagggccauccgugaauuauuuagagccuggacucagugagugucugcauaucaagguccugugggaggaggcuaugcuaucucacugagaaaucaucagaagcucaggugcaggaaggaaugacugcauccuaaagacauugcacaugcuagcaugccagggcuacacauguucccugucgcugcaauuggaucuguuuuuaaagagcaagagcuaguaccuccuacuucuaguuaauaaacaaaaacccacauucucauguuaguaugucacauugacagagauuugguuagaaacgacauuaaaagcacauaggaacacagaguaguuguguaaggaaagcacacacacacacacacacacacacacacacacacacacacacacacacacacacacacgcucugcuuagcucuuucccagaagaaagcaccaaucuggguauagauccauuugaaguggugcuuccuguagcuaucacugucucugcugcugacccaucacugcuugcugguauuugcaucuuccacacuucuacccuuggaagagugugccugcuagcagaggagaaagugcugguguuaaugguguggugggcagggcugguggaauggauggguuagcucuggcuguuaggagacaaggcaguaugagaccuggcuugaugauaaggccccugucacacucccuuccauucuaggugccugcuuaaagugguuucuucaucucuucucuucauggucccuggaaaagauaaaaguggguaugaauaccugagggcaagaucagaacacuaacuuuuacgaagaacagauuuauauccugccuuuccucuuugcuuuccuugggcuaugcuacccaggaacgguguguucuccugucccaugaaucccuccuaaaacuggagccccauagcucugcacaccagugugcaucagccuuucccccucugugugggaggucaaaugcacaaccaaaaaucagggcaacagcaggccuggccccucuuacauuccuuagauacucucccauuacagaguaccuggaggggaggagcccaggucccaagccaacugguaauauauucacuagcuuagcaacaccuguuugccaaagucagggccucuggacugggcuguucuuuugccuauauaaggaaggcuugccugugcagaugacagaugacauugaucaguuuggcuaugguagaaggcucaauaaccagcaguccuuacucaggaccuuggcugcuucuuacuaguguaacuuaagugguuugcuuauuggcauuaaugucagaugcgauguauucaguucugcaaggaccauaugaaccagacagacagacagagaaaacgggaugaauuagguuuguucugcucugguauuuuagggucugcuguaugaguagaugauuuugcuucuguauguguuugaagcaggugggaggaauaugagagaaugagaaugcuuauucuucuaagcaguagagcuagcaaucacuaccggccaugaaguguagauauggcauccuggcccccaagaaacaaugggccuuuuguaacuugcuucauagucuguaugaugguguucaugcuuugagaguuacuguuuuguaacucaaagauuuuaauuaguguguguuugagcacacauacugaggucagaggacaacuucaagaacuugguugucucuuucccaaauguaggucccuaauacugcaugcaacucuucaggcuuagaggcagacucucacuguuaccugcugagccaucuugccugucccugaaggaagauuuugagugugggcuuccuaaugguggauuuaagcagaaguggguacugaacugugugacugcuuaauggaguaagucggccaggagggguaacgcauuaagaaccuggacaaggcagaaagcuaauguacagcaguccuaguguauagaugcagugggggaauuucaauacuaauguuccuguuuauugaaaauaagugcuccagguaauugucugugauuaucugucacaggaguuugauagugaugaggaaugaaaagcagccaggaguagugacucccacugggaauccuagcauucaggaggcugaagcaugaggagcacucaauuccagcucagccugggcuacugaguacagcccugccuuuagaaagaagaaagaaaggggagaguugcaaggcaaaucuggaaagagcagugcaaagaaucugcucagcaauuguuugugugaaaccuccucccauuccuucccagcuccgggcuugcuuuuccaaauccugguguuagauguguacaaaugccuaucccaucuuagcauuuucaacauccucuccuggacaucuucagucuuguuaauguuuggguuuucaggaaaugaaccgucaaagcuuagccuuuucaugcuugcucuaaugcagggaaagcauucaucuccucaaccccaggcagcauaguggcccugagaacacaggcuucagcucacucgcuugucuucuccuucaccguccacaugcuaaauccuacagaauccuagagagugcagagccaucgagugugaaaagaggaacaaauccaaauaaaacuaaacaaacccauucacaccagagcucucaaaguagcaaguuuugugugcacuaaaggaugauacggagggugguuguggaacugcaugaauuuuaggcuuaccuugauggaguuaaaaaaaaaaaagcuuuuucuaaaaagcuuuaaaaaucacugcuuaguagacgacuaaauagacucuaagaauacuggagaaguuggaggcuauacuggacucggucaguuuggggaugaacuaguugguucugcuacucucugcuagcaauagagucacggguaaggaaagcacaugccuugugagcacacuugagacaacaucaugggguuggucaccugagaaaauuuaugugaaacuuuuuuuucaguucuugagacagggucucacuaugucaccuuggcugaucucgaaacucuguguagaccaggacagccucagucccucagaaaucuacuugccucugcuuccuuagugcaguacuaaaggugagcaucacacacuagcuaaugagaacuuacuguaaucuacauguaugauggugacuuuaugaccuucuuagcuacuuuuuuauuguuaugaagagacaccaugaccaaggaaacauagagaagaaagaguguguuggagcagacaguucuagagggugaaugcauaaccaucaugggagggagggaacauggcagcaggcgggcagggcacuagaacaguagcugggagcucacaucugauacacaagcacaaagcauagagauagauguaacuagaauggcuuggguuuugaaagcccaccuccagugucacaccacuuccaacaagucacaccucauaauccuucccaaacaguuccaccaacuggggaccaagcauucaaaucuaugagccuauauagaggcuguucucauuuaaaccaccacaaugaccauucacauacaaugguaugugaagacugauaauugagaguaaaguuauaaaaaaugaaaccccagcuugggacacucaugucacagaugaauacuuuuaggauauauggaaaauuacaugacuauagauuccaaccugcuugguuuauggacaaggacuauaaggcccugagaaaguuagaagccaauacauaaaauuaugaaguuucuugaugguacuuggauguuaggaugagccuaugcaccaaauauucuguucuucuaccauccucuguugcuucuaauugcuucugucuacagaucacuacaggaaccugguuguuucuuguaucacagaugcagccuguaugggcuucaguuguuuuguuccuguagcuuccuugccaaccaugucuguuuguauuucaccuuggaaucuggcugcaguuagaaaacaggcacaaccguuuaucaguuggcccccuacuugggugagcaauggcaguuuuuagaugagaaaaaaaaaacggggaaaauuaaaauugcacagucuguuacuacagaaagcugguuaaacacgcugaaaacuuuccuuuaacacucccauggacauucacauuuuccugcaauugguuagggucuuggagauucuaauucugagguaacuauaaauaagacugagggcaagacucuggaaccuuuuguuuuauucagguacaacuaagcucccuuaaauguggugguucuucagaacuccuucaucauuaccugaccaagggugugccuccucuuggcuaaggcugauggcucaaccuugagcuauucacucaccuuucccuuccuaccuaugccaacuuaggacuagcugaaaugugagcacagacaucaggcuugacugggcccuacucagaaucucuucuccuggcuccauucacaugucuccaucaccccuuucucuguucauuccgguaaccuggcuuuugcugguuuggauccauugcuuuaauccaccccuggcauacugucucccuuaagucccuuuugcagcauuugaugcugucugucucuauuccuccuuggguguccucccuucuucauuguauuuucauuccuugguguuuuucucuucaguuuuggcugucuuggggguaaguucuaguaccauugagcuauaccuacagcccuccacuguuuucuuuccuaaggccauauuucccccagaucccugcuuagcugcuugccuuauuccccccuuccuagauguaacuccacuaaaucuacucuugcccuugugcuccagagucagucuucagcuuugacuucucuucuccauuccugaccacuauggauguaucaccuggugacaaagagucagacaaaggucagaagagaaugcucaucauuccuucuuuauacccccuagccagcucuaaugccagucuuucuugacuguccucugauggucuuguaucugauuaguaaccaaaguucugcaggugaacucuuacaucaguccauuccuuucuaauccuauugccacacccuaaugggcccuuugaccuggacaguugcaaugaucucucaggugacuagcugccuucagucucuccuaucugccagguuaaucacugcuagacucuguucuccucuggcucaaaauuuuccaagcccaugcuugauucuagcuugcuuucaugcuucucucccaaaaugucaguuucuuuguggugcagcuagccugucacauugucuguucugcuccuuugguggugacaugaagaagcuucaucuucucuccaacguacugguugucuguguuuccggaaccagucugggugucagcguuucccuaggguucugacccuucuuagcuagguguggccuccuuguucucugaaaucuuuguguuuucugaguauuugacuguuugucuauaauuugucccauacccuuugucuaggaacucucuaguuuuccucaaauccucuaaaacagcagugugugcaguauaguccaaacuggcuauauucuaccuuuucccagcuacugaguuaggucaggagggcuuucagaguugccucccauuuuuacuuggccccaugccaccaaauggauguuucugugaguugcuaaacccuucuucagccucaaugcauucauugcucuaugguuuuucagucuaugcuuuuaagguuugaguguggcuauacuaguucucaucuuuccauuacacuguauagaaccuggcuaauuggaaagcuuguuuaauauauauucccaaugagagcugaaaaggaugauaacugaguggcguaaaaaaauuuaaaaaaauaguuggaugguagauaacuuugcaaucuuguuuucugugcuauaacuggauauucagagagggacucaccacaucauuggcauauuuaacagugaaguagggucuguuaaaaagaucccccuuugaaauaauuacccaugaugcuuuguagucuuguugugaugggcgacagaauguaaggagagaugagcuuggaacaguaugagcacuuucacauccaacuuuagugguuuuguagagauagguauuauuucucaguauuaacagccaagguugagaguccaggguuuuucuuaaggccauggaaugaggaagcuugcuuggcuaucuccaaaauuagguuuugagaauccuagaccaagugugucuucuaagaccuagcauuucauggucuugcuagcuuggcagacacaggagggcuuuagaauauguucuccaucauggauguaaaaaugucuuuugguugggccugacuugggagccaaaaauugacaauguagacauuaggacaggagcugagguucuugagggaugaacggcuaacaguccuugcguuaucucuggcccuggccugcccccaccuccccuucagugcacacuggaauccuuuagggaggauuuugaauuagaaccuugcagaauagagcuggugaucuggaacuuguuacgcacagaccagguuagccucacugauuagucuuccugucuccacagaccuaagcauuaccacacugaaauuaccuucuguagugauggcugcaggguuccaagcuggaagugccaaguuuauuacagaccugccaguuguagugagggggaaaaguaggaagaggauaggaccagggucaauuauuccccacggauauauuuuggucacaucauuuucuacauaggauuucuuuuugguagaaggaggugagaguagcaacuagagagaaccaaaacuugagaggcaucaguaaacaaaucaaagauaaguuuugaaggugauugcuguucuuuuccacaggaauguaaaguucuuaagaccaguaauccuuccucccacaaugccuugcaccacaguacucugauaaaucuuccuuucauggaguuaacuaacgggguucaucaccucagaaaugcaguuauggcagacugucugcugagaagguucuucagagggccucguucucauuucugugggcuguacccuacagggugccuagacugacuuugacuuaagguggcgccggguugggcugugcuugcaguuggcgcccgcgcaguggcugccugcgcccagguacaaggcggcuugaucagcgggcucugacccgccucugggcccugcaccccuuuucgagugauaguaaucguaaucggauacuuuucuguuaggcggggccgcccaacugaacauuguaauuccagcagcuuugugggaccugaccgugcgcggguuagggucugcaagguuggccugcgaacgcccuuccgcgugguucggccggcguuuccgucacaaugcuguuaugcuaaucaggugacaucacagcgcagcucaccgcagcucccgauuaaauuacaaaccggcaaggggggugggggcuugcaggcaguaggugugcgcugcucugugagcuggagcacagcgugcuuagaguuggccauauuuaaaauauuuuccaauaggauccugcguccuuccuccuuuuccuccuucccuccucccucccggguaauuuauuucuagcuuccaggcaagggccacacaaggaaggaaauccacaggggauuagaugccggggugguaacuccaccaggcuagguuggacucugcagccaacuuccuaucagaucacccugcaccuauuuccgacccgaccggaaugcgacuggcuugagguccagcccuuucgccugggcgggagcagagccgcggaagcugcuuggaguuggauggggguaggaaggggcuggagcgggaauccuacggugcaacuggccugggccuaagguugggcauaauggaguugcagaggacauccagcauuucagggccgcugucgccggccuacaccgggcaggugccuuacaacuacaaccaacuggaaggaagauucaaacagcuccaagguaaguccgcugccaagggccaggccugcuugcggguguuccgacaggauccuggagcuuuuugaagcuuuauuucugccauacgguacacgacccuagugaagauagcagccacaccgccccagguugacugugagcaccuaauuaaggcauuaaaggaggcaguugcucacacuacuccaggcucuagauuagccaccauuuguagucucgccaguaccuaccuuuugguucuaggcucuaguugucagguauccuacuuucuguuguauguuguacacacacacacacacacacacacacacacacacacacacacacacacacacacacagagagagagagagagagagagagagagagagagagagagagagaaacacacacacaccauucgggaugcuaggagauuaauguuaauagauccauuaguaugcuuuuauuucagcccgccucuuuaacucccagccccuuaccucugggagcacguagagguguaaaauacacugcuccagacccaguccaauagaacaauagcaaaggggaggaggaaguggucuuuuucuuccuaaguccuugauaaauuaguuuuaguuccuaagccuaauuuuaacucuugauguauuguguuggaggacagcuuucccauuaauuuggugggcuauguaauuuauaauaaaagccacuuauugucauuccagggcuauggguaggauuaguuggaucacuuacagacauuuucuagagucuaugccaggcucaaagauuuaagguauccaguauuuugcugcacauguuuuucuggagagcagguuccuggaacaguugugugcuguuucugcuuguaucccugggcuguuucugaccagucagcaugccuuggucagccacucagccuauacgugacuaaaaaauaaaggucucuagcugaaaauagagcuugcacuuagaagccuguagaaucugguaauagguaggaguagcucuaguacuguaaagaauauccaaagacugugugucucuuauuuuaacuccguccuaaaugaggagguauggaaggaaacaucuugguccucguauguuuucauuggaaaguggugaucucuuucauucauugauuuacuuuucuuguaaaguauuuugacaacauugacuuguuuuggaaaaugaggcagaacaggaugugauuuuuaaacauuugcuagauguugcugcauucuuucagcgucuggcuaagaggugggucauuagcacugggagaucaacuaagucuuuaguugcaucucugagucauugaaaguggaauuugcuuucuugaaaauuuaggugagugagcuugcaaguagugaaauagaaaacauauauucuaggucuuugaggagcccuacacuuguagaaucaaaagaacucagaaugcccccuuucuccuuggccugggcucucuaaggagaagaagcacuuacaggauucagucagaaaacuguuucaagccuguccaugcuguguagugucaguaaaaacaaucaaacaguagaaaguauaaaaagagccuggcagugaugggacacgccuuuaaucccagcccuugggaagcagaggcaggcggacuucugaguuugaggccagccuggucuccagagugaguuccaggauagccagggcuacacagagaaacccuguguaagagaaaguauaaagaggauguguguggaacgcacuguuugacccacccauaacaaaaggguuauucuaaaagguuuaaguguaguuguaaguugcucacugcuugggguggagcuuauacacaggaaaugucuuaacuguccucuuuggacaaggaaaugguuuuuaaaaaucacacgaaugcccucuauuuuaguucauguucuuuuuccucaaggaacuaucuuuuaaaaaugguggggauuaaguuguguaguaaauauaccaaauuuuuagaaguaagcucggucacuugcucuagcuccagaugacuuuuuaaauacugugguuuugaguugcauaaguuuacuguugguguuucuauaacagaaaaccaccuguguugaagaacugagaaagggugaauuaacuuucaaauaggaugggucacauuagggucacuaacuuccaacaguguccuagugagaagaaaaacagauugggguuuaaacaggaugagaguuuggggguuuuguuuguuuguuuguuuguuuuuucgagacaggguuucccuggguaguccuggcuguccuggaacucacucuguagaccaggcuggccuuaaacucagaaauccaccugccucugccucccaagugcugggauuaaaagccugugccacaacgcccagcugagaguuuauauaaaaaccuuucucagcuccugauccuuggugugcuguucugauccuuguaguucuuguaaauguuauuuuugauaacauaaauucuauguacugguauaauuuuauacaugcucgaaggccuggggaauaaucuuucuuagcucuugucaccuaguguaugggauguuuuguugauuuuuuuuuaaugccccccuuaugaauuuauauacuugguauauaugucugggaagggcuuucauuucauggaaguauguuacuauauuuguugcuggaugcaguugguuggaguuugcuuuucuagcagcugagcaaaaccugauauuaagagaaaccuggucuguuuagauaacauaguguguagagauuuaugggccagugaguaaguggcggggugggggugggggaaucucauuggcuuaaggaacugagagauacugguuuugguuagcuuguuuuaaucacuccuaaguucauaauaagagaggucagggucuucaaucucugaacucugacuuuagccaccaguacauagcuuucuuucauuuuuccaccugucaaauuaaauuauucaggucaaccccugucuuauaaaguuggauucauuuucuguuguugcuuuuuuuacuuuaagauaagcgaagaaaguugaaacaacugguuucagcuuccugcuuagaaaacugugauuacagaaguucacaauaccuucccuguaguuguacaucugccugcuuaguccuugugggagaauccucugccuuguuagucucccacuguguucucuuaugcaugcuuauuguauaugaaaaaguauacgcucuugagcuuggcauucaggacuugugcaaauggcccuauacuguguggucuuccucuuccaacuccuucacugcagucaaaccuguagacagguagucagucccucaucucuagccugccuucuuccgcuucccuuccucucagcccagagcacugauuggcuguagcagugagauagcagaggcagaauccagagggaaagcaucaaaacagguuuuguuuguuuguuuuguuuuuuuaaaucuucuuugcaccuuacucuaugguuagcaccauucuggagaagcgcuuucugcagcuucuggcuggaugaguuugcccuagaauacugaauuucgggccacaggaguucauuucccugcucauuacaugcugaggugcuuucuaauuacguguguguguguguguguguguguguguguguguguguguguguguguguguuuuguguuuucccuuggaagugggaagaaagcaucauauguccuagagguuacagauuuuugucacccacccagugugauagcugggagcggucuccaguccucugaaagaguagcaagcacuguaaccauuaggcugucuuuccagccucuuaacuauaaaaauuaauaauuuacuuacuuauacuguauauguaugugacguguauggagguuagaggacagcucuguggaguuggauaccaccuucaaacuuucuauggguccugagcauugaacuaaaaguucacuagucuugcucaguaaguuccuuuauacauugagcuaucuuaccagcucuuaauucccugucacccuuuucuacuacugaaccaccauuuuugagacagggacucauauaauccaaacacacuauguaauugagucuggccuuaaauuccuuguucuuuucaaaauguugggauuauaggugcccaccaccauccuuggcuauuuuaauuucuuaggucuuggagaaagaugagugcugauuuuauacccaugauucauaaagaacccuuauaucuuuaucuuuucaagacaagguuucucugcauaucccuggcuauucuggaacuuucucuagccuaaccuggccuagaacucaaagaguucugccugccucuaucuucugagugcugggauuaaaggcgagggccacuaucacucugucacagaaaaacauuuauuaaguuuuuaguaaacuuuugguuuguggugugacuuaaaauauaugcuuuaccucauuucaauagccuuagagaaagaaaaugucuaagucuauacuuaaggucuuaaagacaaauguucaguauuucccauuacaaugugaacagacuugaugacauaauuuuuaaauuuauuuuguguauggauguuuuaccugcauguauguaugcauagcauguugugccuuguguccucagacuucagaagagggugucagauccccugggacuguguacauggagaugguugugagccaugugggcucagguaggagcuaaaccuggguccucuacaagagcagcaagugcucuugaccucugacccaacuuucuagaccaacauuauuuuuaucuucaguauaugaguguuuuuccugcauguguauggaaugccuauggaagcuagagagaugauguuagagucccggaaauaaaacuuaguuauuaagagccaugggagugcugggacccaaacucuaauccucuacuaaagcugcacgcuaucuccagcagcaaauggccucuuccuccuccucuucuuccuccauuuuucguaggaagguuagggguaggauuauauaugaggacauuugagggauuuuaugaaaugcgcuguauuguuuuguuuuuguuauguuccucagacaacuuuauggggcaaaucaucaaagcaaaucaaaccuuuccccaguuucaucucaggauuaaguccugauaacuuugugacucaacccuguuuuuuuaaugaugugcuaauuauaauuauuuucauagcacuuaaccuuaauguaugucaucuggcuuaauagauuuuucuuaaaguacucagcaugaaagauaguauuuaguaaauuccaaauaaaugugcauuuccucaguaccaguaauucuguggggcagauagucacuugcuuuuuauaaagacauaugugucuuuauaaagucaauaugacugaucuaaauccaggcuuuucuaaguccaaauuugacaacccuccuguaguaacuacuucaauguaugggcagagugugggcaauuaguaugugcugagagcugcucagauuucaguuuaggcagccaaaggaauaccagaccucuucaguccuuaaacaaaauguuuaagaagacuacuaagaggccuccuacaugucaguuauguagcaaagagaggaggcuucugcuuucugacacaucuuaugccucggaagguccgaguguugcaguggcuuucuaaaaagcccugccuccuucuggcagucagacccgaggaaggaaacuguucugcagaaucuuaggaguuuuucaucauucucagccucuacuugguuuucuggauugggaauugcuucaugagccaggaauuauucagaaguucagcucagaugugucuuuuccuagggagaugaaagucaaaacccccauuugguuucccucccuaaaauguaaacugauagcaagcgccugaccauucugcugugguuuucacacauugcucuuuguuguagcuuuaauauuuacucauuuguuuuucuucuauuuccuccaucuaggagcccaaagaucagacuggguucuaucuaucagaccugcccaucucacgcugagaagccgcugaauauuuguuaagaguauggguuauguuucauuaagagauuuucaaauugaaacuauuaagauggggacucuaaaucaguaguaccaacccaucuugagaacaugcuagaaacagaaacuaccuucuuaaguuaugugaaucugggacucugguauagcccaacaauaaguauuuuuaacuagcuuuccagguagucucuguacauuccucaaguugcuuccauacagggacaggcauaaaaaucugauuucuuauggagaagcgaaaacuuggaggaauauguauuuagaauaaaguuguauacuaaagaaaaaggcauuuggccagccaggagugggcucuauccugcuauaacuaaggaagccacguaacaauugugagccugugccucaugcggucaguuaccccguucuuccauugaguuaaagagggaaauaguguauauauaagcccugagaaugguucagcucaacacuucaccucuauaugccuaauaaauaaccuauuagguuuaaccuaaagaacaaaaauuucugcugcuuggaaaugugguggguggagccugacuacacccugcacugaucuaccugaaaaucuggccuuugcucccucucaaaggaacguccaggguugacuuuaccagggugguguuggaaacucuuucaagucuccuauguauguauuuauuuauuguuuuugauuuuucuuuuuugagacaggguuucucuguguaguucuggcuguccuggucaaguuuccuuuaaagaaagcuuaaaugugcacacagacuguaagaaucccguguuguucugacuucagggguuuagauguuuaacugucugugguggaaacugguaugguuaacaacagcucuacagacagguaaggguaucuucccagccuuaagucugcugugcuagaauucuacuugcauagauuagcagcccagacagugaaaaagccaggaguuuucagauucugauacuccccucucaucuccccaacaacuuuauaacuaagauccagcuaugaaaaaguaaaaauuaaaaaacggugaaaaaccucagauaagggcauguuucuaaugcugaaugauuaguuuaauuaaagauuugacaguauuaagccauuuaaugaguacucagaacuugcuacuugaaagcuuuguaguuuggucaguauggcauacuuuaaauaaaagcaagaaggauccuaauuuuuaaauaaaagucaaguaaaguugacuuuaaaaugaaacacucauuucuuguuauuagcacaaauucauugcccuuuucucugagcuuuggucuugugguuggaaaauggguuggucaucauagccugagccgaacaacaaaugaaagcaaaugagaaauaaacucacugccaggaggcaacuuccugcaaggcuaaauucuagagugcagagugagaaaggggacagacagagacaggugggggaaggggugcugagccagguuuaaauuuaaagguaguuauuggcuccugaacaagaucccuguucugaaagguguggcccauaagaggaugcaggaagccaguccucagcgcauucgcugggguggcagccuuacuacagugcaccaggaacuuuggagaccuuuuuguuggacguggucuguaggugauuuaagacuugcuagaaaugccgccauucaggucugcuccauacuugcuggguuagaaccccauuuuaacaagaucuucuggaggguuuuaagcaauuucaaguuuaagaaacagucuuggaaaugguccuuccccuuguuccuccaaagaacacaggaagagacaguccugaaaagguuaugaccucugagguuugaaguuugugcuuuuacauauuauucauguuaugcauacauuuuuugauuuguuuagcaauauuguuuaauuauaaaaguaaccugaccaaauguauaauaguuacaguuuaauauuuuuuuuugauuaaagaacuuuuaaaacuugugcauguauguauugauugauugaauggaucucacuauguaguugguggcuggcuugguagaacgcacucuguaggccaggcuggccucaaacucacagaaaucugcucaccucugccugcuaaguguugggauuaaagacaagcuugaacacaucuggccaaauuaaaggauuaaaaaaaauggcuaguucuuagcuuuguaagucuuagcaucauuuuggcugggauuuuuuuuuuuuuaacuuuuaaauucugcaguuaaagaaauuggugagauuuuuuaaaauuccacuuuacuuacccacuugguauuagaggagaauuacagaauuauucuuggggcuggagacaugguucagcagucaagagcacuagucacucucucucucucucuuuuuuuuuuugguuuuugguuuuuguuuuuuguuuuuuucgagacaggguuucuuuguauagcccuggcuguccaggaacucacuuuguagaccaggcuggccucgaacucagaaaucugccugccucugcuucccaagugcugggauuaaaggcaugcgccaccaccaccuagcuuguauuugucacucuugugaugaccuaaguucaguucccagcauccacaugguggcccaggguauguaauaucaucuucugaauuccucaggcaccaggcaugcaucugauguuuguguguguguguguguguguguguguguguguguguguguguguauguguuguguguauguguacauauauauguauguguguaaaacauucauauacauaaaagauaaaucuuuuaaaaaauucuaaauucuuccaauguucaaugaaaagaauuuaugccuuuuaaauacuauuaaacuacuuuuaaaaaugauuuauuuauuguauauaaguaccacuguagcugucuucagacacaccagaaaagggcaccagaucucauuacgaaugauugugagccacuauguggaugcugagaaucaaacucaggaccuggaagagcagucagugcucuuaacugcugagccaucucuaucuuuauguguuugaauguuuugccagcauacaucugugugcacccaugugugugccuguuggauccucuggaacugggguuacagaugugagccaccauguggguacugggaacuggaccuggguccucugcaagaccagcaagugcucuaaccacugagcugucucuucagaucuaaacuauuuuuugauuaaauuagaagaaucucuugcauugaauggugauccuuguuuacauucuauuuuuauugaaugcuguuccuacauucaguuaaacuguuuucgugcacaccagacuagugguaccuucagguuuuguuguuaagugcauuugaaauaugcuaaguauauauuuuauuugauagguacuuauuuuuucuggguuuguaauugaaguucuaaaguggaugcuaauaagguaggagagagagcauuuuuuuuuacuuuuuuauuuuaauuuuuuuauuuuuuugaccagagauuuugucuucuaggagaaagaaggcuggaggagauaagugauccuuaguuuugacugagggcucugcagacucucccuaaugggagggaagccacagcccuuaagucacugagugacucuggugaaagguuuucuugccuuuuuuuuuuuuuaauguguguguguuugcauguauguguauauaauagcauguacuuguaggucauaggacaacuuguaggaauaggcucuuuaccucuacuguauaagggauacugagcuccagugccuaggcuuuuggcaggugccuuuaccugcagagcgaucuggccagcccuguugauggcuuuucaaaagcaggauugagggugaauaaaagacagaauuaaauuucuagcugcuccuuuguguuacccuagcauguuuaauauguaacacuaucaguauuacuauauucucaaaagaaaugaaaaugaaagcaguuacaugaaauuugacagugcagcaaacuuaaguuuccaguacuauucauaccacauacacauuauaaucaaauaaauucagugugucuuuuuauguuuuacuucacauuauaucuuaagcuuuucccacgguuauuucugugaauccuggcauacguuuccagcuugucuuuguaaacaugagaacugcgcuuaccggucuccaaguguuuccuuaaguaggcuagagauaauacacauacuguauucauguaagaaucaaaugagcuucaguguagaaacccaugguuauaugguccuugagguuugagguaagugcucacuaacccacagcaguugggaugauuucagcuguuaguuaaguagacaaugccucaacuucuagcccuacccagcuccucccccaacugucacccccacagcaccccccacuucugggugugguuuccuucaguguguugggagagucuucagcuugccuggaaauacgcucaauugaaacuugcacuuuuuuguuuagaaagaacagaaagcuaaugagccucaugggccaggugagguuugauguguauuacgguuaccauggugauuacucccaaauucaugcaaagcaccuagagcagcuauugcuagagcuagagagcaucaaccccuuuuguuagagauguccagaggaaugcugccugccuuccacagaccuguuagccuguguccccuaaccaguuggccggagguacaagauuuuuaugcagcaauacaguaaucacaguaucguggagacagggacuggucuuuaucuggccuguauucacaaagucccugugaagugucuggcuuuauugucccuuucuaaugugaaaugaugcaaguggagaguuaauuugaagagcacuaaggcacacuauucaugaagaaugugaggaaaccuuaaauagucucaaggcucuguucuugucugauggaaugugcacagacucugccucuauuugaggucauuuaugguggaguuuuguagccagauaccauucgaacaaaaaccaguuucaaggguguuauguguauuuaaccugaaguccuguacaaacuguagacauuauuuuggaagcauugauaugauauaccuaagaucauagaagaucaaacaaucucuuaagagauauguggcauuguuauuuuuaaaauuaauuuucuuuuuuaaggaaaagacacauuaaggcagugguucucaacuuuccuaaugcuguggccauuuaauauagugacuccuccaaccauaaaguuauuuuguugcuacaucauaacuaauuuugcuauuauaaugaaccauaauguaaauaucugauaugcaagauaucugauaggaccuccaccccaccccuuguaagagguuacaucccacaaguugagaaccacugcuuuaaggaguuacaucauuuuuauuugcaucuauuuuaauucuuaguuuauugaacugaugaguuccacugagucacuguaagucaucagcuucugugugugauacuugagaugugaauuuacuauguuucuagugcuugaacacaguacuuucauuuguauugagggagacauuuaucaugauaguagagaagauuauuauguguauuaucugcacagaauugcugugcaagugaauucccacuugugugcucugugcuaguagccaggggagccuuggaaggaguguuaaaccuggucuuaguggugggcacaacugcccaggacuuugucucuucagaagcagaaggaggcuagaacgcacaugcauuauggauucaccaaagcuuacauucaauccuggcuccguugguaacuucuuuuauccugauuuccucaucuggaaagaauagcccuugggaugcuuauggggauuaacuugaauauauuguaaccucaccuuggucuaccagagcacugaacauuccauauacagggacucugccuuaguuauggggauauuggauauuguuuagguaaagauuugugaacucccuggagaaacagugggagugggggcggcuuuuccuguuaaaaggcacuagaaaccuauuuauuuucuuauccuuggcaccuguuucaugaauaauggggcugucuuagaguuucuguugcugugauacaacaccaugacugaaagcaucuugauggagggacaguguuuauuucagcuucugguacauccaggaacuaaggccaggaacucagaagcaggaacugaaauagaagccauggagggagugcagcuuaaguggcuugccuccccauggcuugcccauucuccuuucuuacaguacccaggaccaucagucagaaaaagcaucaugggcuugcccacaaggccagucugaugcagacauuuucucaguugagguucucucuuccugaauuucucuaacuugcaucaagucgacauaaagcuagccagcacagcgggaugguggaguaaggaaaacaguaacacacagaguucuuuucguccugguugucuuccuucuuccccugagaagacaggugguaccaacaaacucagaacuguugaaagaaagaaugaaucugcagucaaaguacagcuuuaggaaggucugggcuaaacuuauuugcuuuuuuaauuugauaugaucccagugaucccugccugcccuuaacucucuguuuuagguacugcuugugaacugcaaggugcuguggaauuuuaacuuuaagaggagagaagaaacuaaacauaacuauaaaaguuuggauagguagaagugguuugcuggaguuagguauuagaugucucccacugacucuuuucuuuugaguggaaugcuugaaaaguuuauaaucuggcuucauggcaacaaguguucaauaguguagccugugaaacuggauccacuucccuggguauggcugccauucacauuuguguguuguguuacuguaaagcaaacccagcguuuuacacugcacauggugccuuugccccagggccugcagcaugaguaauacaaacaaaggcaaggccucagaaauguaaauaacacauuaaugugcacacuuaccuggcuucuaauaauuuugaccccgaacuacuuucaaguccuugguguuucucagucccuacuccauuuucuaaguauucuuauuuuuccuauguaaauacaugauuucaaaguuaaauuguuuuucacuugaaguacaggaaacugcuuuuuaaagucauuuaucaauggaccagacuguggucuacuugacuggggcuuuuuaguuacaacugugcauaauuguagucuuuauugagguuggggagaagggauaguauugagggagggagucuagaguggugggagcaguuugguggggguaguguguggugauggucuucugugcuuaccucucagguggaauagaguauacgggaacggaugugaauccguggucagcccuuaacacacacgcgugcgcgcgcgcacacacacacacacacacacacacacacacacacacacacacacacacaccaacccccuggggacccuuucaccuucugcuguuaccagacuuuucuuaccuccuuuuccugugaacuccugaauuaagucauugauccagcccuguugugugcucaggguuuaaggaaaagggaagugagacacagaucucuugguaauucagaaguugauguaugaucuuacguugucuucccuucuaguaggaauuuacaguguaacuugacuagauuucuugcauuaaaaagaaaacaaaacuacucuugcaugaggagcccugguaauuagaauaaugaccaggcaugauucauucucugauuaauauucugcuuauggaagcguuucuaucuccagcuccacuaagcagcuggacucacagggauacaguuucucucuccaccuucaggaagcucaccgaccaaucaagagacaagaaggaaguuuuguugaggauuugaguagauacucugaaagaggaaagguagacuacacacacuugcagagcagaggccaucucuccuagguugcugugagaaucagcuccauucuuguaugucgacccucugugaaaaggggaagacaaaagccaacucaguugcucagguuccugcugguguaaaaggcuucguucuauuggcagugguaacuuuuacugaguacacuguugacuuagucaguucuguuauuuguguuggucucuugagacagguguuacuauagaacuggaaaucaugguccugcugccucagucccccagugccaucacaccuguuaugcauuccgaagaauucuccagauaagaacagaaaugauccauauuuacauaugaggaaagaaguaacuugcccacuguugaguaacugcuagugguagagcuggcaucugcaccggguugagcacaaagccauuguagcuuuaaaccauuguuucacacaaacuccaucccagagaacggaggugugcuuggguguggccagcaugcggaaguugucuagcaacagucccugcaguuuauucucccuccccaccugccucuuugucucucccucucucucugacagaguauaacuacauugcucuguccuaggacaguguuuccuuccuucuucuggaggggugcucuucuagcccaggucagaaagccaccaguuacuagcaugcugcugcuugagcuauccacccuuuguauuaggaugggucaugcucguggaggccgcgguaaaccagugcuacuaugaaaaguaugacuggugucauccgguuuggaauuggaagccacacccuugccaccacauuguacuucuuauacugauaaccuguggcuucaaagucaaaccacaaacuucugcauugaaugugaguuuaagaaagaaauaugagguaccuucacacacacauuauuuacccuuucagacgcccagugagguagguguuuuuucuguccuguggguuaagaaaucugaggcuugugaggugaaauaugucuagagaaaagagagagccagcaacugacaaaucgagcagguagcuaccaguggcggaaauuguaucaagacaaagcucuuuucaacauuucuugaaaauggcuauguuuccuuuccuuugugucuguguguguauguguauacauguuaauuaugugcaggcacacacuuacguacacauagaugcgugcuuguagaggccagaagucauuucccaggagucugucaagugauauuuuuuuaaaauuuuguuguuagcuuuuuuuuuuuuuaaaucuugacacaggaucuuguuguauagacuggucauccuccugccucagugucucaaguucuaggguagcaggcaugagucgcagugaccaucucaagucagauuuguuuguuuuguuuuguuucuuauuguuuauuuuuugagacagggucuuucuaugcaauccuggcuguugugaaacucuauuauguagacuaggcuggcuuacagagacuccucugccuuucccucugccugugccucaaaaaugcugggaguuaaacuguguaucaccaugucuagcccaauuuguuuguuuuuuaagaugggucuuacuggccuggugcuuauuaauuaggcuggacuggcuggucagaaacuacuaaagaucugucugucucaaccuccccaguggugagcaccguaaguacauacugccugagugguuugcauauguacuuuguuguuguuuugacaugguuucuagggauagaacuccaguccaugcuucagagcaaguaauuuauuaccugagcuaucuucccaggcccuaaaacccuauuuucuaauagguggcaacacaaaacaagucauaguacacacagcugucagccuguguggauaggauuuuaguuuuugcuguaagccauuguauacuugaucauucuuuguagguauuagacagauuuguggggaauucuaaagggcacacuuaaccuaucaacagacugaauaauacccagcuggaaaaaaguaguuuuuuuuucagauaucaaaacauaaagcuguuguugcugaugacuaaauucuuccauauaaguuaugcagccauuuaaucugcuuaucauugacauuguaagaauacagcauaggauggagaccuaaauucuuccauauaaguuaugcagccauuuaaucugcuuaucauugacauuguaagaauacagcauaggauggagacccaugcuucgaccugcacaggcauugcugacaucuacucauaugcaaauagucuccauggagccaaggaagguauguggaggauggaguuugagcuagccuuaccuuaggugauucggagauuuggugagucaagagccuucugaacacucacuggguaggauggauggcgagggcucuggauuugaacugucaggugaaauaccuguagugacucaguggccuccagacugcucuaccucaggguauaucuuguuaagagcucauuugaaucagucuguaauccuuugaaccaaaggagagggaaaauguguuuauauacauuaaggaggcuuugcuccaacagagaaccuugguuuucuugcuuuuuccuaagauaggaauuaguauguaguauaagacaaacaugagguguaugcugggggauaggacccucauuuaguaugguuuaguuaugacagcagaauuagggagaaggccucuguuuuaauugcugugucgcccagaucuuccguuuucugauacugccuuggcuuggcacguagcuagaaugcugauguuggaguguauuuaggcccaagaaaagaggcucuuggccuaucaagugcuucagaguuucugcuguuuugaugaauuaguugugauuucuaaaacauuguuugaaaccccacagacgaagcuucaaagccaguugcuuauaaugugcucuaguuguugcacuguugcaggcuggcugcuggaacaacguacaagaaggaaguagaugucaugaugaacaagcauguacaguauaaggacuuuggaaacaugggcauauaaaggccagcuacuaucugaaauuacauuuuaaaagagaagacuagguagaaauggcaaauguuucaagaaguguaagguauauugccgucuggaucauggaauguaaaaaaaauaauuuugggagaauugucaaaaccaugaugaagcucauaugaugauggucacauggagguaguuaugaacagagagagucacaaaacuggagccugguggaaguauuuaccuagguuaugguauuucccccccccauuucaauuauuuacaguuauuuaggauuuuugccuccauuuuguuagccaacuguaaguuaauguuagcacaaauccacagaaucugcugguuagaagccagaguuggcaaaguaacguuaggcaaauagcugguguuucaguuuucuuacagguuagcaaggauuguuggucaucuaauacaaguuuuaaagacuucuguaauacuguuuuaccuugugcacauugauuuuguuugaugcuaucuaugucuaauagauguucacuguuuuaaagggaagaaaaaaacuaaaaaaagaaaaagcacucuuaccccugagaacaaacaaagaacaaaucccaaauuuaaacaguguagauguccuguucucugagaucaaagaaucaaguccuguggagggaaugaugggccauaaaggagugggacguuccaguguuggacagcagcacagugagagacccuugccuaaaguccgauaggugccagaaaguuguaguaugcucaagagcagccacacaagacuugugcagguagaguucuguguauuugagccuugauuucuauguuccuuacugaaucccauugaaguauuaucuccaucaugaagauaggcagagugaggcacaaagggcguauuggccagaaaugcucagcuagugaaguguagucagaauuacaacccagacaguuugcuuugaaacuguauguuguuguuguuguuguuuuuaaugcugugcuggcuuucuaguguguuuucaguaauaauuuuugagaagacccaguuccuuagucuaugauuuucuagaucucagacuagaauucugcaaggacuugagagacgcagauuugggaagggcgaauccugagagauuaaaauucuugauuuuuguccagacugguucauaauuggugguggcagggagggaaguaugguaagucagugucguacacaagacaugucuuaccucggaagacucauucuguuuggugauucugauauaaaagaggcucaauaaacaauacagaauuuucugaucuguuuugccauuacuaaaaaugauuuguaagguccuagagugaugggugcugauauuuagguaaagguuuuggaguuaagaguauggucuucccuucucgggaaaugguggugcuggagcaguuuucaaaaguugacagcauuauccaggcagugguggcgcacaccuuuagucccagcacuugggaagcagaggcaggcagauuucugaguucgaggccagcauggucuacagagugaguuccaggacagccagggaggguuauacagaaaaauccugucuaggaaaaaacaaaaaaaguugaccguauuacccaggaauguggaguuuuguccaaguuucccuagcaugggacaaaugauaacucuccaacuuuagguccucagcuugaugaauuuuuuuuuaaagaguuauuuauuuauuuaguuucuaugaauacacuguaguccucuucagacacaccagaagagggcaucauaucccauaacagaugguuguaagccaccaugugguugcugggauuugaauucaggaccuguggaagagcagucugugcucuuaaccacugagcuaucucuccagcccccagcuugaugauucuuguuuguuuguuuguuuguuuuguuuuguuuuuuuccagacaggguuucacuguguagccuugcuguccuggaacuccacagagcaggcaggcaggcccagagauuuaccugccucugccucccaaguggagugcuaggaucaaagaugugucucccacccccaucccagcuacuaaauuuucuugauuuuaaaaacuucagcuucucuccuauuuauuguuaaguuuaagcccaacuggcccuuugauaucugauguccacauuggaauaaaguagauacuccauauuugggguguggcugucuccuggcauaaaugaauacuucuaguuuccccagucacuucucaggccacuuuuugaauuuccccauaucauguaaaaauaauuuuuagagcaguuuauccacgcguguuaguaucuuaaaaccacaaaacuugguuuucuuugcuagcugauaaugcuuuaauucuggcaccaggaaguaagguuuuuuuuauuuuuauuuuuauuuuuauuuuuauuuuuauuuaugguuuaauuugaucugagccagugucuuuugguagugacuuuuucugaguguaugugauaauuguacucaguccagaaucacaagauucauuauaggauugaugggcucuuuucuuuggcuucucugucuagagaagucuagagaacuucuuaggaaguucugaaagaugucaugucccugauaaagggucuuucccccaagaugugucuucugagcaacuugcuugugugaaugugugcauucugucgucuucucucguaaacauaaagcugacugcugauuuauauaggucacgggauauuccccuuuacuuuaagcuguagugcaucugaaauguagaaggagcuauaacagguacuuggucaaagacagccgaaacaauuuacuuuugucuuguggccucuguaggugugggagggaagacaugcaguauuaggcuacaucuuggcauuuucuuccagauugagccugugggugugacaccuagucucagcccucacauaaguaaacucaaacuuugugacaccagcuguagcacucaaggagccaggcuucccucuauaguaggguuagcaugauuagccccuuaacaugcucacuuggcuccuacagucgcagagcagcauuggacaaagcugcuccucuacaguacuuccuggaggcucugaaacgccucaccuuagguucacauaaggugagucugagagaguaugaggacuuaggaacuuacugguuuuagcuagugcaucuagaccauaaugucugcuguuuugggguuuuuuccccacugaauccagucugugcaaguaaauagcccagagcaguuaacuguauuguccuuggaaaaggguucuaaaacuaacccuuuuuuccgugugauuacuuucuccuuuaguagcaccugagaaccacucuuuccguuucuaggaccaaacagaauuccuuuguuguguaaauaaguaaccuuggguucauuugcauuacagccuuaggugaaaggugaaugggcugguucugucagccauggggccccuggggaaggaagccaaugccaagaaaauugaagcauccaacgaggguuacagaguacccuggauugucagagcagugauggcugggaagaaguucuuugaagaaauucucuugaagauuacuuggggugccauuguuuuauaagauuucuucuuuuuuuggcaugucaagugguagggacuaaagguagaacuaacuacauguagaacuaaacaguauuugaaacuugaaacaaacuagcaucaggagccuacuuugucagucaccucuuguuuguaugcucuagccagcucuuuauaccacugauccuuaugaaacccauguuaagcucaggccuuaggaucugagaagaucacagugucgcauugcugcuuauuuguguaugugggggaguguaugcguauguguauaaugacauuauaauccuaggauucucugugugugugugugugugugugacugacugaugauugaacaugccaagccaagaguuguagccaggauuacagacauauaccuccauuccugguuuaucugcugucauuuuucaucugaacaagaaauuuacuagcaaaagcugcugcucuccaucugcagcccuucaguauuguuagugcuguggaaggagacuggcuucauagaaacuuugguugaccgacacuguuggcuguccugcuugucagccguggguauccuuuguugcugcuuuugaggaugucuuggcuggacgaccuuggugcucauuggcuccuucuagacuggcaaggcaaccuuguagccagcuuucauguuuccucacucuggggaguuaugguugaucacuugaauuucguguguauuuguuugguuucuagccuuuaauuugcccugcgaccacuuguggcucaggguuagccaggcccauaguuaaagaacaacauaguugcuagcccugagcuaaaguccuuuuuccccuuuuauuucugcuuccucuucacagacuaauuaccagcugcugcuguucuuguuaaacuucauuaauccugagccucuguccauagaaauggccuuaagauaaaaagacccucaacuaaacauuuuguugcugcugcuaauugccccaaauuacauguuuuuauuaauuaagcacggcuugccuccaaauccuauugaagaauguuuccaugacuccccugaauacacacaugcugcuuugugguuucauauuuugguggggguggaggucccugaaaugaucaugccccaaaacaggguaguuuuagaaacaugguaaaggggaaacccuauguaaucuuauucagagccuuaauucuacacugauaaugccuuuaagcagauacagugcugaaguauuccauguuuguuuaaaguacaugauggcagacgguugcaaaacuagcuuucuuaagucauuauggggcuauggggcccagcacauguuugugcaauuacauauuucuuucuucuucuuuuuuuuuaauaaguguugcuguguguagguuaggcuggacugggcacuaguguuguccuuucccuucagucucaugagugcugggaucacaggcauaagacacauuagacuauuuuggaugggagagagagugaaauauuuugcaaugugacacuugaagauggauuuggauuuggauuaguaaugacugaacaaaggccucccgauagugcaagguugauauauaugagccucacagaugucaggggagagggacaccucucuuaaugaauaacuagaaaauggaggguuuucugggcuaauaccacuuaucagugacugcauaucauaugaguucuuuugugauuggguuaccucacucaggauaucuuccagauccaucuauuugccuaagaauuucacgaauucauuguuuuuaauacaauaguacuccauuguauaauugugccacauuuucuguacccauuccucuguugaggggcaccuggguucuuuccagcuccuggcuauuauaaauaaggcugcuaugaacauaguggagcauguguccuuauuaccaguuggaacaucuucuggauauuugcccaggagagguauugcuggauccuccaguaguacuauguccaauuuucugaggaaccaccagacugauuuccagagugguuguacaagcuugccaucccaccaacaauggaggaguguuccucuuucuccacaaccucgccagcaucugcugucaccugaauuuuugaccuuagccauucugacuggugugagguggaaucucaggguuguuuugauuugcauuucccugaugauuaaggaugcugaacauuuuuucaggagcuucucugccauucgguauuucucagaauucuuuguguagcucuguaccuauguuuuaaugggguuauuugauuuucuggaguccagcuucuugaguucuuuguauauauuggauauuagugcccuaucagauuuaggauugguaaagauccuuuuccaauguguugguggucuuuuugucuuauugacagugucuuuugccuuacagaaacaauuaauuuauaaaauucuuaggcaaauggauggaucuggaggauaucuuccugagugagguaacccaaucacaaaagaacucacaugauaugcgcucacuuauaaguggauauuagcccagaaacuuagaauacccaagauacaaucugcaaaacaaaugaaacucaagaagaaggaaggccaaaguguggauacuucaucuagggaacaaaauacccauggaaggaguuacagagacaaaguuaggagcugagacaaaaggaaggaccacccagagacugccacauccugggauccauuccauaaacagccacuaaacccagacacuauugcauaugccagcaagauuuugcuggcaggacccugguauagcugucucuugugaggcuaauacagugccuggcaaauacagaaguggaugcucacagucaucuauuggaugaaacacagggcccccaagaaaguacccaaggagcuauagggaucugcaaccccauaggagaaacaacagugugaacuaaccaguaccccccagagcucgugucucuagcugcauauguaguagaagauggccuaguuggccaucacuggggggcccuuggucucacaaagauuauauggcccaguacagggaaaugcuagggccaggaagugggaguggguagauuggggagcaaggggagggaaagguauaugagacguuugggauagcauuugaaauguaaaugaagaaaauaucuaauaaaaauaagaaaauggagaauuuuggaugagggcguauaaaaacuuucaguuuagggauuuucauggcauuaaguugcaggguaucuuaaacauacaugcaauccugaauuccauuuccagcaucgcauaaaacuaguguaacaguaaccccaacccucagaagucagaagcaggaaaaugaucaaagucacccucaaacugccuacauaagacccaauuucaaaaacaaacaaaaagcaaaaauaaagagacugaauucaguuuguugcuaucaggggaggggcaaccuuguuuggcauccaagguguaacacuauuuauucuaguugcagcccauggacauugcucgugcagaauauguaggagcuuuggaaucagacgccuaggauuguguuucccucgagacuacacaaaucacugaaugucucuaacccuuucaguucuucacauaguguuuaugagaauuaauuccauuuuagcaaaguguuuucaagagugcugguucccaguggucacucaauaaaccguaacuuuagagugaauguaggagaugguuuaacuccuccauuccuuggaaucauguccagagcaccucccauguucuuauuaucggccccuauugggcucgaucccacagacaccgauaaugguguugccucaugaccaaaggacagcuaaugcuguagugauuugcuuagccuucgcuuugccacacaucccagcacagugugaucuugaggcuggcauuucuccuucagcucugaaauccuuagauaguucuuagcucccacugcauacaagaacuauuaaaaacacuaagaauaggacuuguuuuccuauauaugaaauaugaaauugaacuccuguaaauaagagacaaaaugggaacauccugccauaaggacaggugaguggauacuuggcccaagccuuccugcuccucaccuuuugaauuguuuacuggcuguuguuggaaacucuugcccugcauccuguagaacucagaauuucuucagagaaagugacugaauguaaaauuaaugcccccccccauuguuaaaaggaaacacuaagauuugccuuguuauuuaugcuuauaaaugaugugacaggguaaauauugacuugacauuucucagaaggauuacaagaauucagggugguauauuuguuuuagacuacuuauccaguuggcauguccuuacaugggcauguacauuuucuggaguuuuccuguagccuauguauacuuguccacgggucucaguccuuugcuguugucaaguaauaauauggaauuucccuuucaaacagaaauggacuuuaaauuuuuaaaguugguauauacucaggguuaggcuuaugguuuuuaaauaaaauguuagcagucaguucagaaauccacagauggaaacaucgccaucuuugcuucuguucccuugagauaauuaugacuuagaguuucaaaaacuucuguagguaugugcauaacauacaguauacgcuauauguuuucauauauguuguauagauuccuuauauucguaaucugaggcugccucuggaauucccuuauuacuucuuguggauuagccauauuuuaauuuuccuuacuuacccuuuguuguuucuaguucuuccuuuugcuuuuacuguuccuagguuuaagucuguuucuuagguuuaagaauacuguuuuuaauagcaguauuuaauaaauacuguucuuauauauaaauauuuuuaaaccuguaguaucauccuacacaucuuuguuuauacauaauuuuuuacagagugaauuucuauaggugaggaaguguauauugagccucccagacacauacaaauguggcaguuguuccauguguuugcuaaaguggcaggauucacuuuucaagcauaagcaguagaguuaugguuugauuccagcugcuucugacaguggacucucuacugucuguaaagccuacagaacauguaugagccuccagcccuucccacacuaaucguagauugcuaucuuuauaguuggcuauugagaaacggcuuagguauucauuaagcaaugaaccaccacuaaaggacaauuugguaaagcaaaagguaacuagcaacagcacuuuuccugucugugaggaggcugguuaacccugucccacccaccuccauacugguacccacagccggguccccacaccccacaccuguugaaaguaccuuacacuguguuaaggcuuaggugaggugaaaugaaugcaguggguggaccuauguguuuuaugaugggcauauauuuccagaacaaagaaaagagaaaaacuaauuuccgucuuuguaucuauuuccauucaaagcuuugcuuuuaucauuaaaaaaaauuaaauuuagguaaaugaacagcaugggccugcuugugcuuucugcaucgucugacauggaaguagcaugaaagcuuugguuacuuuuuuaauaaugaaaauuugguuugaauuaaaauguaaagcccauacagaagcuauuaauugugcugucauuccauagacauaacaggugguugggucaggccacucccacauccagccucuaccccuuuacaaccaugcaucacacacuugcagguccgcuggucaaaguguaguguuggacguggaaagaccucuugugcccccuuuacuguagagguacgguuggggaaagccagcaaggaaguuaggauucaggguuuccugcuugauguugaugguugucaugauaacuuuuacccuggcuucguucccugaaaguaacuaaauaauaguugaaggugugaacuaucuagcacuguggauucuuaagaaauucgagauugcucuguaguuuuuaagggaaagaacucuaaauauuuuaaaauuauauuuuauucauuuauguaugugugugggcauggacaugccauggcaaacuuguggaggucuccucccacaguguggguucuaggcaucaaacuuaggcuauuggccuuggcagcagugaccuuaccugcugagccaccucaccagccugggaaagaacucuaaauacucugaagcucaggacucgguuacucauugugguguuuuggcaggagaaaugucccccauaggcucacauaguugaacacaugauccccggguggcguugauauuggaaccuuugggaggucgaagcuuguuggaggaagucuucagugaggauggcuugggacaggaucucucagcuucuugcccuggcucucugcugcuguuccuuccaucccacuauaggcucccucuuagaaccauaauucacuuuuggucaggcaacagaaaaauaaucaauacacucauugucuugauguauaaugcuugcucuucuauauggacuacguuuuaggcauuggaauaguugccuggcuaacuauggagcuacgaguugcgcuagagcuuaugauuuaauaauuuacuuccuaaaugaaaaauaauccaagaaguaaaauuuugacuugauacauugguauauucuuuuaaauuaggucaagccaauuacuugucucaucacuacaguguuuuacauuuuguuucuuaaucuucucacagucauuaguuagugguaaaaucccaguguagcagacaaucuuuguccuccucggcccaaacacacaugaagucuguagauauugcauuuuagaguuugacacuaaaguugagauagucuuauuuauuaaugucauuuuaacccugauaguuucuuuuuuuuuuuuuuugaaguucauuuuuuuuuccauuuuuuauuagguauuucgcucauuuacauuugcaaugcuauaccaaaagucccccauagccacccacccccucuccccuacccacccacuccccuuuuauggcccuggcguuccccuguacuggggcauauaaaguuugcguguccaaugggccucucuuuccagugauggccgacuaggccaucuuuugaugcauaugcagcuagagucaagagcuccgggguacugguuaguucauaauguuguuccaccuauaggguugcagaucccuuuagcuucuuugguacuuucucuagcuccuucauugagggccaugugauccauccaauagccgacugugagcauccacuucuauguuugcuaggcccaggcauacucugacaagagacagcuauaucaggguccuuucagcauaaucuugcuaguguaugcaauggugucagcauuuggaagcugauuaugggauggauccccggauaugguagugucuacaugguccauccuuuuaucucagcuccaaacuuugucucuguaacuccuuccaaggguguuuuguucccacuucuaaggaggggcauaguguucacacuucagucuucauuuuucuugaguuucauguguuuaggaaauuguaucuuauaucuuggguaucuuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuauugaggggcaucuggguucacccugauaguuucuacagugggcaauggccacuggccaaguggaauuuaggugacuaauuuguaauguugauugagacagaggccaccuuuuaaauugguuauguuuguuuguuguuucuuuagacauucucugauaacccaggcuucguacucaccgaguagccaagguuaaccuugaacuuaggugugcacccucacucuuguuaugugguacuaggaccuauggcuucaagcaugcuagaggaguacuguacccacugaguugcaccaccagcccuagcuguagggaauucuaaucuugucuguauaugugugcgccacaugauagguugguuuagaguuuaguucuuugcauuuuaugugugugaauguaugccagaggucaaaacacaacccggaggaguugguuccaggcaucaaacucagagcaucagguuuggcagcaaguguccuuaccugcugagccaucucacggaccccuuaauugcuucuuagaaaacaucauuacuuaggaaaauuacaacacauagcccucucacucccacccagccuacaugugcugacauuaggcuaccuuuggguuucaucuuugcuguuucaguaauagcauucugucaucuaacuuaauaacuaaggaucugcuguuuguguauguugaaaguuugcccuaauauuuauggcuguuacaaauuacuuucuauucaccuugaaauccauuucacccuucuuccugggaggguuuggugauggaacauaauacccuucagagaaagaaugcagucaguuacuaaagccagccuugaguaucauagcucuuguuaauccucuuuagggugcaggugcugcgcugggcucugacaggucagguagccagaugggugaggaagagaccccaaguccgucuuuugccuguggguacuguuacaguaacaaaacuaaaaaugcacgucacuauggagcaucaacuggcuuaacagagaagguugaaguggcaucugauacgaugccuuguuucugacuagcccagagugcauauuugcuaaguugagguugacuugaaagggaaagcugaugauugugguacuaacaauauucucaaaguguuuaaaccuaaaaugcagacuucuauaaaggacaggaugauuaccaaucuaggcuuuugugggccucaaggauuuuugaagugcaucaccuucuucuuuaaacagucccuucaaaacgugaagcuaaauaugucugguggugcauaacaacuacuuaggaggcugaagcgggaggacugauaaauucaaggcuugccugggcuacauacugacucuaaggcaauaagugaugcccuuucucagaaagcagaggggaaagcuuagugguagaguguuugccuagcauauauugaggcucugcauucaaucucuucuacuggggcuauggaguuaggggugcaggauauucuagcuucuccuagguuauacaaaaauaggcuauaggcugaaguuuacugacaccuauguuaacuugauacuuuaagguuuucguguguaauuuguucuuuuguguauguagauagauacaacaugugugaacauugauugugggcuccagaggacaaccucagcugucauuuuuugugugccauccaccucauuuuugagaccuuuuauuugaccccagcacuuacuacuuaaggcuagacuggcuggccagcaagacccacagcugaccucuuugugucuccccagugcuacaaggacaugccaccacacgcagucuuucacaugggugcuggagauggaagucaggacagacuaucaucuucuuaguccuguauguuuucuuugucccuccccuccauggauuugauccuuaaaaucauaaacuggcuggagacggauagcuguguuccuguuuuccucuugcuuuggcaagcuaauuaguaguaucuguuuucccugggcauuguggugugugagcaggcuuuugagguucuuugggguucuggugaauuacccaaaacacuggugucucaguuuccuccugaaauuaacccugagacagaguuaguggagguagcgccuaacacagcuuccacuggugcacaggaacaguggcugcuccucuguccuccugccuuuuuucucuggcuacuucagccugcuaugcuuuguguagacagaaagcaguggauugccagcuuuacaauauaguuuucuucaagugaagcaguuuugaagggaaccaucuucgugaaugcuucuaaacauuucacauggagucuugucuguaacuacacaccuuuuacguaguucugacuugggcacuauacacuguuguuaauucacauugucuccugggucuuauuuucagugguaguuccauuucucuaccacuuauuuucagaggaagcuguggccauaauuccaacuugcuccacagucuuggcuucuuauaaauuaugauuuuaagggguucacuuugaaguagaacuggcagggacauagagggguucagugugcuuucaggguuuauagcugcaaaguaucuguccuugcugcgcuccucagaagacagacucugcccucuguccaugggcuuguaccucugaugcagggugcagguguuauauagagcucauagcucguuuuauagucugcagaucggcugcaugugccauuuuggauuuguggugauacuguguuaauuguagggcccuaggaaugcuuaaacaaguguucuacauuccuaguccugcuuggacuuucagaauagauguuuacguguguguuuuguucguccugggggacuguuaggaaaaaaauuuaacucagguucuauuuauaugccaaccagcaaacgugaauugcaggcuccagaccagccccagggaguacucuagucagaagaugaguuuccuuccuccuguugccuuagagcagcugcugcucuuaucaguaggaccaguugcuuguuugugguuuccugcuaugucguugugcaugcugcuccaggaacagcaagaucuccaucccuucuugucuuucauugggaucucucaaccuccuuaaaaaagggaggagguggggaagguuuugcuuuuauggauaaguccuugaaauuuuuagucuuaugacaguuggccuuguuuggaucuuguuaauguuuucuguuuugcuuuauuuuauauuuuuauuuguaugaguguuuucccaguguuuuaucuaugcguaucacaugcaugccuguuguccaaggaggucaaaagaagguguugaauccccuaggacuggaguuacggauuguugugagcccccauguggguacuggagacaaaacccugguucuuaacugcucuuaacugcugggucaucucuccagcaccaguuguuuuauugauuacauuuaaaauuuuuauuugauguguguguguguauauguguguguacuuagaggugacuuuguagaugccauaguuuauauguggaggucauaagaacuugaggaaaccaauccucuccuaucauauggggagggggcuguuagauuuagauaucaggccaaguagcagugcuuuuauuugcugaaccauuugacuagcacuauauuaauuuuuaaguuuuauuaucuuauauaaguggguguuuugccugaauguaugucugugcaucauguaaugcuaguagagggugucagggaauauccugaaauagaguuacaguugugaguuuccaugugggugcucagacuugaaucugggucuguugaaagaacagcuaauguucuuaaucaugcagccaucucuucagcuccuauguaaauauucuccuguguuaaaauagcacaguuuauauauauauguauauauauguguacauauauauacauauauauguauauuuguauauuuuguggcuuuacagguauaaguaacaguucaaaacaagaauugucaaacucuguagguuuguuuuuuagacaucuuuaucuaauuguauuuacauuuuagacauuaaagaacaauuagaaaacauuucaauugugagagguuuauugcaccacaauaauauuuaauuacuuagacuauguuucugugcuuagagauuucuucccucugugauuuccagggaaccacuaacuagcugcagaagauguauuaagaauauuccuuuuuccugggccggauggcucaugguuuuaauagcagcacgggagaggcagaggcagugaguuugaggccagccugguguacaaaguucagggcagccagggcucuguuacucagggaaacaaugucucaacacccuccucccuaaaagaacauccuucuuggacacuaaaagugcuugugaaguuuguuguguggcugcccugcccaguggguggguaaggcucuaaacaggugacaaauggagcuuuuacccugaagagguuauaggcugguagagagaagaggacacuggauacagacugaaaaaguaacagauaauggaauugugauuacugaaacccaguaggacuucccucagcaggucaucuuggcuuacuucuuaaagaaaaaaauuagagcaaggaagaugccuuuguagugagagcagcaguucaaaggucggggaaggaaggugcuugcgugugagcucacgugaugaacuagauuugcacagggcugaagcacuagagaagucucucaacaacaugauaccuucaggaaggccccuuggucccccaggaagcaaaaaucugucagugcaguagguaaucucugaaaaagcacugugggccagugcucaauagugaugcaaaaacuggaucagagggaagagaagggaucagaguaaagacgugguggcuagacuugaaauuauucugaauucuucaauacaaagcacacuguagucugcucuuuccuucuuuauaaucuuuuuuuuuuuuuggucacuuuuuaacuuuuuguuuuccuagauaaacuuaguuuacuaaguauaugggaacuuacaugagacacagaacuugacugacugaauuucagauucgcuagccaugggacaggucuucauggugauuaccucgucaucccccuuccagucuuauaacuccuuuuacugcuuugaacccaagucugcauuuaacuugguuggaaauuguaccauuaccaucucugguggcaagcuauuguguuagcacaauugacuaagaaucugguaagaauggggauguaaucuuagcugggaaugguaguagaaccuuucuauagucccaguaaucugaagacagaccacaagauugcuaucaguucagggccagccucagccagaaagaaaagaaaaauucuugauacuuaauccacaaacucuuauuauuucucuuguuacuuucuccuagagugugugaugccuuuaccuucuuuccugacuccuauaucuuuccauacccagaacuggcaccuggugaauaugguugcaguaucuuaugcagagaaguauugcagagagaugcuauagcaagacccuuauguucaccaaagcuguguuguuuccuauaacuuguccaguuaugaaaaugugcuguuguagacugaguagguacuuauaaguacacuagguacuucuaauaggguguggugauugagggaaaguuccucacugcucuuugguuuggccaccagguaaaaucguuguucuguucuaaauaccaaaucacccucuuaaacauuugcuacgaaaugaaauuucaaguucucagauaauguaaagcagagacucagggagaggcacuuagaauuuacuguucccuccuguguggauguaaaauaggagaagugugugaaccacucuccccuccugacaccagaccuaccauucagccugcugccauugagccacugggcucugcuacagaagucuuuuggauucugucuccuuagucguugcuguaaggcuuuaggaaaccuugauggaguggcuuacagugcagaugcauugugaugugguguugcugcuacggugcaaugagaguccuccugaguccagucacagaauugcaacucacuccuucagucgucagaacccacgauuguguuaccaucucuugacaggaguucccugucugcuugguacuucugacugaccagcaguuggcuaguucaucuuuugaguuuguagagcuaacagcuugcaugacuggaucuucacacucagcuacagagacaguuuucuuggaguguaugugcuucugagaggcuuaugaacuuggugugugucucccccaccccccugcuuacuaucuaaccaugcguguucuuuuugcauuuucuuuacuuuuaauuuccaaccacugucucucuggaugugcuggcuuuugaaaaaauagucgguguggaggaugaaucgaggaaagcugggggucuugacaugaacgaggaagaaacccgcucucuuaggccaugggcuacagaggcugaucuagucuucagugucaaagaugaagcauacucagaagaauugggcuaggacagugacggugacucugccucauaaugggaauacgucgucuucccuccucacccaguuuauacacaggauaauguugcucagucacugagaggccugacucuggagccagccugcuugagucaguuccuacuucacgggaggguugugagaauuauagaugcuuagaucugggccugggcuauauucacugcuaaauaagugccauugguuguauuaaaagcuagaaacaagacauuaccuuggacaaucuguuguauaaccuccuggcacauauguuuacaugugauuuuacaaaccucaucugggacguuacucaucuuuuucauuuagaggauauuuuugauuggaccauggaccuugcacaugcuaggcaagcacuguaccacugagcuaccccagugcccucuuccuacauguuauuuucagucaggccuuuacuacagugguccaggaugacuuagaaccaacccacugugugguccugugcuuguaccaagaggcucagcuuaaaauuuuuaagugacuacucaaguguugaagagauuauuucacucaagaaagugcauuuagauggcuucuaaaggauuguucagccuuagauuguaugauccuaccaucccugauaaauuucuuaagugauuugaguugagagugcuucuuugguggggagugcagcaggaacaaauuuaaugaacaguuaaaauagucugguuaccucauugacuacuuuacaauccuguuugauacuagguagccuuuagacaagcucuuuugguguaucuguaugauuagaauugguaacagccauacaaggcccuucaaggguacagggagaguggacguggcaggggaagccaaaugcccaccaacauucugagucacauaggguugcaccugcuuuuccacucuaucuccagcuucuuguggaaugagcaugccugcaggcaacccuuucuacugucaaacugucaggcucugauguaacccaaagagaaagaugcaugaacaacacccuaaauucaaguguucuucuccagcucauucagucugauacacucaaguuccugcuguaauuaauaaaagcucagaaccuuuaaacugaauuucucaguccuggccuggaugauucuuuguuauagagguuacccugugcagaguauuuagccgugucccuggccucugcacccuagcugcuaguagcaccuguccuucagucaccacuaucaaaaacguuuauaagcacugcuucauguucuccagggaccauagucaaccacuggucaguguggcgugugaagggccuccauauucaucuuacucauuugcugugaugaccucauguuccuaggacuggauaacgcugcugcucccuguccucccaccgccuuccccugagcuuggccagcugcaacagcuugagcuuggaaacccucuggauugucuuccauugucgcugccaacagccuucuguuccucugcaggcgucuggcuuaucuccucuagccucucugggaaggggguaggaagaguacaggcaugaugucauuugccuucccaggaaggguggaacaaaggacugggucucuagagacaguucccucccucuacugggccaagagguagaaucccaccccacccccuuuccugcuucagaaguguguuguugugcacauacuuuguuguaggaugacacaucagcuggccuggcuuugucccugcccuuccucuguauaggauguuguucauguccaguccuuggauagaaguuuucugccuuucucaguguggugggagccuuuuuuuuuuuuuuuuuuuuuuuuuguacccuucuucaacuugaaacuggagaaaggcacagauaggaagaauuaaaccucuccuucuuuuuacuuuuuaauuccuuucccucccccuuucuagagcuucugagguacacugcaguucuggggagccucuuaugcagauuuggguguggcuauucgagcucaguuuucucugccuccaccccuggccucugucucuucuuggagcauagggcgugggauugagcugucacugcggggcagggcuucugcugauucugaaccugaaagaagucaccaggguuucuuuaaugugugaguuaccccaagggaugcugguaacugugcaauaacauacuuuacacgcuagcuuauugagaaauauuuuaaccuaagcagauuucuauuuugaucaucuucucuucauagauugggugcgguagugacuuugaaccccaaaccuucauuaauagccuaggauagccaucaggauaaagacauuuucagcuccuugcagcauauucaagaaaccauaauuuuaaagaaauuagaccuaaagauauuugaaugaggaauuauuagucuucuagguacagucuaggaaguaucccucuugacaugguccagucuacucuuucagaacagccaaacuuuaagcaaacaacaacaagaacuacacuugccauuguagugguaaaguuaccauucauaaugacgauuguaagaauaauacaugugaucucaaccucucauaguauuacuggcauaacuccuuuugcuaugcccuuaacugccuuuucuuccuucccacagccccagccauucuguuucuuuguuucugauuaguccuuauccaugaagaaaggcccucuuuuggauggauaggcuuuagggaaagacuggaccucaaagaacugcugacugcagcaggaggcgcaggugucuuggcaggugcuuggcuuggaguacaucaguaaaagcuugcccaguauggucucugccucacugccuuacuaugcuagguugaauggaggccucagcacagccuuccagauacuagacuguuuacugcuccccugaccaaucuaggagcccaguacacacugacuauacagccaucaguaggauugaguuucacacacuaugugcuggguuuuuuucaguacagcaguuguugggguuucugcuuauuccaucaaguuguauguuguaaacguccauaaggcaaguuuguacuaggaguagggcuucugcucaaaggggcccagcuagcacggucagugaagcaugacgcucuuaagcuccagggucaugguuucaagcugcacagugggauccaucuguagcagugacuuaguuuaacugcuacauucugcuggcugcaaaccugggaguugacuggugcaaggguuguccaaaucccaguauucccagacaguagagagcuaaguggggguuugguuggaguuuaguuuugcugaugcacucuugcugugugggccguggggcuuugcuggcuugcaccugcuguugccagugcuugguuguugguaaagugaguucuccucugcuuacagaugagcgugaagcuguacagaagaagaccuucaccaagugggucaauucccaccuugcgagaguguccugccgaaucacagaccuguacacggaccuucgagauggacggaugcucaucaagcuacuggagguccucucuggagagaggcugguaagcacaaucaaguggggaaacauuuuuugaacaaacaaguaugggcuugucucuuggugaauucugcaaugaagaauguuuucuggaggagggcagagugaaguagauaugcugauucugggcgguguaauugaaacaccgagcucugagggugcaauaauguucuauaauaauguagccuccuuucugggaugccuguguauuuuguaaggaagacccuaguugaugguucuauuacgcacagugcuagcaauggaagggccaggccuggaugcuggcucugagaugauucugccgcuuacaugagaccauggaaggggcucuaaauuuaugucuuauugaugauucuuuggaaaaugugagcugccaucucaagguggcacgacucaaauccaguggccucugccaguuuuauuuuuuuauuucccucuuuccuuuuguuuggggguggggaagggugaugguacaugcugauguuuuuguuaucuccuugggaauggagcaucugauaaacuuacccugcucuucugggcagagaaauuguuagcucgcagugaaaacuguaugucugauuuuuuuguuuguauaccuuaugccagagaagcuugcuacucacugugacugacccagcagguuuuggcucgccuuggcuugaaagcauaugcccuauuuuccacccagagcgcauguaguuccauaggugguagugcaucugagccaaccugaugccuagggauagagccccaaagcuguacugacaucgacaggaaaauaugccagugguugcuggggcugccagaagagccgcuuauuuaacuugacagccacagcagaucuuuuugcagaucagugcacacaccucugacugcugguaagagacuagggcuuuguuucccucucuugagggucugugaacaaagcugcuucuuuaaacaucaguaaaaaugaagacaguauuuucuuuccccgucccucuggucaggaacaggguguugccuucaaaagauagucaagccuccucuuaucuuuacggaguucugucaugcccugcauucccagagugcagacgucaccaccucagucucaccgccucaguaagccccugugcagauggcuucaggauggugguguuuuuguggagccauggucccaugcugggaugaagcaaaacaguuguuuauugacuucuucagggagacuuguuuuagaaccuaggcuagaguuauugugauaugcaucuuacagaaaguaggcuuuauaaccagacuuuucuuuuucccaucugucaaaccuuuuccucccucuuuauuuaacccuguagauauauuuacuucuuuaaccuuguagauuuguuuacuuuuuuaugcuuugaaaugauagcuuugacaaaaugauaaaagaucacacagauagggauuguuuugaacacuuaauuuuuucuaguacuguccagucuuuuaggcagugugaaguaaaauguuuaccuuugcauacccagagcucacgaagacugauggugaugacaauaucaucauauaauacaugacuggggccucaccugccuuuaucuaaguagagaaaacaaagagaggggguuguuagcuugguugauugguugguacugguugguugguuucaggacacaguuucucuguauagccuugacuguccgggaacucacucuguagaccagauuguacucaaacucagagcuccaccugcuucugccuccagagugcuggcacuaaaccaccaccacccguuuuuguguugugagauagggucuuuuauuauagcccaggcuggcuuagacauaauaacaaucuuccuaccucaaguuuccaagagcagagauuacaguguguaccuaaaucucuguuuguaccacacacacauucauucucaaucucucucucucucucucucucucucucucucucucucucucucucucucucucucguuuucuagugacuuagaaaucuaggagacuagggauagagaauagaagacaccugucaccuccacccucucaggcagucauugucagaauuuuguuuucuucuuugauuuauuccuaacagccaucuuuggcuauagaauggacagucuaauuguucauguucuagugagguaaugcugacuugggcauucucucucuuugguguaugggauucuggaagagacacaaaccacacucuuauccuuggcuccugaggcuguuaggauucagugagccccgaaaggauuccugcauauucagauuccaaagcuuccuguguuaguuaauggccaguuuacucugcaccuucacucuaaacccuggagaaacagacaucugcagucugucugcagcccugucucaguuacuagcauguuaguccuuaaucguccucacuagcucagcagggaauaguagacaaauguuugaaagacuagaauuuacaaguuuacuuucuuaaugaaguuucagguucuuuuacagaggggaaguucuauauguauguguuuuuacugagugaaccugaaaaagggggaguuaguuaaugauccugaacacagucuggauuuagccuaacaaagugaauuagauacauuucaggggcuucagguagccaucugccuugccauggaacuugauucuguucuugagaagagaaauccccccuccccaccguaggauuggcccaauauccaaaauguucuucccacacccucaugucagguauguggucauagagcaaucagacuauuguugauugggaaucagugaaugagaaauaaaaccauuccauuccagugccuuguucugcaaucacuguagacuauaacucuucaugaugguuguauuucaaaguucuauuaaaaauauagacuacccuuuacucuagcaucauauugccaggaaaaaaugugaccacagaaccugugccugacacucuguuaacugacuugaucucaaggccacgugagauugggaccaaaguauggaguuugaccuaccauaaaaucugcauuuggagcuuaaugucauugggguugcaauuaaauggugaaguuaugcuaaaggucauaaccgaggucagaacuugccuaugguugcaacccuuccaugcuucugugacaaagaaaaauuuuagggacgauagccaguuuucugccuugcuguugccaggagugaucuucucugagugagguaaaucuuuccagagacuugggucuucuccagugccugcuguuuucaaucacagauaucauuaggcuugauugccugcugguuacugauuuugccuuuauuuuuguugucuuacuccauuaaucagucucuuagaagaaaaguacacacacacacacacacacacacacacacacacacacacacacacacacacacuguaaguauuuuguuuuguuuuguucuguugguuuugcaaauauuaauuccagaacagcuugagcuaaguggagaagguaagauuucaugugagauuuaagccuauaucccacauugaauuguuuagaaugaacuuuguuuuuguuuuucuuuucuuucuuuucuuuuccuuuccuuuucuuuucuuccauggccuuuguuaagugauaauaacaaaaaaaaaauuuuuuucuguuucuauuagagacaguguuuuucuauguagucuuucucuguagaccaggcuagccucaaacucagagaucugcuugccucugccuccugagugcuggaauuaaagacuuugcaccuccacgccugucuuauguuuuuuuuuuuuuuuugagacaagaguuuuguagacugaucacaaagccagcuuguuuucuaaguauuauuuguaaaugggaaacuuuauuuuguuucaaacaagccgccauggaaaaacuuauaccccuacuaauuuggggcgaacuuaaauaaauguagaaaauaaaauaaugaggaaccauauacuaaggugccagacaauuagaggcaaagcccugggguuagacagaaaaggaaagggcucuuuagaugagggcucaagaaaccuuagguaguugaggcucagugagacccgggaggagcaguggcucagauaaguagccagaagauaggaagucagguuuaucuaggaagaaagcauucucugaagcucaagcugugauagacacaucaguaucacgugaugaagguuuuuacuauaaaaagggguuuuauuagaggacugacuguacagcucaaguguccuguuuaguuggaguuucuuuaaaaaaaaguuguguauguguugguguguggcagugguggugggggguauggguguuuuugccugaauauaugugaaccaugucuguguuaccuauggaggcuagaagaggacaucauaacugaagauaaagaugguugugagcuggcaugucgguguugggacucugacaggcagugcucauaaccucuaaacuauccuucuagcccuggagaguguauagcuuugagguugacaaacuguugguauggguaugagaccuuguguguuaaucaagugcugcacugcucagcaguguacugagccugcuuuauuaugguuacuuugaaacagagucucaauuaguuguuuauucuagccucgaacuuaggauccuuuugccucaauuuuuaaguagcugggauuucagucuugugccaccaggccuuauaaacuuuaguacugacucucaaucuuaggucgugcgaacaguguuauuuaccuuugcaguggcagcaguagcacugagauucauuuggucaaaugaaugcacacaaauuuuaguuuggguuugggcacaaaccaugacaggcguguaugauucaggauaguuccucugcccuucugaguaaagugucuccacucuguucucuggcuuucagccuaaacccacuaagggacggaugcggauccacugucuggagaaugucgacaaggcucuucaauuccugaaagagcagagaguccaucuugagaacaugggcucccaugacauuguggauggaaaccaccggcugacccucggccucaucuggacaauuauucugcgcuuccagguaaggagcuuggccuaaagaauauagaccagcuuuccacauacgagcuuucuguuccacaggaaccaggcugaugccacccuggaggaaugccagagcuaccauguucuuguacauuucacugccccuggcauacgugccuuuccugucuuaaugggacuugguaauauggguuccuaagguguaccucugaacaucugaucucugcuguuuggcuuucaguagccaaggucaagcaguauggcuagugcuggguacuucuaggcuggcuagacuuugcuaaauuguggcccguauagaauaggggcuccguucucaccuucucaucccccuugggguggaaaggagcaguuuucaggaggaaagggccaaaaggccuuugaugaauuugaauuggugacuaugugauggaguuaucucuguauagaagcgaguaugagauggcuccuuaauccgugcaacucccucaagucuuggguacaguuuaggcugccucggggccagggggcccaggaaaagcacuucuguuuaguccuggcucacgauccaggcguaugcuuugugcucuuguucuucaguuacaguuugaagugcuggacgcuugcugcccuggugucaaauuacucuccacacaucucccagaaguccugucuuuugcacaaguccuuguguccaaaauaaucucacacaagggggggauaaauaaaaaucaaaaacuaaauuuuaacuguguuaguuuuccuguucagacucugaaaccagccuguaaauaaugcuuuuccaucccugcugccuuccuaagauugauagcuuccaaugaacaguguucuagacgucucuguguaaagagggagaguuacaaagggagacaacacagacuugucaucugucuucacugcugcgguugagaaagcaucuuaauaauucagauuccaaggcccaguuccaaagaguaucaguaggcuaaguggggaauuacuguugaagaugacauccauugccuuggccuacauuaacgggaacauggauggccauucugaucguggccccuugacagaggaugaaugcccgugucagggagcuggaguacacggucuuuuucagacuucuuacagugaacuaaguugaaaaaacaugacuguccauuugccuuuucuucauucaccucaaccugcuaauacauacuuucuccucuuaaaucaagaagcaaaggcugcugguauuauagcuggcguugugcaguuucuuuuacuacauuuauuuuacugagucauugguuguauucucaccucuugucccaaauuuaguuaaaaggggcaagaacacagacuacaguuaggaacauuuaucuaaaaucauauaacugauggugucuccuaaccccaagaacuaacauuuuuagugggcaugguagaacauuccuguaauccuggcauuugggcgauagaggcaggaggauuggaguuacucauucaagguaguuuuccagugcauaauuugaagccagcuugagaucccaucuaaaaacagcagcagcaaggaaagaacagucaaccaacuaaccacaguagugcugugagguagccacuguugccuucccugagauggaaaagcugaggugcucagguaggaaagaggaccccuucagggcccagugguccuucccauguggugaaaggaagaaacuaacuuccacauguuguccuuugacuucuuucauauguguucugugauaugcacaugcuguuaugcacagauacacaaugggggggggggggggaagcagagagaacacauuuagucugaccaaaagaagggagggagaaaaaaaagaagucauuuagcuuaacucugguaccauuagaucagacuuuuuguuuaggauuuuacugcuaugaacagacaccaugaccggggcugcucuuauauaaggccaacauuuaauuggggcuugcuuacagguucaaagguucagucuguuaucaucaaggcaggaacauggcagcaucuaagcaggcauggugcaggaggagcuaagaguucuacaccuucaucugaaggcugcuagcagaagacuggcuuccaggcagcuaggaugagggucuuagagcccacacccacagugacacaccaagcauauacaaccaucacaaugucuaauguugaacuugugaacuuacaaaauagagagcguggaagcauagcauuuaacagguucugucuaucuuauaggaaaugauacauaccgugccuucagcaaaauacuuuucugguuucuaugagaaaccacccacuagcuuguaguuucaaagauaugggccccaggggccauacauggccucuucauaggugcuacggaggcacucguggaacaggucaucccccuggcuuuguguguagaauaagaaaccuaguucuggaagguccgaggugagccugacaguucuuacugacauggagagcagauaacgugcagggcaagacuucgaucuauuucauauaaaugcagaccuguuuugcaguggcucucaggcuuauacagcaguugggugauugccuaauauuucuucuuaaacuuuagauccaggauauuaguguggagacugaagauaacaaagagaaaaagucugcuaaggaugcauugcugcuguggugccagaugaagacagcugggugagugugcacuggaaggacacaaggcaucuccaggauuaaacacaggauuccagcacuaggaauccuccaggauuaaguucccugucgcaucacugcgaaggugcugacaagugucuuuucauagcuuccacugagaugucuuguuaccacauaaacaguugguaugugacauuucagaacuggcugucagaguggaaagaggugugauuuauacuuggaacagaucuuauuuccuuaacggcugcauucucuuuaucggaaagcuccacggacaauuagaucuuaaauuauaaaauucuugaagcauuucuuuuuuuuuaauuuuuuaauuuuauuauuaauaccuuauaagccuuuuuguuuucuuuuuuuaaagauuuauuuauuuauuuuauguaugugcauacacuguagcuguacagaugguugugagccuucaugugguauugaauuuuuaggaccucugcucccucuggucaaccccacuugcucggucggcccuguucacucaguuccugcuagcuccggcccaauuuauuauuauauauaaauacacugucgcuaacuucaaacgcaccagaagaggacaucggaucucauuacgggugguugugagccaccaugugguugcugggauuugaacacaggaccuugggaagagcagucaguccucuuaccugcugagccaucucgccagcccuuuuagagcauuucuaagaagcaaacccacauauuuuuuaaaugcauuugggaguuuucuccuuuuaauuucugccauuugguaaacuuuacacagcaaacuuagaagcaguuauuacguaagccuguccugguuuuccuuguaugcuuucacuaaaacccaauuuggagauacuuuuacacaacugcaacuuauugcugcuuacugacauugugugaauucagcuauacuaaacguguaacauggcucaguuuucagcucucacugcuuuccuggagaacccagguucuguuguccaacacccaccccgguggcucacaacugcuggaacuccuguucccucaggagucugugggccccuucaugcacauggugcucauaaacuuacacaaaacacacacauacauaaauaaaauugaauaaaauacauauuuuuaaauccuguaaagugcugaugaaauuauuucagaguccuuggcucuuaaugagaaucaguuccuugucagguuaauuaguguguuacucuuaaaacuaccuuaccuuggggcuggugagaugucacagcagguuaaggggauucaguucacaucucauggaauugaauuaccaagcacuugugaagaaauacagcuaucuauuuuauuuuuauuucaagcaaccugaucuuaacgggacacaugcucagacaaaauugucauuauugagacaugaccuugaguuuacagugaacaugaacacaggcuuuuuuucuuuuuuuuuuuuuuuuuuuuuuuuagcauuuaccaaggcauaaaccuuuauuugguaauuguuguuuugcuuuuguggucugucuuugacagguaccccaaugucaacauucacaauuucaccacuagcuggagggauggcauggccuucaaugcacugauacauaaacaucgguaagucugaagaaaucaugguaaagguagaaagauacaguaccauuuucuguggcagaucuggauuaguugugguaucuccugucuguggguuggauauuguaccauaguggaaauuccugcauucauauuagggagaaugugugaguucauuauucaaaaaccauguaucauuguuugaugauuauauaauacuguaauuuuacuccacuaugcuauuauuuuaacauucucuggagcaguuaucaugccucauuagacacuugauuuguuuccaaggcauaauguuuauguuccacugucauucuguauaggccugaccugauagauuuugauaaacugaagaaaucuaaugcacacuacaaucugcagaaugcauuuaaccuggcagagcagcaccuuggccucacuaaacuguuagacccugaagguaaggauccgagauaugaaaggugggacuuggaacaucucuagcauguaaagucuucuuuguguuguacaaaggugcucuguguguacagcaugccuugagaauuaucaaaagaaaggguagaaggaucauuuaaaauuccaguuauggcaacaguugaggauuuauagaaugaguuacguuuggccagacuuugaggaugggugugugagagaggacgcaaagguaaaaagccagaaaagcauugagggacucugugggagugguguaaagaauaacccuagggggaggguggccgucccucugcaggcuggaagcgaacgcuuugaggcuguuuagcaggcagugggugucacugagguucucagcaccugugcuuacugggaagccuagccuagcacccagugaacgccugugacugauguucaugagggugggucugcugagggugaguugaggucaagggcauucuuaggaugcuggagcuuaaagaagagaaugugaauggaugaaacagaggcacaguuuucuuaugauagacuguaucucaucuauguggagcugauugcuaggaucucugggucucugcagaagccaaagcuugucugcagaugacuaagcuguccucucuggaacagccuauauauauauauauauccucaucuaggucccguuacaaugugggauuucagaagaacuuuuucuaauuuugagaaauauuuaaaucauaaagggauuauuuaguuuauaaugcuagaggcuuagagauccucccagcuguaagcaaauauuagagauagaaauguaugugugugaaaguuuaaaguucuuauaaaucuagaagaggaaguugaucuccccaagggcaucuugaggucaugugacugccaagcuaguuuuugcuguucuccagugcauaugauuacaggaagccaagauacaauuaucuuaggcuaacccauuaagugguuuuuugauauaaaaaaaaagcuaaaauuccuugagcugugaucagucuucauguuuaauuaacuccuuccucaccaucagugguguuccuuaggucuagcccuuugcuagacaaaaauucuuucuccuuuuccuaauacacagacuuuuuauuaauaccauucauuaauuuuucugaucuuuagugagcauaaaagggagacugauauuucucagaucacaagacuggagcuaaaaauagcauuuaaugucuuguuuccuaugguuuuaaccuuaaucacuaguuguccaguauuccaaaggauaccaguugaaauguauucauugauuaacuuggaaauuuuugccuucuauuacuccagaaauaucaauauuuugugcuugcuaaauuagaugcagcacucucugucugucugucugucucucucucuucaaacccccucuuguggacauugaugaggaugaggacggaggacugugcacuagcaaaagcaacugcaguuggacucuuggucccauugcuaccuugacaacaaguggggcugggaguauucuauccugugcccuagaguuuucauguuuaaaauuaaagaaacuguuuuccuccacacuguacuauuuacagaauagaaauaagguuguguaugaaauguauugaaaaacgaaccugacagauaggaaacuuguguguguguuaauuuuaaucuguuccuggcugaguguuucucugaacauuuccacucccaagacgugucauuuucauuuacuugauucacugaauacacacugucccucuaccuucaggaauuuggaagguggagugguauaggaauccuacaauagagucuugacccuuuaggauuaaggcuuaaaagcaaaaacauaugaguaaauuauaucuugcagaaaguagacuauguauccauuuauacagagucccaaggcaggaagaagaaaguaauuuaacuacaggaauaagaagugcauguauugggguuguagcucuugagcugcuccuuuugagccaguaguaaaugugagugggagaaggcccuuucaggcaaaggcugguuguaaggaauauggaaguauuggacauacagggcauauaugagugaagaagcauauccuccuauggaauuagaaacaucuggaauaacgcauggcacuuagaaaaagccugauaaaagaacugaaggaacugugcucacgcuaaagggcauuuuguguucaugcuucugagggccagccuggguugaguggggcaacagagaaucccauugaggaagccauuguuuuaaguuuguuuaugugaacaggagagugugacauuaaaaucugucacuaccuggauucagguaaaaggagacaaaaguugucccaagaugugugugccaugggcugagcuguggugucugaccacagcccaguuugguuuuagggguugagaauaaggugaggaaacaagcuggccuucugcagaggcauuuguggauauccaugugcuaaaugaaucuggugugcugucuucccuguuggggaauuaacugugugauggcagaauuuucaaacacuaaggaguugcuggaugguuaagggaugcuggaugucguagcugcuuuugcugcccuggcggcggcaugacguguagcacucugacugaaccccucugguuacagauaucaguguggaccacccugaugagaagucuaucaucacauacguggugacuuacuaccacuacuucuccaagaugaaggccuuggcugucgaaggaaagcgcauuggaaaggugagcuccuuacacacaucagagcacaccuccugcacugcuucugagcccuuguucuucuaugggcuccacuuuggccaguagcaagcaguacuuaauaguaguagaaccauugucuucccaaagguagugagaagcagaaugaugguggggaucucuggaaaggaacugagaagagaucucagacacaagccuccugucauccuucacuggaaauccacuguuuaaaaucuaacuaaauuggcuucacccuggucaggaaauccuacagaccaugauuuuuaaaagccuuagacuuaggacuucuucaucucauguaggcagaguucacuggcuuguuuuugcuuguuuuguuuuguucccugucccccaauccagaaaucuuuuugcuuuuguagcaauuacagaaaccaucauagucuuauccuggggggguuggguggcuucagaaccaguuccaguugaguuaggcugccacugcucacagguaauaggccuagauugcaugccuuuuugcacuuaaguuaaaaugcucugucaagaaacagaaccacagaaaagcuggccauugcucgugugugugugugugugugugugugugugagagagagagagagauagagagagagagagagagagagagagagagaaugaauauguuaguagcauguguuccuugacuggugacaccuggguauugguuuucuaacccuuccuuucaggugcuugauaaugcuauagaaacagagaaaaugauugagaaguacgagucacuugcuucugaccuucuggaguggauugaacaaaccaucaucauccuaaacaaccgcaaauuugcuaauucacugguugggguccagcagcagcuccaggcauucaacacguaccgcacaguggagaaaccaccuaaguaagaggcagcguguaauguauggucguuaguaugggagcagacgugcagcagcccaaagacaccuguuuguaacguuggcgauuuccacuguuaacucagugucccuccuaguagccuguuuuccuucuugccugauuuguaguugcugagacuuguuacacaccaugauuccccugagcccuaucuaguagacuggaccguugacauucaggauaugugugagccgaagaagaacacagguccucagucccuucucaaagcccuggcaugcagugcucuguagauucuagaaaagcaacacagugaagccagccaggugugguagcacacaccugaaauugcaauacuuggggcacuucaggacgauccugaguucaggauuaauucagacuacauugcaggagcauuccucaaaagaaaaauagaagaaaaguuaggguauauauugauacauaguauauguuauaagacccuggacagauccgauaaaauauccuguaaucaagcauaugcugacauuaauacuguguuagguaaagacaguuaaucauugccuaucaguugagauagaguuuugcuaccuaagaaagguaauuuuuuuuucuuuucuucaaauguaugugauguaugcaccuguauauguuuggaaaugcacaacuguguucaagcucagagaccagagaagugugucugguguccuuacuaacuugagacaggcucucucgacacaccugaaagugcuagcagucauccucccacuaucaccagcauaguugcggcagcuuuuaaugcuggugcuagagaucuaucuguacuccuuacacuuguacagcccggacauguuaaaccgucucuccaacccccuaauuuaauuuuugaguuuaguauuuuaaaauaauuauuaaguaagaauuauggacuuuuuuccuuguuuacuauacuuccaaaguaaguccuuucauuucuugugaaaauucaguuguaaauucuuuggugagggaggucuuugaaaccaacugaaaauuuagauuagacauuugcuggcuuguucauccaccuuucugaauuaaguccauugcccaggacaguaguucucauccuuccuaaugcugagacccuugaguacaaguccuccuguugugggggacccccagccauaaagcugucuucauugcuacuucauaacuguaauuuugcuacccuugugaaucauaauacagagucgaaugugcaggagaucugauaugugaccccuaugaaaaggucuuucagucccccaaagggucaugacccacagguugagaaccacuggucuagagcacaagguuuaaaccaugguugagguuacuaguaagaauacucuguuccuugauguucucaaacaucaguccuagcaacaacaagcagccgcaaagcaaugcugcaguucccagguccauaaacacccauugacuagccugcugcugccccaguguacagauuuugcagaacaggguuuuagaauuccgugacuguaugaaguacguuuuucucuaauaagugagccuuuggucuugaaggaagaaggcacgggagugcuuacggcugguugucucuccucagguuuacugagaaggggaauuuggaggugcuccuuuucacaauucagagcaagaugcgagcgaauaaucagaaggucuacaugccccgcgaggggaagcucaucucugacaucaacaaggugaagcggaccugcacgcucaugcguugcccccccccuauccuugggguuuucucugcuugauuacuuuaggggggcaagaaaaugccagggucacucccagcaucccccuguagauggcagggaauagcagaagguccagcaaagaguuguaauaggucaguucacuggagcucugcaggcagugucagacuuugucaacagccuuggcccacaguuuaccuuguuacgcagaugcucgguuuaguccucaucuuugugaagcacucaacucagauguccuccuguuguauagagaggaacuggaagucugauuccacguguuuggaaugucuguggguuauaaacauagauguuguuucucucugucagaggaguuguuauacauaccggcuguuuucauuguugugucucgcaagccugcaaguagagauuuguacuguggguauuauuuucaaaugaaaacuagaaaaacuacagaacuguucauuugcacccagaauccuuugagcauucauugauuggauuuuaaaaaaaaauuaaguaagacauuuucgggaaugaauuuaaugucaggauuuugaaagagaaauucaggcauguucacuuuuuaaaauguggcuguggguggcgugaaagucaguucauuucuugucugugaugagagcugcugagaagaugucgucguguugcucauauccugcaaguguuugcuuccaagcuuauggcaggaccuuugaacacaagaguguguucccaugagacugugcugagggagggagaaaaauaucuuuuucucaaggguggaaauguuguuucccuuucaaguccugugaucuuuuggacaaauacuagcuguuguuguagucaaggacagcuccuugaaugcuucaggaaaccauguuuuuuuguuuuuauacuacugcaggccugggaaagacuggaaaaagcagaacaugagagagaacuggcucugcggaaugagcucauacggcaggaaaaacuggaacaacucgcccgaagauuugaucgcaaggcagcuaugagggagacauggcugagugaaaaccagcgucuugugucucagguucugucugaauuacuaaugcaaguguuucugagguagccaagcaacacuagcucuuuccaagaggccuuggagcucaggacaacacuuaacaacauccaguauugugacguugcugaccagccaucacuuccauuugcacaaaggauguuuaaaauuucugauauacuuucuugucuguuugucuaacuugucauagacuuaggagcucgagcaauuuguucagagccugugacugaauuguucacauucauguaagcuguaaaaguuccccugguuuuuuuccccucaguauuugaccaaccauccucucaaggcgugacacuggucaugaaauacaagagcaguuuucuuucccuuggcuugacaaaguccaacauacuucaguaucuuaagucagaugguaggcccucuguaaagugagaaguuucuuaaguacuguuaggaacacaucugaacucaaccagaaguuugcaaggguccaagggcagugagaaaccaguggcaaagucagcuuacgcacuguauugugcuccccccacccggcucagugacuuacguuucuuuauauuucuuuuuguucugucucucuguaggacaacuuuggauuugaccuucccgcuguugaggcugcuaccaaaaaacacgaggccauugagacagacaucgcugcauaugaagaacgaguucaggccgugguggcuguggccagggaacuugaagccgagaacuaccaugacaucaagcgcaucacagcgaggaaggacaaugucauccggcucugggaauacuugcuggaacugcucagggccaggaggcagcgucuugagaugaaccugggauugcaaaagauauuccaggaaaugcuuuauauuauggacuggauggaugaaaugaagguaacuuuugaccaaaagaaggcaggggaggccagagcugacgcagucagaccuucucuuugugggaguugugcgcuagugcucuuuguccagugaacucuucugcaaagccagacugaagccgcagugcucauaagcuggcuagcucacuacuaaaugagaugagcaccauggaaaaguuguaaacgaaaccauuuuauaucccagaucugacgcagugauuuagauuuuuaccaauguagagaaucaugauuuucuuuuucauuguuaauauguucaguggucuguguauuagugauaguguucuaggaucauauaugcaaauggcggguggugguaagcauaggccagggacuaggaagccagaauucagaucuuagugcuguaucauuuccucuccuucaaaccagccaaugcuuaagucugccuuguggccucucagaagcuggggugugguaagauguguccagguuacugugggacuggaugauaauggcugcagugcucuuuugugcuuucuccucugucccuggcacuucugagccuagauucaugccguugugccacagcccugugccuguugguuucuucugaugcagcaucuuuauugaacaguuuuugagcuggaaggcuuuuaucccuaauggcaaugggaugggauuuguaacggaugagaguaguguuuagaccauccucuuuucucuccaaacacgguguuucuuacguaagagaacucugccccuagaugucagucuuuaccugcucccugccucuuaaguuguggugacagagggacaagggcagcugauaacuccaguuucccucugcuuuugccucacacuuagaauguuguuacuagguuugauccuuugaacucuuaaaauagaaauguuccuaaaguauagcaaagaugugauuuucacuuuauaaaucacgauauguauacuguaauucagguuaacauaguuuccugagaacuguuaagagugaaauagaaauuuuaucugaggugauguuggaugguagccgggagaaaaauuugcaaauugaaugaagaacaagaaaauuccagugaguucauaauagugaugugguaccugacuguggucuccuuacuaguuaaagacguggcacuugaccauggucuucuuguuggguuaaagauguggcauacaagcuguuaaguagauucuccuauugguuguauagccagcagaaaggcucuuggggaagggucccuuaaggggacuuucccuuuuauucuguguguuuaaugugaauuuuauuugcuuuugccaaggcgcaugguccuuaguucauugugucucucccgaucuaggucucauguuuguuuuguugugacuuauuuggcauugucuuguccagagguggccagugacaaaccagaggggugguacggcaaggcugcuaagugugcugauacacugaacucaguuguauucacagugccauuucuguugcgcuuuguccacaggugcuauugcugucucaagacuauggcaaacacuuacuugguguugaagaccuguuacagaagcaugcccugguugaagcagacauugcaauccaagcagagcguguaagaggugugaaugccucugcccagaaguuugcaacagauggggaagguaagaauggacugcucuaggcauuaucaccucaacaacggaaauauaucuccaugaacuacaaacauuguguguggcgacgggacuuguaaguuacugcaccauuuuaggguucugggaggacuguuuacuuccaggucauaaugugucacugcaguguuuugguuugguuuugauauuucagcacugucuuuuucugaaauagacccauauuuuucuuaaauacucaaaugcuaucugguuuugagagcuuuagcaucugguaguguuaauguuuucaguccauacucguuaacgauguggaccgacagccuacugugguugcucuagcagcucucagcuuugacaccuagucacgugcuauugagggagaaggacugggccuugcuucuuuaaauaagaugggcagagguggugcacaccuucuuuuuuccccaaagguuuauuuauuuauuauauguaaguauacuguaguugucuucagacaugccagaagagggcaucagaucucauuacggaugguugugagccaccauguauguguaugugguugcugggauuugaacucagaaccuugggaaaaacagccacugcucuuaaccgcugagccaucucuccagcccagagccuugcuuuuuuguuuguuuguuuguuucgagacaggauuucucuguuguccuggcuguccugccucugccucccaagugcugggauuaaaggccugcgccaccacugcuucuuaagaacuaaguaaacacagcugcuuccauaugauacgugugcuuucuugauuuguaagugaucucuuugucuacaguugggccaaaagugcaguguucgucauagcccuuucuuccuguccuagucaguauggcaggaagugacuguugcucuuuauaugacacugcuuagacgggagccaagcuagaacauggaacauaguuuacugucugcaaaugaacagggagcuauuggagacuuagcauucuuuccuugguguuaaaacaggcuacaagccaugugacccccagguaauucgagaccguguugcccacauggaguucugcuaucaagagcuuugucagcuggcugccgagcguagggcucgccuggaagagucccgucgccucuggaaguucuucugggagauggcagaagaggaaggcuggauacgagagaaggagaagauccuguccucugaugauuacgggaaagacuugaccagugucaugcgccugcugagcaagcaccgggcauuugaggaugagaugaguggccguaguggccauuuugagcaggccauuaaagaaggugaagacaugauugcagaggaacacuuuggaucggaaaagauccgugagagaaucauuuauauccgggagcagugggccaaccuggaacagcucucagccauuaggaagaagcgccuagaggaagccucauuacugcaccaguuccaggcugaugcugaugauauugaugcuuggauguuagauauacucaagauugucuccagcaaugaugugggccaugaugaguacuccacgcagucucuggucaagaagcauaaagauguagcagaagagaucaccaacuacaggcccacuauugacacacugcaugagcaagccagugcccuuccacaagcacaugcagagucuccagaugugaagggccggcuggcaggaauugaggagcgcugcaaggagauggcagaguuaacacggcuaaggaagcaggcucugcaggacacccuggcccuguacaagauguucagugaggcugaugccugugagcucuggauugacgagaaggagcaguggcucaacaacaugcagaucccagagaagcuggaggaccuggaagucauccagcacagguaagugaaguuacuacuaccugggugcuaaggcgauggacugaaacauaagccauuaaagucacuacucuuuugaauugcuuuccucagauuugagagccuagaaccagaaaugaacaaccaggcuucccggguugcuguggugaaccagauugcacggcagcugaugcacaauggccaccccagugaaaaggaaaucagagcucagcaagacaaacucaacacgagguaugcauggcaucagcagagcgccugcugucccuguguggcucuggugagggugacagugcuugcccagcuuugcugucagaaaagaguuuccugcacagguucacauccuuguagcauggaugucaugacagcagcaucugcuuuaccaaguauucucauccauguuuugcaagaaacagcuuuuaaagugagguuacauuauucaggacaugagucagagucacccaguaccuaacuucuccucagauuaaaauuagagccuugguagaagacagacagcaagauagaaccugucuguguugucccuuuaaguugaaguuaggguuagaacccuagagcaggguucuauaaugaagcuugauuugccaaagauagcaucaguugucagggcagaccccuguccuguuccugucugucuguggagcagacaucuuugaguagauuguucaaaaguuuaccaucagucuggcuuggggaaauauuccuccagagcaguuuugaaauguaugaugcauacagcaggcacgaauuacuagacccugugggacuccauugcacuaagccaucugauugacauuuacugggugacaugauuuaaaagcacacaaguaaaaacagagaaagucagagaaagaugggaaggaggaaagugaggcagcuucaacucuggcuacccgucucaggaucuaccagacauucugaucccuucuugugcugucuacauucacagguggagucaguucagagaacugguggacaggaaaaaggaugcucuucugucugcccugagcauccagaacuaccaccucgagugcaaugaaaccaaauccuggauccgggagaagaccaaggucaucgagucuacccaagaccuuggcaaugaccuggcaggugucauggcccugcagcgcaagcugacuggcauggaacgagacuugguagccauugaggcgaagcugagugaccugcagaaagaagcugagaagcuggaguccgagcacccugaccaggcucaagcuauccugucucggcuggccgagaucagugaugugugggaggaaaugaagacaacccugaagaaccgagaggccucccugggagaggccagcaagcugcagcaguuucugcgggacuuggacgacuuccagucuuggcucuccaggacccagacugcuaucgccucagaggacaugcccaauacccucacugaggcagagaagcuucucacacagcacgagaauaucaaaaaugagaucgacaauuaugaggaagacuaccagaagaugcgggacaugggcgagauggucacccaggggcagacugaugcccaguauauguuucugcggcagcggcugcaggccuuagacacuggcuggaaugagcuccacaaaaugugggagaacaggcaaaaccuccucucccagucccaugccuaccagcaguuccuuagggacaccaaacaagcugaagcuuuucuuaauaaccagguaacguuccacauggccuggcuuccauccuguugaaacaggcccuggcugauguuggaaacuuuugguuaaguagcaggcuuaagccaugccuauaugaaauuagauguguuauuuugaaacggaugccccuccacccccaacucuucaauggcauugaaacccaucacgcuguaaagaccuagaauugaaaauuucuaaggaagcucuuuugucuuccaaaguaugauucugugguaauuacuguugaggucuauauaacuccuuauuuaguuaggcaguguucuguggcgugcgggcucaauuuaaagaauacagugagcaaguuuugggggauuauuuuuuguucuagaaagaucaagaauuucacccaaggauacaaagcaacugcagauggcugccagugucaggguuauaaucucucuuaagagaguacagagggucugcugcugcuucuguggaccugagaggacucuucuagccagcagaccaagcuuugcuuauuguaggaaaaccuauuuauauaacauuuaccacuuagagaaauggagcgacuaauggauuauccuugggcuaggcuguguguguguguuauguuugucugucaaacuuuuaauuuuacccgcuucauaaauuauuuuguggaauggaaauacagugaaacaguccuuguaauuucuuuguuaauauguaaugucauuuuggauuuuuuuuuccucuuuuaaaacaaggaguauguuuuggcucauacugaaaugcccaccacccuggaaggagcugaagcagccauuaaaaagcaggaggacuucaugaccaccauggaugccaacgaggagaagaucaaugcuguuguggagacuggccgaagacuggugagcgaugggaacaucaacuccgaccgcauccaggagaagguggacucuauugacgacagguacagcauuuuugaauguuggaauugaacuauacucuggacuguuaaacuuccagccacuaacgcagaguccuugggacuguggguuugagcuucccagagagcaaucuauagguauuuaucagaauugcaucaacucauccaacaagugagugccugguacguggcucccuuaguuugauucuugugaaguguuuauagauguccucaaaagaaggccucgaagcccguccuccauaagcuguacucuugcagaauucucaugguggcucacuugaggggaccuugaaagccagaguuuuccuggcccaggccauauucuccuucauccaugugacauucuucaggcaccuguaaggagaaaggaaagaaggaaggugagacuugcuuguccugagcacugaagaaagcuauggagagacagcaucugcccuuuauuaaaaaauggacauagcuggugcugucauaugcucuaccugcacacccuaagaugauagaaaaagauauuuucuccuagucuagggcauucuccaggauuagacaguugggcaucaucucuucuucuuccucuucucuccuaaaagcuugucucccuaguuuuuaaaggucuguguuuucuguaucugaguccugcccuguacugguuaaaguacagaggaggccugagcaguccaguguugagcugcacugaugagagucauugugggcugcucauguagacagucauuagccucuguuguaacaguuaccuuuugccugcaguuuagacugaauuuaaggucuucaugagagugauaucagggcuuuucaucugucuuuaugcaguucaaagagcugcuuacugccacagugucuugcuuucagcaucccaaagggucuccugggaauucuacucaaaaauaagacaagguacagaggggaguugccuucauucccaguuccaauuuucuugcacuuuaguuggagcuuguauauguucuaaggguacaccuauaagauacaauauaacuuuuacuauaguugugugugugugaugcuuugaagaauaaacaaaaguucuaucaaaaucuuaagugaaugugagaaccaaagauccuccaguuccuaauauuuaagaaaaagaaaagaaaagaauuccuucuuuucuaaugucaggucuccuuuugugaguguaauaugccguguuccucugcaugaggugcagaugcugggucccuaaggcagaaguagcucuuagacaugugcauuuggacaaacaugcugcuagcuuucuaccuccauagcuuauuuauauguugcacugugcugcagcuguacagggcuguuggaagccggugacucuggagacagcuagcugcugcacuucagggcuuccuuaggauagcucaggguuguucuuguuuuucaggaaagcauuucuguuuguccuugguuauccuggaacucgcucuguagauuggccucaaacucagagaucucuucugccucugccucucugcuucucucucugccucucugcuucucucucugccucucugcuucucucucugccucucucccucugccucuguacugagauuaucucugagucuacagaacaagcuccaggauagccagggcuccacagagaaacccuguggggggaaggagguauguaccaccacacccagcaaggauuucucaauuuaaaaaugaaguagaaaaaaaaaugaaguagaaagaacauucuuuacuauugcuaaacaaaaaaugggaggagagggcucccuuguugacuccacauccaucuguuuuuuuaacagcugacauaaacacgagucuaguaucacuucauuaucccuaaaggccccuggauuuaaaaccaaagaaaaaggauuuuuguagacagaccugggaguuccagaggcuguagagaugcaagauaauuaaauaucuaaaccuucaggucuauuuucuugcucaaaggcacuuccacaaagccuucuuauggaauguaaaguaugcugagaaaauaugggugcaggugacaucagagccccaaaccuucccugagggucugaaaaugggagggaggcuucugcgcaaagggaagguugcagcauuguccagacacaggguagugcagcaugaaccucuauccagcuugauacaaaaaucccucuguuguagucagggucucaaucacugugauaaaauuccauaaccaaaagcaacuuggagaggaaaugguuuauucucagcuuacagcuuguugcccaucuccagagaagugggggggcaaggagucaaaacaggaccuggagccaagccauaguggagugcugcucacuaauuugcuucucaugacuugucagucugcuuuccuauagcacccaggagcacccacccaggggugucacugccuggacugagcugggcccucccacaucaaucaucaaucaagaauuuauaccacaagcuuguccacaaguaaaucugauggggcauuuuucucaauugauguuaucucuuuccaaaugacuuagcuagccugugucaaguuaacauaaaaacuagccagcacacuugacacccuuuggacuugacacacaaacacaccauuuauuaagcaauagucucucuuucuuguggucuucaaaaugccaugcuaauauuaauaugacaauauaaagcaaucaaaaaaucccacagucuuuaagucgagccucucuuaucuauauucucuuugaaauacccauuuuuauuuaauuucaaagucucugugaaaguccacggacguucaacuaugacuucuuucauauaaaaaaauucuuagaugcuuucuuaauuaaagaaggaagaaccagagguaguuccagugaccucaaagucguaggaagcugagugucagacuucugagacccacucaggauuugcuggguuucaacaggucuugcagccauccacugcacaacagcuugucuccuaugcucaagucagugccacgccacacuguugcugaccaugcuggugguucccugguuauugacaccuccagaaugauugggucuccacugaaacugggcugaaccuucaccaauagccucuccugggcucucuucagauacucucacauguggugccagaccucaguccucuccgugaccccuucagucaugggguuuccuaugcuauugcaccgucaccaguagcuucucguggugccagcagcugaggcggcuguccaugacugcuucaugccuucaaaaccaguaccgccugggaugacccuuacagaaccaaguccuccaacagcuuaaguggcagccacagccagcucuucuaugugcugacccuaagaaaacacuucccagauuuuguuugucccagcaaaacagaggguuuauuuccagagacuuuuuuaaugaaauauuuuuaaaauauuuuuuuccauuuugagggugcacacuaugaauguagacagaacuugcaggaggcgguuguucucgccuaccauguaggucccauggauugaauuuaagugaucacacuuagcaacuaauguuuuacccacugagucaucccacugauuucuacagguuauuaaucuaaaauaucacauaaguggaccaaauagaaucuuuguuuccuucugaaauuucacuaggcaggccuccauugucugcacugcucucagcuuuacccucuucccagaucacuguugcccaugucaaguugacacagaaacuagccauuuuaccaucucacacaaguuagugucagcggguuagccaggagacagauggugagagaugaaaaugaagcagaggacaccacugcacagagcaccuugaugaguacagaaaccgccagacuugaguagcuucuuccgggucccuucccucuuaacuucaccuaggaccccaguuugaaagcauuucuaaguuuuccuuuuugugagugccacauguuaucaccaggaaaccuuuccgacaugggaacugacuauguuuugcuuuguuuugugauacaaucuuacucuuaagccccaguugaccucggacucacagcaauuccuuccuagucgugggaacacaggcaggaaccucuauacaagauuucaugcucaguguuaucuauggcuguuuaaucugaaagcauacuaaguaaagccagacuuauucccucuccccacccccacacucagcggugucuuuggacuugauaucacugccaaugggagucucuuugccucuguggcauuugcaugggaugcugugaggaagggaaucaaaucuuuuucuuuuuacaaagccccugauuaaagacaaggcgacugcauuuugccacucggugcaacucaaaugaucuuccacuugaaaauuuguucaugaacuuccauuguaaauagcugggauuugaggguaacggcuguuuagaagugaccuuguccuuccuuccugacaaacauuuucagaugcuuacuccuucagcccaaguucauugaagucuugcuuuaauuugugguuucuaauagagaauagcaauggcaaaguagcaugcucacauuuuaaguguuuaagaucccuucauccauggaaccuucaggaacccuuucaccugagaaagaaaaaagucccuuuauccaacauuuuaauggccauauuguuuccauuugugauauucucucucucucucucuccuucucucucucucucucucuuucuuuuuuuguuuuuguuggcaggauuucucaggcccugacugucuuguaacucgcucugccucccaagugcugggauuaaaggugcccaccacugcccaacuguucgugauauucuuauagcccuggaauugggagcguuuucuucaggccccucgguagaugagagcugcaaugccagggacuacugugaauugcguugucagcaugcaaugagggugucuuucuucugauaaaaguuucuccaagcgucacccagcacuuuugugucuccugagauuuuucuugcuuacuuguacugcuugcaggaauggagaacauuccugucccccaggcucauacaacaaagaauuucuuugagaaucgcagugaagacccagcucuuccugugagccucaaacucaguuagcugaggguagccuugaauuucugacuuccugccuccagcucaguaguagugaugcaccaccuugccauuguguguguugcuaaggaguaaauggagugucuuguggugcuagguaggcaaguaguccaccagcugagcuauaccuccugccucuaugcuuuaacccuauuggcuacuuuagcccuccacuucacacccucagugagccagacuuuucuugcaagggcuaccagcagcguuaggacuuguauuugugcauacuuguugaucuuuaccacugagcaacagcucucauugcaucaguggcccuuugcuggcauuuacucugcugguccaguuucuggagacuugaaggcacaagaaagauauuugccagcaaguuaggguucaaacuaagcaccugccuucucaugcuguucaccagggcuaguuccaaaucucacagguuuuggaguuaugguuuugguuuggguuuuguuuguuuguucuuuguuuuaagguuuggggauuuuacuuaaaaccuuagcugcccuaucaagaguagaacugaauaagcaugugaccccauaggucugaacuuuugcacuugugguauuuggugugaugacuucccaagauaagaacuuuucagaaaauauuuuuuaaggauagucaagcugggugagguaaugcauacuuuuaauucuagcacucagaagacagagacaggccuuugugaguucaaggccagccuggucuuuaaaaaaaaaaaagauaacugcaugauuuauuuuuauucucuauuuauuuuaguacuauuaaccaauaggccacuucucuggcccaagaguuauguauuauguguauuuuuuaaccuuguaugaguuucuagagaaguaaguuuugaauucuuucacauugucaguagcagggccuugugcacacucagaucuucucuucuagaaugagaugcauuuaaauguaugcagugacugucauuaccugggucuccugugcaccuccuguggcuuuacccauuugcaggaugcuaaaaguucuccaucuugccuauaucaaauacuuaugagcuguaagcgaacacuucccagcacacacagaaacccagggaagaaaucagccuguaaauucuacaccuaauuauuuuuaaauuauuuaauucuuuugacagacacaggaagaaucgagaagcagccagugaacuucugaugagguuaaaggacaaccgugaucuacagaaguuccugcaagauugucaagagguaaguuccccuucagcuuccucugcggcgucccacagcagccagcacuggagaaaggcaauugaaccgugaaaccagggaagccagaaauccauuaggggucugugguuauggguuagggcgccguguuccugucagucuccuggaggagccauacauaucaccagcaguuuagauuauccauucaucuacauuuuaggauacauuguagaguagggcuauauuuaaauuagcugcauguggccauuucuuuuuaaguuaaaauucagagcauacuucucgaaaacagcugccauguuuuaacucuuuggaaaaacgguacauuuaaacaccauggacggaaacaacuuacuaaauacugaaacucucucuauauguuaaaaaccagagauauaggggcuagagagaugcuuggugguuaagaacacuggcuugcucuuccaaaggauucggguucaguuagacugacaauuuccugaaauuccaguuccagggaaucugaccccuucguugacuucugcaugcacugcgaacacauguuacacggcuguauauguagagaaaacaccuauaaacauauaauaaaaguagauaaauguuaggcuagugagacggcucagcaguuaagagcacugacugcucuuccagagguccugaguucaaccacaugguggcucacaaccauguagaaugaggccagagcaagugagagccagagcaaguggggcugaagugagaagccagagcaagugagagccagagcaaguggggcugaagugagaaggaaaaagagaaaaaaaguagauaaaucuuuuuagaaaaacagaaaauuuuaagcuauauuccagauuucuuuuucauuaagaccuuaaaaagaaaguuuaugccaagcaguacucugcaucucaaagaccaucuuuuaacaugcacuauuaaucucaugauucccucaacccccaauaaauccagaaagaaacuuugaaaacuaaaguuaaccaagaaaauguagucucuucugaaagccagcuaggaagaaacauguagcaaacuccauauauguaaauucauaaacacaucauauuucuccaucugccagagaacuacaguggaauucguuccucucuaguuuauagaauaaauucccuuagaccccaaaaugggauaaggaacauccacaagaaaguguagggacccgagggccagggaccaggacagaauauagucuuaacccauuacaaacaccuuguauauggacauccagcuauauguucaaagaaguacaacagacauguuagaucuuuugcaacaaaaggcauucgugccuaguaaagagaccgugaaccuuauaauaugcucuggcagcccuacgcaccauguuagacaaaaagcuucuucugagugucagggggacacagauagccaauuagagaggauacucacucaagacacacacagcaagugugcuuugcagggagccagugugugcaggagagaagcacccgccacacacuggcuuuccuuguaucacccugauguuugccaugaaacagacaucaccugagacuguguuccuucagccagagaauuaauggauuauguuauaccugcuuuuuugggguauguauguauguauguguguauguaugugagacagugucauacuguaguuuaaaccagccuggaaccuacuucuguuaugaaaauuaaguuacagauauuagccacugcccuagucuugcuuccacuuuuaaaggacaaguuaauauaaugaaauugauugacagaaccauguuaaagcccaggcuaagucugaggaaagauauguagcuuucuacaugaauacugugccaagucccccucauccuacgucucuuguuuugcuguugcucugugggauuccuuaaaguuugcacagccacagugacugcugagaauguuugaugucccacacagcuuauagucagcaugugacaaaacuuagguuugcugguuuccagacacuuuauagacauacaaguauauugaccaaaagaagugucccauuccugcacugcaaacacccaucauucugccucguuuaaauauaguaggccagaguauuuugggaguggaggucauauagaccagccuuacauuugacuauguuuuaugaugguaguuauuuaccuaguaggcagaaguuacuguuacuagcuguuuguguucaaggucuagagaauccacagguuuguugccuccucaauaccccccccccccccacauacacacacacacacacauacauacuccuuuucuccugggugccuuggcuaauggaagcaagaauuuuaagaucugccuuuauugcccccauaaggacugagggcagccauuguacuugauacaguuaaaacagggacccacuugcucaccucaaauaccuauguagggaacaucuuaauuuucacagcgugguuuugguggaguauagaugaucugaaaguuguggcuggcugguuuauucucuuagaguguacuucugacuuuugaaggugaauugguuugguugguuggugguuuuuguucucuuuccccaggaagucaguacagacuuguuuggcacaggacugaguuuuguacugagccuugcucagugauuaaagcuuuuuuuuuuuucuuuuucuuuuucucuuucucuuucuuuuucuuuuucuuuuuuccaucugcacagugauuuuugguuuuuuuggguuuuuuugcagagaaugaguauauucugacaugaccuuugugaaugccugaaauaaucacuuagcucuaguuccagaauggugacagaggaccagaauacuagcuaguuccauagcucuacagcauugugcuggucugcaugauaucuguaggaugauauguucaacaaagagcacauugguuuauaaguguaauuuuuauguagugcuuucuccuuuuaaaaacaaaauccuacuuguguguuaugaauagugaaaauauguguaugucccuggcacuuucggucaacaaauauccucuauuguaggagaccucucucugugcuacacagagggauuuuuaucauuugguuuucuucaucucucucuuuuuuuuuuuuagauuggacaaacguccuucguaugucacauuguagccauuuagauugcugggaaauaguuaaauucuuuuuuaguugaaaacgugcuaucuuuacuguuguuugaccaaucaguggucuuccauuacaaaagauuugcuuugaccuuugcucccgacaguucuccuucaugaaagauggagcuaguacuuagaguuuuuguccauucucaaagucagcaguucucuugugacccgcuuugcccuccuugacauuuuauaaagaacagacccacugcuguugaagcaaauauauggagaagccuuucccagcaguaccaggguauuaaugaaaggcuucagaaacacggauaccguaaaggcgucuuuggucuccugugccauuguagacuuugagacaugaaaccauggagauauucaggugcagacucacagggaguagugacugcuuuaaaaguaaucucacuuucacccacccaaguggcgguagauggucccugaaggacuccauuguauaucucuggccugggcacuuauaggcaagcaggaccaagcagggucugacuugggauaaaagccugaaagaggucagagcuugguuuggccaacucccauuccaagccucuuauaauuuauuuuagucugucagcagcuggcaagcuuuguguggcuuucuaguauauaugguuggucucggaguccaguucugugaaguguucuuaguuugaguggaagguuccuucgagaguuagaggcuacagaaaaacagguaaaggugauuuagaguugacagaaaaaaaagaauggcuguugucauugcauuaguuccacggugagcaaguuguuuauguucuuugacauucccacacaucacccaguagauaaaugagcagguuuguguguuguuugguucuugguuuuuugagauaggauuucucuguauagcccuggcuguucuggaacucacucuguagcccacaguggccucaaacucacagagauccacuugccuuugcauuccaagcacugauacuagaagcaugcgucaccacugcugugcagauuguuuuaaaauacauacuugccagaugaauuaaaugauagucaaugguuagcuugcuauagcugucacagguaucugggggaggaaacagcuuguguuuugaacuaguaagagcaaaacuacaaacacaagcuuuuuagggaaagcuggccaagagugcaguugaguuuaaaagcugcuuuggaguuuuuauacuucuggguucaauguuagguccaccauuuauaucacacuuagcuacaaaaugggucagaggugcaaaguaaaauauuugccggucuguugacauggaaaaugucgacacggguguaauccuuucugggucggaguaaaagguuuaaaucuaugaugacagcuucuaaacacuucuugcuguucuacccuagcugucccucuggaucaaugaaaagaugcuuacagcucaagacaugucuuaugaugaagccagaaaucugcacaguaaaugguuaaagcaucaagcauuuauggcggaacuugcauccaacaaagaauggcuugacaaaauugagaagguggguuaaacuauuuggugagaccuuucccucacccuccuuuccaaauuguggccuugguaaggaggaagacauaaaaacuuagggaagagggaggagagaaaaugaauuccuuuuauuugaggguagagcccuaugucaucacagucaguaacaauccccugcuuccacuuaguuucuaaccugaugucugucccacagcgggcagagaagcagagacccaaacaaguggcuuaguuuaucuuucaguggcuaccagaugaucagaucaguugcuacugguggaccaugucccuuccuuccucauugccacuggccauaaaccuguguugcuuuaugggcggcuuuaucagauacaauuacauaaauuuuaaaaugcaauaugcuuuaagucuauuagggguggugugacuacuauacaccaggcacuaacuauguuaauccuugcaguguguauucacauagggaaauucugugcaguguguguuucucacguuccugucccuucacuaucauucuccuaagaauuaaaauuauguguuauauauagucuuuagagcgugaaguuguagguuauuaacaauaaauugcccaauugaaacuguuagagcaugcaacacuuaauugcuaacaaagaccacuguuuauuuuacugagcacuaacuuccuggaugaauguagggaguguggaugcaaguggggcaaucacagauuaaaugucucagaguuugaguuuuguuuuuucacagugacauuuauucucuugcaaacuauuuuuaaccucauugguuuauguucuccaggaaggaaugcagcuuauuucagaaaagccagaaacagaagcugugguaaaggaaaaacucacugguuuacauaaaaugugggaaguccuugaauccacaacccagaccaaggcccagcggcucuuugaugcaaauaaggcugagcuuuucacacaaagcugcgcagaucuugacaaauggcuacauggccuggagagccagauucaaucugacgacuauggcaaagaccuuaccagugucaauauucuucugaaaaagcaacaggcaagugggcaaggcaguauucuguuugggcuaugcucgcuucauggcuuuccccuuccucucuacagaucaagagucuuuuccuuugcucuuccaugggaagggauuuuaccaccagauaagugcuuacccugccagcgguagacuuuuucagagucaucuagaaagacuauaauuaguaaaacuguugaaugucugugcauaggaauauuuucauuuaacaucuaguugaugcguauuauuaccauucagugguugagugaaaucuucaccuguaugagugaauaaucauauuuaucuucuuuccauguaauaucuuaaauaucuucaccuguaugagugauaaucauauguaucuucuuuccauguaauaucuuaaauaggugaugguugggcugaauugucugcucucuacucugaauuacucucugcuugguagauaauagaggaaauaaccauuuuuuuuuuacauauugugauaggugauucuaagggcaggugaauuuacucugaauuaaugagcaaacaguuuaauacaucaucagauaugggcuagagagaugacucagugguuaagaacauucacuuccagcaguccugaguucaauucccaguauccauauaacggcucacaaccaucuacaaugggaccuuaugcccucuccugggguguuuaaagacagcuacaauguacucacucauauaaguaaaauuaaauaaaucucuuuuuuaaaaguaugucacggggaagugagagauggcucagcugugaagagcaccagcuacuuuucuagaauaccuacguucaaaucccacugcccucccauagcuguugguaacuccaguuucaggggacccaguaccuucuucuggcuuccacaugcacuuggcacacaaacauacauguaucagugguaugguuugagaagaugacucagucaauaaaguuguuuuccuuguaaacuaaggaugugcuuguaaucucagugcuaggguggcagaaacagaccaugugcuccaggccaaugagaccuuguucaagagaagguggguggcauuccuaagaauaucaccugugcuuaccuacugcucgccauaugcaauauacacagacagccacacugucacaaacacucuuuuagauuuugguuuuuugguuugguuugauuuuugaaacaggaucuauaguccuagcuuuuccugaaacaguggugugguggguguaggccaagcuggccucaaacucagagauuuaccugccucuggccaccaaaugcuagcauuaaagauggcaccacacccagcuacacuauuucucuuuaaagguaguagugguccacuuuuccaguggcuccucuccuaacuuggcaguauuuuaugauuccuaagccuggcaguuuuacuagucacugccgaauguugagccugguuuuuucauccaaaaggacauucaugcuuuugcuacaagguuggcuacuuugcucuugaaguuucugugcauuaauaaauuuagacaggugguguuuaguuguagcugcugccucuuccuagggagguuacaguuagccucaggugcugguugguuccaggauuugugacuggcugugcuauguggguggguagcggugggugugauagcuccucagugaacacuuuuguuuccaccuuagcuuguuuccuucagugagcggcuguuguguucccucauuaucucccaugauucuagucagaucucugguugaagaaauaaagauacuguuucucaccagaaagaacuggacccucaaaaguguucucccuucugauagagaaacugacuucuauguaggcauaaguaacguugucucccugucuuucuuuucccugaguuccugauuaaaguuuaauguuacuucaagcuuuaaaguccccagagacugaauguuuuuaaacaucagcugguaagcuagaauacucacugguacuccauuccuuggccucucggcuguauaaguuuguauuucucaguguagccuuccaccuuagccagugccaaaaacaaaguuccaagcagagucucuguguuuccucuggcucugaugcgcucucgcucccuuagaugcuggagaaucagauggaaguucggaagaaagagaucgaggaacugcagagccaagcccaggcgcugagucaggaggggaagagcacagaugagguggacagcaaacgccuuacugugcagaccaaguucauggagcuucuggagcccuugagugagaggaagcauaaccuguuagcuuccaaggagauccaucaguucaacagggauguggaggacgaaaucgugaguagcccgagagcgucccggcgcgaugguugcauuucuguugugucaccucggacugugucauugacaucagcccuuauagccuaccuuccauguuguggugcucuguccccucacaugcacacaugcaaaugcacucucuucuuucuggaauucuaaagacacaccaggauuuuaaugccacuagaaccggacuuaaacuaaccacagggcucacaguguguccaacaccaagaugaaguaagucuggaagcccugccucauguccaagaguauaucccggccccuucuaagggaaggcuagaccuuccuccccagugcuccccucaccccuuacacucuuacuugggccauuucuuuguccuucacaugguucuaaccucuucuuauucucaauuuuuuucuagcuauggguuggcgagaggaugccuuuggcaacuuccacagaucauggccauaaccuucaaacugugcagcuguuaauaaagaaaaaccagguaagcuuuucuaccaaggcuagcagugccugauaaaugacugaaucacaaugcagaugaagugagagacuuuugaagguuugugaguucugcuuagcaccaacauuuaaaaauaaggacccggcauggccguuuagcaaauuguuuuugccucuucugcacagacccuccagaaagaaauccagggacaccagccucguauugaugacaucuuugagaggagucaaaacaucaucacagauagcagcagccucaaugccgaggcuaucaggcagaggcucgcugaccugaagcagcugugggggcuccucauugaggaaacugagaaacgccauagacggcuggaggaggcacacaaggcgcagcaguacuacuuugaugcagcugaagccgaggcauggaugagugaacaggaguuguacaugaugucugaggaaaaggccaaggugagagaugcuucccaacuucccugagaggaagccagagguaugccucagaagagugcccuacucugauccuuugaugcuaguagcuacagagugucuuuguucuaccugcugccuguagauacugaaaaguaaggaaagacaucaaaaaucuggcugcugucucccuugaaauaaaggcuaaguauguaacacacaugcaggccuagaacuuaauauauagcccagacuggcuuccaacucaugauuuucuugccuuaggcuaccuacuaggauuacaaguagauaguacuaugucuagcuaacuuagauagauagauagauagauagauagauagauagauagauagauagauagauagauagauagauagauguuauauguuuguauauaagucuuauaugaauauuuaucuucaaauauauauacauauguguguauguguaugugucucucucucucucucucuauauauauauauauacauacacauacauacauacagacagacacacacacacauacacacacacuuuuugcuuguuugagauaagggcuucgcuaauguagcccuggcagggcuggccuugaacucacagagaucuaccuuccuugcacucccaauuacugagauuacaggcauguucuaccaucauucauaaaauugcccaggcucuccaacauacaaaaugguuuuaagaccauuaaaaguacuuuaaggcuauagaaugcugcuaugcagaugcauaacugacugagguuuuuaaccagcugaaauauauuaaacuuaccaagcuccccucuaccucacagcggccuuggucacacuacauauuccccuuugcagaggccucuguuagucccugcuaaugcacucagcugugucuuguguucauggcuauagcauacauuuuuuuuuucuuucugaugauccuuccucuugucccaccccacagugcaguuaauuuaucaccccaagcauagaguuuggccacgguuucauuggucuuuuucuuugcaggaugagcagagugcugucucuauguugaaaaagcaccagauuuuagagcaagcuguugaggacuaugcagagacaguacaccagcucuccaagacuagccgggcgcugguggcugacagccaucccgaaaggugaguggcacuuugaggaugaggccacccaggcuguuugauuccucagugaaggugucuuacugaccugccccaaaagaaaauggcacuguucaucauacagcaaugguuaagcaugccauugaccuaagagcuugugguguucugggaagguguuacucagaagugguuccugcgcagugauuguccagaaaacagggaagacaugugagagugugagcucucuggucaccaggcugcugugguaacugagagagaagagcuccuaucagacucaggaaggaaaggaauugguuugaguguuuguuuauccagugcaagacaggcuggaaagcuaaggucagugggccuguucuacaugaggaggcccuuaaggaguucauaacuagauucccaagaaagaauaagcugcaacaaagccuuuccccucuccuaucaggagauauaauucuggugacgaauucaaagaagugggauucgaucucuuagcuacacugaggaaacaaaugcagacagagcaaggaagggccacagcccaucaggaaagagcagaauaggccagagaagagcccuaguggacagccugugccuucuggcaauagaagaugguuccaauauuuugcauuaacuuuuagcaguguguggggauaggagggucaggguggccuuugccuuaauuauuuuguuugguuucuccauucacucuucaucauuugaaauggaggcuauucaggguucugggguuuuuuuuuuagacaaaauagguuaaaugggaguuucuuuggggaaauuuugguguaacacuuauguuauccucacuccguugugugucuucagaagaagacauugaggccccuuccucacugcugguucuuuuccagugagcguauuagcaugcggcagucaaaggucgacaagcuguaugcuggccugaaggaccuugcugaggagaggagaggaaaacuugaugagaggcacaggcuguuccagcucaacagagagguggaugaccuggaacaguggaucgcugagagggaaguggucgcaggcucccaugaguugggacaggacuaugagcaugucacggcaaguacugggggaaaguggguggugguguggaaagcauuccuagguugugaggucaugggugugguuucagcuuggugcuuuccuuggguaucuuugucaugggucggcauuccucaucacagacagacaacucagguacugcagaucugugguucucagggcuugaguaucaacuugugccucccacuuagcaguuuccuuccagcaccauucaugugauggaguguaaaagcuccacaguggucucagugguuucuuugugugcaucccauuucagauguuacaagaacgguuccgagaauuugcucgagacacaggaaacauugggcaggagcguguggauacaguuaauaacauggcagaugaacucaucaacucuggacauucagaugcugccaccauugcugaguggaaagauggucucaaugaagccugggcugaccuccuggagcucauugacacaagaacacagauucuugcugccucauaugaacuucauaaguuuuaccaugaugccaaggagaucuuuggccgaauccaggacaaacacaagaaacucccugaggagcuuggaagagaucaaaacacuguggaaacuuuacagagaaugcacaccaccuuugagcacgacauccaagcucugggcacucagguagguagagcugcccagggcaagagagucucuuuauaagguaucuuuguacaucuugaaccucucugucucucuuggcuccucagaauauaccugaaaugauacucagacuaaacacaggugugugcacacacgcacaugcacaccccacccaggaaagcuuuguagucucuacaguucugaauuugucacacuugcaaauaauguuagaugaacacacucguguuuaaauuaggcagauguacguauaaggccucaguacaaguuaauguuauguuaaugugaccauccggaucacuuugaaaacaguaccucacugucuuccaccagccaucucaaaagagaaaucuauacuuuuucauuugagcaugguagguuuauuuuucugcauugauuccucuuauuaauucuuuguguuagcauaccaagugagaaaucacaugucauuuugauaaauguauuucuauuuuuuuccgucauuccccugucuaccacugcuuaccccauguucccugacuccacuuuccuuccuuuucucaggugguccuacuucugccuaguagagacuaaguccuuccauuuugacauggcagaucuucuagcuccagcacgcugugaaguggcuuagcacuaaaacagcuucgaggcuguugagaaccagggaaacagcgagacuuaguagugugcuccaucucuccuuugccuucugauuccuaguuuccugauuagucuuaguucuugccguugaaaaacggucaucucuucccuccaaauggauguucccggagaagaagcugguuuugccuaauuuucuuaauccugagaaggucaggaguucuauucuugcuuauugagagcaaaugaucaguacagagucagcagaaggccagauggaguauauucuugacuuuguggcuguguaguuucgacugaauccaaugggaaagugaaugggcagaggcuguauucuaguaacuaccuaacccccuccccacgacaaaaggucuagacguggcccagguucagguucaggugaguaucaaccucaccaugcuccaguacuuaggacuuacucauccucuugaccaccauugucuuuugacugccaucuggagucucacucaguucuugccucuucucuggcugugaguuaauucaccucucugugccugggucuccagcugcuuuggggauugagaugauccuuguaaaacaguuacaucugugaauguguccccguuacugauuuuaacaaaugcuaagggagguuuugagaagccuagagacagguaagaacuagguccuuccccauuuacuuuuaaaacuguaggaugcuuaagacagagucauucccuguuuuuuucauuaaauacuuuugccucaugagacuguugaggcuuaauacccacagccaagaacccaacccaagucuguuggauuccaccuaccucaccaugucacuguaaaguaauuaagagccauaaaaagaaguguggcccuccugcaggcacugacccaccaauaucuuacagaggcaguaauaaucuugcguggccaaggugguccugaacucuugugugagcuucauugugcuagcuucucccaucuucucacugagagacccuauuaaaaaauaauaauaaccagaggcccaagaaaugacgacuuaagaaaacaaggagauugauuuucaaguaauuuccuacagcuugcucgugauaaucugauuuacauaccuuagcuguaauucagaauuagagacaaugaaaauggacauccaaggauaagguagucaggugcaaugguggacacauuuaguccuuauacuugggaggcagaggcagauaaaucucugaguuugaggccagccugguuacagagugacuuccaagacagccaggguuagauagugagacccugucucaaaagagagagagagagagagagagagagaaagagagagagagagagagagagagagaaagagaaggaggagaguauaaaauagucacuauuuuuuuucuaugaugacaaaccuccaucauuaccuaaagugauagccuguuuuuguuuuucacccuuugacacagaaaguaguguucagcauacugucuguacuuuuaaaacaauauuugguguauuguagggcaugcaugccucagcaguacauuuguagguccaaugacagcucuguaguaguaauccccuccuaucauuguguguuccaguguucaccugaggucaucaggcuuauauguuaagugccuuuaccuauuugucagcccacccacucccacuuauuuuuaaaaguuaggcuggccuggaauacacuguauagcugaggauguugaugauggggauuauaggugugugccagcacacccagccaaucaaaguauuucucaccuuggaauauaucuagaugugucccuacucagcucugucuucacaucccaggcuacaggacuucccuauguuccuguagcauuuuauuucuuucauuguucgaacaguacuuaauaacggcauuuaguagguuugggguuuugugacuuggcucuaccaggugaaaaaagaacguauuaagaggcacagacccggcaaccgauggcuccuucccauugccguuuauggugacaccguaaggaagggaaggggugaugguggcaaggccacaguagugaaaccuggcuuuucuccccuguggcuucacaggugaggcagcugcaggaggaugcagcucgccuccaggcagccuaugcaggggacaaggcugaugacauccagaagcgugagaaugagguccuggaagccuggaagucccugcuggaugcuugugagggucgcagggugcggcugguagacacaggagacaaguuccgcuucuucagcauggugcgugaccucaugcucuggauggaagaugucauccggcagaucgaggcccaggagaaaccacgguaaggcucccucccggccacagagguguggguguucagggaagagcucuacugcuuuuguucucuaccacacaccgcugccauggaaagaagagccaugguggugcucauuuccucuagauucucacucccacacccccaccuucccacucaggcauuuuggaguucuuucucuguaucuuuguuauauuaaaagucucuguguccaugcauaucacaaaggugauguucacccuuggcauuuguuucaaguguccggaaccgaaaugauuagugucuucccuuuaguuugguuucuuucaaagcagugacgauuuuaauagauaaguagaggcaucagcuuccugaguguuuuccuccacaucuggcuuuguguuucuuuaugucucaacuguuccaucagguugugcuuuguuggaacugccuuugugccuucucgaaacagugucugccugcauugcaucuuguaugcacuuaaagaugccuuucuuugaaaguuaccgaguuagccaguccuaaguuaaguguuacugagauuuagugauuuggccugaguuugggcugcaaauaagcccuaaaaaagacaauuaagcugucaguuuccuucaaauuacgaguuuuaaaaccuacauguuuauuugaaaagcuccaucucuuaaaggugauguuacuuucuuauagggaugugucaucuguugaacuguuaaugaauaaucaucaagguaucaaagcugaaauugaugcucguaaugacagcuuuacagccugcauugagcuugggaaaucccugcuggcacggaaacacuaugcuucugaggagguaggaugcugcuuugggaccuggugugaacucagccaguguuggcauguaaaaggauuuuauuuugcaacugugucuuugaagccucccacaaucuacaaggauugauuccaggacuucugugaacacuagaauccauagauggcuagauaccauaugugaaaugacauagggcuuauucauaacuuuagaacaucucuggacccuguguaauaccuaacacaggguaaaucacugcuguacuauaguaaggaaugacaaaagccaagucuacguguucaguguaguuucaguuuuucuaauauuuucauucuguguauuugugugcuugagcacaaggccuacuuuaacagggccuacaauacacgugcaagugaguacgcuucuuuacaucauuuugaagcauauucugucugccuagaaaaacuguuacauacaacuguagacccaaaacugguaauuguuuguccagagauaauuuuugagggguccagguauaaaaacagccugugaacucaucagugggauggcucuggcuaucacucaacucugcguugcauuuggcugauggcugcagcucuggucagaacgauggcacugaugucuuuuuuguagcauccuucacaggaauggaugucucucagaaaagccaaggcuuugucgguauuacuguccuucucuucauaaacguuaacuguuucaggaagccccagagucuaucgaaauagcacacaguuugcuacaucagcacaggcagcuuugaauagaacucccaccccuucuggaaaacuagccauguuuuucucuccaggcucaagacaugaaauaauacauuuaagcugauacuuagcagcuuaggggaaaauagauuuucuuguaccaagugcucauccgggacagacacaagguugcaguguuuuauuaaggcccuuguuuuugugcagaucaaggaaaaguuacugcagcugacagagaaaagaaaagaaaugauugacaagugggaagaccggugggagugguuaagacugaguaaggacaugcguucuucauuugcuuuucuguucuuucuguguauccaaggaaauacaugcguauacaagucugcuuuaacuaauguuauguuauuacuuaaugauucugaaguuuuaaauguuucuuucucaguguauucaugcugaauauuguuuuuuaagaagguggaaagugaguuccaggauagccagggcuguagagagaaacccugucucaaaaaaccaaaaaaaaagaagaagaagaagaaaaaguucuuggggcuggcugaagagauggcucagcaguuaggagcacuuacugcucuuccaaaggcccugaguuugggucccagcacccaagucagaggcucaccuccugcccagcuccagcuccagagcaucucaaaaucucuagcuucugugugcaccuguacucagaugaguguaugugcacacacacgcacacaaaauaaaaguaugcaggguguaaggguguacaccuuuaaucacucgagucagaggaauacgguucucugugacaucaaggcuagccuaguuuacauagcaagauaugagaacagacaggaauaugaagagagugucucuaaaaaacaaaaauaaaauaauaaaaauaaucacuuuuccccuuccucucccucucccccucccucucuccccucucuccccccucuccccaucuucucuuucccuuuccucucucccuucccucucuguguaaucccaguuuaccuggaacuaugagcccucacuggauuuaaaauguauuuaagaauaguaccucaugguugauuugaacauuaaaaguaguucaauucaagcuuuuuuuauuuuaaucuauauuauaacaagcuguguugauacuuuagacucugucuuguauucuagccucauuccuauauauuguagacucuuaguaaaaacuaaaguuguguaaaaaacccaauugggcccagagcccucuaauguucaauuuggggccauucuguuauugaggauuucauuugcagauuuugaaaacucuggggcaguuucauucugugaggcaaaaccugugucguaccugcugugaacuggauaccaggcuacaaucuggguuacagugaugauuugccugcuaccuaccuuaaagaauugacaguugccuaguuucuugucaauugauaaguugugggguccaucguaaucucaaagugagauggcuggccuguucuuggcucagugauaguccacacaguagguucuuauccaacuggccccagacucugcugagugagaugcugaaugugcgcuggcagucuagcuaagccagguucuaauccacuuccucauaacugcaucagguggagagcuuuuccucacauggaggacaaggacccugucuucccccuuuguuaguauuccuacccucucaaucccccaagagaaaacuggauuucaaccuaauacaagcuucuauguggguuccugccucaccugcauagucuggcaugaauagguuguguguccugugagggcucagagaucugaucucuuagaauuagggccauaugaccagaguaaauucuagaccuguauaguccaccugagagccacuguccacauaugagucuuggaaaauagaaaucaucuuaauuuuuguaguauguacuuauaaauuuuaaccuguauucuuauuugguaaacaaaaaaaguguuguguuaaaauaguauucuuuuaauauauuaaguuaaaucaaaauccaguuaaaguaauuaccccuauucuugcgauguucuugccuguguggcucacaguguuuacauuugauggcauuugguauuauaaaugauaagauggcuaugcuuagagcagugccauuguguggcccugugacagacacucacucuugauacccucugcaguuuuggagguccaucaguucucaagggaugccaguguggcagaggcuuggcugcuuggacaggaaccauaccuauccagccgugaaauuggccagaguguagacgaaguggagaagcuuauuaagcgccaugaggcguuugaaaagucugcagcgaccugggaugagagauucucugcucuggaaaggcugacaacgguaagugucuaagcauguccggcauaguacuucaccuauuuuugugaauuuuaggaaucacauggacaccagaucauaucuugaccuuggauuacuauuaaaucaucgccauuccagauaaugccucucucugccagccaaagcuuuacugcagagcuugggcacuggucuuucuucuucuuccgaaacuuuuauucucauagaaaauggacucuugcugucaguacuuccggggugggggaagggaguaugacuauguauuaaaacaauucuuuuacaauauaugaacugcucauggacuggauuuguuucaggaagacuacucuguggcuuuaauuauuuuucccuguuucucuacuacaauacagauggcuuccuugaacauuuuugugagcccaugguagguuuuuauugagacuucauggaaagucugacuuaaaccccccagcaacuuuucccucucaacaaaguuaagaagaugcagaguuaauuuugaaaucucuauucccagaggaaaaugaaccagccaaaggauuucccagcaagggguagacagcuguccauucccuacaguuuuagcuuguagcuauggugcucauggacauaaugccauuguauuuggaguguugaccuuugagguuguccaguaugaaccauuguagaaaaagucuccuggguuucuagaacguuuuucuaaagcagcaaaagucuuagccuugauaaacagcaagcuguucuccuguaguuggagcuacuggaagugcgcagacagcaagaggaagaagaaagaaagaggcggccaccuucuccggacccaaacacgaagguuucagaggaggcugagucccagcaauggugaggcacuggaagcauaagaggcuaaaacuuagcuggugugguggugcagcccuuuaaucccagcacucagggggcagaggcaggcggauuucugaguucgaggccagccuggucuacaaagugaguuccaggacagccaggucuauacagagaaacccugucucgaaaccccccccccaaaaaaaaaaacaaacaggcuaaaacuuugguuaugguggcgagugagauuauggggcaucugucuuaagucuuguagagccaggaaauacccuuccuguccaaugucucaucuauacuauugagaauccuguagccauugccaaguggcaguggagaacagucacaugacagagugaaaugcagaggaggaccaccagaacacacagacacagucucugggugacucauuggauagaagcaccacugggauuucaggccagcgauucuguguuagggaagaacugauuuccuauuugcagaaggcuauugguggguugugagcuccaugaaaaugucuaaaguggauuuauaagauagggguggugacagaguguuucugaaggcuuagggacugucuaaaacacuuagaagugccagauguaacagcaugacauuguguggaagaagguguucacgcuugguuuuuccuuuucucuucccuucuuucucuuccccuucuaucuuucccuucgcuuuuccaaucucacccuuacagggauacuucaaaaggagaccaaguuucccagaaugguuugccggcugagcagggaucuccacggguuaguuaccgcucucaaacguaccaaaacuacaaaaacuuuaauagcagacggacagccagugaccauucauggucuggaaugugaaguucacuaccauuugucaagaaccacucuguccacauccuuugaccuuuuggcuuccacgucacccagaguguuaaaauuuuuacuuaauucauagcuguccuugauuucauauuuguuugcauuuaauuuauguuucuuuggauccucauugccucaaagcagcauacuuaauuuuuguuuauuuauugugagcuuuuuacuuuaagauuuuacaugaguaaucaaaauuaaauuauagcauaaugaaauuagacucuuaacagguacggcacacacaaguuaauaguacucugcuauaggugcuauguuacuuacaaguauuauuaaccuauuggcuuccauuguauaguaguuuaguaacuaugaagacugguuuguaaggaaggaaacguuuacuacuaagguuaggccugcaguugcucuggaacauuccauggagaaugcauucaucaaacggcccgaaagaagcuacauuuuguugggaagcuggauaaguuuuaggugcaggaccccaaauguucugagaccuuuggggccauuuauuacuuuguacaagcccaauaauccucucuuuucugccaaguccucaacccagaaauguaggcuucugugcaccacacggcacagcccacugauugcugccaccggcucugucuuggucaguguuaccacugccagcacucaggcuguggcagaugccagcagcucuuaccaucagucagagucuucagggugucaagcuguuuucauuuuuuaggcaaauagaacaaaagccauuuugguucauccugaucacuugaaugauagacucaaugcccugugccuggcagggagcgcuugcagagguguccuagccuuagagggcuacuucagugucucuacugacagaaacuccuguaucucaaauggaucucgaaguucucuaguaaggaguccuaaggaugacauguauugggccacuagcagggauugaaaacauuuuaaaagaaauccuuuuucuuaggaguaaaagcugguaaaaggggugacuuccugguucugaucaaaaccagaccaaacccucauuucagcaaagccuugcaagacacucccuugcucauuugccauauuuagaugucuuaguggagucagagcccuguuugguauguguuuuucaugcuaagucuaaauugucuuuucauuucaugaugcauuuuuucucuuuugucaggauaacaucauauagcaucuuguuuguuuuuccuaaucucuauguacauaucuaucuaccuguaaccguagauagguaucuagauagauaccaagcuuuuaagcucugggcuacuaugcaucauuauugggucucugccuuaaaacacauccaaauuuauauuagaaaaaaaaaaaaacuguaucuuuuucuuuggucacuaagauccccugaccaugucuuuauggccacaaauuauacugugucacugaucauauauauguguguguguauguauauguauguguguguguguauauauauauauauauauauauauagccacacaugaucauacuuauauaugauguuuccauauaugugcuguguguuuaaguuuuguaucauccagacugauaccaaauuuuaagguuuuuuuuuuuuuaacaaagacaauacacacauaagcacauuaaaacaggaaugcuaugauacuguuuagcauuugcucugcugccuaucuuucucuguuuuuaauuaacaauuggauuuuauuggaagaagaaaaagcaguuucauuauuuuggaugaugaugcagagacucauguuaaugaacucgaaaaugguguugcuucauguacuuugaaaaccaaucagguguuuccugcgcuacuacuugucauguugcauucauguucacauccugauuucacugccucagaugugccuggccacaaagcacucugaacuaauuccuaaagagaagcaacaauauguguauguggggggguugaucacauacauguaccaucgugugaucauaguacuaugauuugcuuuugacgucuguccuagugauguguguugucugcuggcaugcuugcagcacauguccauuaaaggucauuuuguuuauuuguuggcaugcuuacaacacauguccauuaaaguucauuugguccuuuuauuuucauuguuuucuugguuagugauuucauuugcauaaacauuaauuaucucugcauacuggugugggguuuucucuuuccuucuaacuccagagaaaaaaauuuuugcugcagaauucccaucagaagagacuucuugucuucaacuuccuugaagugugaccagcucugauaaauuauagccauuucuagauaaacuucugcccacccagccacuagugguuuccgcgucaaagcugcagcacuaaauuuuuuuuuaccuggugucuguauguacuaacccauguuucucuccacucacaccggcucagccuuccacaccaacucacaugugcuccuuacaugaguuuccugagauuccacuagaagagauuugucaacuguaagaccccucaacauucuuuugacuugggcuuugauuacuuucccucccccaaaauagugaaaagggaauccagguguaguggggauacuuggcaauccucgccacuggcagaagcauugggaguuuaagcccauccugggcaacaaagcaagacaaaacuaagagaggaggggaaagagugguagccuguugcucagaccaugcccgcaggcugcugcuuucacagccaggccaacuaagcacucugucccccaccccgugucuuucugcccugauaauccauuuaccauauuggcaugagaauagagaauuuuaaucaaaaacaaccuuaggauugcauagucuccagucaaacccuaaaccuuggugcuaauuaugcuaguuuaccuaaguuuauaauuccaaacgcuucuacaacguucucauuacuauuuuuccagaaaauuagcuuuauuuacaauaagcaggcuccauuaaucgagauaagaccuaagcaagagaguugacagaucugaguuuugcagugggaguggccagucuaccgcuuauacugcgaagguugcugcuaacugggugucacucugacucuggacagcaguggugggggacuauagcuaaugacugugccauugauacuuccaugucugucuguguaugaggggugcagguugucuguaaucuacuaaagcaucagccacacccagcuuuaguaacuugcuaauccaugcccuggguauaucagccaggggcugcuacaguuaaugguacacaguugaugguacacaggccgaaaacgauaaugaaucaagacccuacuacauuuccaaagccgaaaaaccguguggguuacaauuuaagugagcuugggaaggaacgcuccugaagacgucuccagacugaagggucaaagccgcuggaagccuggcugucucugggcucccgucucagugcagcaaggcaccgugaucaaccacccgugauggggaaggcccugguucagucuuuguuuggggguaaauagcugugugguguugagugacugugauuggcuuuuucuucagcuccuuuaacacaaacuacaacccacucacaaucaaccugggcagaugugguucaguugauguuuguggacuugccucauuuccuuccagcucuuaaguuccaaagucuaacggggaugguagaugugaaaugcaugacuguuguucuaauuucugcauguguuuauggugaucuggagaggaggggugugggagaagaacuagggagccucuuucagaaaccaaagguguuuacuuguugcaucugggggaaugcuguauaguucugauaggauugucucuccaucuguuugugaaugcccuuuugcuucaacuuuagcccuucugaugaugcccuuggauguaagguggcugcuguauaacguccacucucauacuuaauaugucugauuguuuccauugucuuuguguuuuaaaguaaccguaagaggagaugaucugaguauguuagugagaauggaguaaucagaggaguagagugcaguaaaacucauacuggcauuucgcuuuucucauuuccccgcaagugggugggcauuaauccauucccaccuucuaauguccuugguguccaaagcuggcuuugcagggugugcacugguuuuacugcacugccuccaucugugccaggcauuuauacacagccacgugugcgagucagagcguaugugguccucucuuacucucggguucucugaauggccccucugcugucccuagauggcaggaaccauggaaacgagugaaauggucaacggugcugcugagcagaggacaagcuccaaagaguccaguccuguucccucucccaccuuggaccgaaaggccaaaucugcacuuccagcccagagugcugccacccugccagccaggacccuggagacacccgcugcccagauggaaggcuuccucaaucggaagcaugagugggaggcccacaauaagaaagccucgagcagguaaaggcagcacgugaggaaaguggggagggaaaucacccgugggaagguggcccagggucucgcaggauuggcauucagaaggucagagcuugucauucuuguguguacaguguguugagaaucggagugagagugacacucagcucaggagauguagcuggcaggaaucgcaggaguggccugaggcuuguccugaggaggcgcucacuagagcaaaguugaacagucuccugaagugaagugaccucauuguaggguuccuaguaggauccggcuuucacagguacucacuccuccauaugagucuugagaugaccaucucccaccagucucuaaguuuauuauuuagcugaugagauaguagugacucugagagguuguaaaaaagcauacuuuuuuagacaucuaguaaauaguaaaacugagaugaaaaccacaucuaauuccaaagcugguacaacuuagcuggucugccauaugucuagauuacuguacauguggagugucuacuguacaaaggacuugugucuguguuggauaagguaacggucugauguucucauuaaguuaucguauacugacaguuugccccuuggguauuguuggcacacaccugaguguagcuccccaaagggauaccauaaauaccaauggcccuggaucuacccucuugucaguagcugaaccccagaaagaaugucacuaagucugggggagauugugcuugagaauaaggagccuugucuguguuccugaacaugagugaaaagcuucaaaggccgcaugugauagaagggacagcagcucacguguucucugaugcagagccguaucccuccccagcugcgccucaggcauaugcgcuguuccaaagaggcugaguucagggcuaauauuugguauagguucaguuuagagaggcuuugaauaagggguagccuguuugugaagaucuuucagcaaaggugagcgcagagccuuaauacuucuuucucugcuguacccacucagguccuggcacaauguauauugugucauaaauaaccaagaaaugggcuucuauaaagaugccaagagugcugcuucuggcauccccuaccacagugaggucccugugaguuugaaagaggccaucugcgaaguggcccuugauuacaaaaagaagaagcacguguucaagcuaagguaagaguuuucaagcucauggcugucuggguguguucaucucacagagguuggcuuucccgcuaagguacugugauggccgugccuccuccuaccauucucagucccuaagaaagugaauauccagucugcacacagccuacugagacuugcuggauuaauucugaggaaccaaggucacucuucccugggccugguugugcaccuggacccagaggaaaaggagccuucauuucaugaccuggaacacacuguuccccgacacugcugugggccauaauugucacaguauauaaugggagcuuuaaagucccauuuugaguccuucuggcuuaugcagacuaaggaauuaccauguuugcuucagauagguacugugagucauccuagagccugaggagacaaacaggaaguacuugggugggacaggccauccuccccagcucuucccacacuucugcauccaaaugacuccuccuuguggaagacacccccucacaccacauccacacgcaugcuccuuguguuuggauauuggcaaaccaucucauuucucaaaguguaaaaagauaaggcaagggggugagaaugugcucaguggcaacaguuccugcugccaagccugauuauacagcuuuccuucucagaacccacgugguggaaaggaggaaaggaaaggcucucuugcagguugucuuuuugacauucacgagugugcauacauacauauauuuucaaaauacauuuugucaugagagucccagauaacuugaccucuuaacuguuccaucuuagcacccccuccauggaccucagagucaguuccuacugcugcacccauaguaccagacaucacagugccacacugauggccuccugggugugacugcuuucauuuccauaagaaaaaucuagaggucuuuuuuuuuauugucaguuggguaacucuagaaauugcagauguggaagacacaaacucagaagcuagaauuucaagaguacucaccuuuuuugaaguuuucucuugaauucauuucuggucagaaauuaagaauccaagugguauuggccauaacaaagccagaccuuucagagguugaauuuuuuuuugauccuucuguuggauuaaagcaccagauugccuguguauauuggauuuaucuggugaaugugugacuucauaaugaccaggggccauugucgggccagugcacaucuccaggccuggucaucaacccauggagagcucuauugacaucucugagguaaacccauggccugcuugugacccacccuagauaaggggaucaugggguuuuguuugguugguuugguuuggguuuguuuuguuuuguuuguucuguuuugcuuuuugagacaaaguuccucugugccuggcuauuuugaaaaucaagcuauagaccaggcuugccucaaacucacagagauccaccuaccucugccuccggaguacuggaauuaaagauguacaccaccauaccuggccuguauuuuuaauuuauauuuuuuaacuuucuaauaugaaauuguuaccuacauaauuauaaaauguaauuuucuugaaauuacagacuaagugauggaaacgaguaccucuuccaagccaaagaugauguaaguuacuacuggguuuuguuuucucagauaccaaagcucauggaaguauuugugagguguucaacugucuggucuucauagccaccaacacuagacuaaaagaagaaaauaucaucauguuccucauuaaaggagggaaacuagagcaacauccacuagauucacuggaaacuaggagcaaggaaggcccuugccugcugcuccuuagagcaaggcacagagagguggcccaagucugaguauauguccugaugcccaguccaaagccucuacacuguacuccauuaccauuagccucaccuccuuggagaagagagggucaccucagugaucauaacaugugcagcaauuuacauuuuaaaaggccccuuccaccaggagagguaacucuggaaaagggcguggggacguguaagauggcuuaguugguaaagggccugccauccagucugaugacuugaguuugauccccaggacauacuuuauauaaagagaaaaucaacucugaaaaauugucuucugaugagcaugaacuuacgugucuacacacacacauacacacaugaaaacauuuuuuuaauuuagggaggaaaaacacuuucuagaaugagagugauaucucacagccuuagucuaguccuguagcucuuguagguauguaggacuacaucccagaguaauggucugcgggugcagagcagugggcccaucugaggggcuaagccauauccucugugguauugagaauguagauaagcauuuaaggacagugacccuagaggcacugcugcugagccuucuagcugucaggcuuggaucgucauggagguaagaccaacuccucaugcccgccccucuugaccaagucuuaaccugugucccuuccucuaucuaggaggaaaugaacacauggauccaggcuaucuccucugccaucuccucugacaaacacgacacaucugccagcacccagaguacgccagcauccagucgggcgcagaccuuacccaccagcgucgucaccaucaccagcgaguccaguccuggcaagagggagaaggauaaagagaaagacaaagagaagagguucagccuuuucggcaagaagaagugaacuucccuguugucccgcccuucucuuaccuuuaguaagaguccagcaugcaaguuccgaccaacacauuacucugugccuaauguuccuccauguaguugauuuuuuuucuuuucuuuuuuuuuuauuuuugaaauaaauuuuuuaauuuauagaguauuucugaggggugggggaaccauaccuaaacacuuuaucuccaaguuuaaaaaguuugagguacagagggaaggccagauuuuuuuaaugaaauuauauagauuagaucucaguauuuaaacuguuccucaauuuugugaggcuguguuggaaauaacccgccucugaugcuguugguaugcaaggcaguggugcuuacacaauauuuccugugcucuccagagacgauggaccgauuuccugacacuacucucccuucacuuccgugguuacccugagucuugacuuacaaaugcccacgauggguguagccuuuauuaaacagaucauguauucugaucucuugcugcagccacagugcagcuccauguaaaccuacaggccaaaccauuuguauccggcaucacuuacuaacacacaacauguggcuuuucugcaucaauugcugugacaguucagaauguugguauacaagaaagaauagaaaauugauaagguuuuaaauaaucuguaauuucagucucuuuuuuucugaaauacauuauauuguauguuugagauaauucuaguacaaaguauaauaaacuagauguauaauaaacccuuuaaaucauugcuaaguguauaaguggaacugaagcauuuacuggacaaaguaauguuacucuaaugguuacuugcuugugcguggccacacuguuauaauuugcuucauuacccugcuauuugauacauagugugcauuucucugucacuguaacuauuguaauaacaaauuuucaucuuacugcacaaucaaaauggcaucuauaguaaugaccuccagagucugagcuuggacagagagugggcgcucaggccuggugcuccaucauacgaccuguaccucucaacuuuugcccuguuaaauauaugcuaugucauuaaaugcuuuuaaaucuag

SEQ ID NO: 5916 - RNA, 4564 nt, Mus musculus
ugaaaaacaggcaauauuguacaaggaauuauaauauugaauaggaaaggccuuuaauggaaaauacagcaugguuucacuugcacauauauuauauauauauacuccacugacuucuguugugggaaauauugaaaagaauagcaaguucccacauacacugggcaccagcaggcuacaugguuccagcuggguauucucaucucagcagacuuucugcccagagcuccaaaaucucuccacccagcucacuaaguucccauuggugggucacuaccaugucugacccauguuucaaaacccccauggccuuugugaugcacaucuggaaaacccacacuuuguggccguaccuuucucucuugaacccaguugaaccacccacgugaaggaaaacaccacacaaacuuaguucagaaacaaugguaacucaaucgcuguguacaauaacuagaauccuaaucuuguaagccauauugaaucuaaauccucugcuggugaauuuagcagauuugccauaagccaacgaaacaggcagggagauacuaguagcuacauuuuguccucucacuaucuaaguucaauaggacccuaucucuuucuuccuuccucucuuccucucuacucccccagugauugaauccuuuauucauuaggggaugguucacaaggagucaccugaguaugugacucauuacucauuccagacaaccccuccuaggaaagcagaauuaauaucaaaauacaacaacacugagccacccacaacagauucuuauuuuaaauuuuauuuauuauuauuguguauauacauguaugguuaugugugauuacaaaaaugcaucaugauuuguguguagaggucauaagucauuucuuuccuaucuuguaucuuguuuccuugagucccaggcaucaaguaccuuuaucuucauagaccugauuuucacauuuuuuuuauaacaauggaacccuccucuaaaacacagcuuuacauagaacugaauacauaaaagaaguugguuguuuguuguuuuguuuuguuuuaacacaacuggugugacugaacuggaauggagaggucccucauacuuagucucuccuuccuuguauuuuggucuacuucaaaucccuugggaaaacaaguugaaaaugaccauccuaguacaucuugaaggcauaacaaauuguagguagaagguuucaugguuggguugauguaccagucccaccauugaaaacuuugccugguuacagaagauggaagugguaguguagaaugugggagaguggcaaaccaauaauggguacaacuugaggcccccacuagcaacaagugggagcuuaugacagacacuccauggacugcuaggaaccagaggcugcagagaccagagacccaagagagacccaaacacaacugaugggaagaaaaauaaggcaaugaaauaauuccuaaugauauucugcuacaccugugccuagcucaauugucaucaaaaggguuucaucuagaacugaugagagcagauacagagaccuguagccaaacacuaggcagagccaggggaaucccaaaggaguacaggaggaaggacuguaggagccagagaguucaaugauaacaggaggacaagaccuacagaaucaacuaugcacuacucaaaggggcucacagagacugaagcagcaaucauggagccgguaugucaugguuguguagcuuggugaucucaugggacuccuaacacugagagugggaaguguuucugacucccuuuuuuuucuugggacccuuuucuuccuauugauugccucauacagccuugauaugagaguuccuagucuuauuguaacuuguuaugccauacucaguugauaucccugagagaccugcccuuuucugaagagaaauggaggaggaguagaucuaggggagauuauagguggaggagggacugaaaggaauggagggaggggaaacugaaggggauauaauauauuauagaagaauaaauuuaaaaauaaaguaaacuuccauuucauuuuuuaaaaaaagagaagaaaaagacauagagaaagaaaacuaccaucaacuaccacccuaucugugaagcaaauucuacugcuauauauggcccaaggcaugaccuguaccuacaaaucuguauucaggccucuccccuaccugcugcaugguaugaauugaaagaaggaaguaggccuggcagugguggcgcacgccuuuaaucccagcacuagggaggcagagacaggcagauuucugaguucgaggccagccuggucuacaaagugaguuccaggacagccagagcuauacagagaaacccugucucgaaaaaaacaaaaaaacaaaaaacaaaaacaaggggcacaaaauauacuuguuuuccauaaacucaucuaggguauagcguggccaggcaaccgggccuauauauuagguagucuauagucuauauugucauggaggacaaacauagcauugauguaugucucugucuuaagucaauaggagcucaagaacacucuuacccaucucuacuaauggccuucuauagcacacucuuucccauuuagaccaaagucacaaaggacacaugaauaugcacucaauacauuuuguauugaugaauaacugccaugguaaaauagcuaagccugcugaaagugaucuuguaugaaagcaaccaaucuguuuaagauauaaguuugaaaaguuaaaagcaaugagauuauaauuaauggcccaagcaauguagaaauuaaaguuguaagccaugggaaaguggugaaucaggauucaaaccaucccugauucuguucuuuuucucuuuuccuuuuggcuaguccuucucaaacuucagccauaaaaugcuuuacuauuccugaaugaucaauuuaaagguaacauucuucaugaaggacauucuucauaguccucucuguugaaggaauaaaagaucaaguccucuccuguuuugaagaacuaccucagacaaggagguuagagauucuugcaaaugggaaauagagguuucuaucuuuucuguaucuguaucuauugcuguucuaaggagcucauaauuuuuuacuugcaaaaccagggcagaagugucaguagcuacuccucccacacucagagaguuccuuggcacccaaauuuuaaaaauuuaaaaauaaaagacaugauuuaaauaaugugguguauggggauauaauccccccuuuuuuguuuuuuuuuaugaagauauuguuuuaaaguuccauggaccuguuccauaauaccuuguccuuuaggauaauaaggaaauaugaauaacauccauuugccauaauugauuagguaugaauccucaaaaauuaacaccauuaugugguacaugaagaaauugaggacacugagaacaagucuuuacaauuugauguguauaauuucuagaaauaugaaauuguugucucaaacuauuacuauuuugauguuauaaagaaugagauuguuuggcuaauuguuccuguaaguccugguacaaaugugcugugacauuggccagggguucaggcaaucauguaugagcucuuaagugucuucuaaaguaaggaacaguacauguuucuuaaauuaagcuguauuuguauaaauaacuguaaaauuugagaauuagcaguaucuaaaaauggaacaauuucaugcaauuguaaaccaugagcuauauaucggcuaucaguauacaaauuaaaagcuugauuuuuuuuucaacauuucaaaaacagugguuacaacacauaauucaauuauuugugaagcaagggggaaacucaggagaauuaucaaaugcuucucucccauuagaugagcugauuauaaauacaguaaaugcauucuuuaucggcugcauggguaaauuuacaggaaauacaaaaguauguauagaggcaaauucuaacaauugucuuuuggauaaugauuaucagauuugccuaaaauguuuccaugcaauaggugaaauaucaguauucuuuaauaaccaauguaauugcuguuuggaauaaggaauaaacauuucaucagguucuuaagacauucugaaagagaauuaaaauucaagguacaugacucaugcggcuugcuaguuaagaaggcuuuuugggccuagagcauagaacaaaggcuguaaagcuaucccaggaacuggcuagucauaaagauagggaagacauacaagaauguccagacuggccuggcgccucccuaucucccgcccuucugaccuggguuaaauguuaaccagaugcucugcugacuuagauaagcacccggccucagaauuccugaugcccugaccugaacauacucuuuuucugauguguauguuuaaaugaaccaaucgugugaaaccaugccaauuccucccccagccccaggcccuuuucuuuaaaaaccccuagcuuucgagccucguggccgacaaccgcuaucuccugugugagauacaugucggcccggagcuccgucauuaaacuaccucguauguuugcauca

SEQ ID NO: 5917 - RNA, 385 nt, Mus musculus
cagucagccgaguuuggugucagcgacugggguugccacgcgaggcugccggcgagaaacaagagacccuacucugcuccagcaggauccagagacacggaauccgacuaccucuccacgcucaguauccucucuucugggccaguuuacggaagagcagcuuguaucccagccgggggcgggaguguggacagcgaagcaguaugagcacaaagaguucuaggccaaccucugcuuccuacuggcaacaggagacacuaucuuuaaaaaaacguguauggaagaaucuguauacacaauaguacccuguguuccucuguccuuuuaccccccaccuuucugauauuuccccguccacccuccaaaaaaguuacucaacaaauau

SEQ ID NO: 5918 - RNA, 8374 nt, Mus musculus
cagagggaggggccgcgccccggguucggugacugcgccgcgcgcccggcucgccuaggcucccgggaugcgcggaggcggcagcgauggcgaugaugacucuagcccggcagcuuccaggccaccgggcacagauagggucacuacugcgacacggaggaggaagggcggcgcugaggccagcugguaggugagaggccgcaagcccagaccgggaggaucacaccaggguugugaggcgagcgggagcggggagaaggcuaagcuuggccuggccugguagguugcgcaccuguguuccugugcagccuugcuguaagcucuacacagaccacaacccacugccugcauccaggcggaguccaagcaucccuggacuagccuaggccuguguuuccuccaguucuagggagcccccuacccguuaccaaucacaguuggggauaaaccugcaaucuccuacuccuuuagucaauaguacgauaguacgcagugcuccacagacuccuuaucccuccaccagagacccagaucuuucccaccccaucagcuauuagccucaauggauagauaguucaggugauuagaaacaaugggagguuugaaauaucucacugaccuugggcaaguuauuuagccuccccgugcuuuucuagauccauucaaauuagugggaaugggacagaacuuaguuuugugugagggcuguggaaaaaaaaaaaaaaaaaaaaaaaaagccuuccaugaagaaauucggcauuuauuugggguuggaauacaaugaaauaaucaaggucaugaguuaacuuguaaguguccuaacguuugcuucaaaaauuaauaaucucugugagcuccuagggauccggguuaguugauucuguuggucuugcccuucagcucccucaguccgucaacuuuuagaaugggaauaaaacaaacaaacaaacagcacaguauuagagacccaucgccccuccccccucccgccuucucuucccccugucccucccuacaccuacucaugacccccucccuccuucccucaggcuggcuuucaaguaggugauacugccuuuaugcucuugagagacugagauuacaggcuaccacauccagcuuuucacauauuuuuuuguuuauuuguuuugcaacagagugucacuauguagccuuagcuggccuggagcuuacuguguagaucaggcuggccuccaacucagaaaucugccuccuucugccucaugaacacugagauuaaaggccacauccauauuuuacuaagaguugacacuaagcaauuuguuaggaguuccucguucuugcuuccaguuaccucaacauccuuccgcaacuguaaucagauguauauuaauucauuuugagaaaaagucucacuauauguauguaguccagacuaguccugccugguuuuguaaucuugauccucuuggcucagcuuccccagauaugugucauuauacucugcucauucuaucuuaucaugguuaauaaguauacuuaaacccagcauucugagcuggugagaugucuccacagaaaaggcauuugccaccaaugccaaggacuuacaugauggaagcagaaagccaacuucuacaaauuauccucagaacuccaaaugucugccugucuuaggguuucuauugcuauaauaaaacacugugaccaaagccacuuggggagaaaagguuuauuucaucuuacagcacaccauacaagaaaaucagggcaggaauucaagguaggaacugaugcagaugccauggaggacugcuucuaacugucuugcuuuuuauuguuugcucaucuguuuucuuauaguacucagaaccacugacccaggaguagaaucaugcauagagagcugggccaucuccuaucauucaucaaucaagaaaauguacuugcccacaggccagucuggugggagcauuaucucaguugaggcuccuuccucuaaaaugacccuagccugugucaaguugacauagaacuaaaaaacacaguauaacaguauaguauacacucaccaaauaaauauaguacaauacaaauauguuuaaggcuagauuguaauuuaaaauauuaugauacgacuuuuuacaucuuccaggaccuaucuauaaccccagaaauaaaaaguaacauguagguaugcauuggaaauaacauuuaauguauguuuaagaauaguuaaccacugacuuugcucuaaaggacggggacacacacacaauuucuuuuuuuuuuuuugguaguuguguguguuuguuuguuuauuuguuuucuaagacaggguuucucugugucacagcccugucuguccuggaacucacuuugcagaucaggcuggccuugaauuuauggagaucugccugccuauacuucccaaauguugggguuaaaggugugugccuccaugucuggcuuacaucuuuauuuuuguuuuuaauuuucucuuaaaaucccaagaauuaguauggagcucuggguugaauuuucuuccaguuccuuuauugguuuugaaguuuuguguuccaggaacuuuuacugggaacagcaauuuaauaauucguaggauuguuuuaauggugaaguaaaguuugauagcuuauauaagguuuaaaugugagauuauagcauguaacagccguacaauaaaugagagcuguuguaauuuaguuuugaucuaaguauuccucucuugagugugaccauguaagugugcauuugugugggaauggagaagcuuuugggggaaauaugguaguauaaagcccugagaacaaagccccguacaucauaaauauucucuagauacuaacaauaguucugagagguuuauugcucuuauuuccuaaugugcauuucuauacuuuuaaauuaaaaauauauugauuauccaacuuugcacaucaucuucccaacccagggauugaacccaagaccucgugugugccagaaaaguacauuacugcuagcuauaacacccaggcuggcuuugaacuuacaguccuccugccucuguccugaguagcugggauuacagccugugccaccacuccagacucaauuccccccucacacacacacuucccucucucucuccuuucuuuuccaugauuacuuugugccuaaucaucucaucuuuuacaucuagugcuugggucuuguaacuuccacgguuccauuucauuauccccugcuuuauuugucuaagcaccuugguuccaggcucuuaucauuucccuggaccaaauuccugcuacucugguuugucuuuuucccuucucauaaauuaacuccaagaaacuuuuuuuuuuuuuuagccaacaguaaaaugcugucuuuuugcacuguaacaauaucaaaaggguucacaaagaggcaugcagucuuuuuuuauuuuuuuuaguuuauaauauuuuuaauuuuuaaaaaauuuuuuauuagguauuuuccucauuuacauuuccaaugcuaucccaaaagucccccauacccacccccccaauccccuacccacccacucccccuuuuuggcccuggcguuccccuguacuggggcauauaaaguuugcguguccaaugggccucucuuuccagugauggccgacuaggccaucuuuugauacauaugcagcuagagacaagagcuccgggguacugguuaguucauaauguuguuccaccuauaucuuucuuucuuuuuuuuuuaauuagguauuuucuucauuuacauuuccaguacuaucccaaaagucccccaugcccucccccccacuccccuacccacccacucccacuucuuggcccuggcguuccccuauacugaggcauauaaaguuugcaagaccaaugggccucuuuuccacugauggccgacuaggccaucuucugauacauagaggcaugcaaucuuaaacuagaaauaguaagagcucuccauuauuacuuaacucuaaucauugauaagcaaauguucugaauuuauacuuuuaucucucauaaaacuuaguuugaaaauguauuuuacagaaaagugaaugucacauugcagugaagaaaaucaccauaguguguguucugcaguccacagucaaugcaacagcagccacggcugcuucuggcuuaaugagggacacgguggucacauggcucucccagaacugaucugacugauucucacugccaagucuguaucuguuuaaaugcugagagacuucugcucuagauagaccauaguaguuguuuggagccacaguaaucauuuauugacuagauccagucugcaccuccugauccaacagcuaaaagguuggcaccuggaggccacugagauccagcuccagguggggcuuaaauauucugagcauaggcucuggaccuccugagcgucuuugguugucccugcaauguuacauaaaagcaaauguuuuccaguuguuaagagcagaacacuaaauguuaucuauugugcuggauucuucuuugggagaggacagauggcaaaccauacacaucuuuggggcugggaacagugaagauugugugacuauauauuaaauguccuugcauaugaaagaaaaaugacuauagauagaaagaaggagcagaaaguuuagucuuuuaaggugccagguguuucuuauguacauucagcagcuagaacaacacacacauguaaaguuucgugaaaaaugcagaauauauaccucuaauuugguggugaggaagagcaauacauacuuuuaaccacuaagccaugucccuaacccucauaguggaguguaugugugugugugugugugugugugugugugugugugugagagagagagagagagagagagagaggaauagagagguaacaaaaauacuuuuuaagcuagacaggugcaguacauugugcaccucuucacacagcaaaguauuacuuugcaccucagaaauuacaaacauaaucucagacaccuuuuguuacuugauuucuucgucuuucaaauguaguccuucaugaaucucuuuuccaaaggagauuuucaauuggucaagaacuuaacucucaaacuaguaaaagaaguaaaugcugagaaauaaagauuccucucuagaaaaaaauuggauuugucagugauuucugagcuaaagggccauauuauguaucaauacccuccuguuuaaauuucaagcacauuguguugcuugccugccuucuauugcagagaccuagucuccauuucccaagcuguucauucuucuccuugccccucaucuuucacccagcugucuucuccacaccaaagcccccuucaccauugcucagcuucuucccccugucccuggcuuuagucucugcagucacacagauguaacuauuccaggaagagacagucaacuuccaauggagaggucguauuccuguguguuuccauugccugguuucaaugccuuuucuguauuagaccuuguaacaugguuuucaaagcaauagaaauggaaauuuugaauuuuguaaaacagaaugcaauugcuagcucacuaauccauuucugucucuggguguacuuuuuuuuauguguguguguguguguuugugugugugcaggcuuaucuucuuuggcacaugcucgucgucugugagcugagauccugacucuuuuccugcugaauuuauuuuuuugagaacacaagaaagagacaccucucucugaagaugaacacaagugccccgcuucagaauguccccaaugccaccuugcuaaacaugccuccccugcacgggggaaauagcacuucucuccaggaaggucuucgagauuuuauccacacagccaccuuggugaccugcacuuuucugcuugccaucaucuucugucuaggcucuuauggaaauuuuauugucuucuugucuuucuuugacccauccuucaggaaguucagaaccaacuuugauuucaugaucuugaaccugucuuucugugaucuguucaucuguggggucacagcccccauguucaccuucgugcuguucuucagcucagccaguagcaucccagauagcuucugcuucaccuuccaccuuaccagcucaggcuucgucaucaugucccucaagaugguggcugugauugcucugcaccggcuccggauggugauggggaagcagccuaauuguacagccuccuuuuccugcaucuugcuccuuacccuucuucucugggcgaccagcuuuacacuugccaccuuggcuacacugagaaccaauaagucccaccugugucuccccauguccagucuuauggauggggaagggaaagccauucugucucuguauguuguugacuuuaccuucuguguugcuguggugucugucucuuauauuaugauugcucaaacccuucggaaaaaugcucaaguaaaaaagugccccccggugaucacaguugaugcuuccagaccacagccauucaugggggccucugugaagggaaauggagaucccauccagugcaccaugccagcucuguauaggaaccagaauuauaacaaacugcagcacagucaaacucauggauacacuaagaauaucaaccagaugccaauccccucagccagucgacuccagcugguaucagccaucaacuucucuacugccaaggauuccaaagccguggucaccuguguggucaucguguugucaguccuggugugcugucuuccucuugggauuucccuggugcaaaugguucugucugacaauggcaguuuuauccuuuaccaguuugaacuguuuggauuuacucugauauuuuucaagucaggauuaaauccuuuuauauauucucggaacagugcugggcugagaaggaaaguacucuggugccugagauacacuggccugggcuuucucugcugcaaacagaaaacucgacuucgggccaugggaaaagggaaccuugaaaucaauagaaacaaaucuucucaucaugagacaaacucugccuacaugcugucuccaaaaccacagagaaaauuuguggaccaggcuuguggcccaagucacucaaaggaaagugcagcgagucccaaaguuucugcuggacaucaacccuguggucaaagcaguuccacacccaucaacacuaggauugaaccuuacuauagcaucuauaacagcagcccuucccagcaggagagcgguccggcaaacuugccuccagugaacucuuuuggguuugccaguuccuacaucgccaugcacuauuacaccaccaaugauuugaugcaggaauaugacagcacgucagcaaaacaaauuccuauccccucuguuuaacauggccagcgagucuggagggaaugguuuucuauucuaacuaagcaagccuuuaaaagaguuugcaaagcaaaaccuggacucaacugaacacuugacaauuugauuuucuuuuguuuauaauauuaguaucuggguuggcuucaugguuucuugacauuuuaagauuugauguaaaaguuuauuucaacuucuacucuaaucuaugucccaauacuuuauauuaaacugcuaagaagaugcuaggaucuauccuacugaugaccuuuuaagucaguauuaugggacuuuagauauguauuggcuacauuuucuuucuuuccauuuauuuauuuacucacuuuauauccugauugaagccccaccucuccucccaguacccgcucacauggcccuucucccaauuccuacuacccuuuauuucugaaaagggggagguuccuccuggguaaccaacccacccuggcaccucaagucacugcaggacuagguauauccucugccacuaaggccagacauggcagcccaauuacgggagcaggauucacagacaggaaauagagucagggacaaccacugcucuauuuguugggagacccacaugaagaccaagcuguuacaaaugugcuggugagccuagguccagcucauaugugcucuuuaguuggugguucagucucugggagccuucaagggucagguuaguugccucuguugguauucugaagggguaccuauucccuccagguuccucaauccuucccccaacucauucacaagacuucccaggcucagucuaauguuucgcugugguacucugcaucuguuucugucaacugcuauaauuuggcuacauuuuuuaaaauguguuugaaaaaaaaaugaucuuucugaaguguuauuuuuauaaaaauauggaauuuguguuuuugaaguacugaaacagcaaacaguguacuuuuuuugguggcaagugauuuaaauaaaaaacuuacuauuaaagcaaaaaau

SEQ ID NO: 5919 - RNA, 8374 nt, Mus musculus
auuuuuugcuuuaauaguaaguuuuuuauuuaaaucacuugccaccaaaaaaaguacacuguuugcuguuucaguacuucaaaaacacaaauuccauauuuuuauaaaaauaacacuucagaaagaucauuuuuuuuucaaacacauuuuaaaaaauguagccaaauuauagcaguugacagaaacagaugcagaguaccacagcgaaacauuagacugagccugggaagucuugugaaugaguugggggaaggauugaggaaccuggagggaauagguaccccuucagaauaccaacagaggcaacuaaccugacccuugaaggcucccagagacugaaccaccaacuaaagagcacauaugagcuggaccuaggcucaccagcacauuuguaacagcuuggucuucaugugggucucccaacaaauagagcagugguugucccugacucuauuuccugucugugaauccugcucccguaauugggcugccaugucuggccuuaguggcagaggauauaccuaguccugcagugacuugaggugccaggguggguugguuacccaggaggaaccucccccuuuucagaaauaaaggguaguaggaauugggagaagggccaugugagcggguacugggaggagagguggggcuucaaucaggauauaaagugaguaaauaaauaaauggaaagaaagaaaauguagccaauacauaucuaaagucccauaauacugacuuaaaaggucaucaguaggauagauccuagcaucuucuuagcaguuuaauauaaaguauugggacauagauuagaguagaaguugaaauaaacuuuuacaucaaaucuuaaaaugucaagaaaccaugaagccaacccagauacuaauauuauaaacaaaagaaaaucaaauugucaaguguucaguugaguccagguuuugcuuugcaaacucuuuuaaaggcuugcuuaguuagaauagaaaaccauucccuccagacucgcuggccauguuaaacagaggggauaggaauuuguuuugcugacgugcugucauauuccugcaucaaaucauuggugguguaauagugcauggcgauguaggaacuggcaaacccaaaagaguucacuggaggcaaguuugccggaccgcucuccugcugggaagggcugcuguuauagaugcuauaguaagguucaauccuaguguugauggguguggaacugcuuugaccacaggguugauguccagcagaaacuuugggacucgcugcacuuuccuuugagugacuugggccacaagccugguccacaaauuuucucugugguuuuggagacagcauguaggcagaguuugucucaugaugagaagauuuguuucuauugauuucaagguucccuuuucccauggcccgaagucgaguuuucuguuugcagcagagaaagcccaggccaguguaucucaggcaccagaguacuuuccuucucagcccagcacuguuccgagaauauauaaaaggauuuaauccugacuugaaaaauaucagaguaaauccaaacaguucaaacugguaaaggauaaaacugccauugucagacagaaccauuugcaccagggaaaucccaagaggaagacagcacaccaggacugacaacacgaugaccacacaggugaccacggcuuuggaauccuuggcaguagagaaguugauggcugauaccagcuggagucgacuggcugaggggauuggcaucugguugauauucuuaguguauccaugaguuugacugugcugcaguuuguuauaauucugguuccuauacagagcuggcauggugcacuggaugggaucuccauuucccuucacagaggcccccaugaauggcuguggucuggaagcaucaacugugaucaccggggggcacuuuuuuacuugagcauuuuuccgaaggguuugagcaaucauaauauaagagacagacaccacagcaacacagaagguaaagucaacaacauacagagacagaauggcuuucccuuccccauccauaagacuggacauggggagacacaggugggacuuauugguucucaguguagccaagguggcaaguguaaagcuggucgcccagagaagaaggguaaggagcaagaugcaggaaaaggaggcuguacaauuaggcugcuuccccaucaccauccggagccggugcagagcaaucacagccaccaucuugagggacaugaugacgaagccugagcugguaagguggaaggugaagcagaagcuaucugggaugcuacuggcugagcugaagaacagcacgaaggugaacaugggggcugugaccccacagaugaacagaucacagaaagacagguucaagaucaugaaaucaaaguugguucugaacuuccugaaggaugggucaaagaaagacaagaagacaauaaaauuuccauaagagccuagacagaagaugauggcaagcagaaaagugcaggucaccaagguggcuguguggauaaaaucucgaagaccuuccuggagagaagugcuauuucccccgugcaggggaggcauguuuagcaagguggcauuggggacauucugaagcggggcacuuguguucaucuucagagagaggugucucuuucuuguguucucaaaaaaauaaauucagcaggaaaagagucaggaucucagcucacagacgacgagcaugugccaaagaagauaagccugcacacacacaaacacacacacacacacauaaaaaaaaguacacccagagacagaaauggauuagugagcuagcaauugcauucuguuuuacaaaauucaaaauuuccauuucuauugcuuugaaaaccauguuacaaggucuaauacagaaaaggcauugaaaccaggcaauggaaacacacaggaauacgaccucuccauuggaaguugacugucucuuccuggaauaguuacaucugugugacugcagagacuaaagccagggacagggggaagaagcugagcaauggugaagggggcuuugguguggagaagacagcugggugaaagaugaggggcaaggagaagaaugaacagcuugggaaauggagacuaggucucugcaauagaaggcaggcaagcaacacaaugugcuugaaauuuaaacaggaggguauugauacauaauauggcccuuuagcucagaaaucacugacaaauccaauuuuuuucuagagaggaaucuuuauuucucagcauuuacuucuuuuacuaguuugagaguuaaguucuugaccaauugaaaaucuccuuuggaaaagagauucaugaaggacuacauuugaaagacgaagaaaucaaguaacaaaaggugucugagauuauguuuguaauuucugaggugcaaaguaauacuuugcugugugaagaggugcacaauguacugcaccugucuagcuuaaaaaguauuuuuguuaccucucuauuccucucucucucucucucucucucucucacacacacacacacacacacacacacacacacacacauacacuccacuaugaggguuagggacauggcuuagugguuaaaaguauguauugcucuuccucaccaccaaauuagagguauauauucugcauuuuucacgaaacuuuacauguguguguuguucuagcugcugaauguacauaagaaacaccuggcaccuuaaaagacuaaacuuucugcuccuucuuucuaucuauagucauuuuucuuucauaugcaaggacauuuaauauauagucacacaaucuucacuguucccagccccaaagauguguaugguuugccaucuguccucucccaaagaagaauccagcacaauagauaacauuuaguguucugcucuuaacaacuggaaaacauuugcuuuuauguaacauugcagggacaaccaaagacgcucaggagguccagagccuaugcucagaauauuuaagccccaccuggagcuggaucucaguggccuccaggugccaaccuuuuagcuguuggaucaggaggugcagacuggaucuagucaauaaaugauuacuguggcuccaaacaacuacuauggucuaucuagagcagaagucucucagcauuuaaacagauacagacuuggcagugagaaucagucagaucaguucugggagagccaugugaccaccgugucccucauuaagccagaagcagccguggcugcuguugcauugacuguggacugcagaacacacacuauggugauuuucuucacugcaaugugacauucacuuuucuguaaaauacauuuucaaacuaaguuuuaugagagauaaaaguauaaauucagaacauuugcuuaucaaugauuagaguuaaguaauaauggagagcucuuacuauuucuaguuuaagauugcaugccucuauguaucagaagauggccuagucggccaucaguggaaaagaggcccauuggucuugcaaacuuuauaugccucaguauaggggaacgccagggccaagaagugggaguggguggguaggggagugggggggagggcaugggggacuuuugggauaguacuggaaauguaaaugaagaaaauaccuaauuaaaaaaaaaagaaagaaagauauagguggaacaacauuaugaacuaaccaguaccccggagcucuugucucuagcugcauauguaucaaaagauggccuagucggccaucacuggaaagagaggcccauuggacacgcaaacuuuauaugccccaguacaggggaacgccagggccaaaaagggggaguggguggguaggggauuggggggguggguaugggggacuuuugggauagcauuggaaauguaaaugaggaaaauaccuaauaaaaaauuuuuuaaaaauuaaaaauauuauaaacuaaaaaaaauaaaaaaagacugcaugccucuuugugaacccuuuugauauuguuacagugcaaaaagacagcauuuuacuguuggcuaaaaaaaaaaaaaaguuucuuggaguuaauuuaugagaagggaaaaagacaaaccagaguagcaggaauuugguccagggaaaugauaagagccuggaaccaaggugcuuagacaaauaaagcaggggauaaugaaauggaaccguggaaguuacaagacccaagcacuagauguaaaagaugagaugauuaggcacaaaguaaucauggaaaagaaaggagagagagagggaagugugugugugaggggggaauugagucuggagugguggcacaggcuguaaucccagcuacucaggacagaggcaggaggacuguaaguucaaagccagccuggguguuauagcuagcaguaauguacuuuucuggcacacacgaggucuuggguucaaucccuggguugggaagaugaugugcaaaguuggauaaucaauauauuuuuaauuuaaaaguauagaaaugcacauuaggaaauaagagcaauaaaccucucagaacuauuguuaguaucuagagaauauuuaugauguacggggcuuuguucucagggcuuuauacuaccauauuucccccaaaagcuucuccauucccacacaaaugcacacuuacauggucacacucaagagaggaauacuuagaucaaaacuaaauuacaacagcucucauuuauuguacggcuguuacaugcuauaaucucacauuuaaaccuuauauaagcuaucaaacuuuacuucaccauuaaaacaauccuacgaauuauuaaauugcuguucccaguaaaaguuccuggaacacaaaacuucaaaaccaauaaaggaacuggaagaaaauucaacccagagcuccauacuaauucuugggauuuuaagagaaaauuaaaaacaaaaauaaagauguaagccagacauggaggcacacaccuuuaaccccaacauuugggaaguauaggcaggcagaucuccauaaauucaaggccagccugaucugcaaagugaguuccaggacagacagggcugugacacagagaaacccugucuuagaaaacaaauaaacaaacaaacacacacaacuaccaaaaaaaaaaaaagaaauuguguguguguccccguccuuuagagcaaagucagugguuaacuauucuuaaacauacauuaaauguuauuuccaaugcauaccuacauguuacuuuuuauuucugggguuauagauagguccuggaagauguaaaaagucguaucauaauauuuuaaauuacaaucuagccuuaaacauauuuguauuguacuauauuuauuuggugaguguauacuauacuguuauacuguguuuuuuaguucuaugucaacuugacacaggcuagggucauuuuagaggaaggagccucaacugagauaaugcucccaccagacuggccugugggcaaguacauuuucuugauugaugaaugauaggagauggcccagcucucuaugcaugauucuacuccugggucagugguucugaguacuauaagaaaacagaugagcaaacaauaaaaagcaagacaguuagaagcaguccuccauggcaucugcaucaguuccuaccuugaauuccugcccugauuuucuuguauggugugcuguaagaugaaauaaaccuuuucuccccaaguggcuuuggucacaguguuuuauuauagcaauagaaacccuaagacaggcagacauuuggaguucugaggauaauuuguagaaguuggcuuucugcuuccaucauguaaguccuuggcauugguggcaaaugccuuuucuguggagacaucucaccagcucagaaugcuggguuuaaguauacuuauuaaccaugauaagauagaaugagcagaguauaaugacacauaucuggggaagcugagccaagaggaucaagauuacaaaaccaggcaggacuagucuggacuacauacauauagugagacuuuuucucaaaaugaauuaauauacaucugauuacaguugcggaaggauguugagguaacuggaagcaagaacgaggaacuccuaacaaauugcuuagugucaacucuuaguaaaauauggauguggccuuuaaucucaguguucaugaggcagaaggaggcagauuucugaguuggaggccagccugaucuacacaguaagcuccaggccagcuaaggcuacauagugacacucuguugcaaaacaaauaaacaaaaaaauaugugaaaagcuggaugugguagccuguaaucucagucucucaagagcauaaaggcaguaucaccuacuugaaagccagccugagggaaggagggagggggucaugaguagguguagggagggacagggggaagagaaggcgggaggggggaggggcgaugggucucuaauacugugcuguuuguuuguuuguuuuauucccauucuaaaaguugacggacugagggagcugaagggcaagaccaacagaaucaacuaacccggaucccuaggagcucacagagauuauuaauuuuugaagcaaacguuaggacacuuacaaguuaacucaugaccuugauuauuucauuguauuccaaccccaaauaaaugccgaauuucuucauggaaggcuuuuuuuuuuuuuuuuuuuuuuuuuccacagcccucacacaaaacuaaguucugucccauucccacuaauuugaauggaucuagaaaagcacggggaggcuaaauaacuugcccaaggucagugagauauuucaaaccucccauuguuucuaaucaccugaacuaucuauccauugaggcuaauagcugauggggugggaaagaucugggucucugguggagggauaaggagucuguggagcacugcguacuaucguacuauugacuaaaggaguaggagauugcagguuuauccccaacugugauugguaacggguagggggcucccuagaacuggaggaaacacaggccuaggcuaguccagggaugcuuggacuccgccuggaugcaggcaguggguuguggucuguguagagcuuacagcaaggcugcacaggaacacaggugcgcaaccuaccaggccaggccaagcuuagccuucuccccgcucccgcucgccucacaacccuggugugauccucccggucugggcuugcggccucucaccuaccagcuggccucagcgccgcccuuccuccuccgugucgcaguagugacccuaucugugcccgguggccuggaagcugccgggcuagagucaucaucgccaucgcugccgccuccgcgcaucccgggagccuaggcgagccgggcgcgcggcgcagucaccgaacccggggcgcggccccucccucug

SEQ ID NO: 5920 - RNA, 6799 nt, Mus musculus
gggcuauaagaacauaggugauggcuccaggaaaccaaccgucccacaaugcaaaggccgucggugacgccauuagacgagcgccggcagcgcggcgagcggggagcgccuugguccccgccgccucccacccugccgccuccgucgccgccgccuccgugggccccuccgugucugcgcagcucugcccgcggcucccggaggagcagcggagcgcggggcccggcgcgggcgcggggugcggccauggcggacggugcgggagcaggcgcggcgggccaggcuucgggaccguccgggggcucgaguggggccggcggcccugucaaucccgcuucgcugccuccgggagacccgcagcucaucgcucucauaguggagcagcucaagagccgugggcuguuugacagcuuccgccgggacugccuggccgacguggacacuaagguaccugagccucgggggaccaaggggggcggaccauccaguugcuuugacgugccagagcccggaguaaaacaaaaggcaccucgagagccuggcagggacgcgcugcucggggcacuaccgguaucuucugaguggugcacacccgacaccggagcccuuaccagcugugauuuuuaaaucaaucaaucaaucaaucuaucuaucuaucuaucuaucuaucuaucuaucuaucuaucuaucuaucuaucuaucuaucuaucuaucuaucuaucuaucuaucuaucuaucuaucuaucuaucuaucuaucuaucuaucuaucuaucuaucuucugaguggugcacacccgacacuggagcccuuaccagcugugauuuuuaaaucaaucaaucaaucaaucuaucuaucuaucuaucuaucuaucuaucuaucuaucuaucuauucauuuauuuauuuauuuauaguucuuucgcuuuucugaacuugaggauucuuuaauggcugcacacguauacccacuccauacccaagaaacuuguguuuuacaacccaugggaaagguagaguacuuuagaagcuccacccguucccuuguucaccugggaggugauuuuuagcacuggcuggaugggacugcacguuaauagucccuuuccccagcugaaucauuugcagacuuguuugaggucaaauugggauaagcugucgaaucagcaccuucuuuuuuuccauuuaacuaauugaaauggaguuaauggcuauguuagauccagugccaaaggccagucuaccguuaaacaaaaugcuaauucaccucauuuggaaacuuuggaaugugugucacggggcagguauauaguagccagaacauuuccuuucccauuacaaaacuugcuugccaagauuaagguguggagcuaggagccucuuugcugacugagagggcuccccaggguagugguugcuccucaugcugucagggcugugagucaccaagcaagcuggucuaguaggccuuagcuggggcucagcugucagcuacaggcugcuggggccuguccuacggcuuugaugugcgguaaggucuucccuacauagacaugucuuaggccacaaucugcacagguaggccauccuuccugcuuccauguucucguagagcgaccagagccaugcagacacugacaugccauucaccaaggaucgggugaagagguacuaucugccuccaguuggagagaaggucaggggcucagaacauuccuuguacucacgagguaguuuccuagucuuguucuuaagcucugaggaagaggauuuagacuaagugccucaggcuccuuugagggucacagcuuuccuggaaacgcuucacagaacucccuugguuguagcuguagggacucuugcugaggcuuggguggcuguuucauuuggaggggccuuuccuugguauacugccaugaacagucacugugagucaagcagacaggaguguuugcauuuuagggauggaaauuacugacacucagaaaucaggugacuuguaagaagucagugcucggccucaaacccuguuccuuccagaagcagcuugcaucuguccuuggccacauggagauagagggcaccuuuguuuccucuuuuaagccugaaagucuaauguaaaaaaaugagggcagcauaguacuaauaggguuuccgcucguggaguuucuuuagaaguagauuggcuuaagggcuggagcaagagcucagagguuaggacuguucuuccagagguccugaguucaauuuccagcaaccacaugguagcucauaaugagaucuggugcccucuucuggccugcaggcauacacacacucuauacuuaauacacauaauaaauaauuuuuuuuaaguagauugacauauauaggcagugcccugcacugugcccagccacuacaagacaggcacccugcuggcuguugccucauggccgcuguacugcaggugaacgcugagguugggugggaguguguuuaaaggagaagauguguuucucugaaaagcaguuuccugaauggcucagugccaggacauuggcacacacacuaacacggucucuucugaaugaaugucuuagccagcuuaccagaaccuaaggcagaagguggauaauuucgugucaacacaucuggacaaacaggaauggaauccugcaaugaacaagaaccaguugcgaaaugggcugaggcagagcgugguucaguaaguagagaaaagguggaggccccagcgugaaugcuacacaggcugaccacaaguucaugggggucuuggucugugguacuuuguagccaucuugcugucuugugcaucacggagauggugaacagagcccuggagugcuggcugcucacucugggucauuccuagcugugugcauuuggugguggcucuggaaggccuuccagauugccaggcuugcucuucauucuuugaagcuuucaguguaaucugaauacaagugugaguuuuauaccaagauagcaguguuaggguguggaaaguaaguucuguauguucugugaccauggcugcuaaaguguggugacaguucacaggaagauguccuguaaaauguuguccuuuauagaaacaaacugaacuuuuguuagaagguccuguagagcacucacaugagugaccucauuguuacugguacaguggagugggucauggguuucaagguaaauuucuuucugcucuuucaggauccauuuuggcuuagggcuuuuguuuggcacuuuuuuuuuuuuuuuuuuuuuuuuucgagacaggguuucucuguauaguccuggcuauccuggaacucacuuuguagaccaggcuggccuugaacucagaaaucugccugccucugccuccugagugcugggauuaaagcugugugccaccacgccuggcuuguuuggcacuucuuaauccacuaaauuguugaauaaaagcuuaugaagcaggacucugaaaauagaaacaucggggaauugugagaaaagcaaaucuuagaagacugauaugacugcauuugcugauagugcagagauucgugaaggcguggcugccaaagacguguaggcaguuggacugggagagccaaagcacaggcucuuaguuaugcuggugcagaucuaagaaacgcaugcaguaaugcugugcuguaucccccagaggccuuuauguuagagguugguccccaguguuguuaaggugggagcuggcagaagagguucagcucauggggccuucuccccuguggcacugaauuaguucuuugagaaucaguuguugaguuuagccaagugugaugccaugcuccugucaucccagcacucagagguugaggcaggaagaauguuaggagaaccaggcagguuugguuauguagugaguuccagaccagccucagcuauacagugggaccuuccuagagaaggaaagaaaauaaaaaaugggugaauucagcugauuuucucacuaggcagugcgacuuggcaugcaugugaucaccaucaugcuguaacacagauagggacuugagcagacugugcugugcugugcugcuaacacuuucuagccacuggcaucaugagccagguacaccucuuuacauuucccagccucggcuacuuuguuacagcaacacaaagaaaggcuggguuaaugcagguaauguacugcagucuggauacugguaccaucuuccuagcuuugauacuguagugugucaugcaaggugcuaacaccagagguguaagaauagaauguaugagccucuuuauauauuuccuugaaacuuuugacuaugcagugauuuuugaaacuuaaaagacuuuaaaaauagaaaaggauuuuuguugacaaucuaguacuuguguggcucauggccacugaaauuggaguguuguaaauaaagaugauuacacccauauaaaguccugugugucaggagaggauggcaucuaaagguucccaugcugucuuuuggucugugugguauugcucccuuucucgggcugagcucugguggcucagaagccauccuuuacugaguagcuacacacugugugucuaaucuuuaugcuucuuaccaguugucacaaaucucuguugucugggcuguguuggauguuugcauugcugcaggaaaccauuucuguucuugcugcuaaguauaaaugcugaagaaaaugacgacaaaacaaggcuuugcugccuuuaacauuaugacugcaguuuucacuccauaccugaggccaggcucgcuuuugccgugugucacauguauuggccuuugaggcagccugcucugauuugucucauuccuuuguacaaaguuggggcugcauuagggaugguagguagcagucggcucugaaucccuucagaugaaaagccaguagcuuaaacucuggggaaaauggauguuuacugggcucucgaaugacacuugggacauauugguccaaaggagaacucucgagaacuaaauaacagugguuuguuuuaucuccacaggucagguauguuggaagcaggaguggacaggaucauuucccaagugguagaccccaaacuaaaccacaucuucaggccacagauagagagagcaauccaugaguuccuggcugcccagaaaaaagaagcugugccggccccgccuccagaaccugaaagccaggacccuccagcaccaucccaggaugcuuccuaaggucugcuacacccucuguccucccugccugguugaugugugaaaugguuagaaaagggcuaagcugugauuagaagucaugcaucacaccuauucagaagaguggcugucccacggaacucagcacucacacgcucccaaguguccucuguaccagcagagccaagcauccaagucaacagagaaccucacgguuccucaucagaaaccacuguggcggguuuacacaggggacucauguggaggucauccucucugaaauugcuuacacggagcucugauaaugguugacauuugcaguuuucacaugaagucaagcaucauuuccaagggugguuucucaguuaccaugcagcucuguucccuuugucucagguuuaggauuuaaucuaacuuuaagauuagcuggagauagagaugaaugugguccucgucccugacaagucauguguuguaugaggagauggcggcagguagaggaaagccacuguaggaacagaccccucccuuaccuguugucaccccacccccagggaguguucuggccccuuguucugcugcuagugcucuccugugagucuccaagccacuguuaguaauaagguagggagggaggcaggcaguugagcaaggccuuugagcauggcugauuagagguugcaagagcacugcugucguagggcaguaccaguggggcugucuucuugugccucuuggagagguccuugauccaucauggaguauagaguauucauuuuaaaucuuucucauuucauuaauacauuuuuaaggaacauacaguuauugaacauaggccuuugucaaaagcauuuugacaugauugucuuuuuuuuuuuuuuuuuuuuuuagaauuugccugguaccuuuggaaagcuuuacuuaagcaauggacuccugcuucauacgaauacaacuuuagucggccaugucauuacugaugucaagauuuuggccuugacugcggugguguccacaucagauggagagcaaguuugguggugggacaguuacccguacuugcucauggauuguguuaccuuugaccggccuguugaagggugugacccuaguagacacuacagagguuuaagcacuacagugacaugggcuguccugaacgaacuuuuauacuugaacucagacacugcauguggauaucagugcuggcauuuugugguauacagaagccaggcuggaggcuagcuggucaggacagcgagggucagugggagcagcuguuugaugguggguuuugauaugcuagaguuacagacugcagcguguggcaguuagcaucaguagccuuaagguuguugugaccuuccugugcuugggaaucuuaaugguuuccuuuccuuguuggagcccuggagugagugaggaagcugagacuuggggugcauggaaagcugcacagcuucuguccuggcaccuccccauccgcagggaugagucacucugggugccgugcucaguucucauguuuguguuuuuagaaaaaaaacugcuaauaaauaguggauguuuuacaauaaaguuguuugacgaucuuucccuaaaaccucaac

SEQ ID NO: 5921 - RNA, 651 nt, Mus musculus
cagagccgccucuuccgccugcgccucgcccagcggggccggcgucggccucgggucugcgcacccagugcaagcggugcaccgccaucuuuuuuaugggcaaagauuccuuugcgauuuauguucccaaagcaggcuucuuaggaaguccguagagagacgcucggaagagaauggacaucuugcacacugaaacacugagcuaaaguguugggggucgaaguggcaacccaugaaaccuagaauaaacgagaggccugcccugaguaaaggugggugccccgggcaucacgugcucuggcccgagcuccgcccccgagggauggaaggagaggcggguuuucccggcaucugugcugugccuagaacugcauaguccuuauccugaacgcacgucuccggagggauucccuucagucuccauuccuccacccgaaccaccuacucucccauccucccuuugagaugcagaugcuguaggcguccauggcugagccaccaacuauuagcuuucuacuccaccuuccaagcagaacggagggauuuuucuaaaaacgaaauuccagucacgguccuguugugcucauaccuuuuuaaaaauggcaguccguuaccuggagaauaaagaccaaacuccguauuguccugugg

SEQ ID NO: 5922 - RNA, 2922 nt, Mus musculus
acaacucaccaagacacuguuccaaugcgagucugccaaaguagggaagccccacacgucuggaauccacacuccgaccugggaggauacuggagaaacgagcaggauucagaggugggugaggauuuuuguguauucuguagguccugggaaggacagcaguagaugccaagguguuguucaguggaucguucugaggguauggaagaugggacugugcugugucugauggauaaggaagagugggcaagagcuguggcuuaggggcaggugguggcugguuggugggaggaaccuugcaggggaggugcuagacuauaugaaugaaugaaugcucuagccaggggcuagagcacagggacuauugauagucaugucauaaggucagaaauagagagaaaaaaacuagcaaugggcagaggggcaagacaaugaguagaugugacuagaaccacacaacacuugccagcaaaggacucuuucaucaccuugagaguauacacucuucacauguuaauagcucuaaaacuggaaucccuuacaguuuguauuucuaggaaggcauacuccugugcacucggcaguacuuaguguuccauguucaaccuuaccauggugugguucugaggaggucagaggaguguuugucagaugcaccaaggccuugaagucugagcucucagcugcuuugcaacucugauguuuccuugagugcaucuuuucugucuuccuggggcucgcuuccuaugucucuaagcaggggcuggugacaggugagggaggacucuguucuguuggauuucuucugggcucccugaucaaacucaagagcgguguaguuaaagcugcaaacgaguaacccauggaggacggaagccagguguccuuauuuuguguccaauuuuaauuuccuggacuacuugcuuauugguucuccccuccucccuucugagugucucaaggaauccuggugcccuagagucgggggcucccugccucagccuccugagugcuaugaucaucuuaggcugucugacuguauuuaucucauucgguuuccacgccaccuuuagcuuaguuacuauuauuauuauuauuauuacuacuacuacuacuaaugucuuuccugaccucccucuauugucuuuccucuucugauuuuugcacaugguaauaauaauaauaauaauaauaauaauaauaaaguaacacgugaauauguggagggagauaucagaauaacucagaucaacuuccaaggcuagccagaucgaacuggucuggaagguggugccaggagucuagcucugaagggucuauuaguccgauucccacagggagagaccacagcacagcaucuaagggugcuggaggaagugcugcucuguggagccucagugcaguguuugcaguuggcaucaguaaggccuggaagggugugacuucgccagacccaggaacuguuguucuggauaaacagcacuuugaaacugggcauaggagauacguuucuguaacuucugggucugggguuuauagauuuagcuguuuucuggaauuccaugaaaggcagcuuuccuggcaccuugacccuugaccccaguuuggggguacuuuccuuccuuucuauucuugcaugcagugacaaacaucuuaacacaggucauaccauccuagcucuuuuauuccccaacccccaaauuaaggaguguuguguuuagugacacugguuguaagcauaaagagaguauacaguuuggggacuguccuacagaguaagccugcugaccugagcaugcacacggaggguuuaacuacugcggcacccucugcuccaguggagauaaauagcacuucaacuuugcuauagacaaccucacaugaauauugcaaaaauuuucuuuugaaagaauauaggugauuuaaacauuccaguuaacguaauuccagaugggcaagagcugacucagaaacacggggcugaaaaagcaacauggugggcguggcuucuccagauacaagggcuuccgcagcaaucuauuccagugagagugauuuaggagaaauccuaaagaauucaaagugugagagggcucggcaaaauccaagagaacaggaaugaugugcaugcaugugagugugugugccacagaagccagagguguccaagucccugaagcugucuucacugacaguuaugagacaucaaacauggguggugagacucgaacccugaucuucugggaagguagcauggguucuucacugcugagccaucuguccauucccagaaugaaguuuugaaagugaaaagaugaguaaauauaguaaaaacacucaauagaaaaagucucaucaauaggacugaucaagccggugaggcuaaggcuggaaggcaagggugauguccuaguuuguauuauuaucauuauuguuauuaucauugauuauuauuauuauuaccauuacuauuacuacuacuauuguuuugauuuaguuuuuuguuugcuuguuuguuuauuuugacgaagggucucucucuauauuccuggcuauccugaaacucauuauauagauccaccugccuggcucaacugcagaggauggagaagugggcaguguaccuggaaggacagaagggccagaugccaaugagcacuagcacuagccacacccagaacaagggccacugcucagccagaacccacagauagauggguguuucagcagaucagcggggcugugguagaacgggaucuacccacucaccucaccguucugcuucccucucagccagucagucagagacccaggagagaaagauggcuucccuuuaucugcagacucugcugccccucauucuuaagccccgcccaucccucccugaugggaaaaggacacaaagccagaauuaucugaaga

SEQ ID NO: 5923 - RNA, 3584 nt, Mus musculus
cacaaucacugcgcacgcgccuuuugcuuaucaaccuggaaggcagggcaggcuggaggagcgccggaaagcaacacuagucuaguaguaggcaguccuggaggacccggaggcugaggaucggccggaggugccggaggacgacgaggaugaugaggagacauugccccauuccgaggcuguggacguguuccaagaaggucucgccaugguggugcaagacccgcugcucugcgaccuuccgauccaggugcgagacagggcucugggguguggaugggcgcugguggucccaccagagaaagacgcuucugcgcauaaguggaacgcuuagggugaggagccccucugagccgugaaguuugaauuaaacaaacacuaagauaugaacucaggaugagugugacaagucuuuuccuuuugccugaaacuucaguaugcgugacuuaguaguuaauguauucuuuaaccuugccaaucaaagguguuuuuauuuaacgucugugugcgcacagaacugggagccaaacugagaaccuuucgaaugcuaaauaagugcucuaccacugaguuacacaaguuuauuuguacuucccucuguguuuuauuaaaacaucucuugucuggccagaccuuuaaucucagcacccgggaugccgaggcaagggaaucucugugaguuugaggccagccugauacauugagagcuccaggccagccaagggucuggaguagugggucucugccucaaaacaaacaaaagacauuuuguuaucaaagguuuuagguagccggucaguugcacccuggaccugagguacaggccuggagccucuugauacaauacucucaggaucgccaggcccaguguuaauugaaaauccuaacacacaauaggugucuuagucagaguuuuacugcugugaacagacagugugaccaaggcaacuccuuuuuuuuuuuuuuccuuuaaaguuuauucaauacaaccuaaucuccaacuucacugagguggcugaccacguggacucuuauaaggacauuuaauuggggcuggcuuacauguucagagguucaguccauuaucaucaaggcaagagcauggcagcaucuaggcaggcauggugcagggggagcugagaguucuacaucuucaucugaaagcugcuagcagaauauuggcagcaaggaugagggucuuaaagcccaagcccauagugacacaccuacuccagcaagcuacaccuauuguaacugggccacaccuucuaauagugccacacccugggcugagcauaugcaaaccauaacaguaggcaagcuugguucccuuuuuugaucagggccacugacagguagguauauaucaucuauaacuagggagacauuaaggcaucaggugucuccaagugacgcuccccagcaguguggguagggccaugucagugaaagggcauguuuggaaaggaccacuggggcaggacucucagacacagaauugccccauucuaacaccagaaagcucuuaugaucuccaucucccuagguuacucuagaagaggucaacucccagauugcacuggaauauggccaggcgaugacuguccgugugugcaagauggauggagagguaaugcguaaguaccguugucuuaguuacuuucucuugcuauaaagagauacugcgaccaagggaacuuauaaaagaaaaugcuuguaggggcuucugguuacaaagggcuacaguccagaaccaacauggcagggagcauggcagcaggcaggcaaauguccugaagcagaaacugagaguuuacaugcugauccccacaggcaugagacugaaggcuuuugaaaccucaaagcuuacccccaguggcacaccaccuccagcaaggccauaccuccuaaccauucccaaacaguuccauuaaagagcaaacauucaaauauuugagucugugggggaccuucuuauucaagccacaaccgugcuucucuuugagccugaccuuucacaucagcaaggaauuagcagagagcuagucagugagaaacucagaccaugccuggguaugcugggacagccacccguguguggccgcccacguguuucuucuccuauguguuucuaugguuacagcuguggucgucguacagaaugccacgguccuggaccugaagaaggcuauccagagauacgugcagcucaagcaggagcgggaaggcggcguucagcacaucagcuggugagugcgccagaagugccuucccugugccacuccugggcucggggcucaguaggaaggcagcuuucagcuccucauguguguaccaccaguaccccacuaccaaugauacagugacagucccauaucaugagagcuuucugguguuagaauggggcaauucugugucugagaguccugccccagugguccuuuccaaacaugcccuuucacugacguggcccuacccacacugcuggggagcaucacuuggagacaacugaugccuuaaugucucccuaguuauagaugguauauaccuaccugucaguggccucuucucucuucaccggggugcuguuggcucugacucuccuaucagaucaaguauccuguuaucugaaaucccuauuucauuauuaagauguguccagagccuccugcaacugccuugggccuguaucacguagggaaaauguccagaaggggaauauagcuauauuccugagugcccuaggcuguguguccagaaggggaguauggcuauccugagugcccuaggcuguguguccagaaggggaguguggcuauccugagugcccuaggcuguacgcugccagccucugucaugcuagccgcucaauucacccaucugggcuggcaugugcagcaccucaguccccuccuugcagguccuauguauggcggacauaccaucugaccucagcuggggagaagcucacagaggacaggaagaagcucagagaguaagucuguaggucucuggcccaucggcggugcccugugcccaccaaauggcugugguaagagggucccuggccggauugacuguccugugggcaucuccuugagccucccgugaacugcagggcagagaaacagcccugcuguucucacagcagcccacauggaggugaggugggagaagaguguggccauucucacuugauuguuccugaucccuacuaagccugggugagccgucugcagcucggacacuguuaccuuccugucuuuuucaguuauggcauccggaaccgagaugagguuuccuuuaucaagaagcuuaggcaaaagugaacaccagacacagugaucugaccugucccagcaagauggcgcccuccgcuugaccucaagggaaaggguguuggggguagcugcaucccuggaaugcccagguggagcugucagcgugagcccugggacccucggauuguggaaaauuccucugcccuuuacuuuccuuugaacuuggcccaaagguccuaugugguugugggccuggcuuauagaauaaauguguuugcuuugugucuuguaaaaaucagaaag

SEQ ID NO: 5924 - RNA, 12721 nt, Mus musculus
cggcccguggcauucccaggcggacgggucgggccggcgcgcgggcggcgcaggcagggacuaggcgcgggcgcccucccggcccgcagcggcggcagcagccggugcagacccuucugaggacccuacggcggugaguggcggccggggucuuugcgcgggguuccgggcgggcgagugcggagcuugcguucuggcgcguguccgccgaucgcuggcagucggugcgcggaguuucccgagcgccggcgcaggcggcgcggcccggauuccagcccggcgccccacagaaauagcccguggucggaucggcgcggccuggcgggcggggcagcggaguagcagccccgccggguccccggggacaggaguccgggggccgcagccgcccugagcggccccuccgcugccagcccccacaccccaugcccuccgugcucccagggccccgaagguggcgucugaaacucugcacagagagcgcgacuucgggccacaggguccgcuuccucccacucacgggaguaacaguggcagcugcgggccggggagcucggcugggccugcucggcccguuucagcccgguucgcaucggcaaacucgggaagugccuccaaagacaucuccugcccuguacaguggccccgggggcgagcccgaggccacagucgggaucuugaaguaggccugggcgcgguggggugaccgcggaccccaagggcucagggauaggcgagagggccugucuguccugcugggagcacgcuaguagagcuggguggagaacggucaagggacucccccuaggcuuucuuuccgcucagauaguccggaccagaguuccugcuccgugugccucuuggaguagugugucugucugcgugggcggggccuggauccggaggccccccgcucuguccugggaaagcccccccuccccacuuccuguugaagccgggagaagauucuaggaugaaacuggcuuuucagguuuagaccagcuaagaagucggggcagucccaggcuaggugcuccccaccuccauggggcgagccucagccccuugcccccgcccuuaagccuagaggaugcuggggaacucagcagcuggccaguucucaagagguugcagaggcugagcccuaugcuuaccagggucauucugggcaauccggguaagagggcaagggugucggguagguccaguacaguacaggguaggguaguacagguucuggcaccaguccacagaacuccaggcagccuccauggcuggcuagcuccucugcaggagccuuacugggaaguccacuugggugagccaguauagcuccccucggggucuagaggugcugguuugggucucccauuaagggacagucagggcccucccuccuaucgcccuagcucuaguccucagcggagccccuucccuugcccagccccaagugcucugcagccguuggagcuaaggaucccucccaguucccuggcagaccuggccgaggugcugaacucccuugaggcccugugaccucaggcaguaaaaagccucucugagucaaucuguaaaaugggaggacaggagugauuacuucugccaccgguuauaacaucaacaggguucguugggcucaggucugaggcagguguccccggcuuuuggugacugaagcuguuguugcagacucaguuuacccuucuggagccucuccaguuuuguccugcuuccuuuggguucugggagggguuucugagucaguacaggggaacucuguaccccuccuccauucagagacucagcuggacuacagauugggcaucagaaguguccaucuuaguggacacuaauccagaauuugaccuacaguuagcuccugacuccaagcccuuucugaguggcuggcuuagacagguccccuuuccccucugaaccccaccuggauccaggaauuugacugguaucagagacccccugagcuaugugugcuuuugagcuauggauggugccuuuccccagggauggcuucuuugcucucaugugcucugccaucccuggucccuugggucccagggcuccucuagggacuaggagcucccuacagacuuaagugaaucucuuguucugugugccucucugagaugguggcuggugaggagugauggggaggggccaaaaucuaguguguacuggggaugagagagcccccccaccccccgcuaaagcuugcccugucccaugcaaaauaagaggagucagaguggagcucaaggauggccuaaugguucacaaagggcccagcaaacucuguaugaucccacugacagaugaagcaaggagaggcugggggaagucacagugcauguggcgauggacuagcagagagagaggauauagaaagcugcugagugccuccaccagggcaggcugaggcuggguauuagguuagagagaggacagguuucaagcaggaugcuggagugugcgguggcuguagcucucacccaaggaugggggggggggucccaucaacugcagucacugaguagccccgcuuuccuauguucugccuuugcagggggaguccucagguccaucccauaccucuagcuuccaccugcagcucugcuguuuuguguuuguuuguuuguuuguuuguuuguuugagacgggguuucauuauguagccuggacuggcuuccaauucagaaucuuccuuccggagcugagugcugggaucgcaggugugcagcaccauugccggccacaccauugucgaagcuuuggcugucuucuucccacucaggcaucugccccuucugucgauucagcugccgcuuacugagcaccaauggugcugggcacuuucgucagccauuuucagaugagaagaugaaggcuugccaggugugguggugcucaugcaucuguaaugugcgcgaaucuuuaucuacuuaggagguguaggccaguauggguacaugagauucugucucauaaagccaagaagagaaagcccagguaugcucuguugguaagggguggagacaacaguuuggguauaguauagauuuuugacccauguuguuccaccugucuucugucuuccuggcuguucuaacuggacucaugaacagggcuauccuggagggucucuaguugacccaccauggaacaacuccacaaccugccuccuccccuuagucauguccaugggcaaacagugcauucugaggugugccgcuacccuaccucuguguacaccuucucccucacucuccacuggauucucgcucaagcugcuuggagcccugacaaggcucugucguuagacuugacuccauaccaccuccaaccccugagcuugcuuuccaacacuucccauuuacucuggaucccuuuugggcggcuccuugugcuucuggggugacucauggugugugaccccaggcaaugagccucuccaugggccaugguuucccacugcacuggggccagcagaggagagaguaaaggcugucugggaacaagagcccacugugugccagggggagaucuagacacugagccacugugggccggcagcgugcuguuccuuggccuagacucuuugucuggccugguaugccccucccccaggccuugugaaucccacuagcuugaggcccuauuaggaacagagcuuaggguggggcaagcuggaaacucuagggaaggguggguauccuuuccccaaacugcaggccuagaguuguguguguggauucucuuguguuuccuuucucuguagcguggaaggggaccccgggaaacccagacauuugggcagaugucaugggguaaggccugagugcuugcucacagcccucguggcuugugcuuuuucucuucacacuugcccaggcuggucagcuucucucuguagguccuguuaaagggccaucucccuccagaguccccacauccccacucaggagaacuggcgcuugccacccugcauucagguaaggcagcacugguggacagcucugcaggcaggugggaagcaugaugcaggccuuauauagggagguccaagagagucauggaagucauuagaagcuguuggaaauagcagcuuauauucccaagcaagggaccaguucgauaccaccuagaagugcugagcacagguacccaacuuguuggaaaggccaguuuccagcacuugcacagguuuacucucugugauccugugacuacucuugacuacguuccuuccuggagcucaugaguggcugcuugggauggaccagaaggcaggauauguaaggcauccucuaucuuggcggguaccuggccccccacugucucagcccagcuuuggggaguucacugccuuccaggccucauuuucgcaguguguguagagagaauggagccucugucuccuccaagcaucgagagggagaguccuaaguugaggcgucagcuggcugguuucacaaucuagggucuguucaggucugcagaucugaaggugaggcuuuugagucuucugcccuccgagucuugcuugaaggagugcucccccacccccaguccucaucuccacucuagauacagaaggcccuccacuuggagcagggaucagguguauaccugcugugacugucauuuauaaagagggaaguaagagucccucagagaucaagaccugccugacagucaagagcugggucuuucugcacuggcuagaacuuggcuggccucaaaugcacagauucugccugcuucugccuccugagugcuaagacuaaggguguacauccauaugccuggcucaaaugugugugugugugugugugugugugugaaauauauauaauguuucuuucaagacagggugucaguguauaacucuggcuguccuggaacucacuguguaggccaggcuggccuuggacucacagaagccugccucugccucccaagggcagguauuaaaggcauguacuaccaagccaggcuaucuaucuaucuaucuaucuaucuaucaucuaucuaucuaaucagaagccggaagacuacuuuauggauucaguuuucuuuuccacccuuugugauuuccagggaacucaggcuugaauagggaacaagcgcuuuuuccuucugaucugucuggcgggccagcugguguacuacacucuguuuggucuuagguauucaggguuccucaaccugucccugccucgaugccuuuuuuggcaguuggcgccaccucguggucauuuauuguggcuucugcuccaagggaguuuuguuuuguuuuguuuuguuuuguuuuguuaacaaggucuuaacugugucccuggcuggccuagaacgcacuguguagacugggccagccuugaacucauagcgauccaccugccucugucuccuuagugcugggauuaucuggcaccaaggagaguccucugcauacuggagccugcugcccuagguguugcucugaagccccaagaagccaucucuuucucuaaauguggggagucuucuguguaguugauugaucaugaaccccacaguguaugaagugaaagucagagugguuacgauggccugggacaggugggcuggagccuugcgcucacaguuuguccuccugcuccuggaugugcacagacuuacgugacaccugagcggcuuucacuugggagcugucaggaaauccuuacuaccugcuaccaaacagacugagcacuucuuuauuuauagggacaucguuacccaggcuuuaagcuucaagagggcggcagcccucuaccagcuugugcucagaguagguuuauacaguguuuuacccuagauuccuauuguuggaggaucuguggaguucaggcccagagcaugccagccucuaucgggugcugugagcaccucuguagggcuugcaaugcuucuucuagguuuaggcccauggugucccuggagaccugucaggguugucacucagcauaaccuacacucccaggcuugucucacugcgcccggaaccaugagugaagccaggagagacaguacuagcagccugcaacgcaagaaacccccauggcucaaguuggacaucccagccgcggugcccccggcagcagaggagcccagcuuccugcagguagguucuggccaguaggaauuugggaauuuuggaaauucccuggccagggugcucaccaugacccugcugucuagccccugcggcgacaggcuuucuugcggagugugaguaugccagcugagacagcccgggucccaucaccccaccaugagccucgccggcuggugcugcagcgucagacauccaucacacagaccauccgcagguacagcaccauccuggcuguuacacaggcuggggcuagggagggacacuagagguaggcauacagaaucccuguuagguaccaggggugggaauggggcaaaggucccuucucugucagcuuuucuucuccaucuugaucccaacaacacuucagcauccuccuguucuggggacccaugguuggcccuccgucugccucucaguuccccgaguaugcacccucccuacucuaacacccuggcuccuuguagccggcagguacgcuuugggcguguucauacucugccccuuuugaggccgagggcugcucgaaaggcccacccacagcgccagucucucucaugguccuugcucagguaccuuacgcaggucuugaguguguugguauuuuuuggcacgugcaugugauguggccucuuggagcuguuggaguguuuggcauucccuggcugcucaugacagggucaauguuuuuauuugcauguucaaagaccauggccacuguauuguugcugcugcaauugcugcugaguucuuuaguacccuagggugaugguggcugccugaggccaaggccucucucuggacucaggguuggcugagggccuaugagaaccuucuacugacaggcaugcagaaugcucuaguagaaauugggguggccacaguuggagcuccccuguccuguccuuggagugacugggggccugcagcagagcccacuacccagguugaccuuugaggaucuuugauugggguaaggggacagaauauauggcuuccccuugcugaguccuucucgugccagggggacagcagacugguuuggagugagcaaggacagugacagcacccagaaguggcagcgcaagagcauccgucacugcagccagcgguaugggaagcuaaagccgcaggucauccgggagcuggaccugcccagccaggacaaugugucccuaaccagcaccgagacaccaccuccccucuacguggggccaugccagcugggcaugcagaaggugugccgccgccucccacagacuccccauucugcuccucugccuggggugggaggaggggaggguugaggagagaaaguaucccugggagccuguggacgggaaagcagccagagucuuagaaaggcuccugagauacucccagcuagggacccuaggaggaagagagucaugguauuguucuagugcagacucugaauuucaaggggagaaggaccccuauaggugccauggaugagagugaugcucuucauggaagucuugccugguucuauagacugaccuagcuucuucuccaucccaccagaucauagacccucuggcccgaggccgggccuuucgcauggcugaugacacugcugauggccugagugccccccacacucccgucacaccaggugcagccucccucugcucuuucuccagcucccgcucagguuucaaccgacucccucggcgucgcaaacgugaaucgguggccaagaugagcuuccgggccgcugcagcauuggugaagguaaaugcagggggggccccgagguuguagguguggaaacugagugcacuccgacuuccagguccuaaggucgcuuccuuguccucagggucggucuauuagggauggcacuuuacgaaggggacagcgccgaagcuuuaccccugccagcuuucuugaggaagacaugguggacuucccugaugaguuggauacaucuuucuuugcucggguaagaagagccuggggggucgccccaucuccucugucucuggauccaccuugacgucacguauuugcucaggaagguguccuccacgaggagauguccacguacccagaugagguguuugaguccccaucagaggcagcgcucaaggacugggagaaagccccggaucaggccgaccucacggguggggcccuggaccgcagugagcuugagagaagccacuugauguugugagugcgcccgguggguggggggagcagccccacugagagccgcugggcucuggguaugaugcugcaguguucauagcuuggacuuuggaaucuagccuggccaccuuggguauguccagggguaggcacaacccuacuuugaugcccuccuacagaacucccagagcccaggggcuagagucuagaugggagaggacuauggcccaguuaacacuguugagagacagagccugagucuugaggcuccccaaacuugcccugccaaggugccaagggcuuacugguaaggcguagaaugaagaggaguggcuuguugggugucuucgccccucggagggcaggagagacacugagcagugcucugguucugcccaagagagaaggcaguguauagguuccaggcaggaagugaacacgcuggccccuuccaggccccuggaacgaggcuggagaaagcagaaggaaggcggcccucuagccccgcagcccaaggugcggcuucgccaggagguggucagugcggcgggacccaggaggggucagcguaucgcugugccagugcgcaaacucuucgcucgggaaaagcggccuuauggucuggggauggugggacggcucaccaaccgcacguaccggaaacgcaucgacagcuaugucaagcggcagaucgaggacauggaugaucacagguaggcggugccugcugggacagaggcugagcugggguuaggaauccaugucaggacgcuccuggucucaucccugucucacuuacucugucucaggcccuucuucacuuacuggcucaccuuugugcacucacuggucaccauucuggcugugugcaucuauggcauagcgcccgugggcuucucgcagcaugagacgguggacucggugagcccugcgcccagauaacuuggagucuaggcuguggacgcuguggcccggcucugggaggauggagcccuacacauuuggucugaucuuccuuccuacuuuccagguacuucggaagcggggugucuaugagaaugucaaauacguccagcaggagaacuucuggauuggccccagcucggugagggcagggcugggaguggagcuuggaggugccccaccuguccuggauugaggccacagcugcugucucucucuucacaggaggcccucauucacuugggugccaaguucucacccugcaugcgucaggacccacaggugcacagcuucauccuggcugcccgggagcgugaaaagcacucggcuugcuguguacgcaaugaucggucugggugugugcagacuuccaaggaggagugcucgguggguguccaacccaccccgucugugcaguccgcucuuaacuuuagacuugggucucacagaguuccuuacugguuucuggcaguguggcgccucccauccuugcccuucacucccaguuucuguggaggacgcucauuugacaaauuuggucuucacuggggcccacuucuucagcacaugucugcauugauaucuuaaguggauaguaccucauuuuccuccaccaguuuaaagccagacguggugguacaggccuguaagccucauaguuaggaaacccaaguuggagaaagguuaaguuccagaccagccugggcugcauuucauggucucaaaaggaagcaaagaaaaaugcaaaagacucauccaaacauuggcaccauagcugauaccauuucccuacuucaggauagaagcuguuucugugccucaguuaugccccuggguaccguguaacacuccccacgugcugcugggguuuaaccuauuagcgguguugagucaggagucuguucuggggccucgccuuugauucccaacuguuguuaacugagcagaugguaggcucugaccagggcugacucuuguguuccccacaguccacguuggcggugugggugaaguggcccguucauccuagugccccagaccuugcaggcaacaagagacaguuugguucugucugccaccaggaccccaggugaguauuccuaauugcccucuuguguuugguuuuguuuuuucgagacaggguuucucuguauaguccuggcuguccuggaacucacuuuguagaccaggcuggccuugaacucagaaauccaccugccucugccucccaaguccugggauuaacuauuugcccucuugaacugccuuuggcuaugucugacaggguguagaggauuccuuguuuuggggaagaggguaccaucaccacgggacaaaggcucuaaccauuugggcucaugcaggguaugugacgagccuuccucugaggauccccacgaguggccagaagauaucaccaaguggccggugagcuggaaucuuccaaaugucgaaucggggaggagggcauacccuaccguuccuggcgcugcaggcuuucuuuguuggagcaccugcaucuucgcacuguccuagccuuugcccagccugucaggcaaggcuugccucugugagcaaguagucagggcaagagaacuaggugaagacaugagaggccaaauagcuuuauucugguuugcagauggcucagcccaggcucuggguguggccuacuugacuuaagggagccugguuucuaucugagucuuaccuuugucuugguuuccaaugaggguuaggccaagaggugugucucuguguguguaaaaugacgccgacccucuuguuuuucuuucuuacccagaucugcaccaaaagcagcgcggggaaccacacuaaccacccucacauggauugugucauaacaggccggccuugcugcaucggcaccaagggcaggugggugcucacgugccacuggcucggggcagcacuuucucccucauuaaagccugacuaaccugauuuccagcaacagggagugagacugggcuagugaagguggguggggcugagguccuccugaggagagcacaggugacuauagaucucagcagccuccaccuauaaggcugggcacccuccaaacccuggcgugacccucuaggugugagaucaccucccgggaguacugugacuucaugaggggcuacuuccaugaggaggccacacucugcucucagguaggccuugaggccacgccccucuccgcccccgcccacuguggaggcugacuggccacucugcacaggugcacugcauggacgaugucuguggccuccugccuuuccucaauccugaggugccugaccaguucuaccgccuguggcugucccucuuccugcacgcugggcaagugggacuuggggcugggcguguggucuccuuccccaggaguggugggcuggaggcaaaagagaagcucccuucucugcugagugucccucacugcccacaggauccugcacugcuugguguccgucugcuuccagaugacgguccugcgggaccuggagaagcuggcaggcuggcaccgcauagccaucaucuaccugcugagugguaucacgggcaaucuagccagugccaucuuccugccauaccgggcagagguaagauguuucccaggguggggacccucuauguguaccuguggcuagcgugaccccgccugugucgagaucaaguucgccgagagguggcaugggaagaugagcuucugggguggggucgggggugggacggugcagccucaguagcuuagagcuuccaacccccaccgucagguagguccggccggcucccaguuuggcauccuggccugccucuuuguggaguuguuccagagcuggcagauccuggcccgacccuggcgugccuucuucaagcuccuggccguggugcucuuccucuuugccuuugggcugcugcccuggaucgacaacuucgcccacaucucgggcuuugucagcggccucuuccuuuccuuugccuuccugccuuacaucagcuuuggcaaguucgaccuguaccgcaagcgcugccagaucaucaucuuccaggucgucuuccugggccugcuggccggccuggugguccucuucuacuucuacccggugcgcugugaauggugcgaguuccucaccugcaucccuuucacggacaaguucugugaaaaguacgagcuggacgcucagcuccacugaaccagccguggacuccccaggccagcccggccucccagggcugaacagaugggugcuuccuggacacugaccucuugugccuugcucgcuccgguuguacgcuuacacugcugggcauuuaguacaugaguucccaugauaaccuccuaacuaguccccgacaaccaccucauguggucaauaaauggacugggagcguuuuagcugccacuaacucgaugag

SEQ ID NO: 5925 - RNA, 2483 nt, Mus musculus
cgcaaacugccccauggacccaauggccugagcaaccaccugaaguucacagaggcuggagcuggcaccaucugucaagcacaacuccucgucucaucugucaagcacaacuuccugcaacugggcccucagguggucagccacucgcgugcagguggaugcuagcacggugugguucugauggguaaacauccugcuuguucauaucccuaaugcauggggccaaacuaagguacacucacaaauccacauaccaacaggaaacaucaccucaacccuacagcuacuucagagagauaaaaaagaggcuaggagggucguccgacuuguccagucuaacagccagagaguagcacggcaggcaggcaucagcucacccgggccugaccgacugagauguaacucugcugguggccucugagcacugacuuggggaaacugagacacagggcugcguaccugcagcugcuguagcucgcucauguugcuuucacacugcgccaccaugucucgcaucugguucucguguuucugcugcugcugcagccucuccgccuucugccucuucuccuccugcugggagaacugcagaaagaggaugcugcugcugggcgggcagaagcuugccuggacggcugguggggguggggguggggugggggcgggacuuugccuaguucagccugagccagcaaggcccauccuagggacugggccgcgaugcucugaguccagcccaccucagguucugcucucacuacugaaacuugcccugaguggagacccagccacuggcaagugucacccugcugggucaccugauagggugagaugacaagugccaggauagaaaucacagggacaccgagcaguguugguguacgccuuuaaucccagcacuugggaggcagaggcagagaggcagagaggcagagagagaggcagagaggcagagaggcagagaggcagagaggcagaggcagagaggcagaggcagagaggcagagaggcagagaggcagagaggcagagaggcagagagagaggcagagagagaggcagagaggcagagaggcagaggcagagguagaggcagaggcagaggcagagaggcagaggcagaggcagaggcagaggcagagaggcagaggcagaggcaagcaggcagauuucugaguucaaggccagccuggucuacagagugaguuccaggacagccagggcuacacagagaaacccugucucgaaaaaaacaaaacuaacuaaauaaauaaauaaauuuuaaaaauaaaauaaaauaaaaaauucugaggggccugaaucacacaggaggucaggguggaugagaacacagaacgucaugcauguaaacauggggucaugaaggaaaccagugcaugaccaacucuauugaacaaggaucugcccaccaagggagcuuucucccgggcuacugaaacguccaggccaugacugacuuacacacugggcucuaucuaacaucugacaugcggguccccugcuguaugcagccaguccaugcggccaguccuuacccagcucccccaugcucacugcccacagccuaccggacgcacgcacgcacgcacgcacgcacgcacgcacgcacgcacgcacgcacgcaguccccaccugcuugaucuucucgcgcugcucagaggcacugcccgcaccguugaugugcaggcucuucuuguacauggccaugcgcgucuugccgucgcuccucuggaucuuggguagccgcgccuucuccuguugcugucugaccuucagcugcuccaucaugcgcugguuguagcgcugcaucuguucccgcuccugggggggggggacaccaagcagaggugagggagcucuagguauggagggugcucaggagccaaaggccaccaugcucagcccgggagccccaggugccagcauggaagagcuguuagcucccuucuauaguucaaagacauuguucuuucauucuuuucuuuuuacacguauuuauuuuauugggggggaggggucaagcaugagcguggcacucagaagacacaucccggggaucaguuaucuucuucugcuaugagggcucagggaauugaacucaugucaucaggcuugguggcaagcuuccuuagccaccaagucauuuccacagggauguuuuuuguucuuucagcauuacaagugucugacuugugaugguuugacccucagcauucugacuuugcaggcauaagagcaaugugauuuggguggacccagacuuuugagugugcaucuuuuccaggguggacaaaaucuaguacaaucuucuggauuccggacagugggagcaagccacagcucuugcuggccacacguuccugagaggaaauacccuacgguaggcuacuucagaccugugugacuaagcaaggaagcccaaggggcaugcggcuaaagaacacuuacaauacguuacuuuca

SEQ ID NO: 5926 - RNA, 5130 nt, Mus musculus
cagguggacuugugacuugaucagccaugugccacagugagcugaaaggccagggaugggagcguuuccagacagcagaugucacggagguacugaggauauguagcaacaucugucuccucucccacaguucacucugcucaucucuccucuucuuugugacuuuccccccacuauagcccaucuccaugaacugguggacuugagcagaaugcugacccugagcuacauaaccgccugguccucagaagugccuggaggugaggcagccuugguauaugagcccuguggggcugacuuuaucuugguuagagggcccccacugguacccucugcagaaucuagcaguugcuugggaccuggggaccccuguccaugcugugcuggaagugcacugggaggguagaguggucaagaccaucauucucuuucgacaguccacuaaagcaaaguggugggcacauucgcucuugccuuucugucugucuuccaucacacguccccucacucaggaguccgaguucacaaagacaaaaagccuccugaaacaagaggacaaacagacaagaggacaaauagacagauauucuuuaugaggcugcaaucuaucagcugccugauucuccaguuuggcuggaauacacacucagcaagccuguggccaguuaccccagccagcacauaggaauucacacacgccacaguggcaaugguuugggaucagugggucacucucuuggaaguggaccuucuccagugucuucguuuacccagaguagucuugaaugugcuugagagaggagggagugacauuaguuuaaagucauccuacuuaauuuuaugacaacaagaacauuuagguuauuagcagcuagaaagaaggcaagguccugaauaaccagagaaaaugaagccccaggaagaaaucauuacuauucuaguaugugacuuuggauaaguugcuuaagccucaguuucuucaucuaucaaauggggauaauuguuguuucauggggauguccgauagucaauuucccuggcccaaucuguaccaagcacagagaauucuagaacacuuagcuugacgacucugcacagcuacaguagcaacucuguggugggcagagaaaggaccuuagccccuaugcuguccaggugcccaggucucuggcuugaaaaggguagaggcccagaacagaccagaugacuuagaagugcaaaggaggccccuccucucaggcuauaggcaugcacagcccugccaacuugcucugaaauguauuccagaugcccaagagaaugagauuuaaaaaaaaaaaguuggagagaaaagacuugaauauuuaucagcccucgugggagaauagguugguuaaacuuagaagugucagaaaagaucacagggaaagagauggacggagcuggcugagaaaacagcacauacuggagacagcaagugagcaacaagccagaggagggcgcuguccuaugucuaugugcccacguacuccugauguuugugaaguuauccagacccuaguacagggacaaagaacuaaagcagagaauucauagaggaacaaauauauuugggcagaaagggaagacugcagucucauuagcaacuaauuaaacaagcuagcaccuugacaccauugaauaacacugucuuuaaacauacuauuaagacaugcccacuggcacaauaguuaugggagcaaccaauuacuguuuugauucuauauaagagugauccguaaaauggaacccaugcuggcaugguugacagagucaagaaccuguggcuagguaguuccauaggcucuaagggagagccugcuauuauucugcuaaauggucacagaauuaaagcaaccccuaaugauguauugcuaugccuguagccuaaugcauuucccaagcucaucagagcagcuucuucuugcaguaggucgugauuaacauggcaacccucagcuggucaauauucagagagucuuccuaggacaucuaugucauaucccugacuccaaggcucaaggguuguuguggaaaaggggagggaagauugggagagccagagccagcuggagacuucagggaagccaucuuuucuagccacaacagggcagccacacacaugaacucacagugguugugacaacaagcacaagacuuauauaagcucaagccaaacaaaacccaagcacagaggaagggaggcggugugaagucccaccaugggcugaggagcgaucagcauuuacuagcuguggggacagggagagucuguuuucuuucgugguguggcuccugguaggucuaccacacccaagggcaggcccuacucguaagaguaguuggguaacacauuucucauuguguugagaaaaaguugggggagauggagggagggaggaagaaaaagggaaggagggagggaggggaggaggagagauuucacccaguuggauaggcacagagguagggguauaucugggaggaagugggggaggggaggugaauacaaucagaauaagcuguaugaaacucucaaagauuuaaaauguugugggaaaauaauacuguucugugccaaagaagguggggggaugggcacacuucugcucuguugguaggaauauagagucaccuaaaaaauuauaaaggugagcgucagcucagggaaacuggagcaaagcaaaauugucgguacaaauguagacuccagugggcagauagccuaaaggagcugaccaucucaccuaaaauuguguccccuugggcaagcaacuucaccucucagaaccguaguuuucucaucuguaagauggaaauuuugauaaucuuuuacaagguauuauaugaaaagcaccuacacaauuagaugucuuugaaaggggagagggggcuggucauuccuguccuguccuuccuagacacuguccugcccucuccugcauugcuauguccacagcggugauuucucucaucaugaggugacuggaagccggauggggguggcagggauggugggagugguggggugggguggagugcaugcagaacacucuucccacacaaugugugaugaagagaaucuggguugugaaggacggggaacacaauggaaggaccagaagcuuuacccggcugcugagccagggccccuuuaaauagaaacauuuguuagguuaagcuagugugcuuuggagauuagcuauugcagcagcuagcaaugccugcccuaacuaacacaauauucuaauaacagcaucuguggccagcgaccaaccguuuggggcuguuaaauguggugccugauggagccuucggugagcaacagcaggccgccuuaauccagucauuacucaaaagugcacauugcaagauuuucagagcaguggcugauaaaaauaaaaauaaaaauaaagcccuguugguugaauuaagguuuuguucucaauuguugacuuugggucuugcguguugagguugggauugguuggaguguuuugacuagacuggggcucaaaaaaaaaaaaaaaaaaauccaaaggauuugcuaagaaucaaaguggaaagggacaauguggaggugaucaaauugucuguaucagcugauaggagucuggccuguggccaggaaaugucagcccugcuggcgaugugggccucaggugacuuuacagaagcagggcucugacagcugccccagcgcacaguuaauuccucugacaaggugaaacagcacacagggcagugccgucuacacagaggagggcagaaguaguugaaaugccugugguagaggcuccuggcuccccacccaagucuuucuggaggcuuccuuagaaaacaguggcccuaggcuuggggguggagcuugguaguaaagcagcugccuaacaagggcaaggcccgaguuccuccugagcaucacaacaaccagccaacaguaaaaaugguacaggcaucaggaagccagccucaaacgcuccuguaagcucccagugguugcucuggauagccuuuguggccuuuccaauccugcugcucacugaucaagcuagaauccacuccagccgggaguuugcuggcuagaaugugcuagagcccuuuggggaagcugggguuagggagccacugagcgaggauucuuccucagucugcuuuccuucuucacugaggaccauguugccaaagccagagaagaccaaugggacucacaaagaccggcucagccgcugaggcaacguggaaugcggcuguguggacuaauucugucucugcuauucuaaauacuuuggugcuugcucucuuauaguuuuucuccuuagugcuguuacuguggcagaaaacuccuuagggaugguuaacugccauguguagaguuucauaaacauggcacccggcuuuccucuggagugacaugaaggccaaagccugauuggcuuuccuguaaugacuaaugaaggagaggaugcugaggaaaagaccugaccuucugggguuuggcagagcagagugaggggcugaccacggcugagccagagccuuuuuuugaaaggaagucauguagagcaaggcaugcugggacaggaggaucagcagcaugccccuggaugacacuaggaaauaucaggagcugggggagcacugagguggccagcuaggggcugucuguuaaauugaggcuccccagaggcaggucucugaggaaaccuaaagaagacucgggauuugugugagggcucaagaaaguauagagagcacugacaauuugugcccaccuucagacaaagcacccucaaaaggcugugagggacauacaugcagggccuuuggaccuuuagugcuuccuaagccccagcucaauggagaugggauguacagaggagcagagagaugacugaagggaaggcaguggaaccucccgcuauuggccccuagacugcucagagaaguggaucacucucagggugcuccccuuaggcucugccugugagaggcauccacggcagaucagaagguagggaaauucucaaauugggauauuaaaaugucacggcucagauccuaggcaccuuaggacugguucuguaagcuuggauguccacguaccaguuc

SEQ ID NO: 5927 - RNA, 1065 nt, Mus musculus
aaaggcgcuuuccgcacuacccggggacggguccauacugcguuguucuugauucccaucguaacuuaaagggaagcuuacacaauguccggagcccuugacgcccugcagaugaaggaggaggguguccucaaauuccuugcugcgggaacccacuuagguggcaccaaccuugacuuucagauggagcaguacaucuacaaaaggaaaagugaugguaucuacaucaucaaucugaagaggaccugggagaagcugcugcucgcagcucgagcuauuguugccaucgagaauccugcugacgucagcgucaucuccuccaggaacacaggccagcgagcugugcugaaguuugcugcugccacgggagccacuccaaucgcuggccgcuucacaccugggaccuucacuaaccagauccaagcagccuucagggagccacggcuucuaguggugaccgaucccagggcugaccaccagccacucacagaggccucuuaugucaaccugcccaccauugcucuguguaacacagauucuccccugugcuauguggacauugccaucccaugcaacaacaagggagcucacucagugggucugaugugguggaugcuggccagggaaguacucugcaugcgagguacuaucucccgugagcacccaugggagguuaugccugaucuuuacuucuacagagacccagaggagacugagaaggaggagcaggcugcugccgagaaggcugugaccgaggaggaauuccagggugaauggaccgcaccagcuccugaguucacugcugcucagccugagguggcugacuggucugagggugugcagcuucccucugugcccauccagcaguuccccacggaagacuggugugcacaaccagccacugaggauuggucagcagcucccccagcgcaggccacugaguggguuggagccaccacugagugguccugagcugcucugcagacgccugagcaaagggaaaaaagauggaaagaaaauaaaguugcuaaaagcugaagaaaaaaaaaaagcaacaugccgaau

SEQ ID NO: 5928 - RNA, 2839 nt, Mus musculus
agugaaauagcuaacuuuuuauuaaauaaaacgacuuaaauaaaaggaacggaaaaggagaggcgugcacccagccuaaacgcugggugcccccggccccacacgcuucccccagacgccgggucgguugccccuccuccagcggccccgcaggggaagcagguggccgguuucuaaagaaaaaagccaaaacuuuuauuauuuacacguuugggcaaaaguacaaaguauaauacaggcgcccagcccgggggugcgggugcggggcggaguaacguaaggcgcuucuuugucaggcccgggccuggggcgggacggggcgcggggcggggggcuuggauugugcagccgcgaggaccugggcccagccccucuccgcggccggcgcugugcggcgcgccccaagacccacgcgagucgggccgcccuacccuucucggcccagcuucccuucccagcccggcugggggacccggacgccccgccuggugggggcagcgauccguagcuacguugcacgccgguggcucacaccagagaggugacagcggggaccuuggaacuguccuccucccagggcugcagauucugcagagcaaagagcgacgaguugugcagacagagcgggucgggcuggauggaaucguugaggcucuucuggaaggcgucguguugcagcuguagcaugagccggcucgccugcugccgcuccgccucccgcuccuccgccgucugccgccugcacccggggagggagagggacagcaccgucacgcacugggguuugcuaggccaccagcgggccccagcccucccgggaacagagccucccggccccucgaggcgaagccgccugcggcccgcacacacuugccccgagguccgcggggcaggaggacggguggaaccauuggguuuuguuugugcaccccgggggcgcugggaaggcacucugcccgcccguccaccugcacacccggauuuuguggccuugucaacaauaaaucuuguuuuguguguguguguguguguguguguguguguguuuuguuacccccugcgggauaagagcggcagggcaguguauaacugacuugguccugcggccaauggggucacuugugcccacggguggacuggcgggcugugcaccaccagcugggcgacacuugacggggugucuaccaggcacuaucuugaagcccucucuagaacauagagcuucuucgucguuuacggguuggauggaagcaaagauaguauuaaaaagaaaaaaaggaaaagaaaaaagcagaguuggagagaggacccuaaaacagcccuggccaucaauccgaaauccgagugggugggcuagaaugagagagggaggagagugugggaggcccggggugugugugguggggggcaggugggaggaacccaaacgagcaaaggaggcgaaacaaaacacuggcgagaugggccugaaaauggagacgccgaggcgugggagagauggcgagagggauacaggucggugggaagaaaggacaacaaaucuguaaaagaagggcgaugcaugguccagggggcgcggguaggagcuagcacaggagagggcgugaugcuggacugccgcgcagggcggggcaggugcagggcaggugcguggugggccgggccgggccucucucaccgccacuugguccuccgauuuuggaaccaggucuugaccugcgcguccgucauuuugagggacuuugcgagcgccgcccucucggccgaggccagguacuuuuggcgauggaagcgcuuuuccagcucacagaucugcacccgggaaaaggacgugcgcggcuucuuacgcuuggguggcguccgguucugguagggguggccaaugcgccgggucacggugaagggcgugagcgcggccgccgcugcagagacacaugaggccccuugaagcccagcccuaccaccguucgggccacacguggagccccgugggacacagugcuccgcuauuucgcucgucccgcgaguccccuccgcagcuucaagccaggcagggacgccccccccccuuucccugggacguugguuucuuuccccccucccccgacccauaacucuccgauuuaccuucaaccuccccccacccauagccgccccgagcucugggugccgaggccuccgccacgccugggccucuggaaucgauccugggaguggggugcacagggcgcggcgccccuggccccgggagagccgaggccuggcuccuggugguucgcucugcucaccugugaagcgguccuuuacaaagcggcgacugcucuccauccaggggaaauugaggccgccuaggcuggagaccgugggcaccgagggcauagcgggcagcgcgcuaggcagaggcggcggcacggccccagggagcggccugugcgcuggcacccggaucacgccggcgggggccaagcuuagguugacacuguaagaucccgcguccucgaagggcgcgccgaggcccgcaaaggaggcgggcagagacggguacgcggcgcccggacggcccccggggggcccucccagguagcuggcgccgucggggccccgcggggcgggcgcgcuguccugguccgggcuguugaggauuuggucgaugccgaagcugaugggcucgugcggguguggggucugcgcgcuggcgggcgccuccauccugggcgggcggaagggcugggcugggcugggcggggaggcugcuggguccccguuacggcgcggccauggagcgcccggcgccuccagucgcacugaaacuuugccaagagugcgcgggcccgacagg

SEQ ID NO: 5929 - RNA, 308265 nt, Mus musculus
cuuuccugguuagcuggguauccucaccacaccguuggacaagguuagccuuaauuuuuaagaaaugguauguuuuugccuguucaaggccuauuaucaugcaaaguaccuaaauguauuuuacucugaauuaauuuuacuuuaaaaacaauuauuguuguuauggauugauacaaccuaaauuaauuucauaaaaaauuuuaagaauaauuuauuaugaaauaaggcacuugagaaacugguaugucuauuuuugggggcaaacauuugugcauaaaauaggcuuuugcuacaauaauuuuuugucuaacuuuuucuguacauuuuauuuacuccauuucaauguaaagacacauuauuuuuuaaagguguguguguguguguuuacguacccaugugaaugcguacuauguuuuagugaaaagcauugugcaaccuggcagugguggcacacaccuuuaaucccagcacuugggaggcagaggcaggcggauuucugaguucaaggccagccuggucuacaaagugaauuccaggacagccaggccagggcuacacagagaaacccugucucggaaaaaaaacaaaaaaagcauugugcaauagcacuaaggggugaaguuugucuuuucugauuggccuuuccccucauuuuacauaguucccaucuuuaauaaggacaugaacaagauauaaugagaccauaugggaauuacucauuacaaucugcaguauaaaaaugaaauacacuguguggacgccaucacuuagcugguuaaacugccugucucauaaaacugaaugacaauuuacugauuuuuggguuuuugcaguacuaggaguugaacucaggccuugugugugacaggcaaguacugugugcuaaacuccuuucugugguuuugaccugugucuugcuauguuuuuagguauuuagccuuaguuuugagcagccaauauuggaguuugugcacauuauucgguucuacugcuugcuuuucuaacacuguacugaauggcuucaacuccuguccucacuuacagcaaugugauauggcuuauaaaguucuuuguacuauagaccauaaaaguaacuuuuauucuccugauguaauugucaucucugagggcuauuccuucaguuugcugaccugggccuaguccuggaaacuucuagccucuguacaaucuuguuuuuuucgagacaggguuucucuguauagcccuggcuguccugaaacucaguuuguagaccaggcuggccuugaacucagaaauccuccugccucugccucccaagggcugggauuaaaggagugcaccaccacugcccggcccagacuuagauuuuuuccagccucugagacuggcugcugaauaagcucaccuuuucaugcuuuuuccugacuggcuaguucagucucaaacucuucuccaagcugauucaaucuggcuucucucugcuucuccugaacugcguugcuuggccucaaacuaacuuuggcaauauauucuaaucuucuggcuccuucucauucucuggcuuguguugucuucaccugagucuaacuuguuuucuuuauucaaucugucucuguacaacuguccagauaaaacugccuccuuccucuuuccccccucucucucuuaaguagcuuccuuuuccucucucuucuugugagagucgggugcauccuauuuuggcaaaucuuucuuugucacuuuaccacucaauuagacaucacuuuuaaacaugggugcuccccuucuacaaacuaacuuuaccuucuuuguuuggguuuaaaggugugugcgaaggaugagccacaccacaacuagaaacagggguuuguuuguuuuuccaggaaauaacacaauaucaggguuuguagugagaucaaauauccuucaacaauagacuugucaucuugaucucagaaauaacaaagcagaacuuagagagacuggauggauuuccuaaagggccagaagugugacacuccaguuuccugacaaaacacaaaaauuaacacccacccccuccaccuggcuuuccuucagaaggcaauuuugcacaauagaagacaauccuguaauuacuacgggcuuuaauguuuuuccuuugacugaacuuugugguagaaaugaguuaucugacauccuggauaauuucaauagcuauaguaacauaauucuaccuuacauuuuauucagugacaaaagauaugaagccaaaugccuaccuuguggacugacaggaggggugcguuaaggcaguaaucuuaagcagucaguuaaauguaaagguagaaggguaacugggcuucuguuucuagacuucccuggugaguucagaagauaaccagcaaacugugcuguuggcuuuacaaaccuacauuuaugucauucuuccccuggagaugagaaaaaacaaaacaaaacauggaaacacccaagacucacagagccauuucuccucccagaaccuaaagcuggagcugacagaaaaaggacuuuuaaguaauaguuuuaaaagguguuugggagccagguguggugauucacgccuuuaaucccagcacuugggaggcagaggcaggcggauuucuaaguuugaggccagccuggucuacaaagugaguugcaggacagccagggcuacacagagaaacccugucucgaaaagccaaaaaaaaaaaaaaagaaagaaagaaagaaagaaaaaagaagguguuugaaucaagaaguuacguaagcaaggcagggggugcguguguaugccuuuaaucccagugugcaggagguagaggugggcagaucucugaguuacagaccagcuugguuucagagggaauucugggauagucaagguuacaaagagauaccucaucucaaaaaaccggggcgugggggaagucagguaaaugcaguaggaaauuauaauaggauauuguuuaguauaugugauaaggacauaaaaaauaaucacuggugccugagauaagggaguuaagaguuagaaugugguaucauaguugagauuaggcauuaaaaaaauauucagacauugaaaugaaacuuaggaaauaggagcaaaagacuuugggaaauaagaaagagcacuagaaaaagaaaggguaaucuccaggaagcucacauacucagcccaacggaaacuauaauagaaagccugcuucaaaggaaaacuaaagcgagaagugaguccccaaaagauguccucugaccuccauccauauacuauggcaugugaaugcucgagccaccaccaagaaaaaguagucuuuuaaaaacggaaggaugagcauacuaaaaaugucacgguuuagaagcugaguggcaggcuggagagauggcucagugguuaagugcauugacugcucuuccagagguccugaguucacgucccagcaaccacaugguguaacagaaucugaugcccucuucugguaugucugaagacagcuacaguguacucauauaaauauaauauauaaaucuuuaaaaaucuuagacgcugaguggcaggugugaggauccaugggcuauggauagacugaaagcugaaggucacgaguggaagccacagucaaucaacuaacauuggagugcucuggaguagaguucccacuggaaauggcauaacuacaaauuaggacaaauuguguacauacuuuauuuugaauacuauauagacauaaaauuugucuauguuuauuaauaugaauauacauauucaacaauuauagcauaucuauguguacacauacugcaccagacaaguagaaagacuauauuuaauggcuuaaggcacuagggagccaccaacaagaacagagcuuaauuggccacaauccuugagagaauaaaagcacugccuccagccccccaaccccuucccccacaccaagcauuuucuaaguggcagccagaagcaacagagacgcauugccagucaguagugucaauacacugagagcagauacgaugcuagagauggggaacaaaugacugagauuuuuuuuucuuuuuuuucuuuuuuugagacaggggguuucccugucuguccuagaauccacucuggagaccaggcuguccuugaacucagagaccuacuugccucugccuccagagaguugaguuuaaaugcaugcaccaccauugccuggcugccuuugggauuugagacacaaaauuuuagagagaagagugcacagauaugaacuucaagauguauuuacaaagucuuugacaaucaucaguucacuccuaagacauacuugcaaagagaaagacuucaggaaagcuccuguagcuguagcaccuaaagaguuaaagaaagcuuucagcagcugcacauugcuggugauagacuaauguccaggcuguacaagggaaauauaccaggacuucaguuauaagaccuggcaaagaucauagcccaagaguaaggauaaacugaaacaaaccuguaucauagccuaaaacaagcaucacuggaugaagaggagaucuucuuuuauuugcuuaguaacauaaaaaugcagaaugcuaauauagcucaaagccucuauaguuuuucuucuacauuauuugaauuagauaagacauuagacuaggggaauaacuaacacacaaaaccaggccaaauaccaaaaaauggaaugacucagugguugagauauuggaacuacuguauaagaauucuacaugugaucaaaauauuaagaaaauaguaaaaaggaaaagaauuugaucagauccaugaaaauuauuuagacaguagagggacccaaaugaaaaauuuggaauugaaacuauaauaauuaauuaauuuacaagggggggcuggagacauggcucagagguuaagagcacugacugcucuuccagagguccugaguucaaaucccagcaaccacaugguggcucacaaccaucuguaauuaaaucagacaccuucuucugguguguuugaagacauauaaauaaauuaaauuaaaaaaauuuuaaaaauuuacaagggguuguauagcaguuuagacauaguagaagugaauuucuccugaaugggcaacaggucaguagaaaauauucagugcauauuaagcaugugcauaugcgcgcgcacgagcacacacacacacacacacacacacacacacacacaagaaauauggagaccaguucaagaagaaagaauaauguagcaaaaaguuuuagcauacauguaacacaaugaaaggaagaagggagaacagaacaguauuuaaacgaaauacuggggguuugaucgguggcucagagguuaagagcacugacugcucuuccagaggucccgaguucaauucccagcaacuacaugguggcuuucaaucaucuguaaugggauuugaugccuucuucuggugugucugaagauagcaacagugaauucauacacacacacauacaaucuuaaaaaaaaauaaaagaaauacugguuaauauuaaaaaacugaugaagaugucagaucacacgagaacaacuauuaauuucaaguaggaugaauauaacacauagacuuagugacaaacugaaacuggucaaaaacaaagugaaagaaaaaaacuucaaguacucuagaguauauuaucuaaaggugcaauaauuaagauugauggcuaacucuucaacugaaacaauguaaaccagaagacaaugaaauaucaucuuuaaaguaucaaaagauuaaaaaacuaaagcccaaaaggcuauuauggaauuuuauacccagcaaaacuaccuuuaaaauugaugaaaugagccgggcguggugguacaugccuuuaaucccagcacuugggaggcagaggcaggcagauuucugaggccagccuagucuacaaagugaguuccaggacagccagggcuauacagagaaacccugucucgaaaaacaaaacaaaacaaaugcuuucaaauuaacaaaagcugagagaauuuguuaauauaccuaaguuguaagaaacauuucaggaaaauuuccccuuaaauacauaaaaaggcuguuaaauagaagcauugaacucuggagaaaugaagaacacugguaaugagcaacucugauucgauauaucugcucaauaacuccuauucccaugaaauaauuugguguaaaauauaaguucaugugaaaguguagacaaggaguuacagacaagccagaauuuuauaauuuuaaugccucauacacaaugucagcuuaacuuacucaaaaaguuaaaaaaauaaacaaugggaguugggcauuggggaacaagaguuaaggauagcauaugggggggggggucaaaggcuguguguuagaggaacagaacaucugugcagaugugggauuugggagucauguauuuguuucagaguucugucaggaaucaauauggcuugugguagacuuaagguuuauuauuauguguaugaaagcgaugcaggugccugcuaaagcaguuggauuuccacaagcuggagcuacaugcaguuaugaacaugugggagggugcucuccacugcugagcagucucuucgccuaucuaccacagauuuaggagccaaagugggcaguaacacacaccaccuaugccugcacucaggccgcaugcagaugacugugacuucaaguucgagaccagccugguucacguauuacaguauucauagugagaccgacgacccagucuccaaaacuaagugggcagcugaggcgggcaguugggucgugguggugaguuaaaaguuaaaggucagaggucagaggcucacucugaggaugcagcgguuguaaaaggagcgcaccggcgguugggcggaggagcccgaaggacacgcccccuccuccccgcgcuccgccggccccgcccagucccgcugcgggcuccgagcggagcgcgccgagcacugggagcgagcggcuuggggggaucccgcggcggccgggcucgcgcggcgccuucgcucccccuccccucggcccucgggccgcgcggccugcgccgcuccgggaagauggcgcugcacuuucaggucagugcgccgggcugugggccuggagcuccaggccgcgaccccgagcccagccccuugccugggaacgguguggggcgggcgcagaggagcgggcuacgcucggccgcggaguacgcucugguuggcgcggcuguagcggcgucccggcaggugggagcuggggcggaggggccgccauccggcccuuacgcccagcccgcggucgcuguucgccccgggagcuugagcucggaggccgggacggcgggagcaaggcagcggggccagaggacugucauuggccggaggcgggcgcgggucggggcgcggcgcgaccgggagcgcgcagccucauugguggagccucggggcugggcgccggcuacgcugaagggaugcgggucuguccgguggcucccgcacucugccggucuucaucccacagaaguauacugagccucuccgcugugcaucuccuguggcggaacguucucgggaugcagggcgacgucagcuaccacccucguccuuuuagagcgcgcgauaauugcugcacacgugaagacuguuaugguagaauuagucacgggauaucgcgggagcacagaaagggggcaguccauccguagguggaguggagucuccacuuguuacuggguuccuacugaugguacauaagccucugggcaaacucgcugccuuguacucucagggacgugggacucuagcgggaauuguaggaacuguauguagauacccagguagugagggaagaaagacuacagacuaaagacggugugggcaaagcaaagaauuguggaagaccguugcauacugugaaaaucuguucuugcauccuaagauugauuugaaaaguuguggauggcagaagaccuuagagaaguaggcgggaucuuagugacaguguaucugaaugccccuuccccuuguagauuuacauggauccgaugguccgucccauggacuuagugcuuucuuacuucuaaaguaauuuagaaccaggaaauagacccacauuuuaucuuuuuuacuuacuguuaucuuuuuauuuacuguuuuguuuuguuuuauuuuuaaggguuccccagcucggaauuagcuauuuguuaucacuuuaguaaauagaugucuugugcagaacuuuugcaggaagaaucucacagagauuacuuacugugaauuggaaauagauauucagauguucauagugcagguguaagucuugaguaaaucagaaggcguacaagaacuuuggaaccuuuuuggacuuagacgaugccugguaaaucgccaagcccuggaaacugccuucaucuccaagugcaauauuacacaagugagauguuggugcccaaacuggucguaucauuccuagaaauauacacuaaggugacauuuuaaggcauuguuucagugucuucuucacacuugguaauuauguagcuccacgauauaacuacuguccacagggcagaguugcauguguagaccgccaguuccaugcuuuuacccuuaaguccuugcuugccucaguuucuuggaaggcagaggaagauaccauuccuagagauucaaucaggaucauccugguuagggagcaguaagaaacagggcuggaugaucuuuugggaggcauucugaguggaggaacagaaugaggaaagauagaauuauuauaguauuaugacaaugauguugguaaaaagcuuaguguuuuaggaugucagccuaggacucuugcguguuuugcuugaugaauaguucuggaaucaaagacuguuagugaugaucuagcuccucccuugggcugggugaucucaaugugacugaaaaauacacauaaugguauugugaagaagagugauuuggggaagguaggugucagugugaaguguguggcagucacuggauuacuuugcucuucagucuucacauuuguuucagauguuuucugucuguagucucaguagugagucuggggaagcuuagauugcugugacagauucuaaggcuugugccaacuccacuggacaagggacuuuuccaaagaugugucuuuuuuuuuuuuuuuuaaugguuuuugagacagguuuucucuguguagcccuggcuguccuggaacucacuuuguagaccaggcuggccucaaacucagaaaucugccugccucugccucccaagugcugggauuaaaggcaugcgccaccacugcccggggaagaugugucuuuuuuuuuuuuuuuuaaagauuuauuuauuauuauauguaaguacacuguagcugucuucagacacaccagaagggggagucagaucuuguuacggaugguugugagccaccaugugguugcugggauuugaacucuggaccuucggaagagcagucgggcgcucuuacccacugagccaucucaccagcccaagaugugucuuuuaagacccccacuacuuaccacucauuccuaagcagccuacggagaaacccagggcauuggauuuuacuuaguuccucuaacgccuacagagaaacaguuaguagaacugucuaaguaaauugguuugaaccuggaguuugccagauuggggugagacacgguucauaaaacuccuggcaccagcagccgauugagggaucuccccacagucaccuaagggucugacaguucaucagaagcuaucaaauucugccaggcacgguggugcacaccuuuaaucccagcacucuggaggcugagacagguugaucucgaucucugugauacagagcaaguuccaggacagaacaaaauuuccauagagaaacccugucucagaaaaaaacaaagcaaaacagaaaaacccuaucaaauguauaauugugaauuguuauagggaaagaauacagauuaaaauugauuaaagggaggauacagggaggauaaucuuaaucuaugaagguucuaaaauguagcuucucuuugccacaggguaggaugcucuccuggcuccauaugugugugccacugcaagacaggaagguuuaaccacucuuaguaccugcaguacuuacugaggcuucauuacuuaggcaugauugauaguuucugcuuccacucauaaucaugacccaaaaucaucauuaaaacccugaaucuguggcuaucagguguugucagugcuuguccuaaacaaaacaaaacaaaaaacaaaaacaacccaaaacugucaacuaugacauagauuaucuaccagaaauugagggcaaaggcuagaccucuuuuuggacaaagccacuuuuuuuuuuuuuuuuuaauaguuaugcaugaggaauugagagaggaaagcagaagguagcauggagcuugugacucuggucuuaaaacuccaacaccauucuacuggagagggacacauggaguagaaaucugcuggagccauguguaaugugguuuuugccgauccagagccaugugugacgugguuuccacaguucuagggccaugugugacaugguuuccacaguucuagggccaugugugacgugguuuccacaguucuagggccauguguaacgugguuucugcuguucugggguuacuuuuaguaccuuucuagaggguguuguagacauacaagaggaaguuaaaaguaggcauuggacauuguuggcagguggaugaggacuggagaauaaagggugacacauggugagggagaugugccuggugcauacagacuugucauuggcucugugaucuuguacaccuuacaugcauguacucugucaacuuuagguuuuuuaaucugaaaaaugagcacacuaaauuuauguaguauguaggaaucuaguuuuuagaauuggcuuaagaaaagaugaaaauacucuuguaaacugugggauacuuaaacaacuauuugguuggugugguaucugaauaugguuggcccagggaguggcacuauugaccuuguuggaggaagugugcuacugugggcugggcugccuccuagcugccugaagacagucugccuuuggaucuagauguagaccucuuagcuucaccagcaccauacuugccuggauguugcuuugcuuccugccugaugauagcagacugaacuucugaacuuguuagccagccccaauuaaauggggcuuaaauuguccuuacaagaguugccuuggucauggugucacagcaguaaaauccuaacuaagacaguuggugcaaaaguacuuuaguuuugcauuguggaaauuugucauuugauacucuuuaacgugguuauguuguaaaucauuuuacuaugcauuucuuacuguaugcuuuuugcuaguggcauuacaucuguuuauuuuagauuuauauuacggaaaugaugaagacaagcaacuuugaacaauuuuuaaaaauugucuuguuuuauacuguguguacacacuauggugcuguguggagguuauuuacagcuuuauggaguagguuuuucuuucucuuuacauggguuccaccaccugcugagcuacgauuuuucuuguuugaguauaaaauggaucaguaacagcagcauguaaaauggaucucugcuguuguuggcucagggauuucuaaugcacagugcaguggugguucaauaaaguuugcaaaaaaguauugagagcccuaaaguugaggagaauugugguaggugaucagaacuuaacagugacuuaauggaaaacagccacugaaagugauccucuuacaacuacagaaauugcagagaacucaguguggaccauucaugguuguuuaagauuugaagaaaaagcuggucgugguggcgcaugucuuuaaucccagcacucgggaggcagaggcaggccgauuucugaguuugaggccagccuggucuacaaagugaguuccaggacagccagggcuauacagagaaauccugucucaagaaaaccaaacgacaauaacaacaaaaaccaaaaagauuggaagaaaauuggaauggcaaaaaacaaacaaacacaguaaaugacccucaggaccagauggagaugcuuuuagagaacucuguggauuugugucucucuuacucuuuuuuuuuuuuuuuugguuuuccgagaccugguuucucuguguagcccuggcuguccuggaacucacucuguagaccaggcuggccucgaacucagaaauccgccugccucugucucccgagugcugggauuaaaggugugcgccaccacgcccgacuucucuuacucuuuuuuaagucauuuuguuuuuuaaauuuucuuucuaaaaacuuuagugaauucauuucuugaucagauuguaccaugugacaggaaaaugacaauuccugaugaccagcuuagugguuggacuaagaaguucuaaagcacuucccagagccaaacuugcaccaugagaaguccacagucacugucggguagucugcuaccuagcacacuaucaguugaauccugccuagucaaaccacuguaucugagaaaugugcucaccaaauccauuccaugcaccgaaagcugcagugcccucagcauuggccaucauucaggaaagagccgcuucuccagagcaaaacuggacugcaugcugcacaaucacagcaucaggaguugaauccauugagcuuugaauuucucccucauccaccguguucauuguauccaugugaccucuuaccaaugacuaccacuucuucagcaccuugacaguggguuuuuuuuuuuuuuuuuuuuuuuuuuuugggagacaggguuucucuguguagccauggcuguccuggaacucacucuguagaccaggcuagccuugaacucagacauccaccugccucugccucccaaaugcugggauuaaaggcgugcaccaccaccacccggccuuuuuuuuuuuuuuuaaaugguuccuauuuugauuaauaaaauuguuaugauuauuuaacauucacaauccaaaucuccuuuugcgccaauguaauacuggcuucauuguugaaggaagaguuaguuccaaguggcucaggaagaagccuucagggaugcucagcuaacagaagaaggaacaguuuauaggagauaaguaaccccaaaaugaagacaggcaagcuugauuccagaaugcaggcaagagauggggagguaauuuaucauacacacacacacacacacacacacacacacguacacauauauacacacacacauauauauguauauauaugaugaguacacuguagcugucuucagacacaccagaagaaggaaucggaucccauuacagauggugguugugagccacggugugguugcugggaauugaacucaggaccucuggaagagcaguaagugcucuuaaccacugagccaucucuccagcccaucauuuaucuuuuuuaaauauuaguuuucuaggucuuuuguaacauugccacaacugggguggcuuaaaacuccaauuuguucucaguucugaaugaaggccagaaggcugagacagagggcagauggcuugcuuccaucuggaggccuuuggccuagcuucucagaguuuuuggcagcuuuagaacuuuuugguguuagauauggccucccggacucugccugucuucuuauggccuucuccccuguaucuuuuugcaucugaagccccuuucccuuugcagagaauuuggcuggguuuuggagagacuggugagaaugaccaucacaagcauggccaacuuccauggucccgagcguuugcaaggaguuuggugaggggugcaaauggcacuuuagggacgguaacauuuucaagaacauuugguguuuggggcucuguauuuuacccugacauuucauagugcuccacgagucccaggcaggcacucacguguccccauguguugguggguugauagaaggaacguccugcuucaugaauaauccuuauguuccuaugcaguuuggggaaaguucaacgugacaggaagggggccacugccucccaccugucagagaagacuuuugcuaauuuuguuagaaauuuuguauguagcccacgauggcauugaauucucugucuuccugccucagccuccugaguguuagauuguagaaaugugucaccauguucuuccucuccuauaaggaugucaguaauuggguuuagaguuuagagcccacuccaaagcuagaaugauuuuuaucuaaaucccuuaacuaaggauuuauaaagacccucuuucuaaagauuauagaaauaggcucuggaucuaucuuuuaggggauauagcuaucuaucuuccaguguuauuacaguaguaagugcaaaguaaaguauguggugugcaugcaacucugcugccucugcaugcaacucugacugaagcagugagcauggacaguacucaugccuccucccaccuggugugaucucagguaggcaccaacaugccugacaagguccuacacuuuuuuuuuuuuuuaaagauuuauuuauuauuuauuauauguaaguacacuguagcugucuucagacacaccagaagagggagucaguucuuguuacggaugguugugggccaccaugugguugcugggauuugaacucuggaccuuuggaagagcagucgggugcucuuacccucugagccaucucgccagcccaagguccuacacuuuaaugaaucaauuugagacuucaucuuugggcucuuuagcagaaaauuccugaaucuuggcuauggguuguagcacagauagggaaguggggaaugugcaggagcuaagguggauacaagggugggcgccagggcucucucgucucaggucugcuuguggauuugaggggugugaagcuauaagcugcacacagaaguucaggccagaacugaacaaaauuggcauuucuuuuggaauaucccauuauguucauuuggcuaccuguuuuugaaaaucucugccaauauuuuugucaaguauguaauucaaguuccaagugaaauaauuuguuuuauuaaguggcuuuaacaagauucucuuaagccaagaggguggccagacucacuuuguaguuggucguuuccagguguucuaguuauagguagagccaguuagucuuuguacuuauaagaugaaaacuuguacuuuaguuagaguguuaucagaaauacuguaagaucagaagucaugccaugguucaccugaagcacugaguucagaagcccagacuagcacacauagaauuaucauucgaucuuuuguauaggugguaggguugggaacaacaaacgagcuguuggcagcuugugugaggucuuucuccccaccccaucacuuugcccauuaucucacagcuguuuacuggccacuguuucaugucuugaaaugaguacauucauuuuaucugaagcccugucaaugcugcugcuuugccugugcugccuucuagucuauucuucacuuggcuuacccuuuaggugugaggcacucuucgguuuugagcuuuuuagcauauguguaccuucuuucagacauaacuguuaacuuuguaaaggagggacucuucuccuuuauguguaguugcguuguguaacucauuuuguaaguaaauaauuugggcaguagggaaugugcuucucuugcacgguauuaagugagugguauuacugcucaguaccuaugcauugcauggauguauagaagcauuauuucuguaucucuuuuauuuguguuuaauuauuauuuuccauuuaagucaaacgucuuucuuuuuuuccucugaagaguuuggcugaguuggaagugcuguguacucaucucuacguagggaccgaucucacugaaagaauagaggcugagaaagcacucuuggaacugauugacagcccagaaugucucagcaagugucaacuuuuacuagaacaaggaacaguaaguaugagauggguggcugacccugacaggccaguguugaugauauuagcggugguuuagcugcgguacucaaagcuuuugccacaucuuguuguuguuguuuucugucagacggguuaagcaggaagaacuggaaaagcuggggagacauacaggaaacagccacaaaguagaaauaggcauauggugaaauaguuuuuuucguucuucuuggccugguuuuaugucacauuuuauauguugauuuuagcagugcugggaaugaaccaaggccucuuacaugcuaggggagcucucuacugccaaguuacaucccuagcccuagcaauuacauuucagaaauaaaagaaaaaagaaaaagagaaaaaacaaccugaguaucaggguauucagaagagugcuccugcuucuucauaccuucauuguagauacucagagcuguccacucagcaaccagcagcuacugaggagccaaccauacuacugacuugugcaucuaugugcgcgaauuaaaguguucacuguuagagaggucugaaaugagaaggagaauacuacauacagagagaaauuguuuacaggaaaggugacaaacuuuucaugaagagccauguaguauuuuaggcuuugucaguauuucauaaguauuucuauaacaguagagaaaacaaauauucauaaaauuuuguugguaaaauugaaaaucuaaucauugaauauacuuuuuuaugucauacugguuagcugauaaaaauagagcaguucuucuggggguuaauugagguuuaagguugguguuuucuguuauuagacuugagugcagauauucauaguuaauauauccaugcagauuuguaaugaaauucuuucuuuagacaaggccucacuguguaaccuugacugacuuggaacucuguguauaacaggcuggccuugaauucacaauaaucuaccuugcuuuuaccuugaacgugcugguauuaaagguguacaauuagcuaaaauuuuacaucauuggaagucucuucacaaaccugggugcugucagauggcaugccagcaguuuuuagcaucuguuuugcaguguaugugccuugagucaguuggcauuuuuaugcuugucgaauuaaaauucucuugauauuuucugucuugccuaucauuauugcaaauuaauaauacucuucaauuaaaaauuagguggaaggucguuaguugaauagcaaaauggauuuucagauacagaaauuuucuuuauauuuggaucccuggcuaugugcuacugggagugucaguggagguuagaacauuuacugguguuacuacugauguuagcuuuucucaguguaggaacuugugaaguggcuuggcagugugugacacacaguguucauuguugcuggagugacccaucuaccacuuauccugacaucccuguacgaguacuaaggaaacauuaauuaauguuuccucagcuccuuuaaaauauucuggucuguaguuccacagauucuucauaaaagguagcaguuuuugaauuacuugccauucauuccugacuucuagaaugaguggaaggcaggagucuguaacauuaaccgcaggaacaaguuuuaguaacgucaauccaucuuuugcaaguuaacacuauaucaggguccuguuggcaaaaucuugcuggcauaugccguagugucuggguuugguggugguuuaugggauggauccccgguuggggcagucucuggaugguccuuccuuccaucacuugugaggcuaugccaguaccuagcaaacacaaaaguggauguucacagucaucuauuggauggaacacagggcccccaauggagaagcuagagaaaguacccaaggagcugaaggggucugcaacccuauagguggaacaacaauaugaacuaaccaguaccccuggagcucgugccucuagcugcauauguagcagaggauggccuaguaggccaucaguggaaagagaggcccaauggucuugcaaagauuauaugucccaguacaggggaacgccagggccaggaagugggaguggguggguuggggaucaggguggggggaggguauaggauuugaaauguaaaugaagaaaauaucuaauaaaaauuguuuuugaaaaaaagaaaaaaagaaagaaaggaaagcuaacccuaaccuuagcaauuucccugccuugccuuuaaagugaccucugaccuuguuucaguguccuuaucucugagcauuugucuucucugaaaggcugugaaguuuguuuuuucuuaaguguaacuuucgcugcucuagggaaaccaggugauuagcucaucauuagaaaguagcuucccuuacuuaacuaauggaucaguuguaaacuugacuuugguuuguagacucaccuuuuuuuuaguuucuuuuuuaagugcuguucugacauaguuuaucaaaguucacaaagacuacugacuuucuuugaguugggaauauugcuaugauugcuuaguuugaaacuuucaccgaacauucuuuuaggacaagguuacuucccuagaaggcaauugaggaaguauuaauuugccaucuaauuuaacuaugugccuucaaaguuagauauuuaaagcccacuuuuacuuuuuuucuuuggcuugggggauauauauugguuuaauggaagguaugugucacguuggcucaguucccaugacacucuagaugcugaagucucuggcaccugagcagcagcugcauuucagcacacacaggggcgguuugagcugcugaggucugccauuacacacgaagucagccauggaccacagguaaacccugggcaagguuccuguuuuauaaacauuaucacacugaaguucacaugguuucuauuuuuuacauguuaacaaaauacuguuuuuaaauuuuguuuuguuuuguuuuuugagacaggguuucucuguauaguacuggcuguccuggaacuuacuuuguagaccaggcuggccucgaacccagaaauccuccugcuucugcuucccgagugcugagauuaaaggugugcgccaccacaccuggccaaauuguuuuccaacuguuuaaaauuaugagaaccauuuuuagcucacaagcuauguuucauggauuuuuuuuuuuuuuuuuuuuuuuuugccaacuuguaaucuagagggaaaaauauuuuggcaagaacuucguagaaauagaaugagaauugaauuuuaaaagauggacguguauuuauagaguucgagaaaauuggagaggcuagagagauggucaguggcucuagagaaaggcagaacuugagcugcuucagaacugccuauggcuucagaccuggaaccuggccucugugagaacugcacacguguggugcacagaagcucgagagcacacaugcauauacucaaguucaaaauacaaaucuuuaaacagaagugaaaauugauggccacaguguacugucagacguaaaucugaaggaacacagaaaucauugugggaaaggcauugaaaaacucuuguggacagggccuucugcagcauggagccgggcauauuuggagguggaaggagagagcagauugugcagaacugcuaguccauguuaagaguauuuuaguugaacuuuuucacagacauuucuuuuucccauuuacuugcuguuguugagauagcuauguacacuucuucaaccaugaucuuuuaugagagaggagugugugcauuugugugucuacauagguauauuucaaguacaucuauuuuauucaucauaacuugcuacuuuggagaaguagaauuguuuuugcuuagaaaaauucaguauaauauuuugacuagucuguuuuugugaugauaauaaaaauuacuguucuuuacagacauccuaugcucagcuccuugcagcaacaugucuuucaaaacuuguuacccgaaucaauccuuuaccuauugaacagaggauagacaucaguaagugauuuguuaauuuuuuuaagacaaauuauauuuuaaaaauaaaaaguuucuuuuuauuuguugugcuuuuauugggauugcaauuuuaguuuuauuaguaauuuaauauggguaguuaagucuuauuccugcagugaugaugauacaauagaugagacaauauauaauuauaaaauuuuauuaauuuaaugauaaauuauauuuuguguaugugguauuugauuuucacuauuaugguuuauccuccaaauaaauugauggauuauuuucaguuugcagaugaguaaaucagauaugauaggcucugacuugcucaggaucauacaaccuggaaauaguagaguucuuuuaaaacugcucaaucuguauagagucuaaugcucuuaauugauuggcaauugaaugcccagaaagaaaccagcucuguaguguugcucaaguugcuauaccauagucaguuuggauacauuaaaaacccacagcuaagaaacauacaguaagaacauagauacuguagaguagccauauguauguuuugagaauaauacauuuuuauuuacacauaaccuugaaccuguagacaaaucuaauaauuaggguaggagauuacuuuuuguuuguaauagaacagguuauugucucauuucuguucuucaaacucaaaauuaaugcaauuuauauuuuuauauuagaaaagugaaaauaucugauguguuaucuuuaagaucaaaauuaguagucaaagccauccugggaugucguuugcuucauuuucugauaguuucugccagccuucaauauguagaaaguucuacacuuaagauggcaacagaugcauuugcauuuuuuuuaauuaaaaaaaaacugguucaaacuguguaaacccaguccugacucaggacauaucuuaaauaggcuuacauuuucuagggugcuuuuggauccuuagcaagacugaacagcaacuguagaguuccccuauccucccugccuccacgauggauaggggcccugcugucugcucguagcuucacuacacucaaauccugugaucugcugguucuucccgccuuagcucacccugaucuuucagugucuuccacuguuuuccagaguagcauagagugagaauuguagagaauguagcuuucucagauuuccuucuuuauaauaagccaugucuuuucaugacuggacuuaaugaucucauuucuuuuuaauuaugaauaauauucuuuauugucugauuguuccuaagugaagaauguuucaguugcuuccaaauugugaaacaaaaugugaguaaaguugcuuuagacagaagcagguguccauggugccuugugcaugagacacugaggucagaggcucugacauuugagaccaaccuuggcuaaacugaguuaaugcuacacagcaaggaaggcccuaugugcagguagggcaaggagcacaugagcuaagugaaaccugaaguaauggugacagcacuucuugcuuuguuccuuaacuugggaaacuuuccaaaucucuaauuuuuauucgugaugucaugugaguugcuauuuuccagugguauucuaguucaaguggagaacgucccgcuuuauucuucauugaauuuuaccauaaauggacauugcauuuguuaaaugcuuuucuuacaucuguugauacugucaugugguuuucauucaguaggcuguugauuuuauguguugagccagcccugcacauugaggugaagccugcuuuuccugcuccuuaauucuuaauacauuguugcauucaacuuccuggaauguugagaauuuucauaacucuuuucaagagagacaauugcuucuuguaguguuuucaguuuguauauuaagauaauuuggggaacagggcuuguagucagagauugagugcuugccuagcaugcuugagggcccugggauccauuccuggaugugcagugaaauagauaauaaaagaagguaacuuuagacuaaaauaagguaaauagguuucucucuccuuguuuucuuggcagauauuuccuaaauguuugguagaguuuaccaguggacucaucuggaucugcuggacgauagcuguugucuuagugagggguccacuucugugaagacacacuaugaccaaggcaacaguuucagagguucaguccauuaccauuauaucaggaaguuuggcagugugcagacaggcauggugcugaagagggaacggaaguucuacaucuucauccaaaggcagcagaaggacagacucuucugcaggcagacaggaagagggucucuuaaagccuucccacacagugacacacuuccuccaaaaaggccacacuuuuuuuuaaaagauuuauucauuuauuauauguaagugcacuguagcugucuuuagacccuccagaagagggcaucagaucuuauuauggaugguugugagccaccaugugguugcugggauuugaacucaggaccuuuagaagaguggucagugcucuuaaccacugugccaucucuccagcccccuggccacaccguuuuuaacaagaccacugccacggcacuccagucgagucagccugucaggcagggaugccuaaaagcugcucaugaggcaaaaagaguuucaaggaagcucuccuccuggagucuggaguucucuuaauucuccauucccgcauuagucuaguggauggauccacuugcucucuuuaucauaagugccuuuuaagauugaauucugacauagcuaaagccuuccgacaguguuccaacaguccuagaacguccuugagcuagacagugacauucagaauagccucugguauuacacuaucaauaaaagccaagucgcucccauauacaggaauuuacaaugguuuaggaaguagaucgggcugugguuuuagaguauugcauuauucaugagaugguuagcuagaauggaacucccuaguuagaaccgagacuugggugugaaagcccuugcccuaagagaguaaagaccucacaccuggcuucuaagacuauagcugaguuacacccauacacacacacacacacacacacacacacacacacguauuuacaauggccuaaggagaagguggauuauacaaaagacuaaaauaggaacuauggccugggcacgaagcccuugacccuggcauccaagauuuagugaaucuuggguggagcccucguugaucccaguuguuaacaaugaauucuaucccagguaguuccuguuagaccuucuguguuuguauuccucuguuuuauguaagaauccaguaaccucuuuguaccuugcuggugugucacccaacuuccuuauugucuucugcauaaaaagucuuaugcucgauuugaaauacacauucagauuccacaggaccucuccugugugcgucugucugucaaauucauccuacgcuuuguccacucgagacuagagacccguuccaugcagacaaaggggcccagagggucugcggcagaccacaccucccaauagugccacuucucaugggccaagcauauucaaaccaccaccaaacaguauuauuuacuguuguguugcuauguccagacuacacaggaggaugggcuaauuuggcucaugguuuuauagcauucauaccaugguugucuggccccaugugcuugggcacaguuggcauugggguuugugacaaagguuagaggucuuuacuucuuuguggaugggaagugggaggaagaguaaugccagcacucaucuggcuuuuuccuuccacuucuuucauccuguuaaggucucaaguccauaggaugucgcugcccaaauucauggucguucuuccccauggccaauccucccuggaagcuccacaagugugcuuuaccagucugaggugacuccaagucagucaggucgacauggaaaauuggccauuguacucuuaauuacugaacaaauuuccuuaauagccacaagcauuuagauuauuuauuugacuuauaaacuuuuauaaaccuuuuuagaguacggaacauggauauuaauuuccaaugauuugacuuuggaauuuuuuuauaauacuuugauuauauguaaacaauacuucagaauaugaauuuugaucuuuucuuggguuggugaugugagguauuacacucgugugauacuggauaguggcaguaagcuguagcuuuuuguuauagauaaggguaaauagugauauucuacacuguguugcuacaccgugcuuguaguuagaugcaguaaggaaaaucucagcuuacgauaguuuauuaggguuuuacuucaucacaagcugagcaaggcugggauguaguucaguugguauaaugucugucucacauacauauguuuaacucccacugcacaaacugggcauguggugaaaggcuggaaucccaggacuugggaaguagaggcaagaucaucagaaauucagggucauccuugacugcauagcaaguucaagacaagccugggacauuugagacccuuucucacacacauacaaaaaguugagcaguaucuguacucuuugggaaaaagugaugagcugggcaguuguggggcacaccuuuaaucucagcacuugggaggcagaggccugguuuacaaagagaguuccaggacagccagugcuacacagagaaacccugccucaagaaacaaaacaaggaugaaauaugaggagaaaagaaaguagaaauguauaagaaaauuucaccuaagaaauguuuucuuuuauacuuuuuaguuugaguaaagaacucuuguuuucugucagucaauuagauuuuuuuuuuugucaagacaugcuauaucuaaugggcauguauaauaauagacuugugguuaaaauaaaaaaauguauaaauggccugacuagucacuucacguuuucagauaaacuccaguccucugucugagauggcacacuuguagucaccucauuaucuccuauaaacaccguugcccacuucugugcucaccacaguuaauuucuaccauuacaguaccauuaacauuggccacccauugauuaccagucagauccauuuccuagcacacuacugagucuccuuaugagcuugucaucgaagagccauuauuuaggugaccuuauaacgucaugaguuccauccagguucucguuuguguccgaggucuuccucucaugccagcucagcccugccuuggcgugugaucucacguggcuuugcuggauguucuccuuuucaucucaggcacguguguaguuaggugugcuugcuuuauaacucaguccccuuccuucccuucuuucuucuuugcagcuuaccaagccaugauacauauuacaucauaaaauauaguucagugcuugcaaaaaacccagcagagcaggaucaaucuguuagaagccuucaguaggaagcuuuagauguaguaaauuugugguuguauggacagucuuacaauuuggcuauagaacacgucgucaucauagaaacaccauuuagaggcugucucuguccccaccccuguguacuuucugcuuuuauacauugauuuuuuuguaacuguucauagaaaugagaucauagcauauauagugcuuuugugcauacaugauaccuuucccuaagcaaaaugguguuucaucauguccauugguacacccuuccuuuuuuuuuuuuuuacauaugucuuuaaaagauaaguuauuuuuauuuuguucacugguguuuugccugcaugcaugugagggguggggggguccagaucuccuggaacaggaguuacagacgguucugagccgccaugugggugcugggaauugaacccagcuccucuagaagagcagccagugcucuuaacugcagagccaccucuccagccccuauguauggcuuucaaacaucuguuuacuaguaguugaugaguuuguuggccauuugaguuuuacuucuugucaccacgagcacuuacacuuggaacauuugcaucugagccuuuucaugguucaguuuucccuguuuuucugugaagaacccuaagaaugaaauugcugaguuauacguaaaguuugugcaaacuucugugaaguucucagcuuucccaacugccugcggucuagccaguguguaaagguucugguuguccccaccuucccuuucuaauucuuucuuuuccuuuugcaugugcaggugugcaagugcuuuacuccagagccaucucucuguccugcacacuugcuggucuuugguuuucaguauauccuaagcuccuccagacagauacgaccacuccuuuccuaguguguucuuaggcuuggagguguucccguugaagcauuuuuaguuggguagcuugcaguugauuuugcuguguuaacuuuuuuuuuaaaguauugcuuuaaaugcuucaaaaauacguuguguacaagcuuaucaguauuguaugcuauuauaucuuuaugucacuuaacuaagaucaaguuuuaaaaaaaugguuaucgucuuuagccucacgguaagcauucacuuauuuaguuauuguaauaugauguauguguuucuaaaagugacuguuauacaaugcugcagucuucacgagagaaagaugauugugggaacaaggauagacuugcaggaaauguuugcuagcgucguacagaugaagagauuuggaagcacaggcaccguacagcaaauguggcgcuuuugucuugaaaaggugugaagguugcaggacucauuagaguugcaguuugugaggugcugggacguuguggucagauggaaagucgugggccagacuaggguggagugauguauauauagcacagauaaugacaaacagugagucguagccauccgaggcguacguucugugcucuguuauauuguacugcuuauauaguccagugccacuuaaauagcuggguucauuuggcuugcagcuuucugcauugacuugucagguuuuugcauaugacaucuacaaauacaaaauugacauucauauuagacuuaaauuaaccuaagauuuaucagaauauaguugaauaagcucauguuuuccaaguaaauguuacagagucuccugcacagcaagugcacauuggugacagggaucaacucacuuaucaaguuacaugucauugcccccuccuuuccuucacaagagucacauuuuguuucucagaaguuaaguguucaccgauauucucuugguaggaaacuacauccugaauuauguggcgucccaaccuaagcuggcgcccuuugucauccaagcucugauucaagucaucgcuaaacucaccaaguuggggugguuugaggugcagaaggaugaguuuguuuuccgagaaaucauugcugaugugaagaaguuccuccagguaagaaggcgcguuaacgccaucuuagagcaguagggcuuucgcuuagcgcuccuuggcucucuguggaaacauucuuacuuaucauucauuauuuguccuuuggcuccuuuguuauuugucaguuaagaaaaauacuauaccagaagagugaaaauaaccauuguuucuaaauuuaaaaugugcuuuuauuuaugacauauauguguacaugcaauauuuaugaugauuuucauaauuacucaauuuucaaaacagccauaggaagugaguuucauuguagaaaugaagagucugugguuuauguugagcagcacgcacagguuccggugacuuagugacgcagacugcgaagccagcaaggcuuuugacagcuuuuuaucccacaccaugucaauguucucaagugaaucaugagagcauagcauaugauauaaauauaauuaacacaugauacaaucauaacacuucauuccuaauuuacaccaguuuaguuagauauuuagacuugaaaaaagaaagaacagagcuugcagagauuguuggaauucuagcuuugagacaguggagggacuaagaaguugucccuguuccuguuugccuuuugcuuccuuuguaaauaauuuagguauuuagugauaaauauuuuuauaucugugucauuucuaauugcaaggugguuaacuuuaaauuuaagauuucuugggcuggagagacgguuuagugguaaaagugccugcugugccaagucugaugaucguucugaguccucagaacccauguaaaagcuagacacaguagcacaagccccugccauuccaggacuuuaaaaugaaaagaaagaaaaaagaaaggaaggaaggaaggaaagucuucagacugucaguugguuagagagccacgccaugcaacuuuuugagcgaaugcacacagaguaaccaugauugagugcaugggaauuagaaggaccauaaggaguuaaaaugcauugucugugcucccagaguugaucguuggugguccugagguaacaugaacuuaauuauaccuaguaaucauguugcuuaguuucugugcaaguuagcaggggugacaacugugagaugagauguacagagcacaucugggcacacuuuuguacuacugcauuguaauuugaugcugcauuucuuaaucccaugcuuucuaguaugauuuuguaauaggguaauuuguuaguaaugugcacaugagauaugaauugaaggagguuuuacaauuaaauuguaagcuaauuagaaacaucauggaaacuaugccauauugacagucauauguuuaccuuacuacauugaguacucugaaugucuucauuaaggcaccuaacgacuccauacacgugcacuguucagugauauuaaaagagccuaagugaucuuuucugauauuagaucaagagauuuaaauuaguuucuaagcuacuuauuaauuauugaaugcagcuaucacaguaggccgcaagcaaauuucuagaacaaaaaccauuuuuccccauucuuaagauuguagaaaaaguacuaaauuaaauguuauuuugaagcuuaguuuauuauggguuguaaaugcugggaaacauuguauagagugaugugcauuucuaagguagguauacauuuucuccuuaacuacauguaccaaaauuuauccuucaaaaaugaguucaaaauucuuuuaguuacagaaauaacaauacuuucccccacacacuuuuacagaccauuacuaggcaacugugaugccuugacauuucauuuuuaaaaguaucgccugguugacgcuuaagaacuaaucaugucuucacuugguuauuuucccaaagggcacgguggaacacugcauaauaggagugauaauccuuugugaauugacacaggaaaugaacuugguaaguuuuuccuuguaauaggacauggaauuuucuuagguaaguuuguuucuuuguggcaaaauguauaguuguugugguaggaaacugguaaguguuggucaagucuuuaaguguucguuuuacuaguuggagaauuauuucaugaaaaaucacaaccauaggaaaaaccccacagugcuuguuccuuggauacuuagagaaugggcuuuucacuccuguagauaauauacuaaccauaaaaaugaaugauauagauaggaaggaacacaaacuuuuacguguuuauaaguaaagggcaaacaguuuagaaauugauuguuaaccuugggugaauggcaagaccccuccaggaacagaugguuuagcucugucacugucuagcuugccuuguucacccugcacaaggagcauuuccagaaacuacaccucccccaacagggcuucuugaucucagcagcugaggacauguccccugucaaguccccuuuugugucagcauggguuucaguaggagaaaaguagaaguaguguucuacauggaguaauuuguaaaggggcguuugggcugagaggcuggcguccuccugacugcuuugugagugugugcauaagcagagcuacugcccaacucccuuuguagucacaguguagccacaauauuguagaauugaaaaaaaaaugauuucuguucagugaugaauuaagacaaauuuuauagaauuuccacauuuuaaaaccaccuuaguuuccgugcccaucaguuuugcuucucacaguucuguggcgauugucugcuauggcagguccucucuccaugucagcaauagccaacuuguggguaggaagaugaugagcggaccuugccuuaucugugaaugaguuugaagaacugauguucucuuuuacaaguuaaaaauaguuuuacuucauaaaagugagagacuaguguaggaaccacaggcauccagccuucauacuugcuaacugugaaacugguucauugguuguaaagugggaaacuuuacaaacaauggcaguauaggcuacccugaaagugaggacuuuaugacuccucaguuccucaguacuuccucacuuaguucuuuauuauaucuuggagagcaaccaaauaucuuuuaaaaaauacaaaggaacuuucaguaacguuuggagggcagaacauagaugucucuugaucacuugauaagcugacaucaugaugcauucucauggccccagagaauacuuuuacauuuucuucuacaaggacauucuuucuccuacaugaucacgauacuaccauuauauuuuuaaaaagugacauuuugcuauuuaguccuguuuccccauucagccccaguguguccuuaggguugaugccugcuucaaggugcuugcuuuucacacuguguuaguccucuucagucugggaggauuagucaggcggauccccuuugcuuuacagcccgucuuagucaggguuacuauugcuaugaugaaaaaccacggucaaaagcaacauggggaagaaaggguuuauuuauucaguuccauguaaagguucaucaucaaaugcagugagggcaagaacccaagcagggaggauccuggaggcaagggcuaaugcagaggccauugaggggugcucuggcuugcucucuauggcuugcucagccugcauuuuuauacaguuuaggaccacaggcccauggauggcaccacccacaauggacuaugccuccucauaucaaucaugaguuagaaaaugccauacagccagaucuuauggaggcauuucucaaugaagguucucuucuuuuagauaacucuaguuugugucaaguugacauaaaacuauccaucauacaaccugauacauaaagcuuacaagcuaguuguuuuuuaaaauaucuuuugcuuugagauuauucaacguuuccucauuauuaaauccagauuauauauauuuuuuaaucaggaauaucagcaaugaugcuauggcuuucuuagcaucuccugccaggaagcguaugguucgaguugucuaauaauggucaaugcucacuuucauuuuauuguuuuuguuuuuguuugagacaggguuucucuguguagcccuggcuguccuggaacucacucuguagaccaggcuggccuugaacucagaaaucugccugccucugccucacaagugcugggauuaaaggcaugcaccaccacugcccagccuacuauguuuaauauuuuauaaguaaauguagcauuuaagaauagucugaauuguaugcuagacuuuagaaaguaucagauaaucaguucuuagcucacuacaucuaucuaucuaucuaucuaucuaucuaucuaucuaucuaucuaucuuuaauucuuaaaacagcggaaaaaugguuuccuacugucuuucaaauagcaaaagagauaaauaauaaaucuacaauaacuuuaggccacagugguaauuacuacuaggacuggacuuauuuccuauugauaauggaaauauauagcauauauguaauauauauguauuaaauauguauuauaauauauauuugucagagaaaggagccagugcuggugauaaaaccuaucauuucauggguauuaagcgaguguucuuggcucuaauaccacucuguaaauaauuuuuacauuuuaggcuagggacugaaauucucuuagaaaguuaauuucuggcuagguggcgguggcagaugccuuuaaucucagcauucagguagagguaggcagaucucugugauuuccaggccagccugaucuacacagcuaguuccaugacagccauagcuacguagugagaucacccuggcuuggagaaaaacaaaaacaaaaacaaaaacaaaaacaaaaacauuuguguuagcuaauaaaauauucugagaugacacacugugugccuaaucaaacucuuuuuuuuuuuuuuuuuuuuuuuuuugguuuuuugaggcaggguuucucuguauagccauggcauuccuggaacucacuuuguagaccaggcuggccucgaacucagaaauccaccugccucugccucccgagugcugggauuaaaggcgugggccaccacgauuggcucuaaucaaacucuugaguauguuuuuacuuuuguuuucaaaauuuuaguaauauaaacccugugacauuuaaauacuuucauauaaaauuuaacugauucacacguuagaauuugaagaguauuuuaauagagguggcauuguagguguucuguaggggacauuugagaguuagggaaguuauuuacguuauauacaguaccgggcagaguucaugaacccaccaucucaguguuuguggugcuauuaucugggucuuacauuggcacugaaacauugauggucuuuggguggguucuaacccugucuccgcccugaggaucgccaucaagucucccucgcagucuuugacaagcucugucuucaugcucuugugguuacgagugccauuauguucauaguacauuugccuuaccuuuccauggccuuggguaaaccuaacucgucuugaccuuuuuagguugauuauuccagaccuucagcaaaacauaggaaaauagcuaccucauuccgugacacuucucuaaaagacauucugguguuagcguguucucuccugaaacagguaaguuggcugguaacuuggcuuccuagaguagcuugggaaccuacuacuuugaaugaauuucgagugcauaguuuuccucugauuuuuuccuuuaagagacuuguguggucagucuuaaauaugguaaaucuguacaaauuuuacuuccugaguauggaagaugacgccguagagaauucaguguuuguguuuaggcaauaguaguuucuaccuucuuauaauguugauuuuuacuuggacagacuaauuugaguuuuaauuuucuuuucugcuugcccauauagaaaacuacaguuuuccauuuuuugucauuauuuucccaaaauucuuuuaacaguuucuuuggggaauaugaauuuccgacuuguuuuuagugcaccguggagcauaccugaccucccuaacuguaaggcucucucugcugcacugagaaggguugguuccaucacacugcccaugcuguuuaugugguagugugaagugcuuuccagagcaucgcauuaagagcuucgccucaugucucuucaguucucuguuacaggcuaaggguccuuuauaaacgcuuggggccagaaggguuuuagacuuuagaguguuuuaaauuuuagaauauuuguguaaauuuuaccaggugaaaaauuucaaaaucugaaaugugaaauccacccaaauccagaccgugagugcugaggacauuuuacacugcagggugguccagguuuacguuguuuagauuaacauuuuaagcuuguaaguuaacguugagaaucacugucguagggcuaguuaaacgacuauuuuaagaauauucuuguaguguggaaaaauaccauuuucgaagguagauaacauagcguugauguucuugaccuccucaucugacugaacgguacugccugugguuaguugcuuacauauaucccucccuaccuaccuaccuaccuccccuuucuuuguauuacucucggagaggucuaggccucucuagaaauaauucuuaauguccaagagguacuuugcggcucugugggaagcggccuuauggaaagccuggcacaucugugcugcagaagcuguggccugaccaacacuggcggccucacuaggugaaugcauguccguuacacaagaugcuagcucagauuuucuugaagaaaaugaagccucagcuuuugcugcucuuguuguuguuuuauuuguuuguuugguuuugcuuuuaaaacaggguuucucuguguagcccuggcugacuuguaacuuagcucuguagaccucaaacucaagagaccugcugccucugcuccugagugcuuggauuagaggugugcgccgcuacauuuggccucuaucagcuuuagaaggcaaucugcaguauguaauacauuuuuauucucauuuuacaagagaaauuuaaaaguaagucuauuauagaaauguguggacaaugauuuuauuuuacuaauuuuuauuucacauuaaagaaauauuuaaauguaugaagcuacaauucuuuuagugauaauguuucauuguaauguuuauuuuuaaauuugaagguguuggccaaaccuuuaaaucuucaggaucaagaucaacagagucugguaaugcaggucuuaaagcugguccucagcugccugaacuuugacuuccugggcaguucagcagacgaaucugcggacgaucuuugcacagugcagauuccaacaaccuggagaacaaguaagaagagagaaggaaggguuaacauggucaguguacaaggugcagaauuaacccagcgugugcuggagugcugcuuuauucugaguggucuaauucagaacagcuacuaauacucaguaguaaaaugcuuuguccaguucauaucauacuaacaauuauauuuugauuucaggaaaaagacaagcacuagagcugcccacauagcuaguggagaggcucuggcagaguuucaaggugaacgaaucagagucugggccugagcagagcagaguuuggguuuacugugugacaggagggacacccagaagaaagcaagaggaacuaggcuuccucaggguagaugugggguaaggacuggagagugagcauuaaggggacuuuauucuaguuuggaucuucaccugugcaacugggagacaaacugacagccguuggcucugugcuuggacaucucccuccuauagcuguguuucuugcagaauuaaacuagaaaagcaucagauuuggggauaucagauagaggguuaacauaaagguuuguuuguuuauuuauuuauuuauuaaaggacuuccaauuuaggaauaaaagauuaauaaacaagggauuuagcguucuacaucuugaugggugauaaugucauaaaccaacauguaauaauaaaaaccauaggauaaaaauauguauguaccucugagugcauaugaaacuugacucuauggcuggaggauugugcugggcucgccggcuguggugguagaguguuguuuuuuauaagagaucaccagugugguaaucagcucuuggaacuguaugugaaucucuaauuuauuaaucuuagaaaguuuaaguuggauguacaaagcaaagacuagaaauaaacuuuauuuuauuuuauuuuauuuuuuuuuuugguuuuucgagacaggguuucucuguauagcccuggcuguccuggagcucacucuguagaccaggcuggccucgaacucagaaauccgccugccucugccuccccagugcugggauuaaaggcgugcgccaccacgccuggcuagaaauaaacuuuaaaaggauguguuuaguaucccuagagagagaaacaagguaaagcacuccugagacaagaauagaacauuugccacauaauuuaacaauucaguaaauaacuuggaagagaaaguuaaugaaauuuacaaaauagaauuuaaaaagcaagauauagacggaagagcacaugugagggaauuagaaggugaagccauaugguugggauuugauuacuggaaguucuagaaagagagaguaggggaaaauggaagggagauggaaacccaacaguguucucaucagcgaaggauggaauaugaauagaaguugcaccgguacccaguuuuaugggugaaaaaagaugcgcacuagcucugaguuuaugaggucccaggaaaagcggcuugaugugcucgaggaagaaaaaaucccuuucuguggguuugacucuagaguggcacuaggccucucuguaacagcagggacucagaguggguuagcagccucaggccgcugcaggauuucaaacucaauggaaaugauuaaaagcaagacacuuuuucagaccugcaaguccuuccaaaucccuccuuugagugcuagcuuucugcaaacuguuuaacauacaaggcaagagacuagaaguggguugguaaaaggaacccuucaaacaagaugaugguaaacaugugaaaaggagacaagaugugacaaagggccaccaguugagguugaucaauaggugacagguauagcaaauggaaaugauguuuagugauauugguuguauggaaauguuaacaaggguuuuuuuuuuuuuuuuuuuuuuuuggugaauuugacaaaacauuggcaaaaauuaguggcagauagauauauacaacuaagccaagccacugugcuucccuuaaguacagagaucauuguaaguguaagauaaugauaauauucuucagcucauuuguuauuuuuugcaugguuauaaauguaaguaaacacuuuagaauugauuguaucacacguugugauuguagugggaagagaaaggauggauauuucagagaugggauugguaaguuagagaacuaaaaucuaacacaguuaagguaaggugggaucaagugaaacuguaugaugaccauuuuuguuaaagguuuguugauuuuauauauaugagcacaccagaagagggcagcagaucucauuacagaugguugugagccaccaugugauugcuggcaauugaacuccuaaccucugagccaucuccccagcuccauggugaccauuuuuuaaauguaaauauaugaaugggacaggacacagcugcuguuuuauaagcuuccuaguacuccuuaccccauauuuauuauuuuaggguaaauacaaacuaacauucuacuuagaaguguagauacuguacagaacuaagacccaucuuacuagcaaguuuuuacgucuguacuguuucauuuaucaaaagaaaaaagcccuuaagaaucagaauaguucagcuguaagcaggcuguggugguggauaucuuuaaucccagugcucaggaagcagaggcaagaucucuuaauucuaagccagccugguucauaaagcaaguuccagggguacauagagacacuuggucucaaagccaguauuaaauaaauaaauaaauaaauaaauaauagucuagcugcaguggguagccauauguaaaggucuugacauucuuauguguuugauaaucuuuuagugaaauuaaugguguuagaaaaaucaucuuuuuuuccaguuuuccuagagccagaaacauuggaucuuuucuucaauuuguaucacucgcucccaccacugcugucucaguuaguaaguauaagucauuuguuaguccuuaaagauacaagacccucaguaguugguuguugcucuuuugcacuccuggggaauugcaccuauggccccguaccuuugauguuagugugguaacugagcugcaugucugucuagcuucugguuuugcuuuuggauagggucuaugguauaccccaugcugccuuugaacuugucuuccauccucauccuccucggugccgggcucagccuuguccaugugguucuuuucuaaucugaaguaaggauaauauacacuucaaaauucuuaugcauuuaauugaguuauauuucucuaguaauucucucacuucugaauguauuuuguuaaauuuacacauuuguuaacagaaucuauuaacaggauuuauuaacagucaacuccacuuuguaauuaagcucagaaucaguaacugaucuuggcuccugccaaagccaggacagucucccaaccucuaccaauaucucccuaaccaguacucaccuugcucaaguccagcgcgccacuaggacugucuuuguaaccaucucucuucuuugccugcuuagacacuugucuuagguuugacuggcagucuccaucagaauuuucugagacagacaaagguggccacucacuugauuggugcucauuacucuugaugcuaaacuuuuaaaaaauuucauuguuacacagaacuuugagaauaugagcaauguuggaaaaaauguuguuuaguauuuaagcaaccagaaauuggagaauugugucucuggaaaaguguucuuagauuuaaagugcauuuguuuaaaugucacuuaaaaggaagacuuguauucccaagugcuuuccuguugagcugcguuccuaaccaaacaagcucucaaaucuagaguugaaagcguuaaucugagugucacaggguaccuaucugagguugugccuuaccuuuuugucuuucaacuaggaaauugcuuuuaguuguuuaagaagcaugaagucauaugauuauacuuuaguauaaagcaaaaauauacucaugauuuaaaaagugcagaagagaacucugcuuugagacgacuagcccaaggcccuguuaagggaugcuuaucuugcuuccugcucaccauggccuugcaagguuaauaacacuguccucaggaggcugaccugaacagaaaccaugcccaagugucuaauugacuuuccccagggcaccagaguaggcauugagauggaaucucaggccucuuuauccccuaaaccaugcacuggugccuugcuuugacuaaacugaugauuccuaguccugugcaguagcuguuuaaggaggauaguuuuuguuuuuuuuuaaacaguaaagaaagucagaaacuggaguauggucuaaacaggaagauucucauguuuguucucacucuuacccuuaccaccagcuuugcauucagauguucauggaagugucacuacccacugagccaucuccccagccccugaggugccuuccuuuguaaaggaaugcagaucaaaaauuaaaacaaacaugucaagguuuuuuguuuuguuuuuuucuucgagacagguggcuguccuggcacucacuuuguagaucaggcuggccucgaacucagaaaucugccugucucugccucccgagugcugggauuaaaggcgugcgccuccaugcccggcacaugucaagauuuugaaagccagauagaaaaaugcagucuccaagcagaggagggugaggggagaauaucuacaagugcuguuuuaguguggggcagaggcuuguagauggugauaguggacauagccacuuuuaaaauuaaaauaacaaauuguguuguuuuucaggcacuuucgugcuuaguucaguuugcuucuacaagaagauccuuauuuagcaguccugagcgcgccaaguaccuugguaacuuaauuaaaggggugaaaaggauacuugaaaacccccagguauuuaugaaauaauuuaauauuuagcauauagaaauuauauuucugcucacugguacagaauacauuuuuaaauauauuauguuuugggaaaaauauuuaguauuauauucaccuuccugaggucucauuuguuauaaucauuuuuuuaaaugagagaauuucaauguagcuucaguguuccuuccaguguuuuauuuguguuuguuuuaggugacugugauagaagucacguguugugcuccgcgucugucuuuaucguuguacuuuauguccuugcuugugcuccuuaggcugcugaggugacugaggagugacugcuuuuuguaguaggcgacaauuuaaacuuaauuguuaauauugaaauacauugcuuuaaauuuugaaauacugucuuuugcccucuuguggacaccggguuuguagcuuuagaaauaaacugcgauagcuccagcgcuuuggugucagcacacacgugcagagacauucaugagagguguagaauguguaacaagaauuggaucacuuucaguucguuuuuuuauggaugaaaacauuuguaguuaagccauggacuguaaacacauaaaugguagcuugaagagcugucucuaugcuucgcaguuacuggcaauuuugggccaucaguuauccuuguauagagaugaaggcauuugguuuuuuggguuuuguuauuguuguuugcuuguuuguuucccuggcuauugaagagauuuuuuuuucauuuuauuuuuuuacaauauuuuuuauuuacuccaacaauuucauauguguguaauguauuaugugcagcccacauagauaccuuacugcccacacccucuacaccccaguaguucuuagguggggugccuuaccuugcacaccucuguacaucucugaacacaucucuuaguucagggcucgcauuuacucauuuugcuuguagauagggcuuuaucuuaaaauugugcagcucacgaucaugagccguauugugggagcuacuuggccacuggaaaagucaaucugguauuuuagaaucauaauugugcaugaaaagacuuguucuaagauguauuuuuggaaauuucccuagauaauauguacuuuuccccccuagagcccccauuauuaaaauucuuuagauucuuuaaguauuaguauucaacaaauucauuuuaaaauguggucauaugccagcuauucugcaaaguguuuaaauauagagguaacaugaguuugguauucuagccacucuagaaaggucuuuuguggucuguuuuuuuaaaguuuucuccaaaaagucaccugucaccuacaugcaguauuuaucugaacgacuugucguuuagagacaggauguuaacuugggaugacagaacacagguaguuacauucaaauaauuuucugugauuugugcuugugcacuuguauaauguguacacacacacacaccccccacauaagcuuuuuguguaaaaguucccaaacacaucuugucaucuuggugugaugcugcuucuaaaagcucugcuuuagauuccucacuguauuuaacaguggcacuaagcuuaucaggcugcacuuguuucccgguccccagcacuguaaucgcaucuacccaucugccacagucagugugcaugagagccagggcucagaacagaaauaaauacuuggauuuuuaucaguuucuuugaagagccuuucuuuuguauuuuaauuuaggguuugucugauccuggcaauuaucaugaauucugucgauuuuuggcucguuuaaagacaaacuaucagcugggagaguuaguuuuggugaaggaguaugcggaagugauuggauuaauugccaauuuuacuauuacuagccuucagguaaguacaaauguauaaucgagguuaagccauaauuuuaaaucaauuucuugguauagguuugguggagguggguuuuuuuuuucuguuuuuuuuuuuuuuuaauacuuuuuugaguacuuagggaauuacuauucuuuacaaaguuuuuagguaaaauagucauugcaacacauaaaauaauaaaaauugauauucuguuuaaauuucuaguaaugaaagagugguggguaucgaagucuauguaaagaaauaaacaaaugcuuuuauagauuauauuaugggaaaauuccuuuggaaguugacaggaaacccuguucccauuugauuauacucuugcagaauacuuguauaauagauuuuaaggaaauucggaaacauuuuaauagucacucaaguaugucgcauagugagagauguuaguuuuuaaguacuuacuagauuuguaaaauuugcuauuugcagagagcuuuguuaucaguaaaaguuaauuuuaucagggcuggagauguggcuugguugguagccugcuugccugacagccacagagauccagguucugugcuagcagcaggucuuggguauggcaguaacugucuguaauagcagcacucagaauguggaggcaggagaaucaaaagcuaaaggucugucuuagaacauaaugaauucaaggcuagccuaggcuacaagaacaacaaccccaguuaguuuuaucuguagguacuuugcuauaugauuucuuguuuagaaugcuauaaugccauaaugccauuuuaaauaacauuugcuguguuucuuuguagcauugggaguuugcccccaacaguguucauuacuuauuaacucuguggcagaggaugguagcauccguuccuuuugugaagucagcugaaccccacuuguuagacacuuaugcaccugaaaucacaaaggccuuuaucacgucccguuuggaaucuguugccauuguugugagguauugaaauauuaaauguuuuauuuuuaucugucucaucuuguaauuuuuaaagauuuuaguaaaauguuaagguucacuguugcugguguacaguuuguaaguucugacaauuguguccaguuguguagcuaccaccgcacuggugauacugagugucaugaguauaauccccaaaccuagagacacuuggucccuuuuuaguuagcacacagcucuggcaaugacucaucuuuuuauuuuccuacaauuuuugccaauucuagguuauuguacagaugaagucuagugccuuucauuuggcaucauaugccuuuggaauccuuccauguugucuccgggguuccuuccuuuuuauugcagaguaggauccugucugugacuguauccgugcacccacguacuguugaugacauuuaggcuguucacuuuguuagcaaugugaauaaacuguugacaucauuguugugcacaauuuuauaugaacauaaguuuccauuucucugugcaaacuaccuuuauauggguuuccuggugguacgguaaguauguauuuucuuuauaaaaagcugccaagcuauuuuuuaaaaugucuguaacaucugcucuuacauaugaacaccuaaguuugaucugcucuggacuugauugcuggcuguugauggucuuuuuaauuuuauaguaagucuaguauguguguagugguaucucauugugcuuuuaauuuguauuccaucaaugagucaugauacuuguaacagugagcauuguuucauaugcuuaucugcugucugcauugauucuuugccaggugucugucagaucuuuuuuugccauaagguuaaguggcuucuuuuucagaggacucaggcuccauuccuagcagccacaugguggcucacagcuggcgggcuguaacuccaggaaagcugaagcucucucggcuuccaugggcacagacagacacaggcaaaguucucauacacauaaaauaaaaugaaaguaauuuuuaaaaaucuguugccaaccccuuuuaaaaaguggguuauuucuuuagauuaagauuuuagaaguuuauauauucuguucacaagucuuagagacuuauauuuucuuuuaaguuauauuugaugaacucccgcuuauuguuuuuguucuguggguguuugcugcuauguaugaggaauuuuuaccucauucaagucagagcuuuuuuuuauucauuauaguuuuaagauuuacacuuaggcgugugaucuacuugaaguuaauuuuuguuuuguguguggauacacccauuuguaugcccaacucuuguucugcugagucaggaaagucacaagcucuggaagucacaagcucuggaagucacaaguacauggaaggccagcuuagguuauucaggaggagugugucucagaaaggaaaaaugaacaaccaaaaccccaaguguuauaauucuguuacauguguaguaugcauauauuuaucuuuuuguuucauguuaaguccagguucuucuuguccccauguccuuugcuuuggaacaucaguuaguuacacagcccccuuuguggauauagacuauccuuucuaguugaauuccauucauauuguuaaaaauuaacccaccccauauaugugguuccauuuugaaacucuguucuuacuaguccaccugugcccugucuuaguuacuagacauaagauaaauguagaaauuugauggugugagucuuccaauuugguuucucuauucagaauuggcaauugugcuucauuuuuuuuuuucuccauguaaaacuuagcauuaguuuuucaggcucuuauuuuauuuaaaaauauauuauuguaugggggagaguacaugcguagcaccugugugcaggucaaaggacauuucauggggugucucuguccuuuuauuuaugaaguucuagggaucaaggucagguccucgggccucgcaguuagcacugugccagcuaagcucucuggcccagucuuggaauuucuacaaggaaaugccugcuuuguuggaauugugcucagugucaucuguuaaucuggaagagggacugagauugcggcagggucgggucuuguggucagcggacauggcauaccugcccuucuguuugucuagcucucuagcguccuuuugucaguacuuuauaauugcagccuuuagaucuugagcauauuuaguuagauucagucaguaccuuuguauuaaacauuuauuuuuacauacuuacuuuugagaacagugucucaugggcuccuagguagccuuuaaauuuacuuguaacugaggcuaggcuuaaccuccugagccuuccguccucacuuccugagugcuugaguuaaggaggaacccucaccccacuuaccacgcuccuuaaaucaugcaacacugagccgggcgugguggcgcaugccuuuaaucccagcacucaggaggcagaggcagguggauuucugaguucgaggcuagccuggucuacaaagugaguuccaggacagccagggcuauagagaaacucugucuugaaaaacaacaacaacaaaaaaaucgugcaacacuguuauuuaauaguccucguucauuuucuuucuuugacauuauagagcagcagguuuguauuuugaacuaguuuguuaugacuucaguaaauucacuucuuaguucuaguagagcucucucucucucucucucucucucucuguuuguguguguguguuaauuucuaugugcacaaucaugucaacuuuauauaugggauuuuauuuuguuuuuauuuauuuuuugucuuuuugagacaggguuucuuuguguagcccuggcuguccuggaacucacucuguagaccagacuggccuugaacucagaaauccgccugucucugccucccaagugcuuaaaggcgugcaccaacacugccuggcugggauuuuauuuuuaaucuuccauauucauuugucauuuauuucuuguuucaucauagcauuuuuacauugcaaaguuucuggguugugauuaagaugucccacauuguaagugaaugucuuucauauuucagagauaauuuagaagacccucuggaugacacugcuaccguguuccagcagcuggagcagcuguguacaguuagcagaugugaauaugaaaagacguguacucuucuuguacagcuauuugaccaaaaugcacagaacuaucaaaagcuucugcaugcugcuccggggcuggcuguugacauggcgauucaagaaggucagucuguguuagacaguugugagcagcgugccauagggaaucauugucagaguccuucgguaagccaggugugguggugacaccuuuaaucccagcacucuggagcagaggcagguggaucucugaguuugaggccagucugucuugagguaaacuacuuuuauguuucucucauuguugucuaguccauuuuuaaaccacuaaucauauuaagccauuugauauuuuggugacuugacuauugaccuuuaauauuuuuaugggacacacaggcaacaacucaucauggacucaucaggaacaguuguuuaaugauccucaagcaggcagugugaugucauugucuuugaaguaauauuuucuccuuuuuuuaauaguagacugaacacuuggcuaaagucagccuguaaaagaagccuaaccagauuuuauuuguauuuauucauuagucuucaccauggcuuuuaaauuauuuauuuauuuauuuauauuuauuuauuuauuuauuauuauuauuauuauuuuuuuuuuugagacaagguuucucuguguagcccuggcuguccuggaacucacucuguagaccagccguggcuggccuugaacucagaaaaccuccugccucugccuccuaagugcugggaucaaaggugugugccagccuugccuggcccggcuuuuaaauuuugaucuuuauuauuucaucuuuaaucuuacugagggagggugcacuuuuacauuccuuuaaauaccuucagauaguuagcagggaauaauuauuuucagauuuuuaaaaugcaauauaaggaugaaaucauuuauagcuuuuauuauuuguuagguuaauauacaaaacaaugggcuucccuggcauagccacaggucuguguugcucugcucugcucucguucauucccaucccucuuccccacgguccucgcuccugugcgccuccucgcucccuucuucacucccgugugucacuccugcuucugugucucauaccuuccacuccuuuuccuccuuccuuaccguuuaugacccugugucauauguuuuaugccauguacaacacccacagauaaaauaugcccuauacucauauguuauacauacaauuuuaaaucuacagucuguguacaggacaaaacaagcaauguaugucuuuuggagucuuuuaaaaugauuucugguucugucccuuucuaccaaauguugugauuuaauuuuucaucauggcuggguaugugggcacucuuuucuuauguuugucgaugaucauguaggcugguggcauuuccaagccauggcaacaggcacagcacuagauagggaagcaccggugccucuguggccccugaggagagauccaggacugcugaauuccggccguagcccauuucuguacgggcugcacaggguuacauccgcaacagcugcaaaugccugcccuuucccguucauguuguccuuuguugucucauccuagucauugucaaacuggucaaggacuucuucucagagcaacuuuaccuuucucugauugcaaggaugcugcgcuuccucauguguuuccuggccauuugugcuuuuccuugugacaguuguguggcaacugcccauguucaucugcccauggcagaacugauuggcgagauaauaauuuuuuuuuuuuuuuuacuguuuguguagcucuuuuuguauucuagaaauaugaaugaccuuaagacauaucauaugaaaaugcaugaaauuaaaaggcuuaugcaggcaucuggaauagucagcagagugagggaaagucuacacaggaaaguauuugaaaaaaccccaccaguugaacaaagcaacuaauuaaguaaaguaauuagccugagguuaaacacuucguuaccaucccagggcucuuuuugcuacauaaguaccugacacccuagccauucauggucuucuuugcuuccauaugaucuuuaggauucuuuucuaguuguuugaauacuuacuaucucugaaauuuugguugggguuaccguguuucuguaagucacuuuagugaugaagcuguuuucauaaaacuagugguggcaacucaugagcauaggaaguccucauccgcagccccuggggucaccagcuucuccuucccguggucuguagagcauaaggaguccucauccgcuggugucgccggcuucuccuucucgugguuuguaaaguauuuacuguaguuguguuugcccuccucaguuaagguuguuauuggguuuuacuuauuuaaaguuauuaugaaugggauuuuuaaccuccugauuuuucccuuuagcaagugcaucauuuuguuaaaaaaaaaaaagcuucugaguauuggauguugguuuguguucugcaucuuguugaaaggcuuuaucaagucugaguaguccucaggcacuauuaaagauuuuaccaucuguaaauaagaauauuugacgacuuuucuauuuguauucuuuaagugucuucagguaacauuuuaaggacuauugaaaaggaguguggacuauauacccuugucuuguuccacauuugaggggaagagaucucgguuuccauguuuguuuaaauagucuuccaucuuugaauaauugggacugauuugcuguauaauaucuuuaauauguuuuaauuugguuuguaagaauuuuauugauaauuuuguuuuauuuauuaaggucuuugguuuuauugucuuuugaauccaucuggucuugcugguaggguaaugcuggcuuuauugugugacuuugauguuucuucucuucuauuuucuuguguguguguguguaguaugaguguguguaccuauguguguucgugcagguccacauugccugcaugucagauguugauauggagugucuuucucagucacucucccuuuaaagcuuuuuuguuuauuauucuuaugugugagugucuugcaugcauguaugucugugcaucacaugcagaaaacagaagaggacaucagauccccuguaaguaaagauacagauaguuuuuagccacuuuguaggaauuagaaaucaauuccagguacucuggaagcacagccagugcucuuuaagucccugcgcacucucuccauuucccccacuuuauuuauugagauagggccacucacucacauggggcuccauuacccaccuacucugccccucucagugagaucccagggaugugcuacaaugcccaccuuuacaugguacuguggauuucgacccagggcuucaugcuugcauggcugucacuuuaccaacugaacugucuccuuaaguaccugucccucucuguguuaugggagacacugaggagcaguaguauaaguccuucuuuaaccuggagauagcagucaguggggacccgucugccuccaggguuuuagucuuugccuuccucccucccucccucccucccucccucccuccuucccucccucccucccucccucccuccuucccucccucccucccuuuugagaagcuucugauuauugcuucaaucucauugauguuaggaaucugcuuaaguucuuuauuuccucuugauugaauuuuuauagaucauaugugucuagaaauuuauuucuucuagauuuuucaguaugucagaauaagauuucaaaguuuguuacuuuuucaucuuuauuaauuugugucuuucucuuagcuaaagguuugccagucuuguuuaaaagaaccaacucuauugugaaucugauuauuuauuuuaauggugguuuuauuaauuuuuuuuccuguuuaaugcuguggucugggaauugucuucuuuuucuaggacuuugugauaugucauuagguuauauauuagaaacauuuucugauuuauucguguaaacccugacagcuguacauuuuuuuuauuaggaauuggcuuaccugugauucaaagggccuggcaaagcacacucucacuuuuauuugauucuaagaaaucugaaaguuucuucuuuaauaacucagugauuauuuaggaguuauucaguuucugaauauuguguuauuuuugugcuuuuucuuacugaguuuuaguuuuauuacauggcccaauauuucauguaguaugcagauucuacuguccugcuguaagcuccuggcagaccaugcuaacauccaccacucugguuccuuugaauccauggucaaaagccacacacacacacacacacacacacacacacacacacacacacaccccuacaccugccuuacagcucagugacugggcucuucuaagcuuccugcagcaagcguacccuucccuuuauuccuugguuccuuugaauccauggucaaaagccacacacacacacacacacacacacacacacacacacacacacacacacacacacacacacacacacacacacacacaccccuacaccugccuuacagcucagcucagugacugggcucuucuaagcuuccugcagcaagcguacccuucccuuuauuccuugcucaacacuaagucugcccucaacuuaguuucaugauuaccuucuccuuuuucagcagccuaaaucugcccucaguuuaguuuuuuacucuccagccugcuaucccagguccagucagggaaguggccaguggccacucaacccaagacuucauaugguucguggcucgcucucucccuacaaagcaugaagcaugaagcacguccauuucccuuuccuccuccugugucuccuagccugccugcagaaaccgggaaguccugccucuucugcccagccauugcauuuuauugaucagucaagaaccaauuggggaacaggaccuucagcauuuacaugccugauuccccaucaaagcaucagaacuucccccuacaauuucacaagaaauuauuuugauucuuugaauuuuuaagacuuguuuuaugcccagaaaggggaucuauuuuagacaugguuccaucagcuacugaagauauauguguuuuguaucuuuuaaauggaaugccauguaucuguuaaguucauuguauuuuaacucugagaauuacugauuugaacuuuuaugaucauugguguuuguuuuaugaaauugggagucacaguauuuuuugcauguauauuuacaauuguuacagcuuuuugaugaaccauucucuuuauuaguauguaucaguuucuucuagcuuagaguguacuuaucagcuuuugaaauaaauuugccaguuuguuucagcuuucauuugauuguauauugcuuuccauacuugauuuugugagugucuuuacuacugaggcauguuucuuggacacacagauaauuggaucugauugauucauucagucauucauucagucugcaucuuuuauuaguaaguucaguccauuuacauuuaaguuuauuacacagguaucugauguuucuuccaguugcgugacuuuuccugaggagacgugaacaaacaccuaguuaucacaaauaggaaaccaacaacaggccaaagaauuccaacuugacaaccugaugaguucauuagaguuauuuacaguagugcagauaaguacaggaggaggcugacucagagacaagcgcaucauggaaaagccaguucuagugcaggugaugaagaacugccgugcugguguucucgccugacuucaggcagccaggcuggucaggcucgagauucuccgcagcuguucacagcuuccaugacuuuccugggaggaagucuuguaacucuuaaauguuccaguuucuuggacuuguaauguuucuuuccugagucccaugagccccuucuguuagguagcaggccuacagaggugaguuagcguaucccuuuacguugucucauucugaucccuuacuuuuauuuucuccgucauguuuauuugccgugaucccucucuacccauguuugugugcacaucucagugccccuuguauuuggaugucuguucucuuucccuaacuuuggcaaguuuucaguaucagucagauuuuuugucuuuagaguuuguuucagugucuucuauucugugacuucuaagauuugaucucuuuuuuuucuuuguuuuuugagacaggguuucuuuguguagcucuggcuguccuggaccuuagucuguaauagaccaggcuggccucaaacccagaaauccgccugccucuuuguccugagugcugggauuaaaggcgugcgucaauccugcuuggcaagaugaucucuugaucaucccagaguucuggggucuugugguccuguuuucuuuuuccuccccccuuuauugauguuuugauuuggugucauaucacccuguccuccagccccaugaacugcuuucuucuaauuggucgcguuuccuugcuuuuuuuuuuguuucauucauugaauuuuuauuuuauugcauucuaaaguuuauguaguauguuuguguauguguauauauguucaugcacuaaggccacagcucuuacaaaaggaucagaggacagcuuguaguucuuuucuuccaucugcagccaguggcagguacuucuauagagugagcaaccuuguugacccugauccauugagguuuuuuuuuuuuuuuaaauuucuguuuuuuucuuauuucuuuauuuuauuuccuauuuguuuccuuauuuuuuguugcuguuugcuuucccccuuuuauaaucugggcaguuuccuugcugauucuuuuucuucugcguuuauaauguugcuuuccuggacugucugcugcuucccuuuccucuuggguccagagcugccuuugaccacuugcuuguauucuuuccugagucacugaucacuuuuaccaaagcgucauguugacugacauucuacccuuuuucaguaucuugaguucagcgguagaggaauuacagucucuucaagaaaucaugccacuuuguuuguucaugcuucguguguuuccuuauugugauuuucauaucuuuugguuuggauaccucuucuguuuuuguuuguauugaggggagagagaagucuuuuugaaccaccuacucuuggucuugguuucuuuugacuuuugccaaucugcuguguguccuacuguccuagugucacuguacuugguuugcaccuacugguuaauuacuuuugacaucuuucaggugccuuuuuaaaccauucauauaucuuuuacccauuuuaaaagugggugguuggcuuuuuuauguguacucauugugggauuguaggaaugccuuguguucugcaccacgucuucuuucacuuguauuugggaaaguacuuuucucugugcuuugccuguuuaauaauuuuuaaagaucuaaagaucuuucuuucuuucuuuuuuuuuuuuuuuuguuuuuuguuuuuuguuuuguuuugcuuugggugguuucuuugugcagcccuggcuguccuagagcuugcucuguagaccagguuggcuuggaacucaaagagaucugucuucuucaccaugcgcugccaaggccuaacguuuuucagcuuugauaguuuacuucccccacucccauaggguuugugauuucuguauuuaagaaauccugggcugguggaauggcucagcagguaagagcacccgacugcucuuccgaagguccugaguucaaaucccaacaaccacaugguggcucacaaccauccguaacaagaucugacucccucuucuggugugucugaagacagcuacaguguacuuacauauaauaaauaaauaaaucuuuaaaaaaaaaaagaaauccuauguaacagcaucacagagauuuuuuucucuaaguuuaauugucugagcuguuauguuuaggucuguaauucauuucagauuaauccuuugacuauugugaguugucaaaauuuucuuuuuuacagucaguuagguuguucuaguaucacuuggugacaaaaugaucuuuccuucauugaauuagcgugacauuuuuugccagauagauuuccuuuaagagagaaguugauuaucacaccauucuucuguaccauuagucucgguauauguucuuaggccaaugcaaucuuauguuguuuaccguggcuuuacaguugagccuucagguuaggugguaggaaaccucuaauucuguucuuuuucaaguagguuugucugguguguaaggccaucagcuucccauuauuuuuaaaggauaacuugcuggauugcagauaggaacaaugacuacuguggggucugccacuuagugaguuuuacauuguuuuggaugugcaguuauaaaacugauccuaaguuuaguauauauuuugauauuucuuuauugauuaauuaggauaugucuuaguuaggguuucuaucccugcacacacaucaugaccaagaagcaaguuggggaggaaaggguuuauucgguuuacacuuccauacugcuauucauuaccaaaggaaaucaggacuggaacucaagcaggucagggagcaggagcugaugcagaggccauggagggauguucuuuacuggcuugcuuccucuggcuugcucagccugcucucuuauagaaccaagacuaccagcccagagauggcuccgcccacaaggggccuuucccccuugaucacuaauugagaaaaugccuuauaguuggaucucauggaagaauuuccccgacugaagcuccuuucucugugguaacucuagcuugugucaaguugacacuuaaaaccagccaguacaacugaccccuugucaacuugacacacaaacacaccacuauuacugucucaacccuuacuuuuuuuuuuuuuguuuguuuguuuuuugagacaggguuucucuguauagcccuggcuguccuggaacucacuuuguagaccaguuuggccucgaacucagaacuccaccugccucugccucucgagugcugggauuaaaggugugugccaccacgcccggugacccuuacuuucuuauuuauccccaagaucuaaauaacuuuaaaagucccacagucuuuacguauuaaaaguucaauccuuuuaaaauauccaauaucuuuuaaaaauccaaagucuuucauaauuaaaagucucuuaacuguaggauccacuaaaauauuuucuuccuucaagagggcaaaauaucagggcacagucacaaucaaaagcaaaaauuaaacucccaacuuuccaaugucugggauccaacucacgaucuucugggcuccuccaagggcuugggucauuucuccaucccuguccuuuguagcacacacauuaucuucuaggauccaacagccuguacuccgcuguugcugcucuucuugguggucaucucaugguacuggcaucucuaaaacacugcaugaucccuucaguccugggcuauaaauugcaacugaggcugcaccucaccaauggccuuccauggccucucacagugccgagccucagcuuuucugcaugaccccuucaugccuucaaaaccaguaccaccugggugacccuuacacauuaccaaguccugcugcagcacgaaguaaaaccuugguuaucucuguuucuuguuuuuuuuuuuuuucuuugagacacgguuucucuguauagcccugguuguccuggagcucacucuguagaccaggcuggccucaaacucagaaauccgcccaccucugccucuagagugcugggauuaaaggcaugugccaccauugguuaucucuggaacacagccucugugcucucagaaaacacauccuagaagaugucaccucaaugaugcuggucucuucuuaaucacugcuaauuucuuagcucuagcuaaccagcaucacuagucccaguaaugcaaagguuuugcuuuaguaguucugcuaucuuguuaaucacaacugauucuucagccccagcuaaccugaacuacagaaucuucacaaucaaaauagcaacacccccugaaaagagucuuuaaucuucccucugaaauuacacaagccaggccuccaucuucugcacuguucucaacauuaucuuccaagcuccuacacaacaucccauagagcucuuaacacagaauggaucuucuagucuaaaguuccaaaguccuuccacaguccuccccaaaacauggucagguugucacaggaauaccccacuaugcugguaccaauuugucuuagucaggguuucuauuccugcacacacaucaugaccaagaagcaguuggggaggaaaggguuuauucggcuuacauuuccauacugcuguugaucaccaaagguugcaggacuggaacucaagcaggucagaaaucaggagcugaugcagaagccauggagcgauguucuuuacuggcuugcauaucauaugaguucuuuugugauuggguuaccucacucaggaugauacccuccagauccauccauuugccuaagaauuucauaaauuuauuguuuuuaaaagcugaguaguacuccauuguguaaauguacauuuucucuguugagcgacaucuggguucuuuccagcuucuggcuauuauaaauaagguugcuguggacauaguagagcauguguucuuauuaccauuugaacuucuucuggauaccucaggagagguguuucuggauaguacuauauccaguuuucugaggaaccgccagacugauuuccagaguauuuuuaccagcuugcaaucccaccagcaauggaggaguguuccucuuucuccacauccuccccagcaucugcugucaccugaguuuuugaucuuagccauucugacuggugugagguggaaucucaggguuguuuugauuugcauuucccugaucauuaaggauguugaacauuuuuuucgggugcuucucagcccuucgguauucuucagaugagaauucuuuguuuagcucugugccccauuuuuuaaugggguuauuugauuuucuggaguccagcuucuugaguucuuuguauauauuggauauuaguccccuaucagauuuaggauugguaaagagccuuucccaaucuguugguggccuuuuugucuuauuaacagugucuuuugccuuacagaagcuuugcaauuuuaugaggucccauuugucaauucucaaucuuauagcacaagccauugguguucuguucaggaauuugucaccuuugcccauaucuucgaggcuuucccccacuuucuccucuauaaguuucaguguuucugguuuuauguggaguuccuugauccacuuugacuugagcuuaguacaaggagauaagaauggaucaauucacauucuuccauaugauaaccuccaguugugccagcaccauuuguugaaaaugcuguguuuuuuccacuguuugguuuuagcuccuuugucagaucaagugaccauagguauauagguucauuucugggucuucaauucucuuccauugaucuuccugucuguuacuguaccaguacuaugcaguuuuuaucacaauugcucuguaguacagcuugaggucaggcauggugauuccaccagagguggaauuguugagaauaguuuuugcuauccuagguuuuuuguuauucccuuuauuguuauuguuuuuuaauuugcaaauugcccuuucuaacucagugaagaauugaguuggaauuuugauggggauugcauugaaucuguagauugcuuuuggcaggauagccauuuuuacuauauuaauccugccaauccaugagcaugggagaucuuuucaucuucugagaucuucuccgauuucuuucuucagagacuugaagcucuauacagaucuuucacuuccuuauuuagagucacaccagguauuuuauauuauuugugacuauugugaagggugguguuguuucccuaauuucuuucucauccuuuuuauccuuuguguagagaaaggucacugguuuguuugaguuaauuuuauauccagcuacuucacugaagcuguuuaucagguuuaggaguucucugguggaauuuuuagggucacuuauauauacuaucauaucaucugcaaauagugauauuuugacuucuuccuuuccaauuuguauccuguugaccuccuuuuguugucuaauuguucuggcuaggacuucaaguacuauauugacuagguagggagaaagugggcacccuugucuagucccugauuuuagugggugucuuaguuaggguuucuauuccugcacacacaucaugaccaagaagcaaguuggggaggaaaggguuuauucagcuuacacuuccauacugcuguucaucaccaaggaggucaggacuggaacucaagcaggucaggaagcaggagcugaugcagaggccauggaggaauguucauuacuggcuugcuuccccuggcuugcucagccugcucucuuauagaacccaagacugccagcccagagauggucccacccacaaggggccuuucccucucgaucaccaacugagaaaaugccccacaguuggaacucauggaggcauuuccccaacugaagcuccuuucucugugauaaccccagcgugugucaaguugacacauaaaaccagucaguaaagugggauugcuucaaauuucucuccauuuaguuugauguuggcuacugguuugcuguauauugcuuuuauguaauauauauacauauauauguguguguauuuauauauuauguacauguauauauguauguauauagguauagguaugggccuugaauuccugaaguucuuaacuugaucuuaauaaaguguuguuuuauucaugcuuuauuuggugcaguguugucaguguuuaugaaggacauuacugaagagcacccucuacuauuggcacuuuuucugccuuaauacauagaauucuggccaaccuaaguuuuuuuucuuuuugucuuuuuuuaauggaaauuuguacuuuauuaaaauggauuggcagaaaguuauuccuaauauuccauuauuguuuuaucauaucuauaggauuuguaguaguaugcuuuauuuuuuuauacugcuuuuuaaaacuuuuuucuuuaauugaucuaacuaguuuugcugaucauuuuagagaaccaauucauaguuuuguuuaguuuuuaaauugcugcucuauuuucuacuauuucuguuuuaggauccaguuuuguuuuauuuucuaguuguggugcagacucuaggcucucauuucaauuuucuuugucuuuuauaaaauguuuuuuuuuucuugucuuuuaaaaaaauuaaacauagcuuuuaucacacaaaucuugauuuuuuuucuuucuguucaaaaauguuuucuaauugaguucuuucuuuguugguggagcauuguuaggaccugcccugcucucuguuuucuccccuugccaagcguccaugccagaguugcuggucugcagcuucucuguaccacacauggcucugcaggaauaucaacuguuacaggaaauguagcaaguaggggagggguagcaaggugguucagcagauaaagauucuugccaccaagucugaugaccuguguuuuauccaaagaacucagauggagaaaggagagaaggauuccugcaaguuauauucugauuuccacacauguucugugggagauacuauguaugcacauacacacacauuaaaugcagcaagauuugguuguaaaaaucaaaagccuguuuugcucuagaaggaaauuuuaauggaacuguagauauucaaaguccuggaugggaucaucuaaaaugaauaauauauuggugugagauauauauauauauguauauaguguaauaaguuacaucaaauucuuuauguuuacaaauagaacauuuuauaguuggauaugcuuuaaaguccuuacauaauaauauuuaaaagucugucuggcacauacaacaauuuuaauaaaugcuuguuuucuauuuuucuaguccaaaaaaucagugagaugaaauuuaccugccuuuuaaagauaccuauaagauagucaaauguaauuguuacucuuacaaaggaugcccagcauugcucuagcuuauacguuguaugcaguagcauucaauuucuuuugugcagacucaacaguucaguuaauguugaacaaagaaaauuauaugcuuuaguuaugugugcuuuaauuuagaugcuuaauggcuuuuaauguuacaaaauaaguuuauuauuauauuaugaucucauuuguauuauauugucuugcucucucauaucuguggugauauggucaugguuuacaaaaacaauaauccccaagaaauaggucauuaacaguaguuaacgauuacuugugaucuaugauaaugacugauuucuuugggauuauugcaguuauaaaccauaauuacagauuauuacagcaauaauuauuuuguuaaggaaaaaauguucuaugcuugaacagcugcuaaaacaagugccuugaauauuucagaauaaagagaaaaaugggaaauuauaaugaaauuuaaucuuauaaaaugagauucuaagagauuuauagauaugaaucuuguguaucagauauguuuuucuaaguuuaguuuagauguauuguugacaugguucuuugaauuucuggaugcaguuuagggacgaaacuaauuuucuugacguguccuuaagguguacagcaggauguuuugauaggcauguccauaauggaaugaauacuauagucaggguuguuauccuauccaccccauccugcccuaguuuugugugccuugggagaaagagacgagugccgcuugaagugugugccuuuauguugugcagugcucuuccccagaguucccaugugucuucagucuuuaggugaaaucauucuaugacugcaaauuuggacccuuugaccuccccccccccccucccugccucugauggaauucuacuuuugucuauguaaacacuuuuuuacuugauucugcauauaaguaagaacaugcaauauuuuugcuuccaugccugguuaauuuaucaaugugacuuuucaguguugcacuuuaaauagaacuuugggagaaugguuugauuuuuaugagaaauaccaguauaccuuuagcugagucccagaauuguaucugacagcuuacugauagcucuuuacuguuacuugcuaacaccaccuucagcuugaucaguucccaagagaagguuuugcuucaguuccccaaaccuuagagauuguaacuuucucaaauaaaggaaagggccaaggcacauaccauguuucaaaguguaccaguaaacuuccauuuaaauguuccauuaguuuagugaaaugccuauaauuuugucacaugcuccuuauacaugguauuauuugauaaccauggugucauuuugaggucauaaugaaagaauuaaauuguuuggauguugagaugucuuauguguaucauuaguuuacuauuagacaacaguguucuugcaaaaaucaucccgacuuaggaacaccacgccaguagauucagcucuugaacacggaguucuugcucccuuagaccgucacacauugagauagaucuuccaaaaucuugacaguacucaguauuuucugaaugucuccucuuggagaauuguuuucagucugggaauguuuguuuaucauacagucagcauuaaggaaguuaugugaugcguuuuauccgacuuucaugauaacaaaacauuguuagagugggagcaacuuaaaguucuuaaguaauaugugauuucauuuucuaguaaaguuucugaaagaagacagaguaaaaauguaaauguuagcauauuuuuauguuuugccuguguggcaaugauauggaagugccauuaaagggcauuauucaacagugaugguaauaagagccaaagcaggcaggagagugcccacagugcugacucgugugaguuauuagcacacuuaggaagcaguaaauugcuaauguaauaaauacuagaucuaagacucgaagcagcccuugcuuuuccuggcuguugguauugcuuagcaugcuaguucccccuuccugccucucucucuugacauaaggucuccguguuuaguuaacagaccuguaucacauucucagcaacuucugcuuuuuaaaauaaacauuuaucauuugauagagaaauaugaaaauuauauccaugggauaauuuuggucuguuuuaacuuagguuuccgauauaagaacuguuuggaagaugguucaggucaccucagugggaagccucccuaguaaguuuuaaagcagcagcaggacuaguguguagcguguuauucaguccuguaaccuggcacggaguagguuaagaugaagacugugaauuugggacaccguggccuguauauguaauguaugcaaggauggcuugaguuagguagugagauguagcucacaccacaccagcaacuccacucuccaaggauuggggaccauagcucaguaacagagacuuuaaaaagguaguauuaucuaaauaauauguaaguaucuaagguuauaaaguguaagggagauaauugaugauuauuuacucuuaaauuauauguuuugcugugagaaauaguguuauuuggagggggguggguacacaggcucuugcugugaaaccugacacgguuccuaaacugaaggcaguauuucugccccaguccucccaagucaugggacuguaggcaagugccaucaugccugacuuauaguagaauauuuaaaaaauagucacucccuuagggcagguaaaguguuacauucaauaaaaguuaugcuugcaguguuucagaguuacuuuauuuuagaagagacuaguaucauuuacagacaguagugcaacugcuagucugauaacugguuagagucacuguuaagagcuucaugauuccuaggauucuaggaaauagagcugauucuuguuauuugcugauaauggucuauauaaucagaacagcauauucacaaauaucaaaucauuauauuggguuguaacauuucugucaaagugucgacacagaaacauuauuuuauguguaaguuuuuguaagacuauuuaaauguauuguugguucauuagcauugaacucagacccaacagcacuauugacucauaccuaaacacagcuuauccagcacagaauuugcuauauagaaggcacgugccuuaguuacuucucuauugcugugaaaaaaauauucuauuaccaagacaacuuagagaaggaaguauuuuuuaagauuuauuuauguauuuacauuccaaauguugcugcccccccccccccccccgcucuuggucuccccucauaaggguuucccccuaccuuuugacucaagagggugguccccuaugcauccccccacucuggugcaucaagccuuugcaggauuaggugcauccucucccacugaggccagacaaggcagcccucugcugaauaugugccuggggccuuggaccagcugguguauacucuuugguugguaauuuagucucugggaguucgcaggggucuauguuaguugacauuuuuggucauccugugagguugccauuaucuucggguccuccaguccuucccccaacucuuccauagagguccccaaccuccauccaaggguugucuguggguaucugcaucugucucagucagcuggguagagccucucagagggcuguuaugcuaagcuucugucugcaagcacaacauauuaucauuaguagugugggggauuggugccugcccaugggaugggucucaaguuggguaggucacuguucagccauuccagaaagaagcauuucauugggucuucuaguucuagugggcugggaggucaucaguaucaugguuauagaauggaagcuggcaugguguuggagcugcagcugagagcucauauucccauucacaaacaggaagcagaaaaagcacugggaugaccugaggccuugugacaaauggccaccaacugaagaccaaguauucaagugccugagauuuacaggggcaucucauucaaacuccuagagcacauaacgccccuuccccauucagaaacacuguauagcacaacugggcuaucucaaagauugaaaucacucauggcguaucaaugggaaaagcaauaaagagacugaaagaaaugcugcuuagaacugaaauaagaggguugcauugccaggagcuggaaucgggugcaccagacaucucagccaugugaauuauuuugaguacuaauuugggguuacaaauagguuuuuaugaaaagguaaauuaaaaaaaucagggaucuacaaauaauaauaauuaguuguagcacaucuaauguagaauggacaccuuaaagaauagaaauauaauuauaguuuauguuuauucuuaguguguauuucaagagaucaacucauugguaauguuaaaccaguaaaacauggccaggcugggauuuagacccuggaguugaguagagaaccuaacagacaaaggccuguugucaugcacuguagucugcuagaguuagcaggcaguaaguaagagcagcuguauaaaauguguugcauguuagaaaucauucugugcuaagauaaagagcagucgcccagagggaccugguucuacuuauuugucaccaaaauuuaguaauuugucaauuaaugguugcuuuuuuuaaccucaguuuucugggcuuuuugagguauugcuguuagcugauagcuggggcuugaguugccuauauuaaucuuccucauuagucuggugucuaugcuggaauucuuggaccuaaacauaggaggucaaguaggauacauauguagaaauguuuaugauuuuggguuaggcauuucuuucuuaucaauuguccucaaacugacaauaacaagaauagcuaaguaguugcagcauuagaagugagcauuuuguucauugaauaacaacaccaagaaggagaaaaugaaccccccagaaaggcagcgacagcuaauauaucugacaagggacucacaccuacaauacaugaggggcuuuuacagcuuaguaauagucacagcucugaaagauagcccaaggacuuaaguagacucuucuccaaagaaggcaugaaaguacccaggaaacacaugaaauuaugcuaaacaucaugcggcacgagggaaggcaucuuaagauaacaguaagcugcuaccucacaccugccaggauagaugcaaagacagaaaaccagcagauaacuauaaguguugaugagaacauguggagaacucaggacucuacacuucaguaggaggcuugccaaguggugcauucgaugagagcaaugugagaguuucucccauggcacagcaguccacucaugccugaaggcaugcaucuacaugguguguaccaugucugucauaacuugguaauagccaggaggugaagaugacccuagcauccagcagcugaaggagcauaucacauauaaccucuccaagcaauggcagcagucaacuguaaaguacuggcacagcacaacucaacuuugacauugugugacauaaaaaauguagucacaaaguaccauuguaagauucugcacguccagagugacaaggcagagccacaaaaugguugcugcaguugggauggggggagcaaacgagugaugccaucauaccuaacuguuggguuuaaucuuagcacaccccaucuuuguuagacuuaacuuuagaaauaagaaaacguaaaaaaauuuguaguguugguugcauaaaccugugaauuuacucagaagacuggcuuauguguuuuaagugaguuguaugguauaugaauuucuacuucaggaaaucuguuaaaauauaauagacccauggguuagaagucccccagaauacaauugucaggcuuguaagauuuguuuuuauagauauugaacuuggcaacuacuaugauaaaauauuauugcagaaacugacggugagcuaggauccacuuuuuaaaauaagucaaaauaaucuccaggcaagucgauuaucagcaaagaguguucauaauuugaugauguaagagguaaagaugagugcuuuaugacuaagaaaauucccuagaaguagcagugaggauuguguguacuuacuccauccuguguucacgaugcacaacuugaagguuugguggaggaagccauauuaccuguuagcaugcuugccaggggaaacuguauacugucuagacuuuucuagugagcuggaaacacguuugaagcauaaacguuaacucagcuucuuacaugagcuuugugcuaguauuuuauuaauacaugcuguggaacuuguuuugugauauguuugaucacauuagaucuucaccuuuagcuguuucauguugcuaauggauacacugcaaaauugacagcuucugaguuguucaagguucugugauagacaaaagaggguguguauuugccagauuauauuucucauuuauggaguuuuugucauugaagcagguugcagauugucugcgguuaccagggagugcuuugcugauugcgcaguauaauccugagugcugacaucugcaggaaaagcuuguugaauguauuuguucuccucaaguccuucaacaagcaccgacuuuuuccucaacuauuccauguauuuaaacaacuacaaaggucacauggagagauuuuuuuuuuagauuugcuuuuauguguaugaguauuuugccugcacauaugaauuugcaucaugugcaugucuggugccuauggagaucagaagugggcaucgcaugcccuggaacuggaguaauagggaguugugagcuaccguguggaugccauaaccaccaagauuucuuaauaaaagaaacauaauuaauuuuggaauuguaaaauaguuugcucaucuuugaaaaaucaguuuucaauaaugacaaaauuucucugugaaaugacauuuuuauauuucugcaggucucaaaaguuuuagagaaucucauacuucuauugauaaaucuagagaucuaacauaauacucuuuaaaaauaauuuagcaaagaauuccaucccuagaguuauuaauuuuggcuucucuaaaguaaaauuugagaaaacuacagauguuuccauuugggagcgaucugucugugucucuuuugauuugugcccauguacaugugcauguuuauguggaaaccgugggacaaccucagcuguuguuccuucugugcugugugcuguuauuugacucucaauagacagucagcaccuuacccaguaggcuagacuguggcucaccugggggcccagcagucggccugucucugcuuucugaugcacgugccaccacauucagcuuauuuuacaaguccugaagaccacucagguuuuccugcuuaggauucaagcacuuuacuaaguuaaguuccuagcucuuuguuucauuauuuaaaucuguauaaucuuuugauauuuuuagccaugaagauuccauagcaaacuuguggauuuuaaaauauaaauaagucuaaagaguaaauucauuaccauccauaauguuacaaguaggaguuccaaaaugaaaauaguuagacagacaccaucaggaaauugaccacucagaacagauggucauuguuguuuguaaaagucuugauaacguacucaauacugaccgagaauucucuggaguacggccugaccucagaguugccauccuucugccucaggcuuccaaguucugucaugacaguguaugcuaucagauucagcccacagugaugcauuuuugugacuuugugggggugguggugggcagagucucugugcugagcgcaggcuagccugggauugacagagguggugcucuccuccugcuucagcacccacucuccugagugcugcauuaccuuaucugcaucucaaaaacccacuugucuuugacucucucuugcugggauuaaagguguguaucaccaugcccagaucuauuaauuuuaauuuuaauuuuaaucaugucuuauuuuuccccauuugcgaaugaaaaccuuaaggcuuaaagagguaaguaaggaacucaugcaaacucgcaacagcuugucgggccuggaaucucaaaguacuuuuuucccugcugaaucccuguuagcaucacugcccugguaaacugucuguugaaaacugacuuuuuaauaguugaucauuuguuuuaaaaaaauagaugauuuuucugauuuaaguauuuucugaaaacuaagcuuauuucuauuaauacuucucaccuucuuucuucuuuguuguaaggacgucuugcauggcugaucuacuugguuggcacaguuguaggagggagacuaacauauaccagcacagaugagcaugaugcuauggauggagaacuauccugccggugagugacagcuauuuacugcacaguggaagaacuuccaccuuuguuuuaacuuuauauggccauguguaaaccagugcacguggccuuuggguguuaguuuccuuuuuacccgaaaggaaauccauggauggagauugugauuagaauuugauuuuucaacaaauaggcucagauuuacuugguuuuaacccccuagugcuggugaucucaaccuuaccaagcuacugaauggcucuucacacauuccuaaacggagggagggaaauucuugugugugaauacugugaauagcuugcuuucccaccgaucuugacuaaauaguuauuuccuguacacuugugcaugguuuuuguuucauuuguuuuggcgaagacuuaaacuuuaugaaaauaaaugucauaggaauuuccagaguacugauguuaguuuuaaagacccuuugaguauuuugaauguguagagguguguauacacugcauguguauuuucaaccuuuuuaaaaacagacauuguuacaacauuguuuuguaacuagaaaaauugaaauaguuaucuauuugugggcuguuaaaagauucaaaugaguuuuuuuuuuaaugcuuaguacagugccugguaaacagugauguauuacccacgcauacuuaauuuaaauugaauacaauuuugugaacauuuaaccuaaaaguuaaacuuuucuagacuauaccauagcuuaaguuugguuuucaaauuuuagguuccuuuucaguguuuauuauaaauugccuccacguaaacauuguuuuuuauagauugagagaauuuuauuagaguuacguuuugcugucuucagauacacuagaagaggacaucagaucccauuacagaugguugugagucaccaugugguugcugggaauugaacucaggaacucuggaagagcagucagugcucuuaaccacugagccaucucuccagcccuagaguuaauuucuuauaaaguagcuuuucauuuauuuauuuauuuauucauuuauuuauuuauuugguuuuucgagacaggguuuuucuguguagcucuggcuguccuggaacucacucuguagaccaggcuggccuugaacucagaaauccaccugccucugccucccaagugcugggaucaaaggcgggcgccacaccacuuggcuuagaguuaauuucuuuucuuuuuuuucuuuucaaguuuuuauuagauauuuucuucauuuacauuucaaaugguaucccgaaagucccccauacccucccccugcccugcuccccuacccauccacucccacuucuuggcccugguauuccccuguacugaggcauauaaaguuugcaauaccaaggggccuuucuucccaaugaugguugacuaggcuaucuucugcuacauaugcagcuagagacaugagcucuggggguacugguuauuucauauuguuguuccaucuaucagguggcagaucccuucagcuccuuggguauuuucucuagcuccuccauugggggcccuguguuccuccauccuauagaugacugugagcauccacuucuguguuugccaggcacuggcauagccucacaagagacagcuauaucaggguccugucagcaaaaucuugcuggcauaugcaauagugucuggguuugguggcugauuaugggauggauccccggguaggguagucucuggaugguccauccuuucgucucagcuccaaacuuugugucuguaacuccuuccauagguauuuuguucgcuauucuaaggaggaaugaaguauccacauguuggucuuccuucuucuugauuuucuuguguuuugcaaauuguaucuugguauuauaaguuucugggcuaauaucuacuuauaagugagugcauaucaagugaguucuagaguuaauuucuuaaaguugaauagauuaucaguuucuguagcauuuuaaagaaucacaguaaguaucaucaauugguuucuggaagaguuauacauguuuagcauccuuaaucugcacaaaaaccccacaguucuuuuuuuaaauuauuuuuuauaauuuguuuuuauucuuuaauccuuuuuuacaguccagacuucaccccaucccauaacuuuuaccccccccccccaucuccaagagccccacaccacaggcuuccccacucccuggggccucaagucucuugagggucaggugcaucuucucucaccuagggcagaccaggcaguccucugcuguacauaugucaggggccucauaucagcugguguaugcugccugauuggugguucagugucugagagauaucagagguccaggucagcugagacugcuggucuucccauggggccacccuccuccucagccucuuccagcuuuucccgaauucaaccacagggggacccagcuuccauccauugguugggugcuaguaucugcaucugacucaguugcuuguugggccucucagaggacagucaugcuagguuccuguuugugagcacaacacagcaucaguaucagugucagggccccggccuccccuugagcuggaucccaauuugggccugucacuggacauuuuuucucaugcucuucuccauuuuuguuccuucagacaggaacaauucugggucacaucuuuugacuaugggaugguaaccucauccuuccacuugauguccugucccuccacuggagguggacucuacaaguuccuccuccccacuguagagugcuucaucuaaggucccucccuuugaacccugagagucugucaccucccaagguugccuguuuccauucuuaaggcuggcccuuggggcuucaauccugucgucccccccaauaccugaucaugguucccccuucccaucccugucaccuuccccucccaugucccucccucccucuacccucagugacugcuuucuuuucccuccuaagugggauugaggcacccuuacuuagguccuucagcuuauuaaccuucuugaguccuguggguuguguccuggguauucuguacguuuuuuggcuaauguccacuucuuagugaguacacauuaugcauguccuuuugggucugaguuaccucacucaggaugguauuuucuagcucuaagcauuuaccugcaaaauuggcagccuacaggaaaaaaaucuuuacuaaccccacaucugauagaggucuaauauccaaaauauauaaagaacucaagaagcuaaucaccaaaaaaccaaacaacccagucaaaaaaugggguauagaauuaaacagagaauucacaacagaggaauauugaagggcugagaagcacuuaaagaaauguucaaaguccuuagugaucaggaaaaugcaaauuaaaacaacccugagauuccaccucacaccaaucugaaugaccaaggucaaaaacucagguggcagcagaugcuagagaggauguggagaaagaguagcacucguccauugccagugggacugcaagcugguacaaauacucuggauauuagucuggcaguuccucagaaaauuugaaaauaccugaagacccagcuauaccacucuugggcauauacccaaaagaugccccaccauguuacaggggcacauguucuacuauguugauagaggccuuauuugugauagccagaaguuggaaacaacccagaugucccacaauggaaaaauggaugcagaaaaugugguucauuuacacaauggaguacuacucagcuauugagaaggagggcaucacgagguuuuuaggcaaauacacaguucuuucaaaucugaaauugaauuccaacacaacuagcaaauauuccaaaaucuaaaaagcuuggagaucugaaauacuucaugucucaaauauauauaugacauuucaguguuccgauuuaucuucuaaaccaaaagccugugggugucaccauaucucuucuguugaacacuauauaauagaauuauucuuauugauaagaguguaacaaauggcuuguguuaauuuguauuucuuugguucuauaugccauucagaauuuuucuuuucaguuuuuaauuuuacuuuuuaauuacugauauuuauauguaucaauuacuuguuuuugcguuuuaguauguguauugugugugugcucauuccucuggguggaugcacacgugugugggugcaagugcuugaggaggcucaaagguugacauuaggcacucuaucauucucuaguuauuuacugcagcaaaaucugucaccaauguucagcuaucaaguuagccaguuugccacagguuuguccuguuucugcguccugugugugugaauggcaacuggucucugguaaccuuguuuugugaauucuuuagauuccaaauccagugcuauuugcacaaaaagcucuuuguuuaccaagucaucucuuugauuccuacccuacuuucuuuugugauuuuuuuuuuuuuuuuuuuuuuugguuuuucgacacaggguuucucuguguugccuuggcuguccuggaacucacuuuguagaccaggcuaggugauuauuuuuuuuaaacuacuaauaauuaaguuuaaaguuuuuaauauuuuacauucaaauuguuaauuaaggccaacucuaucuuguaauggcauguaaugccacauaucuuacacagaauuccuaaugucuuugacagauuuuucuuuuucuuuuucuuuuucuuuuucuuuucuuuuucuuuuucuuuuucuuuuuccuuuuccuuuucuuuuucuuuuuccuuuuccuuuuccuuuuccuuuucccuuuucccuuuucccuuuucccuuuucccuuuucccuuuucccuuuucccuuuucccuuuuuccuuuuccuuuuccuuuucccuuuucccuuuucccuuuucccuuuucccuuuucccuuuucccuuuucccuuuucccuuuccccuuuccccuuuccccuuuccccuuuccccuuuccccuuuucccuuuucccuuuucccuuuucccuuuucccuuuucccuuuucccuuuucccuuuuuuucccuuuucccuuuucccuuuuuuucccuuuucccuuuucccuuuucccuuuucccuuuucccuuuucccuuuucccuuuuuuucccuuuucccuuuuuuucccuuuuccuuuuucccuuuuuuucccuuuucccuuuucccuuuucccuuuucccuuuucccuuuucccuuuucccuuuucccuuuucccuuuucccuuuucccuuuucccuuuucccuuuucccuucccuuucuuuucuuuucuuuuuuuucaaggcaggguuucucuguauagcccuggcuguccuggaacucaacuuuguagaccaggcuggcuucgaacucagaaaucugccugccucugccuccugagugcugggauuaaaggagugcaccacuacgcccagcucgacagauuuuucuuauguuugcauugauccagaaauuuguuguuacaauaacaucacucuguguguguguguauguguguguguguguguguguguguguguguguguguguugggguggaugaguacuauaggggcauauauaugugcaacugugcaaacuugucagaccagagaaggacauuggaaguguucuacucuauucgaccuggcuuuugagacggucucuccuugaaccugagacucacuguugcucacuagcugacccacaagccucugagaucuggcagucucugcccugaagcacugagguuagcaggcaaauguguccaucccuggcauuuauguguuugcuggggauuugaacucuagucuucuuucuugcauaccaacuacuccuaccgcaccaggcaccucacuauccuuaaauguauuccuaaaauuuugauaauauauuguaauugugaauagaauuuuuucacugcauauccuuuauucuguguauuauccuuuuaauaaaauuugaaccuguaauuauauuuuaauuaaaaaauuuaaaagauaaaacuuuuaaccugaauauauaaaaauauucuuagcuuuaccaagacuuguuauuucuuauaucaaauuaaguuacuugaaaaugugaguauuaacugguuagggccuuuauuaaaugcuuauguaauuuuuaagcacaugaaaaaaauauaagcaccugugucaccucuuaaccaauauuguguauugugugagguagaguuggguguuucugguuuuguuaguuugauauuuuaaaaguuuucuucacgggaguggguggguuggggagcagggcagggggagguuuuagggagcuuuggggauggcauuugaaauguaaaugaagaaaauaucuaauaaaaaugccuuaaaaauuuucaucauuauacaaaaaguauauacuggcaguauuucuagaauaaauauauaaugggacagaaagcagauaucuaccugcucauuugaagagaauucauuuuuuuuaaaaugauaauuuuuuuuguuuuguuuugguuugguuugguuuuucgagacaguguuucucuguguguagccuuggcuguccugggacucaaacucuguagaccaggcuggccuugaacucagaaacccaccugccucugccucccaagugcugggauuaaaggcgugcgccaccacugcccggcagcaauaaaauauuuaauucaaaagaagaccuaucuuuuuacuagccuacauccccuacaaaauacaguuaaguggaauuuaugugcugauaguuuauuacaauguugugauaacuugcaguuuuucagagaauuaagaaugauggaaaauaguugagaaaagaagaggcaauguuugucagcucuuacuguuuggauuucugguuuuuaacucaucuuagugauacauuguuuauaaacuucaauucaguucucacaguguuuuugcucucauuuacaagccugagcauaggguaaaacaaaacagaacaagaaauccggaauguuuguggcuguuucucagcugagucuaaugacagccucuggcuucugguuugauugcucaaugccuaaaucaguguccaaguaaauggaagaagaugucugcgucauuagggaauguuucaguuuuuguggugugugugguguuucugggauucaggaauauaagaaaguaaaaaauaugauagacgaaaaaugaucaagaguaaugccaugaacggaaccuauuuugcuaugguuucucagcuccuuaaucccacuuaagaugcaccccuccuccugauuauucuaaccacacuguuaaguuugacucuucccuuugcuuccugcauucuuccuagagcagcagaguucugguucguuccucaacaucuuuuuaagggcucugagaaacuagucacuauagcuuuauuauugauguuugcgcugcacguucuagugcaggaggaguucaccuacuacccccauuccuuccauugcuucaauauugguguuugugccauuggugacaucaaaccccaagguucuuaccuggcauuauuauaaugguggacucuagagugaguaagacuugcauguagcaccucccauaguuccuaacuauaggucuuuaucucauggaucagagguuuccuuaaauuugucccauugucacuacagcauuucuucuugauguugcauuuccuccuuacagaucugcacucaccacuuguccuaaacuccaguugucugugcuuuguaccucuuccuuuuauaucccuccuaugcuguucuuagagcuacaucagauuuuguguuauuggcauugucuggugcugcuggugagcuguccugcagauccacuuaguuuugcauaagccuugaugcuguggucagcacacucaaauucagaagaaccagaugguagacaucagaguggcuucccugggaacucaacagugucuucuccugaggguccucuauagucauucacagugacugaaguccacuuguaguccacucuguagucacucacagugacuguaguccacuuguaguccacucuguagucacucacagugacuguaguccacuuggcuacacagaaaaggcuuccccagguugaggaagcucagggcguaaggaauacgcuggcacucagagcaggcaggcagcgcucuucccagcaugcuuguuguccuuguccucuuuggcagucucccuggguuagcaucuuauaguggaaaugcuuccagcuuuccucucuuaguuuuguccuuuucuccucauugauguuaggaaauuguuuacagaguguauagucuuuucuccuaguuuuauaaaaaguuuuauauuaguuaauauaugaugauuuauuaugguuuuauacagucauuggaggcugucuccauuugcccauuugaaauuauuggcagaguguuacuacugguaacgcuuucuuggaacguaguucucuuccaagcuaaagucuuuauuucuuuucauuuuuuuaaauuaauuuauuuacuuuacauccugauuacagcucccccccuccucucccccaguacacccuuuuaccuucucucuuccaucuccccucccuuucuccucagagaagaggaggccucccaugaauaucaacccaccuugguggcaagucacaguugcaguaggacuaggugcaucuucuccuauugagccgagauaagauaguccaaauaagggaaaggggguccaaaggcaggcagcagaaucagagaaagcaagccccuucuccauuuuguuaugggucccacaugaagaccaagaccucucugccuccuucaaucuccccccccccccuuccacaggauucccugaguuccaccuaauguuuggcugugagucucugcaucuguuuccaucaguuucugagugaagccucucugaugacagcuaugcuagucuccugucugcagguauagcagaaugccauuaauagcgucagaggugugcucucguggcuugggucuuaaguugggcuagucuuugguugucccuccccucaauuucugcuccaucuuuacuucuguacaucuuguaggcaggacaaaauuuuggucaaagauuuugugcauggguuggugucccaauuccuccauuggaagucuugucuaguuauaguggauggguugcuucagauuccaaauaccccauugcuagaagucuuagcuggggucgcccucauagauuccugggaguuuauaucauccugggguucuagcuugucccagaguugcccccaauccccuacugacuccaguuucucucacaguucucucccccucuguauuucccacaccugauccuuccugcuccuccucucccaccuuuucuucuucuuuuuuuuaauuaaaaaaaaaauuuauucacuuuacauccugcucacugcccuccuuccagucaccccucccacaauccuucccuucuuaccccuucccuucucugaaugcauagggcccccuuguguaucucccagcccuggaacuucaaaucucugcaaagcuaggcacuuccucuccuauugaggccagauaaggcagcccagcugcaauguauugauuuuguuaaugcaagguacuuagcaaucaccuucuaagaaaaucucauaaaaaaguugaaggaugccuucaaugaaaaugcaaggcugagaauuacauauucuauagaaauaaaaguuaagaaaauuucucuuagcuuaugauuugcuaauaguaauaguuuuuaaaaguauuaaauugaaaauuuaucauuugugacaaauaauaauaguuacuagugguuggauauugaauaugguugaagucuccuaguauugcuugucuguaaucccagcuacucaggaagaucacaauuuugaggccugccugggcuacagaaugaauucaaaccagcuuggacaacuuagugagauccuguuucgaaauaaaaugcaaaaaguggaauauaaauuguagaaugcuauaaagacccaguuucagccuccggucaaauuuucugucuacacacagcuugacuuucuuaaaaaauuuuuuuuuucaauuuuuuugugcauuuuagguaaaaauguaaugauucauuaagaguacugacuauacuaagaacuuaauagauaugguucuaaauuuugaagaauugagucugauuuugaaauauuuauaaauacaaaguaaagaacauuuaauaucauuuacuaaaaauauaaggguauuuacuuuuaaaucuguauauuauagauuuauacguauaugucaugcaucuauagauaaccuuuaauagaguaauauguauauucucaucuaggagguuuguauuuauauguaaaggccaggagaaacuagaccaauugagucuuacaaagguaggauuucagauguuuuaaaauuuucuggaugugcuuuuguaauuucuuaguuuuuaaaaugauuauauguuuguaauaaauaccucuauauugugccucugagaauuuauacuaaagcuuucguuuuuuuuucauggaaaguguuuuucagcuuauaucuuuaauggauaccagauuaccucacugcaccaaugagaaaauagagcuugcaguucucugguuccuggaucaguuucguaaaacauauguuggugaucagcuucaaagaaccucaaagguagguuuuuacuaugagaaagccuuauugagaaugaacauggauauaaacauauagcaggugggaguugagugacaaaccuugugacucuuuacuacagacauauaauugacaacuaaauucaucuguuggauugguauugaaacacaaugcaaaauuaguuuacuuguuucaagcauacauuuaucauuuucucuaaaggaauaauauuuuuauuuggauaguaauuuaaauacuuuggauuuuuaaaaugcaacucaauagauaaaugucuuuuuacauuucacaauuggaaacaagaugggcuguuuuaauaguucuguggcuugcagggguggacuguuuaagugauuuccaguauauuccagccauuccuugacauucuuacaugcuaagucauguggacgagacgaauuuagacacaagcuagacagacagcagcuaagucacuguaaugguggagucgcuguaaugcgauaauugaaagguuagcauuggcaaguuuuagaucaauugauuuagagacauaauaaaagauuauugaggauguuuaugugaguccuaagggaauacuuaggaguauacacaugcuucuauauuuaugcauuuugcauccauggguucaaccaaccaugcauugaaaacauugcauuuuuauuaaacaugcuuuaaccuuucccuugucaacauuccuuaaaaacauguagaaauuauaaugacacuuguacauguuguauauaaucucgagaugacuuaaaaugucaggggaagaugugugucgguuauaugcaaauacuauggaauuguuuuuacuaauugcaaaccauuauuugauuuucagacuauguuuuccgggguuaggagcauagugugggguaaagcacuugcuuagcauucauaaggcccuggguucaagccacggugccaaaaaaugagagccagggggugugggggggcagcugaaaaagaaaaaagacugaggguuuuuuuuucugguuguuguuguuguuuuaggauaaaguuucagguaaagguuucuuuaccuuuaaaagaaguuauacaauuucaugcuuucuugcgugaauauauaugaaauuuuggucugugagcaaucuuucuaagcuagaucuugacaguuuucuaaaaacuugcauagaauguaaaauauaauauuauaaauauauaaaacauaauauauaauaguucagauaccaagguggauucaccaaagagucauaaaagacaaguguuaggucuguccuguaaguggaaaugaacuaagcuguaagucacauuggucauuagugagcaguuagucuauguuagauucuuugcagacaaguacuaucuaauugauucucauaaaaccaguaugaaaauaguuauuuugauaacaguuuccauuuuaucaacguggaaacugaggcuuugaaugcuugaguaaaugucugugcauuuuggaucuguaauugauuggaugccuucuugagagcgugcccugccauugccugugcuauauuguggcuuuccucugggacacugaacagacucuuccauguaggaucucuguuguaaaccguguuugccgucuaauauucaggaaguauuacguggguuucuguuguccuucuugugucugcucugcgcccugauuuugcugguuuaauuuucuaagugucugagguccacccuugucuccugccuccuccucuuccaugcauuugcauugcuucucauugauuuaaaaagauuuggauugcagucuuuguuucucccucccucccugccuccuucccucccucucuaccucucucccucccuuccucccucccucccucccuucuuuuccaccauguuccauuauccauucugucaucagaaaucuugauggaaaaugagaggggaugcggacuucccguaccuguugucccacgugaucaggucucagugcuuugcuuucuuggcuucauaccuacagauuuuaaauuaaacauggaggacacuguugcuaguuucauuguuauuuuuuuaaccacauuugcucaaaaguagcaguugucauaaguuuuguguuauugucaccugugaguuuguucuuuguucauguuucuguguauuugugaacaaaauaaaaugugauuaacuuuauaugaaauuaguuugaaguuggaaucuguaguaacuugccugcuuugagaauuccugguuuugaauuuuuuuuaauaaaaaaaauuguauuuacuuagaagcauucagaaugucaaaaacagccacaauuuuuuuuugcaauuacaauuacaguguucaguuaacagaacaacaauuaucuuuguauaaacugcaucagagacaacugaagaugaaaaaaauaaaacccaaaauaaaaccaaaagaaaacaaaaacaaaaacaaaaaccaaacuacuguccccauauauaacuauuuugugcuguguaccaauaagaaccugcuuuaaauuuccaugccaauuaacaacccccagacuguaccaggcaagguuaguggcuauugaaaauaccaccaggacagggcuaucuaaagacacauucgguugugugugaacuauacaaaaaaagacacugcauaguuuaaaaacaagucuuacacagccuuacauuucaauuuuuuucuuuaaaaggagugaguuguauacagggggcguuaaaugcuuuauagacaagaaaaaaaauugcgcuagaaccaacuauucaucaucuuccucuuuaucuucaccuuccucuuccuccucuuccucauccucuuccuccucuuccuccucuuccucuuccuucuuuuucuugcucuuuucagccuugaccacccccuuuuucacugcaucagguuuuccuuuagcucuguaggcagcaauauccuucucguacuucuccuucagcuuggcagccuucuucucauagggcuguuugucaugugcugcauaucucuccuaguuucuuugcaacaccaccaaaggagaagccaggaugcucgccuuugauuuuggggugguacucagaacagaacaagaagaaggccgaaggaggucucuugggugcauuugggguucuugaauuucuuuuuggucuccccuuugggggggauguagguuuucauuucucuuuuauaaugagccuugucagucuuugucaggucuucaaauuuccccuuuucuuuagcagacauggucuuccaccucucugagcacuucuuggagaacucugagaaguuagcagaagcauccgggugcugcuucuugugcuccuccuggcagauuugcacaaagaaugcauaugaggacauuuugccucuuggcuucuuaggauuuccuuugcccauguuuaguugauuuuccucugagaggcacagagucgcccagugcccgucggcucucacuugcccaggcgcagucucuuuggagcgcaauguacuacaguaguuccugguuuugaauuuuauugauaaugaggcacacagauuuauuacacuugaaugguaggaacauuaauguauuacugugacauuauauucucauuuuuucuuguugauaagaugcacuauuucuaguuuuucaauucuguaguaaauacuuuuuuaucucuuagaauuuaaaaaauaacgucucuagcuuuguuagauuguucaguuguccucauaaguguuauuacaauuuauuuucauaucccagcaaguuagauauguuuuaucauuccuaucauuccuauuguuccuuuuguaggcuugaaauuuugccagucuaugggaaguaugcuugcgcucucucucucucucucucucucucucucucucucucucucucucucucucccccccccucccccccccucucucucucacacacacacacacacacacacacacacacacacacacacacaagcuuaaaauccuuuagugguuauccucguucacaugaugaguuucuucaguagccaaacuuuguccauuuuacaauguuuucuguggacaguugauuccccucuaugacauguuuuguacuggaaauguugcuauuucuuuuuuucuugcauauuuauauucaauaugaagugacugcuauuaugugucuacuguauauuaaguccagguauaugaaggaaauucagaugaucucuucaguaaauuguguguguguguguguguguguguguguguguacaaguccauauccauguauauaugcaugcuguggaagccagagggccaccucagaugucauuccucacuugccacccaccuuguuuuugaacacaaggucuguuacuuacccuggagcucacugauuaguuuagaucggcuagccaaggaggcccagguauuaucccggcuccaccucuccaguguuaggagugcauauuagugcacacuuuguuguuuauguggguucuggggauuaaagucagguccucaugcuugugaggcaccuuacugagucagcuguauucccaguuccucaguaaguuuugauuuaaaagggaguacaggaaauuaaaaugacuauaauacauacacuuaugaauuuaaguagaacauaaacaauaaacuuucuuuuauauaguuauaacuacuguagaguucaacaugaagacacaauaacacacucaguaauagaacaacaacaacaaaaaaacccaaaaaaccuugaaaagcacuacaaacuaucuaugccagaagacgucuauaguauauuccacuucuaaauaccagaauacauauuccuaagugccuacaccauauacuauaccauuaaacaauaauaacaaaauccucaauacauuugaaaggacuugaauaugcaaaguauauucaacaagcacaaaggacuuacuuuuuguugcuaagguucaaacucauagcccugguggguuucagccaucauagaaaaaucuaaaaauacuuucagaucaauaaaaaugaaaacacaacauaauaggguguauaaagaauacuauuaaaguaaugaugaaggucaacuuaaagcuauaaauaccuacauuaaagagaugaagcuaugagugguagugcacaccuuuaaucucagcgaucgagaggcagagccaaggggaaccaagaagacauuaugauuccagacaagccuguucuacauagcaaguuccagaucugucuaggcuacauggugagacccgguuucaguccauucaucaaucacucagucacucaaucaauggaauaaguaaagagaacaggcuaugguggugaauguaauguggcugugaggagccugagggcugaguuccaaaaccuugcagagaaaaggaaagagagcucaagccagccucccuaucacaccaggaaacaugggaaagaaauuaagucagaagaggagaggaaguaaaaaaggcagauagaaaucaauugaaugucgauuuuaaaacagggguaaaguauucaaagccccaaauagcaguaguaauaauaauaacaguuguuuuuuuuuaggaauaacaaacuuuaaggcgguuuggcaaaagcaaaaggaggugaacacugagauaaaaaaaugaaauaguugcuauuuugccaacuuuaaagaaaugaguuauagugaauacugugaacagcugauuacaaauguuccuuaaagacaaaugucuggaggaacucauuaagguacagaacccugaauagacguguaacaacaacucaugagguuguucauaaccaaaggcugccucaaagagugcagacuaacauaguccccuaguuaauucuaacaaauaguagauaaucaaaguaacuggaaaagaauaaucuuuuaaaagcucauauuccuauaugaauauggacaaauacuaaaauuaaaaaucaggcaaaagaacugaacacuguguaaagccaaguguaaggguucagggacacugcuuaaacuuguguuagacuugggauggaguuacuggccagggaaggugaccacaccaguaagugugcagcauacaauaauaucacacuaauaaugucccuaacuacacaagagaggauucagaaaauauuugagcccagcauggugugguuuaugccuauaauuccagcauuuaggaguuuaagauaggaagacuacaaauuugaggcuagcuuggacuucaaagcaaauucuguguuggccugaccuauccagcaaaacacugccucaaauggaaagaaagagaggaagggagggagggacccaaacuauucaauuuguuugaaccaaccaaaacaaaccaaaaaagagaaaucucugauuuuaaaauaauaucaacacuaaucuaauacuuuaaauuauauguaacaaaagaaguguaaaguuuauaaucugaaaacuaaaaaauauuguugcugggugguggugacuuauguauccaaucccagcacuuuggaggcagaggcuggcagaucucugaguuuaacaccagccuggucuacagagcgauuuccuggacaagcaggaauacacacaggaaaacccuaucucaaaucaaacaaaugacaaaaaacaaaaagaaaccccaaaaacucacaacccacccccaccaaaaccaaccaaccaaacaaacaaaacaaacuaaaaauaaauauuuuugggcuggugagauggcucaguggguaagagcacccgacugcucuucugaaggucugaaguucaaaucccagcaaccacaugguggcucacaaccauccguaacgagaucugacgcacucuucugguguaucugaagacagcuacaguguacuuacauauaauaaauaaauaaaucuuuuaaaaaaauauuuuugaaagauguuaaaagggcccuuacaauggcaaagaggauccauugaucuugcguuaggaaacuuauguuggcaagaaggaacacucugcaaguugauccauacauugagcacauugucugcuaaaaucucugcuuucgugcuugcaggaauugacaaccauaucuuagcauucaggagauaagaagugucuagaagaaccauaacauaacacacuuggauaaaaauggcauaggaagggccauauuuuaauuuaaaaauuuuuacaaaacaacagugaagacaguguguggcauguccaggaacagccauauaggcaacgguggauguuuggaugccgcucugaacacugauuuuuugauaaggaugccauuaaaugggaagagggaggcugucagugaauggugcuggacaagcgcaccaccagugaaggauuguacuuccuuugcuuuucaagaaggcucucaaggcacugggaggcucuggcuccagaggaggaaagacauguuacugauuuauaaauuggguggugccacacacucacagucugccagcgauuuacauccugacacuuguuaacauuauugauagccucauuuucuguucauuuaaguuguccuuauuugaaggaucaguuacaugaucauuuuguauauagaacacauucagaaaugggagauuauagaaauaacuccuuaaaacuaggcaagcauccuuucuguuuagaccauuguuucucaguauugaguaaaaaccguuuuuguaaacauggacgugacuuaucuggguaccauauuuuuauaaauuugugggauaacaggauugccuuagcaaagcaguacucauugaugucuuucaaauugccagaaauaaaaacaggagucccaguuuucugugugugccuuucuaggguuugggucacuggguguuucugguccaaugucuccugcugucgaguccacacguggagcagcagauggcauucucucccugcaguugucagccucgggaaccgugggcugcuaacagcuacugugaaacugauaggaaagugcuuagagagacggugagucuggaaaucauaaauuaacugcuguuuccagguacuugaauauauuuuaaguguuaguaaaauuuaugauuguguuugauaacacuguuuuuaggauaaaagaauuuucauuuagguuagacuauaaauagcagcuuuaaaacauuuuaaauaguauuuuaaauauccuaauguagcaaacaucgaggaguucauagaagcaaagugccaaggauauuaagauuacauuucgaaguuuaauuauuagggaauaaugcugaaugacuuuggggaacuuuuuaaguauuuuaaaaguuuucaaaguugaauucuggcacauugucagguugcuuaaauucuguaaauuuauuauaguuuuuuuuuuuguauauuauuugaccuaguuaguuuuuccuucuuggcagauaauaguaauaguaauaguaauaguaauaguguaaucaauugguuuacagaauugcuuuauuacaaagggauuuguucuuuuucagcgauccauaaccuuaaaaaauguucaggaaagcaaagggccuacauuguuuuauaauuuuuaaaucucuucacuguauaaauggaauugcuaaguuaaacuuugacguauuaacuuccugaguacauauaacuguugccugaaaaauauuaagcaguagacaagaagguuuagagcaaagaaaccugcaguugaaguuuuagcagccaugugucacuaagauuaugauauucauuggaaaaauaucugaugcaaauuggaaagacauuggauucuuuuuuuuuuuuuuuagaaguugacuuuuauuaucugucaugccauuaaacauaccaucacuggacaccaaaucccaugugaauuuuacaguuauaucucccugaaaacacauuuucaccuaaacacauuuugauaaaauugugacucuucacaauauuuuaaauccauguuuuguucucauuuaaaauuuauuuuuaacgauuacaaaaucuaaaauauucauaaauuuuugagaacuguggguaaauuauacaguacaaucuuauauuacaaaugacuuuuuguauucucuuggguacuuagauuuugcugaugauuuuacaaaguuaggcaguguugugguauuucccgcaacaaggcagagaugacaauuucuucuggaguggacuuucaaguguacuauuuucuauuuauuuaccauaacuuaggaugauugaauuuguaaauggcucuaagaaauugaguuagaaaaaauaauaaaguaucagggacuauauuaacuauaauguggcuuuaaauaauuuuuagcacuaaucauuuagcauucuauaauguaauauggaagauauaucauuaauaaaauuauauuucuuaguuuuuucuacauauugguuguaauuuuuuaaaauugggcuugagucucaauagaaauuauguacaagauaaccucucccaacaauccaaaggugagaugcaugguauauauaguauauaacguuuuccuucagaaaaccaauuccauguauuugauaguccuuucuacugggcauuaguagguaauguuuaaaauucagacacuccuaaaagcauaguuuaucuguugguaagaugaaaaagggaaacauucaguuuugaaguuuuggcugggauucugcucuucaaaauauucuaguugcuuaaaggaaagucgagugugaauaaaucauggaaaaaacuuuguuuuguccaugauggagccauagacagaucugaauaccgacuagaaauaugucaaaguaugagugcugccucucuggguggauuuguuuucuuuugcuuauaacccuuuaauguaggcuguugaggggaguccaagucagagugaguccaccauccuugugcuccagaaaccugaagccgcccucugcgagaaccccucccagcuguguuuauuccucuuugacugcugaggcuccaguacauagucucaugauuugauucguauuuaauuggcaagauaaaaauucaaauuaauuugcaaauaagaguuuccaaaaggagucugugcuuuaagacagugauccuauaguguagacuuuuccuacauaccucccugaggaguacuaggcauuauuucacuuuuuuguauaauuagaagcuuuuguauuaguuauuaacugcuuauguacuagucucuuagaauuuugcacucagugguuagagcagggguaagcauggguacuagucugacuccuaacuuuuugagugaugaguaugcucaguacaacuuagugcaacaguuugauauuacgaaaacauuuccugauauauauuggggggcuuguguuuauuucuucuucaacuauauacuaucuuuacuucugauuagugcuuuuaucuaauauacaaauaggaaaacuaacauucugcuucuuaagaacuaugugggacuaugaagccaaguugcaggugaugaacaugacuguauuuaguauugugauagugcugcaaacaauaaaagccagugcagguggcagcgcuggcuuguuguucuagcauuagagcaauggguuccuccucugcugucaccuagaaagaaucugucggauccuaaauuccaccuuguacucauauauuucuaggaaaucugguaaaguccaacggaaaguacugcaguaugauuguucagucuagaguucugacuuuguucagcugacacuaucuaaucuaugauauaugguggucagcuuauuaaauaaaauguaaaaaauauuaucagcaauuauaacuucauuauucuguauucacagucuuauaaagguagcuuccacauuacauaaauggcuaagugcauuuuuaauuccuacugacuucagaaaaaaaugucuguucuguaugucuacuuuguccauucuaggcaucucuagguuacacaguacucuuuacugcuguggcaacagaacagauaaauacaaaccugaguggagugaaauauaauaguuaauuuguaagucuguuacauuucauuuucuuucugccccaugacuggaccagauuuuuguuuugcuuaaacaaaggauagaugagcauugugaaaauguuuuuuacuguccuaaugauuaaugaucacagaauacuuuugaaagauuagcauuuuucaaagcugcuaaaaaauauacuguuuuauuuaauuacaagaaaguaaaggcuuuucacacugacaggugguggaaauuagcaggcaguuuugaaauugugcugugcacgagaaauuagaucucauuuuaauucugcuuuucucaacuagcaaaugagguuaaugccauacauauucagcugauauggaugaagaaauugauauaaaguagaucaacauagcuacagggcuagauuaauuuauagguaaagaggcagugauaaaugaaaguaauguaguaguggucacuaaacuccucugccaugagggauucaauagcguuaguuccucauuaaaggcauugucggggugcaucaaauagaaauuugaaaaggaauagccaacuaaccccuaauuaucaaaauacagaaaauacuaauuauaccuuaauuagcuuuucuuuuaauguacugaaauuuguuacuuuuuguguggcacaaauggauaguuauaucaacaauaaauagguuguuuuaauaacuuucuuuuaccucugggaaaacuacacuccaauuuuuaauaugcaauaaugcuucucucuagccuguaggagaugaaaauuauuaaguagcuuuauuuuuuugaagauuuuacagcagcuuugggaagaauuauuucaccaugcaucaauuacuuuuaauugaacugaauauuuuucagauugcaccaaaugccucucauuuaaguuucgcaguuagaguuuaggaaaacagcauaaugaggguugccgauaaccucugucauagaguguaauaaauaaggaugauuauuuguuuugcucaggcuuagaaacagcucaagauugaaguuguaaaaucuaggcagucagucaccuuaucugguucgucagcauggagauguaaaggcuauguauucaugacauuuuguucaugauucuuuuccuccugcuaacuaagguggguuuucacagucuaguuaagaaagggugaccgauuuagaauaaagagauacagugucacaauggggaagccacuuggguuuuagugugauuauaucuuaaggcagcucuaggcccuuaguaguuuuugcugcucuuggggaauucauaagcgcgccugcacauuugcugcuuugcccgucagcugcagugauacuugauguuguggugauuaaguaaaauagggcagaucccuagcauuacauuuaacgcuccaaaauaauaguugcugugauugauaauaagaaagcucuuaaggaaauucugucucuugcuacccccuaccccccaauuuuaaauaucaugaaacuguuuuucaagggauugcauguaaucagggcauuuaagauaauuaucaaguugcacugaagacuauauaaauuaccauaaguuuauuguuugucaaagaauuacaagggguuguagugaggcuuucagaggaccuaaguugauguugccuccuagaugugccacauauaauugggaauuaaagcuagauagucuuauucuaaagccauaacucaagaaaaagagaaccgugcgacuugucaccuccuuaguuugcagcgaguccagaugucugcagaccucacugugcugcuugugcugagucccuggccucccgcucagccuuucugcuguuuucuuacccucuuuugaaggacaguaaccaugaaauaguguucaucaacaacauccaucaagcuaaaccucucuuccuuaguuuuccuuauugguaaaauucucucugucuugcucauuuuggugauuguacuguguuaugacuguuuuuucaucagcuuuaaaacuaaacuaacaauuuggaaggaaaaaauaaauaagucacccaaagaauagagcaggaaaacauuucacaaucauuggaaacauuacugaacuaucuuucaaagugaaaacccaaugcuuuaaauaaauaaacaugcaaacaaauaaauauauauggaagaagucguaaaccacauugccuuucaccuguuuacaaaguaaccgugaucaguggccccaagccgggucacuggaaacuuguugaccacagcuucuaaugcgcuccugcacauagacccagugacucagagcauccaaggcuguguggccuuacaaacuacuugggcacuucugguuucuguuacaguuugaggaccuuugggucccuuacuugcagacagguggcugguucuaucuuguuuccuuugaccacgacugggagggaguucgggcugggucuggaguggacggccuucagccccuuuagucacaaugcuguaaucuuaacugaaaaugcagagaaauuuccggcguucuagcggaggaaaauggcugcgccccagccacaggcugcagcgguuuccucugcgucuggugugucaggcccggguuccggguccccagcaacagccgcaaccgacccaguugguggguucugcccagagcgggcuccugcagcagcagcagcaggacuucgauccugugcagcgcuacaagaugcucaucccgcaacugaaggagagucuccagacuuugaugaagguugcagcccagaaucugauucagaacacuaacauugacaacggacagaagagcagugacacacccuugcagcacuuugacaaguguuuggaggaguuuuacgcacucugugaucagcuggaacucugcuugcgccuggcccacgagugccuuucacagagcugugacagcgccaaacacucuccaacacugguacccacagccacaaagccagaugcagugcagccagacagucugcccuacccacaguaccuggcugucaucaaagcccagaucaccugugccaaagacauucauacugcccugcuggacugugccaacaaggucacuggaaagacuacugcacccucuacuggcccugggggcagccucugaggucuuucggggaggggcaaagaaugaaguauggccugaggcaaaacaaaagaaaaugcagagaaaggaagugcagcaaagggcauuugacugucacauguuaaaacacugcacuuaaauauuccaaggcaaugguuuaggucaauagaauuuguguuuugcuggccaaugacuaaaaaaaaaaaaaaaaaaaaaaaaaaagcauuugacuauacauacuguauucuguaaagacaaaauuguuuuaaaauaaaaugucuccuuauuuuguuguuguuguuuuaggaaauuacaaucugaaugaaccagcaucuuuucuguucuuguuaugucauuacuguaucaagaaugugauuauguguauauuuucagucaccucauuagccuggcacucgaaggcuaguuccuccccacucccauaccccccagccucacccccccacccccguaggaaaugggacuaauaguguuaggaagauuugagagucaauggauauguauugaaagugauuggcacagugccucacaugcugguguugagcucacuaucuguucucacgcucauaacaaagcguuugcuuucguacuucgguuuaaccaguaccagcacuguucuuagaguuacagaauguuagccugucuuuauaucagcaugagcagagcucauaugaacucacagagacagagguagcaugcacggggucugcauagaucuaaacuagguccuuugcacauauauuagguuuuuccauucaguguuuucauaggaucccugaaugugcaaaugaguuggucucugguucuuaugccuucucuuguacucuuugcuuuguguuggcucgucuuguacauaaguucuaugugacuguuuuugcuuuauuacauuuuauuuuguuauuuuuaaagaaaugaaugaguggaugacaaccuagccacuaggguaaacauuaacaacuaaauuguuauuuauuccugcugggaaagggagaaucaguuuucugggucuaucaacacugggcauaucaaccacuccaggacaggccuugugugcaggaaucuuugaccaacauuuaauuguauuccaauguguguguguguguguguguguuuauuugguuaugguuugguuugguuuuuccuuuguggauguggugucauuuuguuuucuguggaguuuguuuuguguuggguuuuuguuuguuuuuuguuuuguuuuuuagaaagaacauaaaguuggguguguagggaaggggagaggaucuggagggcuuuaggggagaggaacaauaugaucaaaauuguuugaauuugaaaauugucuuaaaaaggauauaauaguaaucacacaaacacauacaaacccaaaaacgguuagccuagaagagguuguagauagauucuaaaugaguauuuucaaacuguuuacuucaaacaggccucugugaguaaaauuuacugaaucuguacuaguuuuagauuuauguauuuuacuuaauguauaaccugcauguauauaugugcaccacacaugugccauuuggauucccuggaagaggaguuacagguguuucugagucacugugugggagcugggacuugaaccuaagucuucugcaagagcagcaauugcucuuaacugacgagucauccacucuccaaucugugugugugaggguuuuucccccagugaaaugaauuugaaaaacuagcacagauguagguaguauggaaauuucuaaugcauguuuacaugggucugaggagacccugcuugaacuaguucaugucauuuuaggaaauaaauggauaagaugccaguauucuaaacuuaaaucuauguaugaaagcaaucauuuaagaauuuauaccugaauucauuugcugguauuggugagaaucacguaaccagucacugucccucuccaggucucagcagcagucaggugcugcaggcaugcacagugguaaagcacucaccaaguccucucuggucaggguuccaucuccaucacaggagacaaaauaagaagaugggaaaaguuccaaucaaauaaucauugcaucugguauaugugaaagugucuacuuucuaaugaauauucauaaucaaaacauucaauuacagaguacaguuugggagaaguaaaugaauucagaaguuuauugucauaaaaauuuuuaaucugguuugggaaugucauuguuugaauugagacauuucaaaaauuuauuuuauacaucucuuuaaugccuuggaauuuauggcugagcucccauuagccuaagaagcagcucagggagucccagcagagccggauugauugggaggugacagaggacugcccucaagggugugcagaccuggagaacuaugauugagggguagaugcauccucugagaaguggagaaaaugggauuuagagaugagaaugagaguugucugaguuacauugauauaaagacuauuguuucccccagcuaauggcagagccaguaucagaucaccagaggagucugcuugucagcaaguguucuccaguguacacuacugugcuucaaacugugguguccugccagaguguccagaccugugcaugaggaaaggaccuuguuuccugucuuucuggcuguuuuaaauuagagauuugcaaaaaggaauacauuuuaauauguuggccaauuuguugauacacacguuuuguuucauauugcccaguagaauguauuguauaagaaucggguuggaagugcuagcauaguauuuuuguucuccaacuuacucuguaauccuacuuuuccuuuauguuuuaacugcaaggaaaccaaauugagucggggugaaaagaccucuucucaagcauuuauuguuucuuugugguaauaacguuacuuauccugucuuaguaauguaucugaaauauacaagauaacaaucugcaguuaccauguuguucaguguuagccaguguuucuccaccucuuccucccuccuuucuacauugcccagccuguuguagucaauguuuccucuuaacuucuggaaggaauuuccuaagauugcccauuugaauugagacuacauggcugcauuucugugucugacuaguuuuguucuaagaacagcuuaugugugaaguguugccucuagcaaucuaaagguuggcaaaaaugcuuggaccaagacccucugcguuacucaguuguuacuagaucugaaucaugccugaaauuaauuuuuucugaaagacaaggauagcaguaucggugaaauggccaaaggaauguaaaauugcuuaugaaaaucugagaugaaauaaaacuggggauguacuggaggaagcaaaagugguugucauaaagucaguuagcaguuauuuggagucgggaauuugguucuuucaggcucuuucaggcucaucuuuucauccauuagacuggauagcugacuaugaagaaaguucuuccguuguuacaauuugccaagaaguuuucacacauaaacaguagcuaagacagaacuuaauuggguaggguuagucauguuagagaacauucacucugcaauguaguuagguuucuggucuuugccuaauaucuaauccuuuuuaugaugauuaaaaauuauucuaaagcuaaaucgucaaucaugacuuuuaacaaaggauaauuaauucucuaauuuuauaaaaggaauaagaguuuuguguuuuuauaaucauuucuuugaauauugaagagaauuacuagacgaaaauuaaggaagacaauguuugcagaauuugaggcugagggagagguuguugaauauaauuucuguaauugucagaaguuccuagagauauggaagaugaccugaaaaucuacauucgaaaagcauuacuuguggucuguaggucauuguugaaauauacuuggaucauuaauucagaaguuccgucuuucaguccacacaguggaggucaaccagggauagcucuguuucuuacaaauguauuucuagcuuuauugauuuagguuguuucuuuaguuaugcaccaauucuuugguuaaccaaauacuacuugacauuccugucauucugccuuuuaguccaagcaaacaacaaacuagaacauacauuuaauauuuuauuaggcuacauggaacaaauauuaaccauaauaaguguacaugcaagcauggaguguuacuucuagcacuguguauguagaggcagcauaaucaggaguucaaggccaccuucuuucuacacagcauguucuaagcuaaccuaaccuacuuaguacuaugucuuuaaaaaacauuuauccuguuugaucuaguaauacaacauuuaggaaucucucaggaauccucacuccuucuugcauuauauguguuaguaguaaauuuaguuuaaacagacuuguagcuaucaugggaauucagaaaauuauuugagaaauguuuuaauaugauguaaauagaaaguaguaugcaauauuaaauauguaauaagguuucaacuguaugaaaaaagaacaaaagaauucuaaagaaaugagccagcuagguagugguggugcacgccuuuaauccuagcacuugggaggcagaggcaggccgauuucugaguucgaggccagccuggucuacagagugaguuccaggacagccaaggcuauacagagaaacccugucucgaaaaacaaaacaaaacaaaacaaaaaaaaaaaaaagaagugaacccaaaucuucauuuucuuuaucucucaggacaauuacaguucauuuuccuguauucuuuaguauuuuuuauaaugaucauaaaucacaguuugauuauuuagaaaaaaaucuaaagaguucacacucacuuuucaaaucaccauugcuuugguaguaugcugugauaauugaaguguguaaauuucacauuaauuugguuaauuuuaguuauacaugcaugcacaccuuuuaaguuacaguguuuuauuuuaauagcucuguuaggaaaauugucauuucacaugcuuagaaacauucaugcuguuuuuggaguugagauguuggaaaaaaagauacagaaacugauuuauguaaucuuguuauuuuuaaauauuucauucuuaagcauauaugcuauguaugaaauauuucuuuaauaauaguaauauuauuuaaaugcauucauuaucaaaaauauaaucacauaaaaauaguacaguaaaaauacuaguacuugggaagcugaggcaagagaauacuacuuaagccuacagugaguucaaggccagcguggagaacaaagagagcccugacacaaauuacuaaaacuaaaaucaggcccagagauugagcucagugguagagcauuugcuuaacauacacaaaguccuaggcuuaauuuccagcacugcaaaaacaaaauaacagaaaaaagauucuuaaauuagauagcauagauccaguaaugauuccuuuuaaccugauggcccaacaguucuauugcauaaggcgacugguauuucaaccacuacuaauuaaaaaacaagccuagugacucgucuggcuggcuuuacuccaguguuaggugucugucuggaaccuugcugcugagaaaugauaucaaguauugcaauuucaaaggaaaacaaguuagaagguugcagguucaguucuguagauuuaaauuuauauaaaauaguuuuauuuuccaagaaaagucaaggauuuuuaaaaaaucauuuguaucuuuucuauacagaaaaugaaugaucauaaaucuaaauaaacgugcacugaugugacugcucucagcuucccuuuuaagugucuauaagcuauaauggcaugguaacguuuagaaguagaaaggacauucagaacucaucaggcuuucugugccaggcuuuguggccaacccaguaaaucagccauauggcugucucagacccccacaugaguugaaaaccacaaauaagaaacuagggaccugaaugcccucguguugguuacaugggggaagugcaguuucuccuguagugacuggguuuccuuguaucuuggcuuaggauuagaacugcagguugguauuguaaaaauggcuaucuugccaaaagcaaucuacagauucaaugcaauccccaucaaaauuccaacucaauucuucaacgaauuagaaagggcaaucggcagauucaucuggaauaacaaaaaaccuaggauagcaaaaacucuucucaaggauaaaagaaccucugguggaaucaccaugccugaccuaaagcuguacuacagagcaauugugauaaaaacugcaugguacugguauagugacagacaaguagaucaauggaauagaauugaagacccagaaaagaacccacacaccuauggucacuugaucuucgacaagggagcuaaaaccauccaguggaaaaaggacagcauuuucaacaaauggugcuggcacaacuggcgguuaucauguagaagaaugugaauuaauccauuccaaucuccuuguacuaaggucaagucuaaguggaucaaggaacuccacauaaaaccagagacacugaaacuuauagaggagaaagugggaaaaagccucgaagauaugggcacaggggaaaaauuccugaauagaacagcaauggcuugugcuguaagaucgagaaucgauaaaugggaccucauaaaauugcaaagcuucugcaaagcaaaaggcaccgucaauaagacaaaaaggccaccaagagauugggaaaggaucuuaaccuaucccaaauuggauaagggacuacuauccaauauauauaaagaacucaagaagguggacuccagaaaaucaaauaauaaccccauuaaaaaauggggcucagagcugaacaaagaauuuucaccugaggaauaccgaauggcugagaagcaccugaaaaaauguucaacauccuuaaucaucagggaaaugcaaaucaaaacaacccugagauuccacuucacuccagucagaauggcaaagaucaaaaacucaggugacagcagaugcuggugaggauguggagaaaggggaacacuccuccauuguuggugggauugcaagcuuguacaaccacucuggaaaucagucuggcgguuccucagaaaauuggacauaauacuaccagaggaucccgcaauaccucuccuaggcauauauccagaagaugccccaaccgguaagaaggacacaugcuccacuauguucauagcagccuuauuuauaauagccagaagcuggaaagaacccagaugccccucaacagaggaauggauacagaaaaugugguacauuuacacaauggaguacuacucagcuauuaaaaaaaaugaauuuaugaaauuccuaggcaaauggauggaccuggagggcaucauccugagugagguaacccaaucacaaaggaacucacacaauauguacucaaugauaaguggauauuagcccagaaacuuaggauacccaagauaaaagauacaauuugcuaaaagcaugaaauucaagaagaacgaagaccaaaguguggacacuuugccccuucuuagaaaugggaacaaaacacccauggaaggaguuacagagacaaaauuuggagcugugacgaaaggauggaccaucuagugauugccauaugcagggauccaccccauaaucagcuuccaaacgcugacaccauugcauacacuagcaagauuuugcugaaaggacccagauauagcugucucuugugagacuaugccggugccuagcaaacacagaaguggaugaucacagucagcuauuggaugggucacauggcccccaauggaggagcuagagaaaguacccaaggagcuaaagggaucugcaacccuauagguggaacaacauuaugaaauaaccaguaccugggagcucuugucucuagcugcauauguaugaaaagauggccuaguuggccauuaauggaaagagaggcccauuggacuugcaaacuuuauaugcccccuguacaggggaaugccagggccaaaagggggaguggguggguaggagauuggggugguggguaugggggacuuuugggauagcauugaaaauguaaacgaggaaaauuccuaauuaaaaaaaaaucauauucugaaaaaaaaaaaaaaaaagaacugcagguugguguggcagauuccgugucacccacuuuguugcugagaugagaguaucugagaauaagccugugguaaaucucuccaucccaaaucugccccagcaaugaaaacacaacucacuuaauaugaauacaugcugugccucuagauuggacagaucuaccacuacacuaccaucuuccaccucuaugagaccccuuagaacuugugguaccuccaggcccugugcuucugcuccgcuuuucuucuuccuccuccuccuccuccucuguguccucucccucuuccauuuucuccuccuccucucuccccaccuuccucuccaccaucccuuuuaucugcccaaucagcagcucuccuuuauuuuacaaauuaaggugggaagcagguuugugagacuaugcaaacacagaaguaggugcucacaguuagcccaauggaggagcuggagaaaguauccaaggagcuaaagggaucugcaacccuauagguggaacaacauuaugaacuaacuaauagccccuggagcucgugucucuagcugcauauguaucagaagauggccuagccagcuaucaguggaaagagaggcccauuggucgugcaaacuuuauaugccucaguacuggggaacgccagggccaagaagugggaguggggggagggcaugggggacuuuugggaaagcauuggaaauguaaaugaggaaaauacccaauuuaaaaaaaaaaaaaagaaaucacuucagugcugacucauuccuuggucacagccacucacuggagaauggaauuaacaucaaauauaauuagcuccagggcuagccacaacagccuuguaauugauggcacugaagauagucuccccaaaagucugucagcauguuagagauuuuuaaggugugagcaaagacgggauuuaaagaauauugaugcuagaucacuaggauauacugauuuuggagaaggucagaaaaguugugauguaagaaauagaaguguuacuuacagccaucugcaugcuagguuagguucugugcuaguccuggguccaggaggcaaugccaauugcauauaacucauuuuccagaaucuuaauuuaaggcuuuuccucugucaauuccccaaaaggggcugacaaaagacaguuuaaaaacuuuagacaggcaggaauguagugcacucaguagaaugcacauauaaaaugugaaaggcucggguuugauucccagcucuauaguauuauaacagcaacaacgugaguaacagaucugccuagagccucauagcuauuaacuucuaaagagcaaagcagaauguccaccucugcuuucccaguaaaugauuuuuaccuaguuaucauuuucuaaaccauugcaugaaacuguuuuucacagguagagcauauuaucacagauagagccuaauuaccuuucuaagaauauuucuguauuuguaaccaggguccugaugcaagcuaccagggguuuccugaucauguauuuuuacaaugaaaauuaagcaguuauaaaaaauaaauagcuaaguuuuucaguugucauagcuggcuuuguuucaugcugcuaauaaugucauguggucaagcaucagcacugagggucgccuccauuaacggaaaccuaagcuguguguacuucugucuagagccaaugucucugugaagcugcgucuacacuacuguuaaaccauaagcaauauuuuuaagcuaauaauugaaugauucagaauuuauaccaucuuuuuuucaaccauaaaaugaauacuauauacauucauuugauuuuugugugcuuagaaaaauacaaacguuuucaauaugauugaaauuguaacuugcgagaaaugaaaugaauauaauugcuauuuuuaccagaacguuuuacuuugguaaaguaugcaucacauaaaauugacugucaaguuuguaguuguuugcacuuuuguuuguuuguuuguugagauagguagggucuguaguuauggcucucauggaacucacucuggaccaggcuugucuuaaagucagagaucugucugccucugucuccugagugaagggugagcagaacuaugccugcugucuaucaaauauuuuuaagugugugugucagugagguaaauucucacuguugugcaaucaucucacauuucucucuggaccucuuguaaaacuaagucugggugauccagugugcaccggcuuuccacgccugcuucaucuuuggaacaguugccuuaacacugggucuccaugaucugauggcuuuaggaucuuuauauaagugucgcuauuuaauguuugcuuuuugacacaauuccuuuuaaggaggaucagauacuaguguucuaauaucccacacaguacuuaucuuuuuauucauugauuauaguuggauuguuuccaugguuuagcuuuauuuaauaauacugauacagauauagauauuuaaauaucuccuugaaagucugcuuuuauuaccaagaaguauacugcuggaucauauagggguuccauguugaaguuuuaaguaggcacaguuugcccauuugugagguacagugugccauuucaguguguaugugcacuguuuacugaccagcaggcuauuggacauauccaucacuucaaaccuuucuuauuucuucaugcagaggguauuuaaaguucucccuacugaaaguaauuuguaauuugucagaucgguaagccauguggaaccgaaggagucuguucuccuguaccucuuguacacagagcaucucccuuucuuaguggcagagccccuguucugcuccuccucuuugagcucaggguuucuaguuucacauuugucucucugugacugaugucaccucacuuaguguaaugacuuaugcaucuuggacagacauuacaggauucauacuuuuuuauggcugaaagacauuucaagguucauacauucugcauuuucuacaauacuuuguuaguagauaucuaaguugacucccugucuuggcucuuguaaauaguuauguuguuuuguauuuaauuuuugagauccaaccauucuaauuuuacaaccucaaugcaaguuuucuauuuucuuuuauugaaguucuuuaugcauaaaaauaaacaucacccucaugguacaguaaucaggucuuaacuuggaagaucuuuuggcuuauacugucaacagucugguuuuguuuguuuguuugguugguugguuggguuuuuuuuugcagccuuugcugccugugcgcaugguagccacauuguguuuuugacagcuacugcauagagauuccuugagguuccuccaggguuccuuccuaaccuguauaacuuccauguuaaggcacacuguaggcugccaggucuucaggucuuuggauuuggaguaccaugucuuguguguggccugguggauaugugcaaagcuggugcaaggaauauacucaguaaacuuacugcccucucugcucuuuauaugaauucugaauuuuguaaggagaaauauuuuaaauuuagauucaagugggcaugauaucaacaaauaggacaaguaccuuaggcaacuuaccuaacuucucuuuuuccaaauaaaaccacugugccagauuagaagagcuagaaauaguaacaaagaauaagagcuucuuguguucucuaaaucuuagcuauuagaucucauuaguuaaagaaccuugggugaguuaaguauugauuuaucuuggguaaaaugaaaggacucaacuagauuaggagaaaugagucuuccgaucuuuuuaauaauaugcagguauuuuuauuuugugcccaucuugggaaaaguauuuuguguucaacagauuuguaaaauuacuuaucauucuccaggaaggauauacuaaggaugaugguauacaaguucuuugacaaugauaaaaggucguaauuauuauacugcaucucagugcaacuagaauaggaaaauuuuugaugugacagggcagguugguaagccaguagaggccuccucuucugaggguggggcuuugaucgggauuuaaaugaauaaauaauuuaaaggagaaaaaaauuagauuuucuaagacguugguauauguauguuuuuuuuuuuucugaagguaaucauaguuuuuuuuauuaauggcagugauggaguaguuuguaagcauguaucaaaugaccaucuugcugaaaaaaaugccaacauuuugauagagacauuaacaaaacaacuugaugucagucuggagacugguacaaaauauauaggaacuccaggguagauaugcuuugaaagccaggcuccuuuguguguggacuccacacuccacagcucuuugguuuuaacuuugaggaguguggaggaaugauucaaggcauauccaucuuucuuuuuacuaaguugaaaaugauacuuugacagaucacagcucucgaaauugagaagcaucguggaaaugaagaucuucagaucgcgaagacaagacuuauuacagaguuuucugccaaguuucccuuccccaguuucccuccugcacugcuacacaccuacuuucaaaucgcugauccuccacacuucuuacccgucuccucccauaucugaacuggccucccucuccccucccaucucuccucccucccaggucccucuaucccucuucuuuguguuucuccucaaauguccuuaauuauuccucagauuuaagaggcaacugcuagauggagcauucuuguuucacaguuuuauuuuguuuuguuuauuuguuguggguuugugugugagugugguuuuguuguguagaucagaguggucuugaacuccuacagauucucuugcuuuugccucccaaguaguggaggugaggcaugugccucauccuggggaauauuuuuauauuuauagacauaucuauuacuuaacaguauucuuuguguguaucuaacuuuccgugugauauuauuuuuaauauuuggaaagcuuuuuuaaaacuugccuuguauugcaaaucuuauggaaauagguugugucagcuauuuuccuucuagcuaaaacguuauuuuuguucuuagcuuuuaaagauuuauauacugcagauaaaauucuagcuuuguauuuucuuucuuucagcuaucuaaaagacauuccauugucuuugggcuuucauaguuaggaaaagaaaauccgugaccguucuggaaguuuguucaggaaguucaagccuccuaagucuguuguguguucucccauaggugagagcacucugcugugaaguagccuccaauacuucagauugugcuccguccuauuuuuaaaaauauuuuuuauuagauauuuucuuuuuuuuuuuuacauuucaauuuccuaguuuucccucugaaaaucuccuauacccuccgcccucccuaugcucuccaacccacccauucccauucccgguccuggcauuccccuauacuugggcauagaaccuucacaggaccuagggccucccaucccauugaugacugacuaggccauccucugcuacauauacagcuagagccacaaguuccaccauguguuuucuuugauuggugguuuaguuccaaggagcucuggggguacuggugaguucauauugauguuccuucuaugggacuucagaccccuucagcuccuuggguacuuucucuggcuccuucauuggggacguugugcucuguccaauggaugauugugagcauccacuucuguauuugccaggcagucgcagugccccucaggauacagcuauaucaggcuccugucaguaggcucuuguuggcauuugccauagugucuagguuuggugguuguuuaugggauggaucuccaaguggggaacucucugaauggucgcucccucagucucugcuccgaacuuuaucucuguaacuccuuccauggguauuuuguucccccuucugagaaggauucugagcuucugggcuaauacccacuuaucaaugagugcaucucauauguguucuuuugugauggguuaccucacucaagaugauauccuccagauccauccauuugucuaaauauuucauaaauucauuguuuuuaauagcugaguaguacuccauuguguaaauauaacacauuuucuguauccauuccucuguugagggacaucuggguucuuuccagcuuuuggcuauuauaaauaaggcugcuaugaacauaguggagcauguguccuuauuacaugguggagcaucuucuggguauaugcccaggagugguauugcuggaucuuccgguagagcuauguccaauuuucugaggaaccgccggagugauuuccagagugguuguaccagcuuucaaucccaccagcaauggaggagugcuccucuuuuuccacauccucaccaguaucugcugucaccugugcuuuugauauaagccauucuggcugguaugugguagaaucucaggguuguucugauuugcauuuuccugaugauuaaggacuuugaacauuuucuuaggugcuucuucagccguuugguauuccucuguaccccauauuuuaauaggguaauuugguuuucuggagucaaauuucuugaguucuuuguauauauuggauauuagcccucuaucggauugaagauugguaaagaucuuuucccaaucuguuguuugccuuuuggucuuauugacaguguccuuugccuuacagaagaagcuuugcaauuuuaugaggucccauuugucgauucuugaucuuacagcacaaaccauugguguucuguucagaaaucuuugcccugugcccaucucugguuuuacguggaguucuugauccacuuagacuugagcuuuguacaaagagguaagaauuggucauuucaccuucuucuacaugcuaacugccaguuaagcuagcagcauuuguugaaaaugcugucuucuuuccacuggaugguuuuagcuccuuugucaaagaucaaguaaucauagguguauggacucauuugugggucuucaauucuguucaauugaccuaccuuucugucacuguaccaguaccaugcaguuuuuaucacaauuguucuguaguacaguuugaggucaggcacggugauuccaccagagguucuuuuauuguugagaaaugguuuggguauccuaggauuguuguuaucccagauuaauuugcaaauugcccuuucuaacucagugaagaauugaguuggaauuuuuaugggaauuguaugcaagauagccauuuuuacuauauuaauccuuucaauccaugagcaugggagaucuuuccaucuucugagaucuucuuugauugauuucuuucuucagagacuuguuccccuguauuucuuuaaggaaguuauuuauuuccuucguauaggccuccaucgucaucaagagaagggacuuuagaucauaucuuucuuuucuggugugaugguguauccaggacuugcuguugugggagaguuugguucugaugaugccaaguagccuugguuucuguugcuucuguucuuaugcuugccuccugccaucagauuaucucaagugcuuguugcccucaauauaucugauuggagccuguccuuccugcaaucccaguugauucagaacuccuccgaguccaguuuucucugugaaccugagacucugggugugucagaguucuuggcagucaagcuuccucugagauucugagauccuggugugaccaagcuccugggacuuugggauucuggaauccuaagauccugggcacguuacagugccuggaagugguaccuccucuggggacuaugaagcugucugcucuguucgaaaccaaaauagaccagaugcugaccagaaggaaccugagccacuggucagguggggcuccuguguccuugcuccugaugucacaagccccucacgauuuuuuuuggaacagauguuguauuucacucaccagugacccuaagauccuaggugugguagagcacccacgguguggagaguccucuuggggaccuugggaccguccaccgaguuuguggcaaauacauuuuaaaagggcacacaaggcucugugggguuggaacaaucggauuguacuugccuugaaacuauucuugagcuuggcuucucuaauacugugcuuuugguuuuccuaaucucccuucuuaauuccucuucugccucuuuugugcuaauuuucgcaguuuggucuuuaauguuugaauuucuuggguuuaggucuuuuuccuuaaacagcuucauagugucugugauuaucauguuaggucaugauuucuaaacaaacauugacuuagcuaugucuucugaacuugaaauuuaaauuaaucaucuacuuggcauuuaggaggcucucaaagaucucaugacacauccugcaacauguuuauuuuuaucauaugauuacuguuuaaguguaaauggcaguaguugcucauauuaauaacccauuccauuaauaaaaugucuuuauacuuucuuuucaguguuucauucuuuauacuuccgugagucauguucccaguucaaccuucucuccaugaccccuuagguugaguuguuuccuguugauuuuaugcauccauuauugcauucacaagaguugaagaguugugacuguugugaggugaaagccaggagcuuucaguugcuuuccugcuauaguaaauccuuuccagucugaagaggcugcugcucucagucccugcacacuuagccuacaacagcuuucuuuguuucuccaucuuccaaagagcuuccuuuaguucuuaaauucuauaaauguuuugucagagccuuugcauguguuguucuucuaucuguuucacucuccucuuugucucccgaauuccaguucugcuuucuccaggcagccugccuucccaaguuuaaagucuucaucuaugugaugacacgccacuuuaauguacauuccacaauugugauuaaucguaacuguaauugauguagugccuuucucacaaaaauaugggcuucauuuuaaaauuuuuauuuuauuuuucacauuccauaguccauucccuguuccccccaucuacccucugucugcuccacaucccacaccuccucccaccccaccacguuuccauguggaggcccccaccucuuaagggaaaaaaauguaccugucccguugaccaugcuauuucugguauuaaguaguugauaaauauuuguaaaaugaaauaggauauuuuauguuucaauugucaccaaauucuauacuucauaguucuuuagggagauuaaguucuuuggaagaauuaggucaggaagaauggcgaugcugcuguuuaccgagcucgcccuucucugugcugcacgugcuaucugauucuagcccuuacaacagcaccacaguggacuuauuuuucaucaagaaaaaaaaaaaaaaaaacaaaccaggcacuaagagguuauuucacuugccccaaaauagcagagacaugaucuaaacacaggcugguccuucuguuaagguccuaaaguccuaccacuagguguugcagccuccuuuuccuaagaucacauggaaaagaaaguauuaaaacaaagaaacauguuuuuaaauuuugacugaauuguaaaugaauuuauaauaacaaccuguguucagccuuguuugugagagguaauguguaggcucucaucuagcuaaauuuaacuuauuuugcaaguuuuauugcugcugauuuguucuauauauuauuuagaguugacauuuuaauauuaauguauuuauuaacauuaguuacauucguugaauguucagaaacagguaaaaagcuuuucaaaauguuuugaaccauagaggccagacugucuguuucuuagaugaugagcccgugaaaugggaagaaaauagcauauuucacaggcaucauagacuucaauggcaaccucagacuuaagggaaaucuagaaauacauguuuucauuaagauuuuaguuucagcucugagccccauuuuuuaaugggauuauuugauuuucuggaguccaccuucuugaguucuuuauauauauuggauauuaguccccuauccgauuugggauagguaaagauccuuucccaaucuguugguggccuuuuugucuuauugacggugccuuuugcuuugcagaagcuuugcaauuuuaugaggucccauuuaucgauucucgaucuuacagcacaagccauugcuguucuauucaggaauuuuuccccuguacccauaucuucgaggcucuucccuacuuucuccucuauaaguuucagugucucugguuuuauguggaguuccuuaauccacuuagauuugaccuuaguacaaggagauagaaauggaucaauucgcauucuucuacaugauagccgccaguugugccagcaccauuuguugaaaaugcuguuuuuuuuccacuggaugguuuuagcucccuugucaaagaucaggugaccauagguguguggguucaucucugggucuucaauucuguuccaaagaauucucaccugaggaauaccgaauggcagagaagcaccugaaaaaauguucaacauccuuaaucaucagggaaaugcaaaucaaaacaacacugagauuccacuucacuccagucagaauggcaaagaucaaaaacucaggugacagcagauguuggcgaggauguggagaaaggggaacacuccuccauaguuggugggcuugcaagcuuauacaaccacucuggaaaucagucuggcgguuccucagaaaauuggacauaguacuaccggaggauccagcaauaccucuccugggcauauauccagaagaugucccaaccgguaagaagaacacaugcuccacuauguucauagcagccuuguuuauaauagccagaagcuggaaagaacccagaugucccucaacagaggaauggauacagaaaaugugguacauuuacacaguggaauacuacucagcuauuaaaaaaaaugaauuuaugaaauuccuaggcaaauggauggaccuggaggguaucauccugagugaaguaacccaaucacaaaggaacucgcacaauauguacucacugauaaguggauauuagcccagaaacuuaggauacccaagauauaagauacaacuugccaaacgcaugaaauucaagaagaacgaagaccaaaguguggacacuuuacccuuucuuagaaaugggaacaaaacacccauagaaggaguuacagagacaaaauuuggagcugugacgaaaggauggaccaucuagugauugccauaugcagggauccaucccauaaucagcuuccaaaugcugacaccauugcauacacuagcaagauuucgcugaaaggacccagauauagcucucucuugugagacuaugccggggccuagcaaacacagaaguggaugaucacagucagcuauuggaugggucacacggccccaaauggaggagcuagagaaaauacccaaggagcuaaagggaucugcaacccuauagguggaacaacaauaugaacuaaccaguaccugggagcucuugucuuuagcugcauauguaucaaaagauggccuaguuggccaucacugcaaagagaggcccauuggacuugcaaacuuuauaugccccagugcaggggaacaccagggccaaaaaggggcaguggguggguaggggauuguggggguggauaugggggaccuuugggauagcauugaaaauguaaacauggaaaauaccuaauuaaaaaaauaaauaaauaaaaagauuuuaguuucacaaaacuuaaaaacugcagguaacaguaaaugagaaaaggaaagcauaugggaacuuuaaaaauugcguucuucuuaagucuuguggcauuuaagugcguaugcuuggguugucaaauauaaaagcuaaguaaacuaaagggaaaugagccaauuugauaauuauuuaagccaccaugccuacuuuguucagauuagaauacaauuaagucauuccuucguuuucuuugcuccccccaaguccuuccauguaccccucuuugcucucuuuccgauuuauggcuucuuuuucuccaauaguuguuucucucucucucucucucucucucucucucuauauauauauauauauauauauauauacauauauauacauauauauauauacacacauauacacacacacacauacauacauauauauucauaaaugcauaaacacaaucugcuuagucuauauaaugcuucuguagcuaugcuccagugcugagcaucugcuauugcauagccaguuugugugcucuucccuaaggaagacaaugguucuuaguugucuguaguucuuuaugcaggguggaugccucaggggcuuucuccuacccacuucaguaugucuauuauuguccuuuuucagauuauuuuugggcagucauuuggugagacuaucgguauagcucuaauuuuacuguaagacagaaucucaccuuuucucuggaucuuacuuugagaaauucaagggcugguugaaccacccuggauaaauuuacucugaucuacacaauuggugagaugaaggcuggaaucauaucugaguuuaguaaagugacaaagauggaauaaugaguaguuauuuuuuaaaauaauagauuugaagaauuugagaugcaacugaaacuauauuauuuauaauguauaaaagaugagaaaaucauacaaaauaauuuggaaaagagauuuagaaaauuauagaccgucaaaguaucuuaauauucugugcuauauggauaacaaugugcaguccuucaauucaacugagaugaaaauuuuaaugcuaaaagcuucccauguaaacaucugaaaagaaauauggagggaccaagcauauuuucaguuacugggggagcaguugcccagcaugugcgagccucuagacuaagauuagggagucuauaggaggaguguuccuccauuuugguugaggaaguagucagggugaacucugugaguuuggauucauggguguauugaacuccuccaucaccuuugugcuugauaagcuuggugcuuguaccaucacuaauagcuagauaucugucaucuguuaaauacaagagaccauggaaaaaagaucucuaguaucuauuucaguucaaaaaucuauuauccaacucauacauuuucagugacuuuauguaaaagauacugaaauaaaaguaaaaauugagguuuacugugaaaauaaaaaaagagaagaaaacuuuucuuaacuuuuuccaagauuuccaaguacaguucccccauuucacuucauuuaacuggauuaagguugauccugugcauagagcucauguguucauuaacagugccccuacucaagagcuuuagauuacccaacgccugugagauagugaagauuugcugauagugauucggcuugaucuuuuuguuuuguuuuguuuuguuuuuugagacaggguuucucuguguagcccuggcuguccuggaacucacucuguagaccaagcuggccucgaacucagaaauccuccugccucugccucccaagugcuggaauuaaaggcgugcgccaccacgcccagccggcuugaucuuuauaagugcucuaguauauaacuucgugaaaaaucaccuggcuuacaaaaguauucaggccauuugauguucagucuuuaauuuucugcaguaaguauugaacuccuaagacgagaaaucauucauaaauucaaaugagucaaauguuucuuuuuuuucuugagagcagacaacuagagugaguucaguuuugaaaugagcuuaucacaugaaauaagguggggcacaacuuugaaacauacauuuucuuuuucauuuuguuaguucugcagagguugggauucuuaaggagacaacagagaauucucuuuuaucuuuucacuucaucuugaucugcacaguuuugucccagacuucuuagacccuuacacugcuccugaaaugcaaguagaacuaguugcuuaccuuuuguagcaacagcacgacaucgucaggugagcucugcaguguuucagcucaguuuuuuaaguuuuuguuucacaacuugcuuuauguguguacgagggcauccuugagaucuuugagcuaaucccugcagcacuaugcugcugucagugaucuuacuuccugcuugcuuacuuacuugcugucagggcuuccuucgcaggaauggugcucuacacuuuggggccuuguguguaguuguuuucauuacagagaucaccuucucuauuugucccuugaauuggguugaagaaaguaggcaggcagaccuagugguuccuaguuauguagaaugggaugugagagcuaagcugugggaguauugacuugggauggguugaucuucuuuguuugguuguuuguuuuuguuuuuuguuuuuuuguuuuuguuuuuuugagacagggauucucuguguagcccuggcuguccuggaacucacucuguagaccaggcugaccucugccucccaagcacugggauuaaaggugcgcgccaccaccgcccguguuuuggucuucuguuaacuagucaccugugcaagugauacaguagcuccugggcucuuggagccaguccuuaccgcaagcguugcuuguuagcuggccaugucuucucaccguauguucucacccacagggugugaaagguuuuguuucuugauuucuaaaugaaaacugauacacccaaauuaagugauacccauaagcacagagcauugacauucccagacuugcacaaccauauuuguuugugcaaagggcaaaaagcuuaauaauuuauuagaugugcuaaaauguaguguuaaaggacaaaaugagccauuucaaaacguuggagcuuacugcuucuguaaaauaguaccauuuaaaaauauuaagucuaauguuuagaaaacagucaucaauuuuggagauagcuuauuuuuagaaaucuuggacuauaaucuauauccacagagaguagcuagaaggguauaugcuucaaaauuaccacuagaggaaaaaugcaaaggcaauguaaucauuuggaccuaggcaagauugucaauauacaaauccagacuugaacauuuaaaaaacacuuuaaaaguaacuauuuuguccaugcaaauaauaucuugaugucugaacugacuuaaagugccuuuggaggaguugacagcgguguuacaauuagcauccugauugcucugcucucauucaaaaacugauuuuagauucaauaccuuugugacucccaacauuugcagcaacuuuucuuagccuguguacacaagagagcuuguagcuaauggggaauuugauaucugacuuuuuccucuccuaaaagaggagacuuuguccacugccacuguaccuuuuucuguucuuuuugucuugcacagaagacuggcaucuuccugugaagggcuuguggcaaaccuauccaacugggguucuuccuccuugagaacgaucugauccaucaucaccugacccagggaucacagucuaaggguccaggugagggcaaggcagucuauguauuaagccaguuucuuugucagguaagucacacucaggcguggucuugcuucagucagccauagcauuuuagugcuauccaggaagauagacacagcucauuaguacucccucaccccacuccgccccaccacacucauucugaugucagccuuagcuauucagaauuuauuguuauuuaaaacuuuuuguugcauaaugugaucauuucagccuuuuaguucuacagauguaaaaaagagggauuaaagacagcagguauucauauguaggauuuuagugcugauccuugucuuuauuguuaaugagcuugaaguguuagcaaguuaaagccagucuagcaugcaugcucuuguaugguuaugauuuuaagaucuuucacuguuuacuuguaaaugguugaagccagaagggauucggaauauuauggcuauuuauaccauugucagggagaucuuuguuguagauucucucacuuaaucaaaauguuuaagaggcagauuuucucuguucuauaccauaaaagaaaaaagugggaguauucucuauaaguggucacugcuaguugaagccugaguuugcaucuuaaaacguuaaaggugaauuacaacuuauuuuucaaauaaguuuuuuuuaauuuuauuuuuauuugaaggagaaaaaucuacuuuuguucucaagaguccuucaaaauguuauuugcuuucauuagugcugaauugcauaccacuguaaguuuucagucucauaaaacaguuuauuuccucaugauaacagugugugauuuuaaucaugugucagggcuggguaucucuuaaauauaccuugcuuuugcaauuugacaacauauaaacaaauuuagcuuuauuuucuuguacugacuaguucuccagaugguuccuaagugaccccaaccacuggaaaguaagggcugucuucuucuaaguuucuuugugucaacuuuuguugcuggcuuaauugcugaauuuuuauuauuugaaaaucucuaaguuuuuagcaagagcgcucucuuuucuaagcuggaaaggugacuucugacaaguuugcuuacuugguccugugucaaucccagcaaguuagaauggacaggccuacucacaacacuagcuauuagucaaaauccccguuccuguuuauuugggcuuaguguaauguuuacagagaaauaggaaauauuuauuauauauuuaaaaucuguaaaugguauuccccuugaacagagaagguucugugcuucagguucuaaugggaaguuauuucccacuagauagcucuuggaagaugauuacauuccuauaguagcuuguauugaggaugaaaacauagccuaacccaaucauguaaauauauaaaguaauuucagugcuuagaaauuugagucauauuacuaugcuggagucuugugugcguuuuauugaauauuagaccuguauugugacagacucacugggcacauuuuggaggcugcacagcagcaacacagauguccuggugcaccugggguagguagauugaauaugcuguugaaaaauuagaacuuugaagaaaccugcuugaagaacucuuacugaaauguguggauuacaucagacuggcucaggagugugugcacuuaagugugagguugauagugacuuaucccauugugucuuccacuuuugccuuucauacaaguucaccuuuguaacccgacuguucuagauaguugcauauguaaacuuuggacauuuucuauuucuucuaugaagccacugagacagcugcccaauuaggaacgaauuaaaauuuagagucuuuaaagauugguuugaccaggcguggcaguccgugccuuuggacccgcugcuguguguagcugacuaugcacaaacuugugagagaaccuuggcucaacuaaauaaaauaaaaaucuguuuuaagucuuuaaaaucagguuaccauucuauugucccaugcugucgcagugcacacaugacagagagaggcagagcgcaaagggaaaggcagauuugcuaagacaaacaagugaauuacagauacaguacuuggauguggagucuuugacauacauugacaggauucauagcccuuccuaaucaaggguguuuugcuaaucuuccaucagcuugauguuccuuuaagugugacauguuucauguaaccugaaguuaccagaaagaagaaaagucauauauaccaagagucuacacauccugaacuuuuaacucuuaagaacugaaguguugcaggccagaguccacguaucuuaggcuguuuuuaguccuuuugugaagcauccuguccacccugccuuuggcuuaacauccuugugacugugaaaaccuuaauucuauguuaagacaaccaugagcuucuaucauccagaagcuaguaaugucaucagaaacuacugcagucugucacagacuuccuuaccuugcugucaccaccgucugcggugaccccgugucuaucugaccgaagcuucauuucugaaugccuuugcucugagacuaacaccuucucacacagcuacuuccacgcuaucaccuaucuuucugggcaaucugaauucauguuccugggcugugaucacucacauuuaacuuaagaauaaacuuccuucgauucccuuugacaugagaccuguauuuuuacaucaacauuuauuucaagcaaugcagaggcuggacccauccaugacaaagaugaccucuugacugcuucccuccuccuuguuuccugcccaaucaggauuuaauuguucacugugaaaagcauuaagguugcauuuuacauuucucuguguccauuuucugucuucuguaaaauuaaaaguaaaaaagaaagaagacugauuaauguuguuuccucaaagaauuucuauagaugcuuuuuucaugucccugaagugguggcacugugcaguuaggaugggguucucugcucuagcuuuuguuugaacucugucuacuacuaacucaaagcaaugucuaugcugguauuauuucuaacauaauuuccucccguugguugguuugcuugauggccacuaaugucucaaguuaauaaccacagaauacuuuagaaaugugcugugugcuucauaaaauguaucugugguugcuaaaauauuuuuuuuuuugcuuagaacaaccaaauauaguuggcuguaaaauuauauauuguuagaaaaugcugcuuaaaacaaacaaacugauuuacuuucuguucugaaaauauucagaaggauuuguuaucucuugcagaccuuucugcaaacuacuaaugggaugaacacaauauaucacuuuuauaauagugagcuauuaaaggcaagcagaaagcagucugaagcccauaagugcugccaacagcuccugcuuuaaugaauucccuuuuagauguccauuaaaugcucguggcaaauguacucauaauggaaauggcaaaucuaaaugggugauaugaauaauccauggaguuuaaauucuguuuaugaucaucuucacauuuaguuuucaagacaacgcaguuuaguuuucauuacaguuuggaauaaagaggacagggaguaauugauugcuucaaguagauuaaaaucaaugguuuuuuuuuuuucaaagaaccaguucaaugcaguaauuccaacuuuaaacauugauuuaggguagucaacacaaaauguuuugugcugugugaacuuuuauauagaaagacuaauauuaauuuuauuucccuauauaucuauauagugaaauauagagcuuguuaggagcauguggaugacuuaauagugaucuauauuaagucauuuuuguauuauugcagucauauaacgaaucagugagauucccgucaucacuguaauacuguuuauaacccauuagcacagagaaauuacaacccaucauacaucauuacugugauugaggcuuuauuaccauauucucaaauugcuggcuugcuauaaaacuaaacagacacaaggcaacuauaggugggauauagacagcacauuauuguguuguaauaauggggcuaaagguaugaggaaaacacugcuagcagugauagaaacucagacuuuuauuacuguaaaggucaaauguguaugguaugugcagguuauuauuuuuguauugcaugaaucaugucuuaauguuuccuuaagaucauuuucuucuuagugugacuauucaagacagcuuuaguaugcuuugaauuuccuagacagguuuuggaauccacauuuugccauuugugagguuagacacgucaccaccagccuggcuugauguucagggggcaggaggucaguguucucuugggcccuaguugauaugauggauaaaugcauggcugucaugcauuuauccaucauaacagugaagaggccugaguguggcccuggcccuggcuggaaggcccucugguguugcagucuucacuguuuuacucacugagcacguucauccucugcugaguguuacuguguggcucugacagcauugccuagagcagcuggagcccacugcugagaugacuugcuugucugauggaugcagagcugucuggugcagacugugcccugaucuauguuccuacaguuuagaaccugacagcauaaacaucagacaauauacaaguuggauacuagaauuaucauaaaauuuuuucauuauuauaaagcuuuuuacaaauaaguaaccagaguaaauuaaccagaguaaccauaacuaccuggaaaaauuuaaaaggcagcaaucuaaaaaggaacuuuauucuuaagucauaauacacuuagaagccaaauuuacacacuacucuuggguacaucauaauguuguuacuauaccuuuuauaaagcauauuuuuuauuuugcaaucuaguguuuguagguagaaagccugaaugcuugucaggcugggucuugacuguaaggagaaaacugcaugaugggaaagcucaauacuguucuugccaagaacacuaggccugacugcaucuaguacuuuuccugggugugcccagccauaccaacauccuuauaccaaguggcaguccaugcuugcccgaguguauaugcugaauuacuugaauguuuuuguaauucgggucauuucaucacuucuuggcagcccaguccauguuacaaaccaaguaagcagugcauaguaguagcauagguauuguguaagacuggcagagagccaggcugagacagagagaaccccaagguucugagucccuuaagauacucuaggcuccaaaguauuuugccgcuggaaucaucaguguccuuuaauuuccucaagaccuuuuuuggcauggaggaggauuugaauaaauaacuuuaaaaauagauuaguugggcagauagcaaaucaauaauuuaaaaaguacaauaaggaaucaaaaugaguacuaacaggaaaacuaaaauaggauaaagagcacagugaugcugugugcuguauuaauauagguuauuuauggaaggacucucuuucuuuaauuauuuauucauucacuuuacaucucgaucacaucccccucuacaccucccauuacccacuucuccucugaggcacuucaagucacuguaggacuaggcagguccucccccacugagaccagacaaggcagcccaguuaugggaacaggaucccuaggcaagccuuagagucagggacagccguugcuuuagaugaaaaccaagggaccugcaugaaaaccaaguuguacaucuauuauauauguguagggguuuggugggaggagguggguggauccagcccauguaugcucuuugguuggugguucagucucugggagcccccaaggguccagguuaguugacucuguuguucuggaaggccuuucuaaugaauaacauuuaaguaaauauguaaauaaaguuaucuguggcaagcaugucccagaaagugauauagaaguugugagaucaaaggguauuuguagaauagcaaauguacuggcuugcaaaguguaugagggauguaaaauaaguuuaagguguauuaguaauuuucaauuuauaguuaauccaauacaugaauuucugguuuuuuugguuugauaaggauuuuacuaugagauaguugauucaaagucaaauaaaugauuccaguaguuauguuuuuguuguuguugucugcauacaugugggucuggacugaggauggccuacaggaguuggguuucuucuucccgcuugggucugacagauugaacucaguuucucaggcuucucaccaguuuccuuuacucacugagccaucucugguuuguuuguuccuuuuccuuuuccuuuuccuuuuccuuuuccuuuuccuuuuccuuuccuuuccuuuuuuuuuuuuuuuuucgagacaggguuucucuuuguagcccuggcuguccuggaacucacucuguagaccaggcuggccucgaacucagaaauccgccugccucugccucccaagugcugggauuaaaggcaugcaccaccacugcccggcuuuuuuucuacucuuuuuuuucucuuccaucucugguuuuuaacagcucucauaauaaacuuguaguuauauuuuguuuuauuuugaaaucuguuuuaaauauauuaacccaacguaauauaucaucugugaaaaccaaguuguuuuguuuugauaaguuguagcaaaaugucuccaauuguggacuuuucuguuaacuuuuacugguuauaguuaugucuuaaccaggcuuucuaucugugauaaacaccaugaccaaaagcaacuugaagaggagagaguuacuuccaucuuccaacccuuugggcacacaccaucacugagggaaaucagagcagggaccuagagacuggccauggaagaugcuguuuccuagcuugcucagcuuccuuucuuacaccacucaggagauugcccagagugagcuuggcucucccaugucuaucauuaaucaagaaagugccccccacagacuagccuacaccaaccugauugcaguaauuacucaauugagauuccuucuuuccagauaggucuacguuugucgcaauuuuucaaaaaaaaacaaccagguuguaguugucaaauguuuuugugucuaccauggcauuaguagguuuuuuacuuauuuauaauacucauaaaacuaaguguccuuuuaguugcccuuaaaaaguagcuaauagcucuguccaaacuuggagaguccuguuuuauuuauuuggggugcugaaaauggaaauaagugguauauaaaauuuggagaaucuaauugaaugucuuuuucaguuguaaauauguuuugagaaauguguguguguguguguguguguguguguguguguguguguguguguguguguauguucauguguguuuguuauauacccgcauguaaugccagaagucaauguccuuuuccagcugucuagauuucccccuggacaugucagcuagcuuucuuuuaggagaaaauaaggugaaagcugcuaugcuucuucuuuuucuucuucuuuuuuuucuugcugacuuugcuuuuuuuuuuuuuugauauuuuauuuauuuacauuucaaauguuaucccccuuucccgauuuccaccccaccccagaaacgcuguauuccaucccccuccuccugcuuccuugggguuguguccccacccacucccgccucccugcccucacacuccccuacacucgggcaucgagccuucacaggacuaagggccucuucucccauugauguccaacaaggccaucuucugcuacauauacggcuggagccaugggucucuccauguguaguccuugcuuggugguuuagacccuaggagcucugguugguugauacuguuguccuuccuaugguguugcaaaccccuucaucagcuuuaguccuuucucuaacucuuccauugaggaccccauaaucaguucagugguuggcugugaggaucugccucuguauaugucaggcucuggcagacccucucaagagacagcuaugucaggcugcacuucuuggcauccacaacaguaucugcauuuggugacucuauaugggauggauccccagguggggcagucuccagauggucuuuccuucagucucugcuccauacuuugucuccauauuuccuccagugaauauuuuguuuccccuccuaagaaggacugaagcacccauacuuuggucuuccuucuucugggaacuucauguggucagugaauuguaucuuggguauucugagcuuuugggcuaauauccacuuaucagugaguacauaccaucuguguucuuuugugauuggguuaccucacucaggcuaauauuuucuaguuccauccauuugccuaagaauuuuaugaauucacugucuuuaauaugaguaguacucucagaucaagaauugacaaaugggaccucauaaaauugaaaagcuuuuguaaggcaaaggacacugucaauaggacaaaacagcaaccaacagauugggaaaagaucuuuacuaauccuacaucugauagaggucuaauauccaauauauacaaagaacuccagaaauuaggcuccagacaaucaaauaacccuauuaaaaaguggaguacagggagaacugagcagagcugguugagccuucaaaguccuaaaacacuccgagguggguucgggguuuauugauugaauucugcuggcgcaggauccucugcagaaagagggagcgcgagagauggagauggacaaacagauuuauuuagagcuguggaacaggacacccucugaugugaaagagcugguccuggauagcuguaagucaauugaaggcaaaaucgaaggccucacggaugaguuugaagaacuggaauuccuaaguacaaucaauguaggccucaccuucauuuccaacuuaccaaaguuaaacaaacucaagaagcuugaauuaagcgaaaacagaaucucaggggaccuggaaguauuggcagagaaauguccgaaccuuaagcaucuaaauuuaaguggcaacaaaauaaaauaaaagaucucaguacaauagagcugcugaagaaguuagagaaucucaagagccuagaccuguuuaacuguuuucugucucaaaauuaacaagaauauuuuuaaugggcauggaaguggaggaauccaaaaagaagugagaaaaaaaguauauauguuagauguucuguguggggcagguuucacugugcaaagauugaccuucagcaugugaccggacuuucauggagauguccuuuuaauuacuuuguuacuaacucuuuuaaggauuuauuaucuuuaauuguucacauguauguagguauaugucagagauccccuggaaguggaauuauaggcaguugugagccaacagaggagaguguggauuaccaauguguguuuuuaaccacuaagccauuucuccagccccugcuaguaagucuucucagguaaauguauaaacugaaacauccuuugcaaacuauguuugcuuuuuuuuaaccuaaacuauuugauuaugaaaguccaagaauauauacaauauaagauuguacuuuuaaagugacuaagaaccugugguacugcuccuuaaaugauacuugcuggaaacaaguaccucuccugggaauguagcuaugugccugcaucuagucacggguucuguuggcuuagguacagccuuuccuuggcgcucugggguaucccuuuagcauccuauacccuggggacuccacugcgggaacugugacaucuguuugugcuauuagaugacauagcuucaauauuauuguuaaaugacuacaucaaccaacauaaacuguuguucaacuggagugugguugucagcuugcuuguaaucaccacugacagcuagcuaugugauaugauagcagauucuucugguuuauucaugugugaaauaagggagaauuuggcugugugaaauuauaagucucggucauucugaaugguaaauauucauuaaccauuagugaagucucaguuuuauucuuuugagacauuaucuugaaacuuggucuacagcuaugagggauuuaagcuuauugauaaggaaaacuaauaaauaaaagacuguuagaaacaauccuuugacaaauuauuaauuaauaaauaauuuuggacucuuaagacccaaaacuauuaaaaggaaauuuaauauagaaaggaucuauguaaauaauacuacaaaauccaugcuuggaauuuauguuuuggguaagcaaaacaugugugcaccugcagccaagagagggcuagaaaccaaguguguuguaccacuccaaccugaugucugcucugcacacgugcaagguucuuuucuuccucaagcugacuguaagcauugauguguaugauauuuucauuuuaauguguucuuugaaauguguauuuuagaaaaaaaaaaacaggucugugaauucuuaggcuucaacaggaugcgcaaauuuaguuggcaugugauuaaacauuaagguuaaaaugacaaacacaugacaauuguuuauaagcaaaauaauuuccucucuaucuauuuuuagaaugaaguuuucagauaacuuuaagguacccuaaauguaccuuuagcauuaauuuucauauugaaauuucauuuuacuuuaucagcaacucuuuaauucauugucuuauuuuuccuauuuugauaauacuauauuuucuaaccaucagagaauuuuguauuuauuugauaucucacuauaauacuugaauugguuuuguuuuacucacaaagguaaaagaauuccaaauuuacucauaauaaaaguauuagagaaacugucaauaaauuuaguguucuaauugaaucauaugauaucuaaauuguugauaauacgaucugcucguuaaacaauagugucuggagagaaugauggauuaauugacugauggcuaaaguuucccucaaauauaaugguuuacccaguuugauuugauuuguguaaaauaacuuucucuaauaaacaauuugcucagaggcaauagaagaaaugaaugguuaucaaaccaaacuuaauuagucuauccuagauugauauuacuuggggagucuucauuuuaauuguggagugcuggauacaaagaguuugguucauuauuuuuuccuguauaaacacuauuguguaacuaccuauggaauaauaacaugugaauucauuuuaauaaaugcuuguaaaguggauuagcuaauuaugccaagcuaaaaaugauuccuuuaauuauuuuggauauuuaacugguacucaauuuuauuauuguuagucuguaaaugugauuuguauuagcucugccaagcuaauuauaauguauaacauagcaauuugaacaguuuuguaaugcgcacagugcuguccucuccugugcagagaaaacauuucuacauuacaugaagauaaagguuugacaugauuucagaccaaagggauggcaaauaucuaucaagagaagagaaaccccugucaguagcuagcuuaaugcuuuuuauaauuauauguauggaaagaagaaacaacugccauucaagagaagcuaaaaccauugacuuauuaauguaucuuaagaugugguacaucauagacccuguccuaauaccuuacagucuaggaaaguguuugagcuucauuccuuucugugaugaguagaccuccuuccucauccucaaguagaaagauucuuaauaaugacauggcggguaugacaaacggugaccgacacccccacccccacccccacugcuuuuacuuaggagacuaacucuaauuuugagucugaaauaaaugaaaacaaaggcuuuaguaauaaauaaacagcauccaaauuuaguccuggaagaaagcaaauaaccuugaugagaauaucagcguaaaucuauuuuauuuucuaaauuagcagauaguaaaguuaacauuuucucuuuggaguuaccuguuuccagcuauugucaucaagaccuugcccugcuuuuguauuuuucuccauagcaaccacugauagucuucacugcugucccuggaccuuucuaggaugucagugauguaagugugaucauccaugaucugaccugucuucccucuucagauucaauuuagcaguguuaguaucauuuuuuaguuaauaugaauguucuguccuauaaaggcauuagugugucugacagugaggauuauauuagaacuugauuuuuccuguaauuuacuacacgcuguugcacuuucccugugugccaggcuagcauuaguucucuugccuucucuuccugccaugcuggagucacagacagacgccacugaucuaacaguuguacuguuagcaacugaauuguaguuggauacacaccauacuuuguuuaaaugccugccugccacacagcaauuuugcugcuacuuagaguaguagccaugcuuguggaugccuauucugcauucuauacugucuggccuguauaguccuggaaaugaauuuaauagggcaaagauacacagaaaaaguguguggaggacagagucaccuuacaaaaagcauaaaaccaguuuuuacuuccuuuuauuaccuugccuucaguauccuuuuuaucuugguaaaucuagguguugacuuuucacauuuuaauuuacauuacuuuaauaguaugguguuugcacuaauacugcuaggucacuucucuaaugugaucuguguuucaacaccgucuuauuuuuauaaauccuagacccucauuaguuuguuuuguagaaguuagaucugagucuuucuccuagucccaugcuccuagaaauaagacucaaacucagaauaucauuacaaauaccuuggccauauuuuaggcuuaucagauauuaacuaaaauaacccauuuauuuaaccuacauuaugccaugugacuguucaggugccaugcuccugucugguuauaacuccuccuugaaucucccaccuggcgcucucccagauucuuuuuuguuuccugccuaagccauaggccaucaggcauaaaauauucucucuacauuauuuguuggaauuaguuugagauugaaauuuuucguuuuguuuucuuuuuuucccuaugcaauagaguuguuaaaagucucauaguuuuaauaauauugagguuuuuuuuuuacacuuagcucuuugcauguauguacuggacaaguaucagcucaaaucucugaccuguuucuaauuagguaguuucuuuuacugcuauuaucauuuuauaugcaaauuguuucuuucacggacaguuuacaaaugcuuucuuuucagauauugcuugucuuuggagcuucacaguggcaaaaucauuaacuguuguucauuuggaugcaguuuauuuuacuagcuugucauuuaugcaguaaacuuuuucucucauggccaagaaauuauguucccuugucccaacucauguacauuuuuuccagaaguuauauaauuucuacauuucuuuuggagcauucacuuuuuguuauuuuuaaauuugcauuugacuguuguuacuguuugaguuuagucuacccucauguacuuccuguuugaucuccggguguaauuuucuccagauuuaccuuuuccagacugcucuagccaagacuguauguauacuuuugaccaauauccuuugaaauuuucucagucuacuuccaaauguuuuugcuaaguaaagcgccuuuucucaacuuuguauuucaguugcacuguguauuccaaagguagauaauguugaauguuucuuguaaacuuuauacauuaaaaauuccuuauaauauuaucugugcauuuagccguuguacaaauucacagucauuucaagauuuaaaaaaaugccaugggcaaugguuguccuucacuagaaggccuuagcaugacucagccagacaaagaaaguuaguuguauuuacuauucuacucuauuuugccuuuuauuggugaguuuccucuacuaguauuucaaguuauugguaauaauuaagguuuaguucugccauuuuguuguuuucuaugcauuuacauuuuucauugcucaguuucucucaguauauacuaccuucuuguugaauggauuuuucuagugucaauuuuuauuaccuguuuaauuccuuuucuguaauuuuuaaaucaguuuuguuaauggcuaccauugagauuaacagcuagcauuuguaauuuauaacaaucuaauuugaauugauaccaaguucaugucuguggcaucucuuacuccuauccuacaccuugcucuugguggugguuguuauuuuggauuauaucagaauacauuguguucucagugacguuuugcacgugcucuugugccagugcaugcucugcuucuuugugugucuguuugggaugccuggcuagcucuucuuucacugcaucuuuaagggucuccauuaauacuacucuagguccugcccacucuuggcugguccucugugccugcuuucauugcuaugauuuuuaugauuguuacugccauugauaaacucugggaggucagauuuuucucucucaguugugaaggggcguuuguuuucuucauccaucuugccuuucagcauuuucaauggaugauccuuuaauguuuucaccaucauccuucugagaagucugcugucaaucuuguaagaggucucuguaugugaucagucacuuaucucuuucuaaucucaaguuuucugucuuuugaaguucucccuguguuuccuauugaagccuuuaccuauguuuuacucacccagaucaguauaucuugcuuguagaaucuaggauccauguaugagagaaagcauuccgugugcuucucuuucugagcccugcuucccucacuuaauguaauguuuuucaggcuuguccauuuucuugcaaauauguaauuucaguuuuccuuaugguugaguagaauucuguaguguaugaguauaucuuuucaugucuuuucaccuuuugguggccaucugucuacacuguccacuuuccaacuugcauggaaagcuuggaaaucagcaucgaugugcuaccaacuuuguaggagaacauugccaugggcaucugccuagagccguuauagcugagucagauggccauuguauuuuuaguuuuucucagaagccucccuagcaguuuccaugcaggcuguacugccagcaggguguuaguuauucuccugacccauuuguauggucauccuucuaauugugugguaguuguucagacucugacucagcccaucucaguguagcuauaauuugcauuuuucugauaguuagggauguuaaaaacuuucaaaacauuuauugaucauuuacaucauuauaaacaugcagagagagagagagagagagagagagagucagucgcagacacaugcacacuuugucugacuuauagcuagcaaagauuucacccauucuguaggccgccugacacucuguugauaauuucauuugcuguccagaagcucuuuaaugucauauaaucauguuugucaauugauggggcuguuuccugugcuguuggaguuguacugagaaauuucuuaucuaugucuauauccugaaggcuuuuccauuaauaguuucaguguuucugguuuuacguuaagguuuuugauccaguuugaguuguuuguacagagugagagauaaggaccuaauuucauucuguggauggacauccaguuuugcccacacccuuuauugaaaaguuuaucuuuuucuugaucaugguuuugccacuuuuauuaaaaauuagguuuccuuugcugucuguguuuaucuuugaguuguuucauugaucuaugugucuguugcuugugccaggauuauguuuucuuugucccuauuguucuguaguguaguuugagaucagauaauaagauguucuugacaguugucuuucugcuuaaaauugcuuuggguaucuggucuuuuuguguuuccaaggaauguuaggauauuuuuucuaguuuuguauagaauaucauuagaauuuguaauggggaugacauugaaucaguagagugcuuuugauaauugagucuucacaauauugauuauacugguccaggaacauagaugcucuuucugcucuccagugucugauuugguuuuucagugucuuacauuuuuuuuauagaggucuuuuacuucuuccuuagcuagguuacucuuggacagagucuagaaggaaugccaacauagauguauaaaaauacauucaauagugaaaacauaaauccauugugaagccccauagcuucagaaugguuguucuaacuguauagaaguuaauucagauguauagacuuugggucuggcuaauuuuaguaugagauguuuuaaauuugcaaggcuuuuuuuuauaauaaaauucauuuuaaaauuuuuacuuguuaggaacacaaguacauguuaaacauagaggaaacccaaguagauaaagcuauauuaaauuacauauuuaagccucaguggucaucagugaaaacacgcaguuuaugugguaugcuauuuuaacacugucaugcuuuuuagagcuaguuugaucuucaggugaauugcuaugcagaaaucauuuggauguagcaaauugaggugaagauuugcuuaggaguccaugagacugaagcaagugaggcccaggcuguucuccgguccguuaaugucuggugucagcaccuaauggccuuugugucuuuguugucuuuacuuguguuuuuguaauuuggguuuuucuaccuacuccucuccugccuguggugcuucccacugaacugaguccucagccucccaugcaagcuguccauccuuuagugaaaccuagccuucaaucuuucaagugcuaacuaaaguuuccuuacagucuaggagacucuuuagaauuuagcuacucauauaugcguuugguaacaaaucuuauauaauaaccuaaauuuugauuguuuuuauaaaagauugauuuagccuuuguuuuucuugucugcuuacuggacugcucuaagauguuuugugucgagguguaauuagaucagugcgguucaggacugcuuucccuuuggcugagggcucauuaggcucuaguuuuaggcugaacucugugcuuuagauagcaauaaaacagacuaugguucugacuagaagucaggaacuccugcuuauaacugaaaacaagugugcagaugucacacacagcugucagccacaaagacagugugcuguguagaguaugcuucauucugauugggucaaggaggagagcgaguuugucacuuuaaauuuuaaaaugaagauugcagccauaauaugaagcaguauugaaaagaauauauuagguugucugggcugagaaaaagagaugaccacagguugaucugccgucacacuauugaugaaccuucacagaggaacuucaaagcuccagcauggggacaguguuauuaucaagauuauccagugacaaaaggaaacccuggccccuuaguagguagucagauuugaugaaagauaccuuuaaaggccaaggaagaaaucauuaauuuaaaccaaaaucagccagaacucaaauggaccaagucaaggaaaugcuacuuguuagaggaaacaaaaagacaaaaacucaguaggauuuucugaguguucuuauuuguugugaaguaagcuugacucaaaucuuacagccuaaaguuuaccagagucuuagcagaauugcaagugacugugguuucuaugucacuguauccaguuguccuuccuccuaaauacuuaaaaagaaacuucuagcagaaaggauguuuuuccucuuggaaauauuuuuguuucugucuauaauguuauuaaguacgaugcugaaacauucauaaagaccagcugguuuaugcuuugggaauuuugguuuguugagacacagucccacuguaaaacacuggguggcauaaacuugauguguagacuagacuggccuugaguucauggaaaucuucccaucucugcccgccuccaauuacaacauaaucaaaucauuuucccuugccacccccucccacaacuccucuucccucuaaaguucauguacucuuuuucuuuaacuguuauuguuauagguguguguaaauacaucgagcugaguguugauguauguuauaugaaugauuucaggacugaucacuugguauuggauaaccagucaaagaaagcucaccccggggaagaauaacucucccuuucuauguauuuguuaguguuaguugccuguaguuccuugucuagguguggggccccaugagauuacuugcuucugcauucagguaucuauuuguauugucuuuguucuuucugguuuuauuuaggcagccauauuguugagguuucauaggugaagcuuuccugucauuucuagauguagucacacagaagacuuucuacccacuggcucccaacacuuucucccucauuuuauacaauguucccuguggucgaggaguugguguuauagauguagcauuuccuggucccauuggucucuccauuauggccaauuuuuuguuuguuuuuaaauuuuuuuuuguagugguaucuaucugguauaaagagaagcuuauuugaugaggagugaggacuuuucugugccuauaaggguaacaaugugccucggaguuauuuuggucuagcaaagugacaguaguagauugucuucuaggauccauggccucacaagcucaguagguggcugggacuuuagcacuaggcaugauuuuccuccugcugagugagccuuaaguccaauuaggccauguugacugcccgcuguugcaccuuugggggagauuuugccaugcugauucuaauuguaguucuuaggcaucaaaagugggaagggcauagcacaaugcagugacaggaaagggaagggggguguuuaaaguguggaggggaaggcacagcaguacaguaagaaaaggaaaagaggguuaaguaacacuauagaucuuggaaaaggucacaagaaaucguauuauuuuauguuuuucuacuauuacauauauauauauauauauauauauauauauauauauauacacauauauaugcauauuuguucaauaaaauuaugccacuuggagugauaaaaaugcuuccccgagagcuauauacuuacugccuaagaaaaagaaaacaaaaaccuuaguaccaggcaugacaaacucccuuucuaguucuuagugaguaagauacaagcccuggaggcuuuugcugcuugcauugguugccucccagagaaugagaacaaggccauauuuuugaagacaccaugaacuguggacauagcacugugaggauuuaaaagccugaaagcccccucccugcagauuaguuuucaacaugccagaaggugcuaugggagcugccaaggagggaagcaaccaacaucccccuugcuuuaagaucagugaauaaaguauuuuccuauguuccguccaagggccauuggcagggugaauaguuucugacaagaggaaacucacugcuaugaaaaacacaaguuauuuuucaaaaucccagcagcagaaucaggaugguuugauguguugguucuuauaaauggacuggugcuauaggagagaggcagauggauguagcaucaggaccacucaggcucugcuuugccagagaaaacagaccuacuguagaauuuacaggacagaaaagucuugcuggcaucuugauuuuaguccaauaaggccugagacaaaguugaaaccaacggaguacauguaacauagcagauugcauuguuuuaauuuauucauuuuguaguaguuuuacuaaacaucaagaauuaauacaguaagaaaaugauggcugggcggugguggcgcacaccuuuaaucccagcacugggaggcagaggcaggcagauuuugaguucgagaccagccuagucuacacugcaaucucuaagacagccaaagccacagagaagaaccuucucucagaaaaacaaaggaaaagaucuauaucgauuuccagaguggcuguaccauuuuauauucccaucaagaauaaaugagaguucuguuuuuccaaggcuuugccagcauuugucagaugucuuguugauucuagccauugaaaucucagauguguuuuaauuugcauuucccuaauuguuacagaaccccaagagauuacuuccuuuuucaguugaguaccuauuuguaucuauuccuauuaucuuuguucuggucuuguuuaggcagacauauuggugaggaaacauagccauuauuuauuaacuguuuuuucuuuuauuaagaauucucucuuuaggucuauagccauuuuuugugacuucauuuguuuuauugacuacuuuuugaguucuuuguauauucuugauauaauccucugucugucacauguuagcuggcaacaacuuucccauucucuagguuuuucccgcacucgguugauugcuuccuuagcuguacaaaagcuuuuaaguguaugaggucccucuugccaguuguuggccuuaauuucugggcaaaugaaguuuuauuagaaaguccuucacuccacugaucucauaauagguuuauuugauuuucuagaguccagcuucuugaguucuuuguauacauuggauauuaguccccuaucagauuuaggauugguaaagauccuuucccaaucuguugguuguuguuuuauccuauugacaguaucuuuuaccuuacagaagcuuugcaauuuuaugaggucccauuugucuauucucaaucuuacagcacaagccauugcuggaacagaacuuuuaacugcagacaguuucuguggcauguguggcauggaauauauauaguuaaaaauuugauauaaaugcccaaaaacguuucuauuccaacauguaaggucuuuuuuuuuucaugugugugauuauacagacuuuuaucugucuauacuuuauuaauucagccauucauaaaggucugugguguugucugagaacuuucuguacagcugaccauuguuaccuacaagucuuaagauaaaugacuacuucagauacuuuguugcaucucuuuacuaugaagagaaucuuugcaugccauuguuuuccacuuggguuucuuuuuccauauacuuccuggucauguuuuuugguuauuagcuggcuuucaucauuuuucauauuuuuaucacauuuuuuucauuuuucacauaccuauaaaaucucuguccuauuacagcuuucucuaauguauuguuuauauuauaacuuuuuagcguuuuuaauaaguaaauaaauagauuuuauuuauaauucuacuuuugagaucauaaucacaucauuuauccauuccaccuccucaguacaaacccucucuuauauuacuucuuacuacgugccaaacuuaggaccuguuugucuguaauuguugucauuuaaaaggaauagcaugucagaaagagguuuuuuauaaauaaauaaauaaauaaauaagauggaaaaaauagaacccguagauuaaauaacuugcagaaauuuaaaaauuaccacgagaaauucuaauguacaguuaauugaaggauaagaaaaaugagugcugauguuguggccuuggauauaucuaaaaauuauuaauugaaaauucucucuaauuugcugaaaauguaauuauuaaauccaaguaagauaguaucuuagucaggguuucuauuccugcgcaaacaugaccaaaaagcaauggggaggaaaggguuuauuccgcuuacacuuccacauugcuguucaucacuaaaggaagucaggacuggaacucaagcaggucaggaagcaggagcugacgcagaggccauggagggauguuguuuacuggcuugcuuccccugacuugcucagccugcucucuuauagaacccaagacuaccagcccagggauggccccacccacaaggggccuuucccccuugaucacuaauugagaaaaugccccacagcuggaucucauggacacauuuccccuuucucugugauaacuccagcuugugucaaguugacacaaaaccagccaguacagauaggaauaccaagaaacaagacaggauuucugaccuccccacccuucucaucccugcugcugacacuucugagacuggguggcaucucuuggcuguccuguaggucuuauagucaagacuggccuugaacucacugaaauccugcuuuugcuuccccaggacuggaauuacaggugguuugaguuuauguggaauguuugacacaaaaagaucucaggauuuuuagaagaaauaauugaggaugaauaaucaaaacucaauucuuuaaaauauaauaauaauaauaauaauagcagcaacaaaaacaauaccucaaauggccacuguuuggcucuugagacuagggagauacaaggacuugugaaaguuaaagugaagaaagaguaggagugugucuauggguggaggaagagccuucagaccacagaaaucuuucacagacacuuuaggcaauucuguuaccaggaacccccugagcugagggaaacucuuggaagacuccuggagcucugcuaccaauggcugcauccuggggcccacaaacgaguaaaucaauccuggcucugcugguacuggagcagugccugagcacccugucugcggagcaccaggccugggggagcaccacucugugagcggugaacaggcagugacuguuccagaggacgugggagagaaguggaugagccagcagcaagcauaagacuccuuguggcuaguuccaaaccaaggaagaacagcugcagacuaacccaugccagacuucucucuuucagaucuaauagaagguuaucauguguugcuuuuuugauaaagaaauuuuacacguuucucuggggauguguaaaauguuuaagucaaguaaguuacuaccgaaguaaaguuuaaaauacacaaauuuugaagaggaaacggguuugauuuguuagaauuaccaaauuuucuguaaguuucuuucuguuugacugcuuuucuuuuagaaaggaucucauguaguccacauucaccaguccauuguuuuccuccuaccuccugagugcuagaauuacaggcuaugccaucaugccuguguuuagaaaauucauccaagaugaacacuucaucaaagaucugucuuuccaaaagggggguauuugauaagccaacaacuuuauacuaugugaauaaaauuuauguacauuauaguccuuacauguaaauauaagugcaaacgauuuuuauaaaaaaugguacaaagagucacuuugucauuuacagagcuauagaucuggcacucuucucuacugauauuacucuuugugagaauaucuuaggagaccccaucuccuuguaucaggaaugaaaacauacccaggccugaccgaccaagcaguucacucuaaucucaccagucauugcuguaacacagccaugugacccugggaaguccacguuaaguguaccucacuucugaagcaugcugaaauugguugcaaagaagcucgcuucccugaguuugugguuggcaaaugucagaguugucagcaguuuagggccuucuguauugggagggaauaaaagaaguggggggggggggagcacuggaagguagacugccgucagguauuggucacaugggguuuuuucaugccugcacaaccuuccaauauucagauacugggugaaugguccuccauccacccguggggucuuuaaaacaaguccaugcugucucugcuaaugauuuggacauaacugauaauguuuuauuccucccaaccuguccacuucaccccuguggaugcgugugugcaugagagagagagagagagagagagagagagagagagagagagagagagagagaaaagcagaagccgugacagagaucaauuugaaucuagcaugguauucuaaugcuauaauagaauaugaaaaugcagauuuagaaaggaauaagggaauguucugaccuguugccaagcuuuacuccacauuuccaguguacccauauucuguaauggucacugcagcacuguguggcccucuacacacacacacacacacacacacacacacacacacacacacacacacacacauuuccaguguacccauauucuguaauggucacugcagcccuuuuuugugugaacuguuuacaugucugacuucguguuuggauuuuacuuggugauuugauaugaaauuuuaaugugaaagcacuuagcauuaggaguuugacauuuugucugaccuuaaucaccaagaggaucaugagagguuuauucagugggaagagaacuguuacagcucugacaggaaugaugggaaauaaguaaacagccuuuuaaaucuucaccagaaaucaauaggguuuaaagaugauggacguugguguuuuuugcugcuuaaggacuucaaccuuuuacgggaaaauaucuuguauaggugucagcaguuucuccauguacgcagugaauggcuacugcagauacagcguucugcauagaacacucuucaucacuauuauaagggagagauuggauaugacuggccaugguaauauagagccuuuuggggcauuuuuauaagaaaaaggaggccuauaucucagaguuuugcucuaguguuaaguauaauuuauacaacaaacuuuucccucaaaaaaacaguacuaguuuuccuacacugaaaaccucuacugugcugacauugaccauaaagugguaacuuggaugauacagcuccguuuuagauggugaaagugaggacuccagguuucucugcguucaucuaauuagugacagaaguggcauuaaaaucaagguccuccggacugugaagcucauccucugcuguugucaggcuguaucucccaggccacagacucgguugcucucacuccagccauauuucuuuagccaguguuuuuaaugucuuucuuuucucuacucuccguagucaguaaaacuaacugaagugacagaucucuacuucauuuaaugagaaaaagagcuaugccauggucauugaauaaaggaauaugggcugagaaugcuucucaauauacucugcagauuugcuuuuuaugaaugauuuaugagcuauuagauugauguagcauuuugcaguaaauucacaaucagcugcagucugauacaaguguucaauauuaacugaguguggcaugcacuguucuuuguuuuaagauaaaaauuucaagauuacaagauuuaaaauuauaaauuucuauuaaaauuuucaaauuacaagaucuuacugugaagaacauucccaucuggaugugguagugcauucguguaauuguacuuagggaggaauaacaagagaaucgggaacuuaagccuagccuuagcuacaugguaaauugaagaccagacugugauuucaguugaggccuuacauaaacagauaaacacaaacacauacaccuauacuucuaaaucgcagugcuucuacgaugggcgugguggcgcacgccuuuaaucccaggacuugggaggcagaggcagguggaucucuguaaguuugaggccagccuggucuacagcaccaguuccagaacagccagagcuacacagagaaacccugccuugcaacaauaacaacaaaaguaaaauaaagcagcaaucagugcuucuaaauacuuuaaagcauaguaaccuuaccaucacuuaacuuucaguuguuaaauugauacauacaaauaaguauauguagaaaauguuuuuauugugugauuuggaaauauucauugcaauucaaauuaaaaaaaacucaggcauuuguuaauaaauguuauaaaacauguuauguuagacaaagaaccucacauacaaucuauguguuugguuuuagguuuaagaguucauuauacuucaguuaauuuauugggaaacuuauaaaagaaaugagcucuuaacuaauucauguuuccuagauuuugucauccuucauuucuguguuuaaaacugaaguaaccuaaaugaucaaagaggucuucuaauucugaaguucuguagcauuuuaaauuugcaauuuggguagaagccauuuuuuauuacauuagauaaacacauauuaauaggcugauuuguagcuuaaugauugaguguuugcaugguauaugcaaauccuuugcucaguuuuuggcacuguagaaaauaaaauguauuuauuauagcauuucuaaaugggccucccugaucccugaacauggguccuuccuaguuucuguuuaccucccugguugguuugaccaaauuguccauagcuuguccucuuccuuacuggacagauugaccuuuucccauuuuaaagguucaggguggagacagggcagacacuguucuaggcacucugaggacacuagauucaucaaucagccuuucucuugugcucucugaguaccuaaagguuucagauagcuaaugauuuauucugaauuugucuaaagguauaaauucauagcugugaauaggucaucucucuacauguuggaucauuucagauaaaauugugacccccucaccugccuuaguucaacauucacacuggcccacaaccuuugaaaagaauguuggagaacucaagcucucugcuuuagugugacucauuuccuaauuuccaaauauugucaauuggagagucauaaaaaccuugagaguccagauuuuuuauaugaaaaaugaugauaaauaggauuauuguagaguuuaauacaaaauaauguauauggaagaauuugaacucauuuguaugauuucauuaaucaauaauuuauauuauuugcuaguacauauaccuauauucucaaauucuuuuuuucaauauuuaucuuugaucuuuuuuuuuacuauccagucuuaucccccucccacuccacccucugacaggucccuaucccauuccuuucccuccuuccgucuccaagaguguaaacccacuucaucucacccugccaggccuccccacuucugcgacaucaagucccucaaggguuagguacaucuucucccacugaggccagaccagguagucuuuugcuguauauguguugggggccucauauuagcuggucuaugcuacuugguugguggcuuguuuucugagagaucucagggguccagguuuguugagacugcugguuggaaacugcuauggggucacccuccucaacuucuuccagccuuuccauaauucaaccacauggguacccauugacuggguacaagcaucugcaucugucuuggucugcugcuucuugggccucucagaggauaaccaugcaucaguaauagugucaggccuuaaagccucccccuugagaugaauccuaaguaggaccggucucuuuuccuuugaguacugagagucucucaguucccaggucucuggugcauucuagaggguccucccaucucccaccucccaaugcugccuguuuccauucauucugcuggcccucagggcuucucuccugcgucccccauaccugaucaugcuccccuuuuccucuccccacuccauucucccacccaguucccucccucccuccugcccuccgugauuccuuucuccucccuccuaagugaguugaagcauuuucucuugggcccuuuggccuguuaaccuucuugaguucuguggguuguauucuggguauucuguacuguuuuuuuuuggcuaauauccaauuauuagugaguacaugugaauacauguccuuuuggaucugcguuacuucacucaguauauuuucuaguuccauccauuuaccugcaaaacucaugauguccucguucuuaauagccaaauaguaucccauuguguaaaugaagcacauuuucuguauccauuauucuuuugugggacauguuucuagcuucugacuauaccacucuugggcauacacucagaagaugcccacggugccacaggggcauguacucuauuauguuuauagcggccuuauuugugauagccagaagcuggaaacaauccagauauucucauauucuuauaaucucaaauucuuauccuguaacuuucaggguaguuccaggaaaaugagaccaaggauaugguucaacugaccaagagcuuagccuguaagcauaaagaguuuagacccucagcauacauguaaaugaugggggaaugugggagcggaucugugaucccagcagacaugggauucuugaugagcugacuaaucauuguaaugaacugaucagaucuuaguuauaaugagagacccuuccucaauauaugagguggagagcaaucaaggaagauacccagggacccaccugggcgucgcugguacucacuccuucucaucuacacacaucauuucuuuaacaugauaaagauuacaaaaugagcagacuguucccugaguacagguccauuucuuauuuuucuuuggacuuuuauuacuauuaauaaauaaagaaaucuccuacuuugaauauauuuuucacauugguugcuuaugauaugugagcuugucuccccauaucccccauccccaauuuguauguuagcaucaauguuauaguguucagaagagggucuuuaggagauaguuauauuaggaaguaguuauaucaggagagagccuucaugaagagcaaaggccagagaacuagguugcuuucucaaccauagaaggaugccauggaaacaugccaucagcugaaagucacucugacagauaccuuguuacugcauguaagacaccuacucuguguaucuauagccugaacucgauauggcagauaguagguucuuuuuuuuuuuuuuuuuuugguggugagauguggcguaauguuucauucuaauuacaucaauuuaagaagcuagaaagcuuuguaaagacaugcuuuaccaauaaugaaacucuucuugggcaaauggauggaccuggagggcaucauccuaagugagguaacccgaucacaaaagaacacacaugauauguacucacugauaaguggauauuagccaagaaacuuagaauacccaagauacaauuugcaaaacacaugaaacucaagaagaaggaagaccaaaguguggauacuucguuccucauuagaauguggaacaaaaugcccaaagaaggaguuacagagacaaaguuuggagcugagacgaaaggauggaccauccagagacugccuuaccuggggauccaucccauaaacaaccaccaaaccuagacacuacugcauaugccagcaagauuuugcugacaggacccugacauagcucucucuugugaggcuaugccagugccugguaaauacagaaguggaugcucacagucauccauuggauagaacacagagcucccaaugaaggagcuagagaaaguacccaaggagcuaaaaguaucugcaacaacaacaacaaaacaauaauuaaagucagugggaaauguaguuugauacuuuaaaaaaauguaauaaagagauuauuuauaauaaaauuguacuuagcguuuuuaguaucauucucaccugaauauggauauuacuuuuaaagaacauaagcuuuuuuuuuuuuugguaaaagucuacauuugaauuuuaaaguaauuuucaucaauaaguaucauaaauccccacuaagacagaaguuauuguucccccaauuucacauuauuuuuccucaggcuuuucuaugccuuuuuugauauagcaauuacacugugugcucaccuggcuuuccuguucacuaagaggagcuuuuucaaaggcugugauacuucuuucugucucugauucuuugacuuagccuuuggcauuugauauuucccaauaauauguuaaauaauguuucagauuauguuuaauacaaaaaauaguuggcaaauuaauccauggcucuaucguguuacaguaacuuuuauagcaaaaauauuccuaaucugggacugauggucggugucacauuuauuucuauaauagucacuucuucaaauaguggcagaauaauaaacugcaauaggguacuuccugagacucuucccgccuucaaaauaaaguacgcaagacaccaugccuccgguucccugcagggccagacuucacucagaucuuauuugccaaaugagaccugacacugcauuauugcuauaguuccaucuagguggaaaaauucucaaacaagcaaauuuaauacuaucugucaccuguauuuauuuuuccuaaaaguccuuucucaugucauugugaugugaccuucugaaguccuacuacuaucaaagcagaugaaaccuagcugguauugucccaagcauucaggggaccuguccuaaaguuuucaagagcuucucagauccugagaagaguuuaauaucucuuucuuuuucuuucucucucucucucucucucucuuuguuuuuuuguuuuuuuguuuguuuguuuguuuucgagauaggguuucucuguguagcccuggcuaugcuggaacucacucuguagaccaggcuggccucaaacucagaaauccgccuaccucugccucccaagugcugagauuaaagguggguuuuaaucucuuuagcucaguauuuggcauuugguguugaccauguauauuaaauugguuuuggaaaaaaauugccuguaaauguuugugguucugucaucuguauuugcugccaucuuuaauucugcuauaguguuuaaguguccuaaucuuguuaugaaagagggaaauagauuuccuugagaacaugaguagucaguuucuguucaguuguguuucuuguuacucuaacaaaauuccuaggaacaacuaagaggaucccacuaagacaaacaccauacugauucuauuuuagcucauaguuucuccagaguugauacuaaugggaagacaggacagagaaacuuaguuuauacccuggcaggccaggaaguaaccccucacuaaugauccuucucuagcuugggcccaaguuuccagaacucuuccauguagcccuagcaucuagagggaggcauugaaaauuucagccuguggggacuguguagacccugaguucugucagguuuaagcuagucgaggacauaagcuuuuacuuuacaaaacuguaucucccuccucacauguuuaguauuucugagcauguauucagcagccaguugcaucuguguaauuaaugcuuauacaaaaauaccacauugcauaaaaacuaaguugucaauggaaagaaauugugcccugcaaggggauaaaaaucaccaggaacgcaggguuauguuaagaggggaacuuucagaaauacuuaacgauugccacuauuauauuuucaaggaaaaggagaaaauguacucccaacugcugcuaggaaaacccuaaauaauaauuuuaaauggcuguaaaauuccuugcuguuuggauuuuacauagucuaguguugaagguggaugugcugcaucauacuguguguuuguagcaaugaagcccuuuacaccauuucaguucagcgcauugggcaacgaggaaucaaagcuggguuuaagcuagaauaauaaguuggaaagaccccggguuuauaauuagguggacuaaauccccauuagccgagcuaaaaugcauaaaacacacaaugucuguguagcuaguagcugguuacaccauaaugauagcuaacuuuucuaguuaaauuacuucauuaaaaguaauauuaguugagaaaaacagucuaaagggagugagggguuuuuuuuauccuuaaaaguacaguuuacuagagugcaguguaauccacauguauauacucuauugaaauguuccuaccuuaaaaaucagcaagccagccagcuacauugugacuuaauggaagacaguagucaucuuacugagcacaguguugaugggagcaguuuguguguauggguuuuuuaaaaauaauuuuauuagguauuuuccucauuuacauuuccaaugcuaucccaaaagucccccauaacccccccacuccccuaccuacccacucccacuuuuuggcccuggcauucccuuguacuggggcauauaaaguuugcaaguccaaugggccucucuuuccauugauggccaacuaggccaucuuuugauacauaugcagcuagagucaagagcuccgggguacugguuaguucauauuguuguuccaccuauaggguugcagaccccuuuagcuccuuggguacuuucucuagcuccucaauugggggcccugugauccauccaauagcugacugugagcauccacuucuguguuugcuaggccccagcauagucucacaagagacagcuauaucuggguccuuucagcaaaaucuugcuggcguaugcaaugguguuugcguuuggaggcugauuaugggauggauccccaggugugucagucucuagaugguccauccuuucgucacagcuccaaacuuugucucuguaacuccuuccauggguguuuuguucccaauucuaagaaggggcaaaguguccacauuuuggucuucguucuucuugaguuucaugcguuuagcaaauuguauuuuauaucuuggguauccuaaguuucugggcuaauauccacuuaucauugaguacauauugugugaguuccuuugugauuagguuaccucacucaggaugaugcccuccagguccauccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccgguugguacaucuucuggauauauacccaggagagguauugcgggaucauucaguaguacuauguccaauuuucugaggaaccgccagacugauuuccagagugguuguacaagcuugcaaucccaccaacaaugaaggaguguuccucuuucuccacauccucgccagcaucugcugucaucugaauuuuugaucuuagccauucugacuggugugagauggaaucucaggguuguuuugauuugcauuucucugaugauuaaggauguugagcauuuuucuagguccauuuaucaauucuugaucuuagaaugugagccauuuugagaucuguuuagaaaucuaguuuccccccugugccaaugaauuaaggcucuuucccucuuucucuucuauuagauucagugaaucugguuuuauguuaagguccuuguuccacuuggacuugaacuuugugcaaggugacaaauaugagucuauuuucauuuuucuacauaucaacagccaguuugaccagcaccauuuguugaagaugcuuucuuuuuuccauuuuuauaugcuuggcuccuuugucaaagaucaagugucuuuaagugugugguuuucuuucugguucuucaauuaagugucauuuuuuuggcacuguauguuaucaaagcaugguguguguugagacccaaggcugcacugaagucucacagcacacugucagccucauaucugaagucugcuugaagugcaccaggcugcuucucugcucuccuucaaaggagugauuuucuucuuaguuuugucacaugauuuguucaagauucuuucauuauaguuuguguauuucuguucuagagcauucuugguuccaguaggaagugcuuguaggaccacaaggcccugaauugguucuguguguguucauaauucaaccuaacucuucuuguuuguaucuucuuguugucauuauggccuaugagauagaaagcaagcccaaguggcuuucauagacaaagaugcugauauuuaauggcuucuguacuagagcaguaaaucuacauguuaauuaaagauuugugugacaaaugauaaugcuugucaucaguccaaugucuucuuaaguuuccuugguauuguuaauucaaaacauaguuugaauugacuuacuguuauugauuccuuuacucauuauaccuuaaagaaaaaccucaccuuugcaagggaaauaugguuaucagaugcucuauuucucguagaauagaaagaccuagugggauauaaacagggagagcgacaguaagauagacguggugaagguuaaugcuugcuuccugcauugauaucggaggucccagucacuugucaguauacucucuaauacgugcaguacaucuucauuaggaaggcagauagcaaucaguuucagguuuccagaugagccuguggccaggccauaauuaaccuuuugaacuugaaauuguaacagaauguacuauuggcuuagguuaucaauuauggucagagucaauugauacucacucaaaggggcuuauuguugauugauauuauaauuuacucaucuucccauuguggugauuaaaaagcaaaggugacauggcaugcuauucuaauuucuauucuuggaaagagaauauuuuauaagccagauaccuugccaaacaguuauuuaaguaaaaggguuuccucuuagucuccaguuuuauuuuuuuuuucuggauucccaaaacugguaagggaacuuuucaaacuauaugacaucucaacuuagagcagaauucucuuauagccuuucagucuauuagaguuuagucaaaccuucuaggguguuguuguuguuguuguuguuguuauuguuauauuucuaauauauuuuauccaguauuucauucaagccaaauacuaucaaaaauaauuaauauaauuuuacuuauuuuggaaaaacuuaauagaaaaugugcuaacgugaaaaauauuagcaguccaaauuaaggaagcauugucuuaauauauguccaauaaacccuuacuuuuaaauuaaauuaagcaccuuuuuauucuuaaguauauuuuacuuuauuauuaauuauagcuuuauaguuuuaggaauaauuuuguugauaucaaaugauguaccaugaaaguuauuucuugggaacaguugcaccuaggaaguuugggcuuuguuuugccauguuguguuguuguuguuugcuugcuucauuuuuuaagauagaauaugcuguauagccccaggcuggacucuccuaugacugacuacauuguuuaaaauuauuuucaaugaacuugucuucaauuaauuuccuuuaaguuucuuaugaguagaaugaacauuguauucaaauguguuuauugugauauuuuuauaauggugauaagucagagacaauauaaaggcaaauacauuaacgaagugaguuauguacauuggucugauacaaauucaucaacaaaaugauagcacagaauuauauuaaagugagaaaauuguuauguuagauuuuuuuaaggaagucuauaaaauuuucuacuuagaagugaaaggaagauuauugaaaacaaacuguaaggaaguguaggaaauuaaaaguggaaaugaauauacauacagugucauggguauugcaauuuuaaaaucucucuucuggguaaaauccuucuggugauguacaguagcacccagccucuuuccuuaccugcuuggugcucccuggcccuucuccucggauaucucucuucccagugaucuccuguguacagucucaugagcccucuagggcaggaggaaaccuucucuucucuuagguuuucuaguucuggauucauaaauuagacuuucaaaaacaggcuaacagaagaaagccauggaaacuuuauucgauaauuuucuucuguacauaauaacagcuuuuauaagauaacuaaggucccaaagaacaguuaggacccaaagcaaaguugggcaugauguuugaaauaaugaaaacguaaugggucagauggguuuggaccagcuacaguuaauuauagcaggggaacuaggaaguccaauugaacaagauuugcuuguugguuccuuuccuuccacugguauagagagaagaacauggguauucucauacuaugaagaagaaaaugaaaguuaagaacaccccucuugcaucugcucuuucuaaaaaaccucuuuaacucaagacaauguuguuucaagguauauauuaucauucugccacucgguuuccaaacucaggcauuucugaaauacagaaaaugggagaugucuuccaucuucugaguuaaguacagaaaucauuuggacucuuucacuaucuucccaaaaguuuuuuugaaaggugcuguaaauucuuuuucuccucucuucuccucuucuuaccucccuuucugucucuaguaauggagauuaaacccaggccaugcuaggcaaccacuaaauuauaccccaacucuccauggcccuuuauuccauucuuggcuuccuacucucugguuuccuaaaaggcugauaaaaugucauuuagagucugcuccugccuuucuagcaaaucucuaccuccaagaacagaggcucuaagauacucagcccgucucagauuggcucccuuauauguuugucauuuucccagccugcuguuguccuuuacuacuaugggcccuuuuauauaauguuuugucuggaaugcaaucuuucuguaauuucucuuugcauuauuuacuacuccaucacgggaaagccuuaccuuuacagguuaugucuguuucacugacuguucuacucuuaauuuaaauaauagagucaccuuuucuccacccucacaauucuucuucuaaugucuuugaacaaagucauucucaccuauuugaucauaagugugauccacgguguacauaccuaaugagaaacuuagaaagaugauaguagcuaagcugugcuaaugguagucuauaaugcucacacuucucuuaugcugcugcuacucuuccagaucugccacucugugcuuuuuaugaguuuauauaaauuauuucaaaagagguuguauaguauaauagucuucaguuucuaugguaacagucacuuauuuacuauacauccuuuguuuacauggugcugcauuucuuuuaauugcacaccccucuugaguugauuaguaucuauagaagaauuuuaauccagcaaccuggcagcucuggucaaggauuacauccaaaguccuaggucuauaugaucuggcaagauuucagacacgccuagauugcaguaugaucuggcuggaauagagacauacauguccuucauccacaccuuuaaucccuaacaaugacagugagguuaguuuguagaaggaagcagccauguuugaaagucaugucuaauugagggcaaacaaauugaugagucagagaaagauuugacagaguaguuagagauaggauaugcccgacuugccagagagcagcucuggaaagaggggcuacuuaagagcaacaagugagagaaaaaaggggugaaugccuggcaguuuuacugggacaguuuuauggagacagguugcacaaaaaacaaccuagacucuggugaagacagaaugagccagagaaugaaaaggagccagaagauuagaacaugcugccaaagucagucugaggccaaccagaaguuagucagaacccaagagaagcuggauugaaucagucaacuuggaagauuagauuguauggaggcuaaaagcuuccagaccuaagccuaggcauaguuagaacagagaaagaaguacucuggacucagcccaugcccuguguucacacaacucugguaugguucucaucucaucccaucaucugaggaaauaaaagcaacauuuacaaguuucuucucucuucauccucuaaauaaugauuaaaaauagaaauugccaggaggugaaaaaauuggagacauuaaaggaacacacuaauacaggaaaaauccaggccauucuugcuguuaauccugugcccauagcuaaaguguuuaucuuaccugaaccuuaguuuccacaagauuagauuguauggaggcuaaaagcuuccagaccuaagccuaggcauaguuagaacagagaaagaaguacucuggacucagcccaugcccuguguucacacaacucugguaugguucucaucucaucccaucaucugaggaaauaaaagcaacauuuacaaguuucuucucucuucauccucuaaauaaugauuaaaaauagaaauugccaggaggugaaaaaauuggagacauuaaaggaacacacuaauacaggaaaaauccaggccauucuugcuguuaauccugugcccauagcuaaaguguuuaucuuaccugaaccuuaguuuccaccuuacaauuugggcauaaaauucuugcuucaccaccauaccugucauaguagauauuuaauccacacugugcuuucuuuuccccuugcuauucccuguggagucuacauagaauaauccuaauaagaguccaacagaacugcaaguggcagguagaucucuuaaaagucagaguccucacuucaacggugccugccauaccaucugccuuucgugugguugcaugucucucuuuuuuagccagaaaacuaccagugauuaauuucuuaaauuugagaauacuugucagucauuuacccaaacuauugguguuaagaaauggaaaagaaucguuacuauuggaauaugaauucaccauuguauaugaacagacauucauccauucauuuauucacagaagugugaccuguguuuacauggucuagauugcauuacauauuagcuguucuuugaucaaauaaauagcugguagauagaaagauguucuuaacacccuccacacaauggguaucuucauuuuagcuuuuuauucaggaucauucuauaguaggccaaccauuuagauucaguuaccucaguuaauucauagaacaguuccuccaagcuauaauuauugcucuuuucaaggaggaaauuaagucugugauaaguuagauguuguccccgaguuauagcuaauaagaggaggaucugggaguucagccuagcuucuccaaaucuagauagaagcuccacuuuuaaucucugugucaaaagauuucagagugaguucuaagaaccuuuuuggucuccaugaugcuuuuaggggcucaauaaaacucuaaaacuauuuucaaaauaauuguagaacaguuauuuccuuuuaaaaucucaugccugauugugcaaugguacucugaagaagcuauaugccauguuguaucaccaaggauugcauguaaaggcagguauaaaaaucuaccuuuugcaucuauuaagggaccuguugagguguagaacaguguuguauacaauuaucacgauucagagcccuccuuuauguauguguuuugaguguuuuaaguuaagcccuuauuugcagaaggccuuaccauuguguuaagaauagcauuuuuuuaaaacugguuauucaguuuguuauaguaauacuugacaguguagaaucacgaauugucugcaacugauacaacugcuugagcacaaaaugcaacccagaguuucaaagcuagaaagucaguacuagaaacuggccggagaucagagggcagugaggagacuguuuuacccuuuguuagaagagcugauuguugggauaucagugggaggaaagacccuuggucuugugaagggccccaguguaggggaauggcaggacagggaagcaggaguggguggguuagugcacagggggagggaagauagggaggggaaaugaggaaagggaauaaaauuugaaauguaaguaaagauagugucuaauaaaaaaauuaaaacaaaaaagugcugauuguuauagugaaaugaguauguuaguuagucuuggcucggccauaaguaaucuauaauuaaauugaagaaauucaguuuauauuuugguagaugaaggcaucagagguaggcagugauguguaauguggguguguaauaugugcucucuuucucccucuuuuuucccuuuuaacuccuguguuuuaucuuuacgcaaagucugcccuggucaguaaauuccuaacacacuauggaggaagaauggucacagaauuauaaugcugcaagcuuagcaaucccuaguuuugaaaacaaaucaaaagcaaaauaguuugaucaauuggccuugaaauuguaauggaggcugguuugaaccaauguuuuauggugccauugcuauguauugauaauagacaugaaauacggcuuuacuggugugagaggcuacauguuuugauagcugaguucugcagacuuuucacuuggagcggguguuucuucagucugcuugcgugcucaccacuggcucagcuuguuccuguacuugguauucuuguuuauguggaugacaggagaaggugauggaagcacauggacccacggcuaacgugggcaguggccugggugagcugcagccugaggccuuuacauagaguagacaugaguuccucaaaguaagacauuaaaaauauauauuuggcauugagacuuuacuuuaaaaaacaaaacaguucugagguauaaaaauaaacaggauuuacauguuaaucaauagaaugauuaguauguauucuggggaguuucaauauuuuggauaaagguugcuuugcauaagauuauaaaaauucuuggaacauucgccugccucaucacugcccagcagauucuaagagaccaauacuaaaugccaugcuuuccuuacaaggaacauagaacaucuccaaacagaugauaauaagagagucuucuuguucaucuuaccuuauuaguuuucuucuugugagguaucaucauugucuccuugcucuaacauuuuuaagugugcucauucaaaauacuuuaaauguuuuauauagaaauuccauuuuauuuuuaauuauaacacaguuuaguuugaaucgcuuagaagaugcaggaaugcaucaugaaagagauaguuggaggccuaugcagaacugaccuguguggugaagagaaaaauagcuuccaguuauuucuuugauugauagacauuaacaauuuuacacauuuuuauuuguucuggaacgacuaauacaauuuuauuuauucuggaaauauauauuguauuaauguuguuugugugaacagucugucauguuucauauauucuuagacuuuuguuuuuagaguucuuuuguuaauuaccaaaguugaugguugagcuuuuucuuuguacagacauugauuaaacaugguuauaccauuuggcaucuuuggguuaaauuucagacacuuagaucuucagcuuguuuucuuuaaagcuagaauuaaaccaagcuauuuaagaacaaaggagauuguguaucauaauucaaaauauucauugucucuguagaauguuucccuuuaaaaauaagauugugccucaaagguaucuaggcauuggaaauugaacuuauuuguaucugcuauugauuuauucaagaucugacaguagccuucaaauaaugauuaucuuguaaaugagacaacauuaauuugucuagcuccguacuacuggauuguagagcuugggaaaauuugcugcuuuugcagucucuucauuccgaugguuuaugaauuaagagcaggggccuaucauagccuaagauccuacaguucauuagugcaaaacaaaguauccauuuauuaggaaaggauugccgaggaugucugcaagaguaaacagagccacucauaagaauaagcauugucuucaaauuuauacugaagugugcugaagaacauguaugcuauggcugugauaaugagcaguacaguagagagaggugauuuaugaugccuguuucugacagcuauagugcggagauucccaggguauccgaucacggcauuagcaugcugacagcucagcguuuagaacauuaugguaauuuauccugccuaugcugucaccugcacugucagaguuucuuuuuaaugaugguauaacuauuuuguuuguuuguacugcauucuuuucauuuggcuaaugcuuucucauuagauugaaccuaguaaaugagaguaauuaagugcuuccuauagcucagaugcagugauuaagcugccgagcugcuacugacuauguuuugucauuuaucucuauuaaucugagaauaauccagaugauaaacacauguaauuuuuugcuaauguucaauagaugaaauuuauaguuccucaauggaaccaagcauuaaguauuuauucauauagaaguaauaaguugguacacguggaccugcuuuaaguaaacauacaaguaagaacuaaaguuaaugaaaacuauucuuuuaauugccacacugaauuuccucuuccuaaaguguccuuuccuccuuaccagagagaccgugaaagaauacaggcuucucucuuuuuuguggagcaggauguuucuccaagucccaggacaagauuggccuguuuaaaugcguggauguuaagugcuuuguugggaucacucccuucugagucugucaguucucaaguacucugauucucuaauuauacuaauuuaucagcguuucaggaaauauuuuaaauauauuacuaaauaauuaguggauuauucucuuaauaaauaaguuaaauuguagaaaaaguaauuuagagucauauaguugguuuuuaaaaauacuuuuuauuuuuaugucucacauuuguucugaaaauaauagugccuuuagaauuuugauauuauuauuauaucuacaaauaaucaauuagcuuuuuaaaauguuuauaaaaagaaaugcuuaaccaaaugauacauuuuauauauaaugagaaaguaauaaauuccaaguucauguguuuuaaaccauuauuaugaaaagauuuguuccucuuugugauuuuuuuuaagguaaaauuccaacaguuucucaaaaauauugagaagauaggauuauuuauagauuauaauauuacaguacuauuuuuauaaauguuuuuaaucacaaaauugcuuaguuuguuaauauuucuuuggguaggcuaugccagauuuucauuuccuguacaaauaauaggaaaauugaagggaaucuaguuguugcauaaguuacaauuccucuaagugguuaugaauauaggagcuuucucugagcuuuaucuuuguggagcugacuuucagacacuggacugcauuaggaacugcucucacacuuauauaacaaaaggucuuuugaguauuuauucauacaguauuauugugcauaauugagguuuuuugcugaauuuuguuauauuaacaaaugauaucacuuaaauuaaguacuagaaacauugauucuaagccuaccuuguuuaauuuuaauaaaauaauuaauuuuugaaguugaagacaucguauaaaacuugaaugccauuugaugauucguuuauucuuuagacuuauuuacaaaagaaaaaaaugcacuuaaaaaguggguuuagacuacacauugaacuuuucuuuaccuuugggcauagaaagucuucauguagacuuauucagaauugaagugaucauaaauuuuauagcguauuacguucucugcaggucucuaccaguuguugaguaucacagugcuuagaagguugaacacuugaccuaauguauugucaccuuuuuuagaaaucagauuuccaauucuguacuuaagucugacuuuaaggcugaguuaaaauauguguugaaaguaucagauugcauauggagcaaugauuuguuaauguugacuuaauagaagacacugggugugcaugggugcuggguuggguggcucucgugagcagugcccauuaacuaaagaagcggaagcagagagaccuaaguuccaguucagagauuguucccuaguaauuucuuuguaaaaaucuuucccuuucuuuugcauuccaggauuuuagcuguguaguauuaaugcaaaguguuaagcuaauauaauguuuuucaaauauuaaacuuuaaaaugggaggccacaaaacuauuuuagaagucaugaauauauauauauccuaucucuguguacugauuuuuaaguaaaaauuagauaauaauacuugauggaacguucucuuaucaguggguuaaaagauaagagcauugguguuauagacuggaacauuuugauacuguugaaauaauuucagaauuaacuaucauuguccuguuuguuuccuugcauaguuuuaaaugcccuuucuuaaacaguaguagucauuacagcuguuaaugcccaaaacccccacucuuccuuuaaacaaagagcuaggcugucugagcuguuaauguugaaaucacgauauacaaguguuucuuuguucuuagcuuugaaaauaauuauguaauagaguaaagagguuuuuuuccuccuuguuggucaguucuguagaaguaauuuaaaauacuguauauugaauucuuugaucauuucuccuggguggacugagaaagaacucaaagccaaggcaauugcuucugggcucucguucugugugccugguaaaugaaacacaaggaaccccacaaaccacaugacuaauggccaccuccagugccgccugcaaucaaagauuaauuugcuuuaucaaguuuaaagaauaccaggugauaaaucaugucaaaaagaaauaaucagucaaaggcugauucuuuccuacacucgaggacaggugcuacacugaacgcuuuugccagucacaguuaauucugguuuuaugcauuuacauguucaucuuaauuuguguuuggaugauacuugaaucaaauaauuucugucauuaagaccaacuagcaucucaacugaaugagaugcaagagcuauuccccuuuacuuugugaugagcguauucucgugaguauuacucuagcuguuucuuuuauaauaugugaguuagcugaugucacauggaaagcgagguugugauuuugcaugccuuuuaugaacuggguauucaaauaugggauagaaauuggugugugugugugugcucaugagugcacuucuauaaaauauuuuuauccucacaucucgccuucuuuuuccuucuuuuaaagugaaagaggaagaacuggagucugacuuaagcuccuugcaggauucauuccuggaaggaaguggccuucccaguguuggagcaguagauacauauugaguagucuaggacuaggcuugugcugugguggcagaaguauuguaucauuacuuggaaaaggcuccauauuguuuuuagcagagcuaccugcugcuugcucgcuacaggcugugcucugaagcuuuaggacaugcuuggaguggguagccaugugugggccuagaucuuuacugccucacucuaccguugguggaaacuuaguccuauuccauuucaugugcagaauuaaauaaacguucaucagguacucagaacucagagcugugaagcuacuucugugugaaagcaguuguagaaaaucuuucuagaaugggucauuuucuuuuugguuucagccaaucuuucugcuuagacucucagcccaauuuuccuccaaguuucuuguuggugacacaaggcuuuuguuguagcugucuuuuguuuugguuuuucuucugauuccugagaauuaucuuaaaauauuuauaaagguccauuauugaucucacuagcaucccaaagagaaagugccuugucagauuccucuaggauuuaagacuucuuuuuaaccugcauaggacucuauggugccuguucacuggggcuggagcgugaaaugucccuguagacucagaugucuggaggcugcuccacagcuaggggagcuguuuuggaagguuguagaugguuuaguagauggagucucacagaaggaagugggaucauugaggauaggcuugaugaauuacagucgagccucacuucuugucugcucucugcuuccugacuacagaggcaauguaaguagaugcuucacacuuuugccaccaugccugcccaccaucauggacugugugcucuccaauggaaacauuccuuuaguugcuuuguacugaguauuugguuacaauaagaaaauccaaguacuauauucauauuauuucaugugaagguauaguuaaugugguauuuuuaaguuuaaauuuauggaucaugaugguaaagucccuuguguuuuggauuuuguaauccugauaagacgcugauucacugauacucacuagcaguuggaauagugggauucucugcuagagaauuucuaguuacugucuacucacucaccccacagcugccacuugcucagagaagcccuuguagguuucccaaaauaauauuuuauaacugcuagcaucuauaccuguaaaacucuuuguguaugcaaacgauuguuaauaucuaaaauucuguagaagaauugcaggcuuugugggauggaauaauguuuuacuuucuugggccaggaucuggagcagugucuaugcaccuagguguauuuuaucuauuaaauaaauaaaagggcacacuaugugcuaaguugcagcugcaugcucaugccaggcauuagguugccuaucucuugugcaagcugaguuuggucuagaaagaacagugaucaugcugcucuucagcuugaaaaccugcagaucuuguggaagucagucuuguggguuccuguucacuggccaguccucguggauccaagagcacagcggcaggaauuggacaaagaagaaacaugacgagagguucugucuaugugcauuuucuggaauucauaaagcuauacaugccuuugacaugauugaauuuuaucacauacauaauuauacucaacuuugaaacagagaggaucuuuugaggguuugaacccaggcaacuguugaucuuuucuuuaccauacugcacaggacggauucagcuccagcauaugcaauacugccugucauccauuguauacccugcaugccaguuuaguuucauaaaauggaaugaauaaaugaaggaacaaaugaaaggcagaugccauuguuggcuacuugaagauuugaggacagcuaugaggccuaaguaaacaaauuaacaaaggaaucaagaaacaucccaugagaaacuguauuugaacuugucuuaaggauaaagauggugcagaguuaggaagggcaauuugcaaauucauuuggaauagcaaaaaaaaccuaggauagccaaaaccaauuucaacaauaaaagaaccucugguggaaucaccauccuggaccucaagcucuacuacagagcaugugauaaaaacugcaugguacugguacagugacagacagguagaucaauggaauagagucgagacgcagaaaugaacccacacacauauggccacuugaucuuugacaaaggagcuaaaacuauccaguggaaagaagacagcauuuucaacaaauggugcuggcucagcuggcaguuagcaugcagaagaaugugaauugauccauucuuaucuccuuguacaaagcucaagucuaaguggaucaaggaacuccacauaaaaccagagacucugaaacuuauagaggagaaaguggggaagagccuagaagauaugggcacaggggaaaaauuccugaacagaacagcacuggccuguguuguaagaucaagaauugacaaaugggaccucauaaaauugcaaagcuucuguaaggcaaaggacacugucaguaagacaaaacagcaaccaacaaauugggaaaagauuuuaccaauccuaaauccuauagggggcuaauauccaauauauguaaagaacucaagaaguugcacuccaagaaaccaaauaacccuauuuaaaaauaggguacagagcuaaacaaacaauucucaccugaggaauaccgaauggcugagaagcaccugaaaaaauguucaacauccuuaaucaucagggaaaugcaaaucaaaacaacacugagauuccacuucacuccagucagaauggcaaagaucaaaaacucaggugacagcagaugcuggcaagaauguagagaaagaggaacacucguccauugcugguagaacugcaagcugguacaaccacucuggaaaucaaucuggcaguuccucagaaaauuggacauagcucuaccagaagauccagcuauaauaccacuccugggcauauacccagaagaugcuccaccauguaauaaggacacauguuccacuguguucauagcagccuuauuuauaauagccagaagcuggaaagaauccagaugucccucaauauaugaauggauaagaaaaugugguacauuuacacaauggaguacuacucagcuauuaaaaacgaugaauuuaugaaauacuuagauaaauggaugaaucuggaggauaucauccugagugagguaacccaaccacaaaagaacacacaugauaugcacucacugauaaguggauauuaccucagaaacuuagacuacccaagauacaauuugcaaaacacaugaaacucaagaagaaggaagaccaaaguaugaauacuucaauccuauugcaaaugccaacaagagcuugcugacaggagacugauauagcugucuccugagaggcucugccagugccugacaaauacagaaguggaugcucacagucauccauuagauggagcacagaguccccaaugaaggaguuagggaaaguacccaaggaucugaagggguuugcagcccccuaggaagaacgacaauaugaauuaaccaguacucccagagcucccugggacuaaaccaccaaucaaagaaaacacugggagaaacucauggcucuagcugcauauguaucugaggauggccuaauggccaucaauaggaggagacacccuuaguccugugaagguucuaugccccaguauaggggaaugccugggucaggaagugggaguggguggguuugggagcagguggaggguagagaggauaggagauuuucugaggggaaacuaggaaaguagauaacauuugaaaugccuuuaaucccagcacgugggaggcagaggcaggcagauuucugaguucgagaacagccagggcuacacagagaaacccugucucgaaaaacaaagaaaccaaaaaaguaaauaaugaaaauaccuaauaaagaaaaaagacagaaggaaaaauaaaauggguagagaugguggcucccugguaaaaguggagggcgauaguuauucccaggugaaggaaaggaagacacaggcugugaggaugugaaagcaggagauggucagccccugggauacacauagugauggagaccauggucacaggaagaugaugcugcacucuggaagagacauggaaaagccagagaggaaagauaguuuugucuuauaaaaaaauaaaauaucaacaaagauuuuaaauuauguagcuaaauauugauugcuuauauauuaaauuauguugauuugguaaccagugaguuaaaguacuuacugccaaaucuagcaaccugaguucaaccccuaguucccacacgguaggagaggcccaacuaauucuaauucccacaguuggucucugaucuguagacguguagacacgugcaugucagcaugcaugcacacacauuaaaaauaacuguacugacaauaguuuaguccuggaagggaaaagacaaauuaaaaggaaaauguaaguugccugcgagacaucuuugacauucugguaaaaggacuauuuauuguuucucuguuucucugucucucugucucucugucugucugucugucucucucucucucucucccucccucccucccuacuucccucccucucucucucucucucucauauuuaaaaacucuugcacugaauguaguaucuaaggaaaaacacaaccuagcuucacuguucuuucaauuuucuucauuaccuucauuacccuucacacacacacacacacacacacacacacacacacacacacacacauuuuaguacauacuaugaagacuaaacacuaaguaccaggcuuucuuugcauccagaauaagagcuagaguuuuuagcuuaaauuauuuaauugguaguuuuagcgugagcuuguggaauaacccaaggguuacaaucccauccauggcacccacagguuuuuugaggcuauuuuccugggcuuugcuuuagauucaauuagcucucuggguuagccaucuucuuaguauccccugccugcaaagccuguauuuaucuuuuaguucaccuguacuuuaaaauacaacccauauuucaccuuggccuaaauagcagccguuuuguguaauaaggcacagagcagaaacuuguuugauuaacuucuuaguaauauuuucuuaccuuuuaaguucaacaaguugacuucccuuugcuucuguccaggauuuguacauuucuugagcccccauaauuucaucagccguucuuuugggaucauuuaauguuugauacuagcaagaguaaauaaauguuucuuuagcaauugccuugagaaucucauccaggaguacugcaguuaccucauucccagcccacauccucccuucuuccacuccucaugucccccauuuacucuaaauuuauaucuuccucuucuuuaauuuuauauguguaugugugugcaugcauauaugcacauacauuuauauauauaugugcaaccuacugagucuguagaguguugcucguauguauaaguguuuacugaugaccacuugggauugcauaauauaucaaaggcuaucucugcucccuuuuuuauuguagcaauagagauugcguaguaguagcaaaccaaaaccuauucuacagccucaaguaagcucaucccagaagcugcuacugacaguaaucaaauuauacagugaaaucguccccaaguauguuauaucugcucacauccucacauacuuagcuuauacacuauuucagagaaauuguuuccaugauguuuuauaguacuuucugucuucuuuaagaacuaacaaacuaaggcauauaaaguuugcaagaccaaggggccucucuucccagugauggccaacuaggccaucuucugcuauauaugcagguagaucacgagcucuggagguacugguuaauucauauuguuguuccaucuauaggguugcagaccccuuuagcuccuuggguacuuucucuaacuccuccauugggggcccugugauccauccaauagcugacugugagcauccacuucuguguuugccaggcaccggcauagccucacaagagacagcuauaucuggguccuuucagcaaaaucuuucuggcguaugcaaugguguuugcguuuggaggcugauuaugggauggauccccaggugugucagucucuagaugguccauccuuucaucucagcuccaaacuuugucucuguaacuuuacauuaauggaaaaaaaaaaaaaagaacuaacaaacuagggggaaauauaauucuuuuaauuauuuagugaaguagauuuuagguacccacaggacaaccuuugggggacaaucccuauuguguguaauaggucauaggaggaagagucaacauuuauuaaucaccuguaacacaacaccaaauguaaucgcaacagucuccugaagucaccccucuagugaugcuugggaugcauccuaacuuugccuuugcuuucugcccuuuuuucuuucaccuucaucauuuggugaauugaacaaucaguaauuauagcugacaaguaaagauacaccucuaguguauacagcguucuuacgcuagcucaaaaacagaagugugugcagagcaaggacagacagggaagucuccucuuguagaaaaggcaggggauagacuugaugccaucauucagucugggaguucucugccugugguucagguggugguucacagagagagccuggcaucagcaggguugcauaacuuuuugaaagucauacaacuagcaguccuuugggcaagcauuaaauuuggggucuucccaauaccacaaaaagaaaugugaugugaugugaccaucaacaucuuugaucagauuuaccaagaaguuuauaacaacucugcccaucaaaagcuaaauaaucuguguuguuucaccuuaagaacuacggggggggggggggaauugguauuuuaugacccuucuguuuauuuuucuuuuagauucauuuauuuuaugcuuaugaguauuguucuagcauguauuauuugugcauauauauaugcaugcagugugguauccacagauauccgaagaggguauuggguucccuggaaauggcguuagggaaaaggauuguaaaccacaauguggauacuggcauccaaacuagggucuucuguaagagcagcaggugcucuuaauugcugaaccaucucuccagcccucuguuuauguuuuuaaaacuuuuuuucuugguuaauaauauucagguaaacuaauucauuguuaguucuuugagcuggaaagccccacuuugauuuuauucuuaguguaauguguuugaugaaagugcaaaccuggaacagaccagcuuuguaacucuacugcuuagcucuguugccuugguaacauuccuaguugcucuuucauuuuccucauuuauacaccucaucacaguagugauggcccuucugauagaugugaacauuggugaguuuguguaaacugcuuaguacaggcaggaguucuuuccagaggugauguucacuucccagaagacaucugaguauauuggaugacauuuuuugguugucauuuugcagagggggugcuaugagcauuuuauagauagagacccaggaugcuaucacauauuucacaacuaugaaaauaggcuccauaucuaugcguuaucuuccuccaguugucaguaauacugaguuugaaaaacacugguuuaguacaguuccugccauaugcauuguaaaauauuugauauuuucugauaaugucuaagaaaagcaucagggaauaauuauuauauacucuucuaggcagcuaaggaaaaguagguaacaaauaggauauuaauauggggaccaccacuuaaagaaugugaauuuuugaaauaugaaugaauaugaaaucauaucugauaaccuguguaggcaauuuuaguaccuaauucuaccuagcacugauauaccuauacauaugugcuuuucagagcauucauguuuauauauguaauguaugagugguuaguuaagaauauggucuuuggaguuauuuggaauuauucugacuuguauucaaaucccagcagucauuugaagacucuuaguacacacguaacaguucucugaaacaguuucuccauuaguaaaauuguaaaacauuuaugccugcaucauaaaauugugauguuacacugagcauaaugcuucuacuccaugcacacuuuacgguacccaugauccuucauuucuaccauccaugaucuguuccauguacacacagugaagugguucagaacuauaggagcgaggcaaggcugauugccgguaguguggcucuggcccuggguucuuugcuuaccguagacacuguauacaguuuuacaugcugauauuacuaguuauauccaaucacuguugucuggugacucgacaaggucuccuuccuugauugauaaccaucagugucuaguucccagcaucucacccuuuuuggagauauucugggucuuuuuuaauugacgugcaaguuaugcuuauuuuuaagaaguguccauuaaagugccaaguuacaugccccauauguguuuuuauauauggaauuucaccccaucuccaaauccccuaucacaccaagaagggauccugaaccaggaaaacagugugaccauaaacuguauucuuuucgauuauauuuucaucuuccuuucaauuauauuaugaaauugccuaugugguuuguucagaggcaaacucaaagcaugacaguuuguuuuuaaaauaauauauuguuugauuuugcauguaguaagagacagugguuacugccuguguuucuaaacacuaauuuguaguaauuucuuccauuggcuuggaauaaugcagucuguaauuguagacauggcuuaaacuuugagguaauuugcaucugucuauauuaauguuuuucuuuaacaagguaauaugcucuucuuuuguucuuuuaaaaauaauuauauuaaauauaaagaauguaugcuaauuuugaagaaagaauuuuuuuuuaccauucuacaguuaaaaucgugauaaauaaauguugcuauaaacugauagcagcuuccuugggagccucaguaagcuccugauuucagguuauuagucuugugcaucaguugaagacaucacaugaucaccaguaagcagaugcagagauugcaggggagacaggccggauguagaacuguaaccagaaguguuggcaaaccacaaguuucucuucuguugugcaccugcuuucuauacaccaguggucuaaaccagcugcuuuuauauucccccuaccuaccuacucucagccaucuuagaauuugaaccauuuuuuaaaaaagagguccagaacugaaggaaaaaccauguuguauuaugggaucauucacaguaaaucaggacuccaugccacccucucagggccugugcuuucggaacauuccaguuuaaucuuugacagaauaacuaauuuaaguguaguauauuguauguuauggggucaaaaauguuuuucucccuccucaacuacucauucugagauaucagaguguaaauugccuguguagaugguuggccacaguguaauacacuacaaacaguuuuuaauauaagcaauuuacauguaccuugucguuagagauggggaggggaagaagaagaacaccauuugguaaaagauccuaauucuuccuaaacuagauauacccccuuuauuaucaauuuuaaaaguagcauuuauaaaguaccuauuguguaauggcuccuauacuaugcauuuucuucucagcaaugaaauguccucuucagccuuguccaaauaggcauauucccuuucauuuuguaaacaauaaaaaugauuucagacaaguuucaaaaaugguuccuggaucccaugugagccugaagacuugaccucuagacugcgugcacgauguugccaaaguccaagccacaaguggggcugggaguuuuucugccagagagacaguauguuuuacuuagguggaucugaguaagccucaugaucugggaagggccuggcuccugucuguuguuugguauccuguggcacauuuuaggcuuguuuuguuuuguuuucacugaucauuaagaaauaguuggccccuggucuuccauacuucuuuuuaaaauuagcuaaauguuuacuuaagaaagaaaaggaacaagguauagccuguuucugaacauguacaguacuucuguuugaauauguauuugucauauaugagugugaguuugugugugugugugugugugugugugagagagagagagagagagagagagagacaaagcaaggagagagagagaagaggggagggggggaggggaggggaggggaggggagagggaccuaccaaaggaccugaggucaguguguguugucucccucuaucaggcuccaccuuuuguuuugagaugaggucucuuacugaacacagauuccacuagacagcaagaucucggcuccuucugucucugccucucuaccuggaaggucugcacugcuuugcucagcugaggacaaacucaggcccccaugccugcauggcaagcaguucaccagcugagccucuccugauccuuacuuucuuaggaggaugcauauagggcagaugagagaaagggacugggaggaaaggagggagggaaagcugcauuuggauuguaaaauaaauaaauaguuaaagaaauguguuuguauaacacggcuagcugagccuguggugucuuuuaaagacuacaguuagaaucagaugaccauaugguuacauucuuuuagaccuuuauagcugccuagaaauggaguaugcaagccagacccacagauacaacagagaaaguucaguucugcauaucgcaaagcagugguaauagaugcaauugauacauacuaaaagcaaagcgcacaugaaagucaacaucaugguugccuuaagucucuuuggccuagaaagccgaauacuuuagaaggagggugguuuauuauauuguuuuuccuauguucaugaaaauuaguaagaugugagaaauuuucugaaauauuuuaauuugaacucuuaaaucuaauuaaagacucuucaagauaucacagauaucuaggcuacugaaguuaauaaucacuguuagagaagaguucauuagcgccuuagagaguuaacggaucugccgacuucuccuucugggccuuucccuccuaaccucccuuauacuuguguugauucugggaaagaggcgaauugucacaguuuucucguuacaguaguucucaaccuaaguuccuaagugcuacagcaaaggacuuaagacugccauuuccaccgucaguacuuguucugacgcuaugaguuuagacuucuuuuggugcguauuuaagugaacuccuuugaguaaaugaacuccacccaccccaccaaggaaugguuagauaaaauggagguacacacaguucagaaugugaaaaguagaaaguucaaauugaaaauaagaauuaugaaauaucugaaaaggccauaauuucaaggaaaagcaauccguggugucagagauggcagagaagcccagaaucaaaaugguugacaccugucuuuugugugcaaauagguagacaaaucuuuuguuuuguuuuguuuuguuuuuuuucgagacaggguuucucuguguagcccuggcuguccuggaacucacuuuguagaucaggcuggccucgaacucagaaauccgccugccucugccucccaagugcugggauuaaaggagugugccaccacgcucggcuagguagacaaaucuuaaaucacauuuugaucuucguucuugccacauauagaacucuuuccuuccagaugcacaagaaaucaguacauucugugaaugaucccuuucagaguccaguacacucacuauccaagucuuaguccccacucucccuuucaucuuuuuuuuuuccauuuucuauuuggaccacauuguuguacacacauacuauccccauucaaccauucacacucacagauaacucauugaaauaauaaugauagugcuaccauucgauucuaguucaucacaugcuaaacacuucaauaacgaacuuuuucauccauuaaaucuuauaaaguguuauuaaccccaauucuacagaaaaguacuuaagcuaagaauauacaaguaggaaauggcagcacaggauuggaccucaagugucaucaauauggcucagcagguuaagggacucuccaugcaaagcuggcuacaugauuuccauucccugagcccauggaacaguaaaagagagagaaugagcucuauuaaggugaccucuauacacaugucauggcacagaugugcacacacaaguuaugcauacaaacaugguaaaaaguauaaacauuuuaaccuuagcucuaucuagcucucuaaaugcauuuaaaaugaugggauuuuauuccugaucuuuuuccuugaauauuuugugcccugugacuucauuuucuuaccuuguuugggauucuugaggacaagagcaauagcaagcaauacaagaacauaacuuguguuuuucaguacaacuagcucauggcuacauuaucaaccauuuucuuugugauugcuuucauacaaaucaggcaggaugugguggucagauuguugaguuacgagagaacuuuaauucugauccuacuagcuuuucugaaauaggcauugcugauucugcaguguuguguaaggagcugacaaaguacaccagccaguauuuagguuuuagggauuuuaaacuagaaaaagaucaucauauugccuacaacuguguuauucuuggcaagaaacauugcuuuuugucuuuuuuuuucauuauacauauauuuaucacugcagaucuauuuaguuccuuacaaugugcuaagcagcagucaccauugugacuagagagaacuaagcuagucuugccaucacaaauugguaaagaacuuaaaagcaauaaguacucaauuugauaugucucauaagugguguguguguguguguguguguguguguguguguguguguguguguguguuuauauauuuaacuuguuuuugcuucuuuuuuuaauaguaaaugcucauguuuacugcacugggaaccugucagaauacccuugcagaaucugaggcuaagacuuuuuuguggcuugucgcugagcugaguaauguaaacauguaagaaggaauuaggagcugcgugguguggcagcugggccuugaggaacucgcucagccucacccuuuccacguucccacccacagaugcaaauccuaaugucaacucaguucggccuguuugucaaauuaagaaggacaacaacagccacuauaacauuccagccaaaaagauaaguuaaagcauugacuucucagaugacaccaagaugcagacacugucuguauucugucacauaggugcgaaguguaauucaagguuguuuuccaugcaccaaaugaaaguucaguuagaauuuacuguacugcagaaagugugagugaacaaacauauuacguguuuugucccuucccuuugucacugagaauauuaauauuuauagaauggggaaugaucuuaauuucagcaaacaugcucauuuacuauuaaaaaaaagcaagaauaaguugauuuuauuuuuaaguauaaacauauaucugcauguccauagagaaguauaaaugcuuagaaugucauuauuacugagaguaaugauuacuuucuaaauaacaugcuuugaaauaaacucaguuuauugaacucuuuaaaaaacacuuaccuggucaauaagauggcucaguagcuaacagggcucaggaugcaagccugacaccugagugucacccccugagagccccaccccaccccaauaugcacugugcuccugccugcccacauuccguggacacacacacacagugauaaguuaaaaaucuguaaaucuuccacacgauccuaauuauuaaucaugauaauuauaucaauucaaaagaaagaaaauggaaacgcagacugcuacagaaugcaaacuucaucucugaagaagacuggugcugcguuguuugugcuuuaaaauuugaagcaauagucauaauacauaauuaaauaaaguuaaaauuuuguagguauggcacaaaaagucaccgauauuauagcuauugcaggaaauagaggagauuaauaauuuuaaaaaagcauauuaccucauguauuuucuuaucaugauuagaggaugagagcauuaaguaaacacucuuauuaauuuaacaauuuaauccugagaguggaguauaaaaauauucccaaacugauuuguauacagaagagccagagagaugggggacagagggauuacaaauuacuuacuuuuacaaaguaaaguuuucauggugguguuuguggauaugugcacauaauuuaaaauacaugcuaugagugggaaagagaagaggaggagcacagaaugcaucugauauagacacuuuguagccaaauggcuaaucugauauggauacucuguacccacauggcuagccucuuacaaauacagugcauaggagcugaaugugcacuuuguccuaaauccagucaucucacuauuuuaacuuuguuuuagguaacugcuuggagcuauaauuuauaaaagaaagcauuauccuaagaacauaaauuagaaaaggauacuguguuggcacucaguaacugagcaaaguuuaaauuaauccuaguuagaaggccuuaaauauauuugguacaaagaaauaauauuuuaaaguuuauuuuggaagcauuuuuaaaagguuuaaauagcauguauagauuucaugaauagcuuuuacuauauguuguaggcauuuguagaucacauuauuuuuccuaucagcuguuuggcagaguacacaauuugcuaagaugguuaauaggacacaaauauagacauuuugugugcuguaccauguaaauguaaaccuuuguaguuacauguuuuuguagcaagagaauuguuuuaaaaggcauguaauuuauuagcuaucgguaacugcuuuauugccuugccgcgcugcaguaauaaauaaaagaaagugaacugaguuuacaaauggcacacaaggugcacauuuugugggggaaaagucuuuuuuuaaagaauuggcauuaaauccuuuuuuugugaugacaaagaggcuaagagugcaaacuguauuuucuguuuaucgaaaacagucuuuuuuucuccggggcauuuuuuccuaugaucaucaagggauuucaaaagcaauaaaguguggaaucauuguucgacuugagcaguauuaaaacuuagguuuuaauuucagugaaguaauaagauuugaaccugucucacauuacagcacuguaaggcauuuagcaauuguauuuuaaaggagguuuuuaaaaugcagcucacuuguaagcuaacugucuuucuguaauuaauaguuuuucuuuagccuaggcugcuguggaucagaccaagaaauaucugaguuuuuaguaacacauaguaauuguaagucuuaacuccuaauuagccuaaaugucuaauaauuuucuauuuguguccaaagcugcuaaaauguaguggggaaaaagagugguguuuaaagcuagagugugucuuugggcuuucaaaaauacaacuguacaugugcauguacguuuuuaugaguuguuauauggagcaaaauuaugucaguauuuuauccuucaauaucauuuacuagcuuuuaugcaccacaucacauauauauguauacaaacacauauauuaagcauauauguauguauuuuuguauguauguguauauauagaucuguguguauguauuuuaagugcaagauaaggguuuauuuguaaagcuaaacgcaaaguuauagucuagauucuuccauuguaacauugaaacucauaguuauguucaaaaaaagcuuuaaaauaugaggcuuucuauuagaucagugugagaacauacuuacugauaaaagauuguauuuaccauuuugaauugcuauugaaaauaauugccucuacaaaaggaaacaucuguaugauggcacaugguuaaagcugccaucaauuuuuaacauuugaggguugagcuaugaccuuuuaugaugacugugaacaguaacugccuccauuagccauaaguuuuguuucuuuauuuuaguagauggcccagacuguaaauauuagagaaucuaaaauaaaucaacauauuauccuaaggauacaaaauguaagagcuauuugugguuaggaaccuuugacagauaguuuggaugaagcagaugauugccugccuagcguaucuggucuccauugcuaugccugcgggcaguuuagugcuaugguuguauauugaugucaggguuaguacugaguggcuagcagugacagaugucuauaauuacaggcaaugcuuccaguauuucugaaaagccagccuaaguugaacaauuaucuuauuucugccuugccaaagagcauguuccaauugcuaguauuagcagugguggguauagagcugcugcugcugccuugggacaaaugugggaaaagcaguugguuauaaaacauaaaugcaaaauauuuuucaacauuuuaaauuaguuaaguacaguguuucccuaauuuuuaucuccccauaauguuucuguugaaggagucuugauauauaaaaacacauuuggcauacuuacugggauuuuguuuuccccucggccuguguggcuccccagugccaguaucccuugcuuuacugaagagauguugagcaagcuggcuuugauguagauuguaugcucugauugauuaccauuacaaaauuggaaaugcauuuccauggaaaauuucucaaacucaguaaguuuauuuggaaaacuuaauggcaaaauuauaaaaugauaggaaaugcuaaaccaucaggcuggagagguggcucagggguuaagaauucuuggcugcucuuacacaaaacccaguucaguucucugaacccacaugguggaucucaacugucuguaacuccauuuccaggggaucuagcacccucuuuugcuucauaggaucaugcaugcaagugguguccauaaauucacacagucaccaacauguauacauaacaaaaagaaacugcuaacagaugccagauaauuuaguauaucaguaguuuuacauuugcuaagaauuacaauuguuuguuuguuuugcuuuguuuucuguuuuccuuguuguuuuucaagauaggauucucuguguagcccuggcuguccuggaaugcacucuguagaccaggcuuaacuccaaccuccuacuccuaccccccaguacuuggauuaaaggaaugcaccaccaccaccaagaaagaauuaugauucuuaaauuuuguuuuaaucucccagcuucaaagauuuucgcuuuuuaaauacuuacugucauuuccaaacuccagguuuugauaaccacuucuuuucuugcucccuuuggacaacuuugcuggcuuauuaggaauguuuuuauucuuugugguacaaauguaagccugucuuuuuuaucuggagguacaaccauuccaacacauuucaaccuacuuaaaguuaggcauuguauaguaauacaguuuauaugcauggcauggguuucaaccucuucauuuucaguuacuguagaauuagaaacaccuagaaaaaguuugagauugcaacuucaacuuaaauuguauuucagucuguaguaagguuucuccuugcagcuuaaacacuuggauaaauuuuuaauuuuuuucauuuagcuuuuuuuucauuuagcuuuuuuuuaacuagauauuauuaucaucaucguaaagacuagaauuucacaaaaucuuccuacucuaaaccaacccagcuugcuuuccucuguguaauguuaccuaucauguaaggauggguuuugagcaugaucaguuucauagugucugaacaaaacuaacauuaugacuucaacaacaguuugaagcagugguccuagcuggccaacagugacacagaaaccaaacucgauccuaaaacaggcaaucugccucagaacugagagucagacauagaaaccacuaacaccauaauccuauguguaugacagucuuugcuaggcucacuguaaugacugcccuuaggcaaccuuacaauuuuuauuuuaaauaauuuaaacuucucauuuuauuuuggaaucccucuuuguugguguacugaagggaaaaguugacaauuagauggauucauugaucugaauuggaaagacuucaauaauugauuggauguggaaauauaauucauccacuugucaguguguugaaaauuuauggcagacaugagaaauaaaaaucuacaaugacucaaaccguuucagaauugagcacucaggugaugcaggcaagccuucaguuaauggcauggccugccauucuguuuucuuccuacuuccuguuacuuuucuugcugcaucuccuacaggcccauuauagacaagguguuaggcugccuuucaugaggccuuucugucuuguaaccauucuuguuuaaccauuacuaaagcucuucacaaauaccuuaaaauacacaacuauuuuccagcauccaauccagauaaaguacaaguaaaagagauuguccucucagcauacgccaauacuaguaacagcagcuuagacauacaagaauuuuacugugucaggacugucuugcauacgcuguauaaauuuacuacuuuaauccuuucaaaaagccaaugaaaauuaggucccauauacauccuuagccuaauguuaagaagccaggcuuuagagguuaacugucuaacuauuuauugcaaucacucuauagcugccuaagucccacaagucuucccaccagccccgcuagccuccucccuagugauuuuacuuuugauuguuuuagauuuauuuuuauauagcaguguuuuugcuuguauguauguauguauguauguauguauguauguauguauguauguguaucccaugcauaacugauguccuuagagaucaaaagagugugucagauccccaggaacuggaguuagaugcuuguuagccaccauguguccugggaacugaaacgagguccucugcaaggaauaguaagugcucuuaauuaacucugagccaucuuuccagccucacaugcuguuauuuauuacauuauauuuuguauucuuauauagauaagacuguaaaaaaaaguaauuuaaaguuguagaauuaauucauuaaauaaaauaauucugagugacucucugcaccacaaggcugguaagugguggauccccagucaaagccuccugugugcaacacugugcauugugugugggcuuccuccugggugaaauuaccuuaaaauaugcucaguaaauuuuggucauuuuuguuuucuuacugacagaagaaaauguuuccugagcauuguguacugucaugguccaccaguugggcuuugcauguuuauggauaauuugcaaaaagaagacuuaagauagaaacagauuuagauuguuguugcaaauauugcccgcucugaguuggagguaguuuucauuaauuaggcuacaauaggagacuaauugaaaauuaaacgaaggaccuucuuaacuauggagaaagacugggaauguagagcaguuuauauaacacuugccagcaugagaaagcccugaacgugagccccuggcaccacauaaaaccagccauggugauacaugucuauaauccaagaaucaguuuauauccacuacauagcaaguucaagacccacuuuguccacuugaaccuccaucuaaaaacaaaaagcauacuucacccaauggaaaaaugugaaugucacugaagauugucauuucuggauuauuauuucauuccuuaccaugucacagauuuccucccacacauaaaggacaaagaauuaagugucucuuaauaggaggaagggaguuacagacgcuguuuuuaaauauaggcagugggacaugguuuuagagagagaauauguaaauaaaaauaagagaaucauggaaauaaaauaaagaugcuaaaaagcagagauugcuucugaguaauugucguagacccacuacaacuauaaggagauacacuuuuuuagaggauuggguguauacacgaauuggaucaagugcagaagauucacuaugauucuauaauuuaccuuucuuuuugaaugcuuuaacaauugaguuuguugguuuuaaaugugguucuggccauugggaggugauguggcuaccaacaccauuagcugcacguguccuaucccucaguucagggacauccuggaagacagcaguccguauuuaaugaucccuuaaguaggucugccaccuuuguuuguuccuuuuuuagagcuagcccugaauaauuuugauuuuuuuuugguuacuuuugaguuauccuacugcaaaaaaaaacccaugguaauucauaucaucauauucagaguuuagaaauuacuucaccauuccacuaggcuacagaaugaaaaucaaaaauauuuuaagugacagcaauagacuucugagccauuuuuuuccuuguaccugaaauugggaaggcuuacugcucuucucuuguaucugacaucagguggcagguccauaaacucuguacuuuuuagguuguacgcccgaagaaugauguuuccagaguuccagagaaggcuuggaaaauaguuaaggugaguugaguuggucacggugaugggcucagccaucuguaugccugucuccugacauuucagcuuacugagguggggagcacugcguugaccugacuccuuucuauaugcuccagccuccuaguguauagguccuagagccuagagucaguacucaccucauuagugggaccaacuauaaagacuguauguagccacugugaaagccaccuaggauucuugauucucguauuucugaguccuaauaccugagaggguaaguuuuacuagacaguaaaaggguacaccugcgccaaaaugcauuucuggcugacaucuucuagaagcaugaggaauacacaaaaugcuuugcuucccaguuccucuccucugccuucauccucucacaaacucuauacagucauuuuuuuccuuuaaaaucuaaccauacuucccuauaggcuuagugauaaaagauuuuguuauaauacaaaauuauaaguaaaccuguaaauggcuaaaaugccucauucaauccauggucucaaacauuccagcaagcauuauucuuuugccauaacauuguuuguaauuuuuuucaauggguuuggaaaaacaauaccuagaauuuuagcguggcuuuauccauagaagacuguuguaacagaagcuuggcuuuagacauggagugaguuggcagccagcaagagcaaagcugugucaggacaaauguacucuucaucuucucugguuggcuuucagcuggcugcaccacaggagucucuaugagcuguguauccugugaccaauaacuggugcacuccacccgggucccucuuggcuagggacagccugucgggaggcauuagguucaugcuggugaagauccuuagucaguggcucccugaaggaaggagaggcaaacagccagauucuguugaacaggugguaguuagacuuuagcucugguuguggggguggaaaggauagacucuccaaauuuaccagucuugcucauuuucacgugaccgauauguacuucucugcccaguaaaugacuggcuagaaauguaucugggaaaaucgcuggcagcaucuggaccucucuuaacuuuuccaccuucguuuaucagucuggauuugggcccaugucaggaauggaaaccccacugggaugcaagcaaaagaggaagcgaguucuuagccaugcaucaguggaggccccuacugggagaggggauuaucacaagcagcaggcaacccugcaccccagccugcugagcucaugcucugccacaggaugugaagcaaagggaaugugaggccagagugcuugcuccaaguuuccuuauacaauagguuauucaagcagauugggaaugcuucuuaagcgauuuccuagauccauguccccuuaggaagguggucaccacagauggugaguucagauagucuuguugcaguacaaauuuaacauucauaugacacuuccucacuggcuuuacucugacagauacuuucaggucuucugacccaggcagcagcuugcucugccauugcuacguaguuuacaacuuaaacuaugguuuuaaauuaaauucugccaaaggauuucuuuguucuaauuucaauccuauauuuauuaauuuuguguuaaaugcuauggcaagguuagcuaagauuaauauagagcuuauucaauaucacuauggguacauauuuaauaugcagcaaugauguuuguaccauuaacuucuugcuauaaugauacguuuauuauaauguuccuguuuuagucagcuccaaaugucaaugaaaugcuguauuaggucacucuacuccaccucagucugcuaccaacuccuuccauuuuaacagaguccucuuauagagaggacugaauugacuacaagacagaaauuauggacauugcuuucuuauuuauaauauacaguuccauggcaaaguuccaaauccuuuccuaaguaguacugguggcuuugucacaugaguacugacuccauacuccagucaacuuuauggaacaggaaccguccuguguggggcgcugucuccauguggguaccaugagcacagguuuuucaaguuacaaguccgagccuuagcugauaagucaaagucacuacaguaaauuaagauagugcuuuaaaauccaauuggggguggguuaucuuaccaauuucauuuuauuugauguaaguuuaugagaauuaggugguucaaagaagguaugucaccugacggcaggagucugugguugauuuccacaguacugugcacaauaugcuaaugccuuugagauguuauaacaucuuaagcaucuauagagugccuacauguauuaacucccuguaauuuucugaaaauucauuauccaaaaaucuuaauucauuauaacagcucauaugaaaaccuacagaacuggguuucuuuuauucuuguauuugcacacaaugagagauucucauuguuucuaauuuguuucauguggugccucugaguacaucucacagagagcuguuauugaaucucugugacuaucauuauauccaucaaccucuaggaacuaacauucuggguuucccaguucuauaaucuacuucagauguaaggauugacauaauuagcuucuugcaacuuauaaucagaaugcagcagacacccaauugcaagcaccagacuggggguggggcagugugcaaaucagcguaggcuuuacuuuacucuuuguuaaaucaaagccaacuagcuuguugaagauuuucuguugauuuccuuuucugguugucuaauuugacuccuuugaaaaauuguauauaagauuauugaggaaagccaaaaaaugaaaggaugauugaagcugucuaccuguaagagcacaaguaacaucccccauuagaugaggucagaaguuggccgugcauugcaccucugaaguaguauauucacgugcaaaugcucguaccugaauuuuaaaagaacccuugcaauaaaauaacaagaauuuauuaaaaugauuuuuuuaggaacauguauucucaaacuguaaugacaauuucugacauuucuaauaaauuucauauauuucaugagcuguuucagugucugacuguuaaaaugggcacuucugaggcagguacuguuuagaugcaguaagaacugguguugcgcaggcugugcggagagcaguggcagaggcucacucagccugcgugaggugcaccacagccggaaaggacauggggagagcugaauguuccgugucgugaaauaccgcagucauuguuuuauuccuuuaccaaagacaauuucugugaauagaguguauuaauuggcucaauauauacaugaagauuuuagaauuaauaaugcaaauuucaaagguuuauuagucuugauguuaucuuuaugcucuuaaaaucuccaugaguacuggagaaauggcuuaguacuuaaagcaauugccacacagcaugaagaauuuggaguccccuaaacccacauaaaagccaggcagguaggauacugagaauccccagggcaagcuggccagcaaaaaccagcauguuccagguuuagcaagagacccuuccucaauaaaugaaguagaggaugaugaaggaagccacaaaugcacuuuucaggucucugcauguuucaaggaacacugaguuaguggcagaaccaaagccuauucuuugucuugcugaguugaagaacugcugaccagacauuccccuccccuccagaagcacaagcuuagugauuggugaaacuuguauucgcaugaagaacugacaguacaagaucauaauuauuauaugauauuaaaaauguugauaauagacuuggaacccuggaauauacccaaguuuccaaaaaagaaaggucuuaaucuauaagaaagcuuucucuaggaaacacuuaugcaaaaguuuggcaauucccaugcuuagugaaugggauuuuaaauaugagauccuguguccaauaaauaaacagacaaauaaauaaaucugcuaugccggggccuaacaaacacagaaguggaugcucacagucagcuauuggauggaucacagggcccccaauggaggagcuagagaaaguacccaaggagcuaaagggaacugcaacccuauagguggaacaacaauaugaacuaaccaguaccccggagcucuugucucuagcugcauauguaucaaaagauggccuagucggccaucaguggaaagagaggcccauuguucaugcaaacuuuauaugccuuaguauaggggaacgccagggccaagaagcgggaguggguggguaggggagugggucggggagggugugggggacuuuugggauaguacuggaaauguaaaugaagaaaauaccuaauaaaauaaauaaauaaaauuugaaauagaacuggcaaaaguauccauuugaccaugaauuuaacaggcacaaguaaagugguggccauaguugcucugaggcauacugaaggggggaagcagaggagggcugaaacaggagaagccuguuuucaaaguaugugucuguuuaaaacacaccaaaggggguggggggugagggagggcuugggggacuuuugggguagcauuggaaauguaaaugaagaaaauaccuaauuaaaaauaauaaauaaauaaauaaauaaauaaaccacuucauaaggaaaaaaacaaaaacaaaacaacaccaaaggugugagugugcauugguugucauuguauuaucagccuuggaagagcaacuggugacuuagucuucaguggcaguggugguggcggcgguggcauugguguucugaaguaguauuacuguguaacccaaguuagccuccagcucacaaucuucugccuguuuaacaguuggaguuagaggcauuugccaccaugccuggccuuaagcucuuauuucuucuguauuuccaugugugucauuagaaucaaauuaccuuaguagcuucugaaaucaaaaguuaguugucugugcugcugucuccccuugagucucuaugcuuccuggaaaggaauuguauaguaugguuuugucauguuaucacaaagguauuuugguaaaaauuauuuuuaaaauuauuuugaagugauaaauguuguaggaagugcuuagaacucuaaauauuauauuagauuugauuucaguagaaaccuuuuuuugacugaugcuuuaugguaaacaguuuuguagauaugccucauugggcaaguuaugucuuaacucuuaaauagucuguguauaucacaugauuaaauucuaaauguuagaagauguuuuccuauuaucuucauguucucugacuggcaugaggccuugagaaaugugaggcagucuuuuaagagaaacgauguaaucauccauugauuuuaagugacccugucacaugugaaaacaaaucagauuguugcucuuaaugagcuuuucaauuuacuauucaguagaucagauaaguggauuuaagagguaaugcuccuguuuaguacucuggcuugacugucagauccugguaguggagagaaguccccgaggacagaagcguugacacagcucuagaugggauaauggggaucaaagcuaauggaugcuaaaaggaauggugcagguuacaaggaggauuguggguaaagcacugccagugcccguguugacugcuugcucuuucguggugcugccucagaucugaugcuuugagaaacuguuuugacagcagggccuggcagaccugccugccugccuagcaaacccccaacaggaaaacaaacaaacaaacaaacaaacaaacacccugcuugugggauucucaguuuucaaagauaacacauuacuagguuccucaccauggcacagugaaacaucuugagauguaaguuuuccuuuuacagaagugcaaagugguccucgaugauccagaagaagaaguuaacuaauguuaacagaaacagaggaccguguuaugacaauaccacagggaugagccacguggaaaugccauguucuuuccaaaaucccaugugucggggagcaacaccuucuagcagugcccagaggacuuaugggacauuuucuuugucuuugacugugaucgugaacucaugaguggaaacuagugcuuggaccuagaggagcaaguagcuucaucuguguuuucauccuuggugagcaccagggccuuucaaauuccaguccggaugaggaacacagugugcacccugcauugagcagaagagagcagacagcagcaugucaggucuccacugcaugugcugugccuucacacauuggucuuaaguacaggcucuuaugggauaaccacagauaaaaauaacaauccauguugcucucuaaaaaacuuuuuuucccauauuuuuuggccacagaauccaguauauccuaaaauguaagagggcacauuucauuauuugauuauucacauugugacaagucucaguaggcuuuuucucuuacauauuaaguauacgugcuguagucauuaacaauugucauagaugcugagccaaugaguaaggcauaauaucagucugaaacaauuuucuagcaaaaugggagaaguggacaacugaacaucaggaagugaaaggaccaggguagaugaaugaggcagauacacacaggaaaaugaagcucgcugugccuggaaggcuaggaaggccuuggagaagacagcuuuugaauagugggagaagagggaggcugcugcugacaagaugaagagccagagaaaucguagcgaugauucaguucuucugugcuuacacuugagagaaaugguugaaaauggguguacguggggucaaggaaugaaaaguuuuacaccaaaagucauacugaugucagcuuuuccaagaggaccgacuugaaucuucuuggcuaugggucaugguaaauuaagggaaaguucccuuuguacacaucauuauuccuuugagccuuuucugugcuuacaguuucugauugagaggacugguggugacuaaguuccuucagcuacaaguaucuuagggcucaacagucagcagaagagacauaggaaaucuuaauacuuuucauuccccucucucugccgcagcuucuucccaccauucugcccuucucucucuuucccuccuccuccuccuccucuucuucuucccucccuccccuccucuuccuccuccuccuccuucuccccccuccucuuccccccuccccccuccuccuucucucucuuucucucaucaguuaucuugcuagccugaggaaggggcuuccagacauaggacccagguggaaaauuuguaucacaaaguucugauuugcauaauuuuuaaaacucaaauacaauacuucugcacuccucuccuguaugacccuuuaacuccgagugauuuauuaucucacugugaccuguggcaguauaucaagcuaauguguaaauaaagcuuaguugucauacguagcaaauaaacagauuagagaaggugagacgacauacagucacuggggaugaagugacggcagagagaucacgugcagcugugucuggcagggagaaccugcagucccagcagagcauagggauguagaggugcuaacugcucggcuuaccaggcucccagggaaugguccuuugacugcuggugguauuucuccacuugaaguaggauucuguguucaaaugugcaaugugccugagguugacacagaaaugucacacccaagcgcugcaaccagcugugcccacuuaaaagcucagaggaucccaugugcugauguucagucccacaguccacagucagaguugucucugucucagcucgagaguguugccgggagugacuggaacuggcucagacuguguuuccuaagaacacuuucauuaucaccuggaguuaucuugaauuuuauugaugcuuugcugauaucuaaaauagauaggaaguauuuauuuuagauucuuuucuugaguacuauuuuccaauuuuuuugguauggaaaagaaaaagguagcuccaauguugaguugugaugggugaaaaugaguguggcuguguuuguguguuaguguggacacauuccaaaguaggaguguuuucuguggggaaagguacugcaguuggggaugacguaguuuucaucucaugagcucuggacucauucccuguuucaguauggauguagaucuuugaguuuuagacuuguuaacuugagcagccuuuugaaacuaccuaugaaugauaaagcuuuuaacacuuacauuuuucaugcaugcagguguaugcucguaugucagaagucuuaggaauaacagaugauaaccauguucuggaaacauucaugacgaaaaugugaguaucuguuuuggguuuuuuuuuucuguuuugauucacauaucaucuuguuguauuuccaucucuuuauagauauuaauuuuuuaacuuauaaccuuggcuauaauuguuagugaauauugcgcuucauuaaaucuucucauacuuacaccucaccaucuaaagggcacuauuauuugucuggauguccacaucacuauaauauacaauaucauaacacuguccuaaaaagauauauagauauugacaggauuuuuuuuuugcuuuauaauuaaaaacaaaacaccccaccucaaagaccacugaagaaugaauugcaaacuauacacauaauugccuuaacuaagcaucccauggcuccagcaaagacauguuuauagagcucaauggcuucuccucacagacccaccagugcuugucaaaccaacaccaaggcuucugcuuggauccugugggccucacaggcaacccuguccugcucacaggagcaaagcugggucaacaccaggacguagaucaguguuggagccccaggugaugauucauuuggggcagugacugguucaccuucaugaauuccuuugugaggauauuuucuguuuccauucuguuuggcuugauuccagauuuguuucuucugucaaacacaacauuauaggcugauuuauuuaaagaauuauuuacuauuaaguuaaaucaaauuaaauuaaaauauuuacuauuuuaaacuuacagaauuucaugcuaauguacauuauauguauauuauuguauaaaaguuuaaaugugcuauuagaauuaaaaaaaaaaaaacaaucuguugaaauuugaacaugcuuuucacuuugugauugaaggcaccuaacuuacauguguuucuuuuccgugggucuucuuaugcugguagcuuucuaacaauugaaaccauuucuuucauguuuaguguuacaaaccugaaguacuggggaagaugugagccuguaaucuccaggacgcuucaguuccucagugaccugucaguuggauauccuuuucuguggcuggugcugcacccacucagcgggcacgguggccuggccacgucauucccgugcuucuggcuuuccaaaauaguacaauaacugucuggucuguuuagccuuaucuaugaauguguuuauaguaacuaugauaugaaaauagauagauagauagauucauuccugucuaauuguguuuuuauuaagcuaggcuaauaaaugguuacauaauaaaguaugcaguacacauguauuuuaauccauaguuucuauaauuuuccaaaauuucucuuucuaaagaaagcauguaacuaacuugaagaaaggcacaugcugugacaaucccaccuccugaagccucguccuuagucaugcgcgaacugagacacacaaaggagggacagaaagagagcuuuuaaccaccuccuugauugccggcuuccucauccaguuaucaucagacguacucuaaauuaagauuuccucuuacguguucaguguuuacauuuuugccucuagaaagcguauaaaauuugaagccagaaaucauccuuauuagauuaguuauuguauuucuaccaauaagaaccagauuguagauuguuccguauaauuuagcuguaagacacauagaugcuaugcuaaauaaauaaauaaauaaauaaauaaacaagcaagcauugcuucaguuaaccuguaagauuagcugauauuuucauauacggacaaauucuggaaaugguuagcuuuggauggaaaccuuuaauguaguuucgucccaggaauaugcuuguauuaguuaaguuuaagauuguguuccucuauaaaccauaaaagauuuccaaaguauuagacacccacuuuugugcuggaauuuaauaugcaacuuuuuauuggaaaauaaucguccuugucuggcaaaauccaccaugcaauauuucuguuaguagguauaaugcaauaaagacagggagggcuauuuaucacuacaaauuuugaggauuucaggauucuuuuuauuauuuuaauauauuucuuugauauuaaaucagaaaaaugauaaauuacaccugucuaggcuguuuuuccucuuuacuggaaagugauguacaacccaauuccaguggucauuuuggcuuuuuaagauauguauuuuuuucuuauuaaaaaaaaucaaccuguauuuuuuucuaauaauggugcugaaauacucuuuauuuccaacauaugaagugguuuauaaguacuucauaguauugcaaacucuccagguuuucacagugaauuacuaugaaaggcuuugguuauagagcacacaccuauuguuuugauucacccugauuuuaguuugauauugauauuugauauaaaauuaauuugauuuguauuuucauuuuauauaacuugcauaauaccuaauuuuuugguaacaauuaagauacuuuuuguuaucuauuuuuaaauacauauaaccuuuuauaagcuguauauuccuuuugaauaguucucaaaauuaaauuuuaagucuuauuuucagaaaaucuauuauacaaagguuaaagguuauaacauguaaauuauuuccacacagguacauugauuuauauuuuuuaacaauuauuucaaguuugcauauuuagaaauauauauuagcucaauuugauuucagugcucaguuauuugaauuauaaaucauuaugucccuucuagcugaucagucaugaaauaucuuugaauucauuuacauaaugggauaugugcuugcuguauccauuucaaugcaguugcuacuuaccaaaugugugucuuguuguucuagccaauuucauuauuauaugaguuuucuuaauugggaucuuaaaauaauaccuuuuuuguuacaaauaaaauugcauuauucagcuauagaaaguaugcaagguaguaguggucaccuauuggucuucaguaauagaaagucuuauuuugauacucaacauauuuuaaaaauauaauuagcaagucagugaaaaucauuuuaucuuuuuauuuucuauauuucuaaugugugucaucagcacuuugagguauuuuguuuuguguuguuuuggguuugguuccuauuuugugugcuucaggggacugucauucaguguuugugauguguaaaaccaaucugugaacuuugauuaucugaccaccuauuuggaaauuaaaauuaccaaaaauuauuuuuagggauuacagaacagccugaaguuuccuuaaaguaguggucaaguuuauuuaaguaucagaacuggaugucugauaucccaucauuaggccccacacagcacgucucucugcaaggcucugaccaggagcugagaaucugccucuucauggcuuaucuggacugacugggcaaauguuggagagccaggcauuucucccauggcacaucuucauucagcuguguuagcauuaaauagggcagcuguggcagaugagaggucaucuggcuucccaugugauaauguggaaauugauccuucaagacuagagagccucuccuucccaccgaguucuguuagcuuaucugacccucugucagugaggcuuuguaauguuuacguucaaagacccuuugagagaacuuuuauauuuuccuaucagauucauuacuguggauggacggacggacggacugauggauggauggauggauggauggauggauggauggauggauggauauugcaucuagcaaauauauuuagguaacucuuuaccauacucuuauaauuuccacaaguaaaauucaagaauucuucauuccaaguaucuugaacuaacgugcacagagcuaaccugcuccaucuggguccaacccucuucagucagggucaguacccgagaucucuccucccugaaauguuuacacaucuggaauucuaguuucuaucugaacaagcuaugaugagacuguucaagugucuggaguagggaagcaggaaaagaggcgugaaggucaacaaagcacucuaauguaccuuaccgugacugccguaaaggagucuccugaguccugggacccacuccuuaucacuugagcuuuccuucuuuuggagaguagcuggucaggcuuucugcugcaguucaucguccagaugauagcaguaacaccgcucacuguggccucacauugaugguaaugaguaguuaaugcacuuaagagucuugaugaggaccagaguuggacccccacacccauggcaggugguuaugguacgaguaacuccagcaccaaggaauccagcacccacuuuuggccucccaaugcacacauacaugcaaaaugugcagacacacacacucacacacacaaaucaaaguaaguauuuuaaaauaaaaauaaaccccgccaggcagugguggcgcaugccuuuaaucccagcacuugggaggcagaggcagguggauuucuaaguuccaggacagccuggucuacagaguaaguuccaggacagccugggcuacacagagaaacccugucucaaaaaaccaaaaaaaaaaaaaaaaaaaaaacaaacacacacauaaaagagcucuuuguuaauuuuuuuuucccuugauucuccucagguugccaaaccgguaguuucuguauuaucauaaacaccuauaaauuuuuaggaccuagcuaaaaaugaaaauugggagucucuuuguucaaaucauugaucauaucacaacuuccaacacuaaagcuugaaaccaacaugaggcauuuauuuuuauuauuauuauuauuauuacuaauuauuauuauuuagauauuuucuucauuuacauuuuaaaugcuauccccaaaauccccuauacccucccccaacccugcuccccaacccaccuacucccgauuccccuguacugggacauaugaucuuuucaagaccaagggccucuccucccauugauggcugagugggucauccucugcuacaaauacaacuagagacacagcucuggggguacugguuaguucauauuguuguuccaucuauaggguugccgacgccuuuacucucuagcuccuucaauagggguccuguguuccauccaauagaugacugugagcauccacuucuguauuggccaggcacuggcauagcuucacaagagagagcuaugucaggguccugucagcaaaaucuugcuggcauguacaauagugucuggguuugggguuucuaugggauggauccccaggaggggcagucucuggaugguccuuccuucugucucagcuccgaacuuuaucucuguaacuccuuccauggguauuuuguuccccauucuaagaaggaaugaaguaucuacacuuuggucuuccuucuucuugagcuucauguuuuuugcaaauuguaucuuggguauucuaaguuucugggcuaauauccacuuaucagugagugcguaucacguguguucuuuugugauuggguuaccucacucaggaugauacccuccagauccauccauuugccuaagaauuucaucaauucauuguuuaauagcugaguaguaguccauuauguaaauguaccacauuuucuguauccauuccuguguugaggaacaucuggguucuuuccagcuucuggcuauuauaaauaaggcucuaugaacauaguggagcauguguccuucuuaccgguuggaacaucuucuggguauaugaacaugagacauuucuaagucugcguggcucauacacgcagggaucugcccuggcuaucuaugacguaugaaaucauucuuuuucuucagcuucagacuaacacaccaaaggugauuuuuaucuuuaaaauggugacuuuucaauuucauccuacacucacuuccuuuacuguggggucuuguucucuuucaauucaguugggcaucugccaaguccagggucaaugagcaaauaacagaccugccccagagcuuucaguucuaacagaaucaacccgacuuugaaccuccuucuaagagcccaagucaauugcuuuacuaacauaaaacauauuuuaaucuaacucaaauuauauaccaauuauauagaaaucuauacauuaaaaauaugaugugagccagguauaguggaacaugccuuuaaucccagcacuccggaggcaaaggcagguagaucucuguguuugaggcaggucuggucuacaaagugaguuccaggacagccagggcaacacagagaaacucucucaaaaaacagggaaaaacaaaacaaaauaaaacuuacuugaaaacauuauuggcacuuagaacauauugucaccucuccuagaggugacaaaguuuaacuccugccuggugaagaaaguuccugagcacaagcuucccccagaauuuaacucauauaucugacauacaguguucuguucuuuugacuucuucuuucuguuuucaagaucuaaauuaucuauaaacacugaacauguguggcccuaagaaaucugccuaaauccuaucaucacccacccugcuaugcuuauugaauauggaacacacuacucaauuccaaaacuuuuuuuuuaacauuuuaacagucuuuguaauguguaccuuucaauuaauauuauucagaauuacuuuuucgggacuaaaaaugauggcccagauuucauaggacuuaaugaucuugaagaggacccauguccagucuccagcacacauggcagcucacaacugucucaaacugauguugacugcacacacaagggaacccuuaacaucaugcaagcaaaacacucacgaauauaaaguaaacuaaaagauagaaguacuuuuuuuccugauaguacauaaaaaaugauuuucuuuuuguguuuauacucccuggccuuuagauugauaaaaugugauagauccuugugcugcuggaugguuuuaugccaacuuggcacaagcuaaagucaugugaggaaaagguaucuccuuuaagaaaaggcccucauaacaucagacuauaggcaagccuauaggguguuuucuuaauuaaugauugguggaggagggcuaucuacccauuguggguggcuccaggguucuagucuaggguuguuggcccuggguucuggaagaaagcagguggagcaagccaugaggagcaagccaguaagcacaccaauccagggccucuguaucagcuccugccuccaggcuccuccccuguuuugaguucccauccucauuuccuuugaugagaacagugaugcagaaguguaagccauuuaaaccuuuuucuccccaacuugcuuuuuggucaugguguuucacugaagcaagagaaauccuaacuaaaacaaauuguuaccaggauugugacggaccugaccaugcuguuuuggguaggaauuugggaaggcuuugugcaagaaaagccauugaauguucagugcuuggugagauguucuguaggaucuuggaaggcaagaauggugagggcaauacggaagacggaagucuggcuugugaaguuucagagggaaagguuugguguuuuguuuugaauuaagauucuguauuucugguuugcugggacugaagagccagcugaacuacuaaagugaaacguuuccauugcuggaauacuugaugcuggucaguuagagcugguggugguuaagaaaagaccaguauccuugaggugaaaucuucuaggaaguguuuccugagugucagcaugcagaagcuguguuccauaggggaccaagguuggacuggcagcugaacuugauaguguaagaaucaucuaggaagcacugguuuaaaggcaugaaagaaucauggagagcaggagaggccauuggugaaaguacagccucaguggcaguugaagacccaggccugaaggagucaugcaaagagauuaaggcuuggcaaauugaagagaaucuuugaaagaaauuggugaaagugcagcccaguugaacagaagacuccagcauuuuggagauucuaguacuaaugggaugaccaccaagaauagugacagcaguggaguguagccagccagaacuagaagacaugcuguauguguuucagaggauggcaccagggaaggaacuccagccccuuggaggagcccagaagaucaagaguaaauccccuacauuggauguuuaguccuuugauuuugcuuugauuggaugugccugugcucugguucuuaccuuuugaaguaagaaagcauuuaauuuaguuuugauuuuacaggugcccacaguugaaaggcuuuggauucuaaaagcaauuggcuauuuuauagagacugaauuuuuaauguguuugacuuuauaaugauagcgggacuucuaaaguuauuuauguuuuuaauaugaaaucuugggggaugaaugaaugagauagguaagguggcuuaccagugacauguuugugucaaguugacaaggagucaauugugccugauagguuuaugucaacuuagguuuaugucaacuugacaggcaggaaucgccacugagaaaugccuccauaauaucaggcuguagauacuugauggaaaaaccuaagcuaaauaagcccucuccuccgcagcuugcuucuuggucaugguaucugcaguagaagcccuaagguauugcucaugaauuggagcccugcuuguuguuucuguggagaucacuacuaaccuguauaauacucacaacacaggaaacacauuuguuaucagcuuaguuaucuucugcaaagagaagucacucagaauuuuagcaguguguaagauaaaccauuccuuugaccucuugcuuuucuccaccaugguugcuagcuucaugacuagcuucaccugucuuaauguuuuuauauuucuggaaauuugcuaagucggaugucguaguuggccauuaacaaauuugcccacucccagaagauaagauucccccucucauauguggggcccaguucuaauuauuauaaguuaggcagaagaacaggugcuagucuuuaagucaaguagauguauaucagauagugcaaagagguccagauacuguagagucagcagaccugggguugagccuuggcuuuaccauauauuagugcauucccaauguagccugugcaugauucccaggacuguugcagugacuguuaccaugcuguccucacugaugggagcugcaggccucugaagagcccaguacuguguuaauccacccauccugcccacuugucugcuagagaagaguaaaaauaaaggaccauaaagauauguccacuuagcccggcggugguggugcacgccuuuaaucccagcacuugggaggcagaggcagguggauuucugaguucgaggccagccuggucuacagagugaguuccaggacagccagggcugcacagagaaacccugucuagaaaaccaaaaaaaaagaucuguccacuugccuuuuccuuuuaacauuacaaaucuuaagaccauuaacuaguucugagcuucauuccuuuaaagggauguaaauauuuagaugaauucuccuuauuguauuuuuucaaauuuuuaauuauuuuucuugagaauuaauuaaaaggcagugggugcugaccuugguucaaagugcacagaugcgguucugcagaaaauaucuuuggcagcugauauuuuuccuguggauguucuguuuauugcuucauaaauauucuauugucuaaacaugacuugcuguuuguuagcagugcugacaggaggguuccuguuaauggcagcauuuauacuacccauauacccugucacuuuuaacuuagcaauuuuaagagaauugccuuugguaauuacuuaagauauuucuaaguuuauugauccccacccuuguuuaacugagugaaguuugagugacaguucaucugcuuaaagauugaugguuuugaaaagucgucaaauccacaucuucaaaucuaagaaaaagcuugcugcuugucagcgcugaucuuguccuuugguugccagaaaauacagugcacuaaggagaaaguguggcuggccgccaggccuguccugauggaguuuucaaucugugugaagacccaugcacauacaucauaugccacucuggugcucaccuggaagguagauagacuuaagucuaagucauguuaacaguuuguaguuaggaaagcauuugccugguagaguugugagagucagcugaguaacuaguccccaugucacccucaugcccuuucccuggcguguacucaguaaagccgucugcgucaucugacccucagaacaaccuuguaaaacagaaaaagucacaguccuuuggcucagccacauccgugcagucuuagauggacaacuuaacuucuuuaagcuucuguuuucauaucuacagaacugaauuaauaacacuguaauugugaagacuagauaaaauaauauaacaugaaaaaugucuuccacuuaaacacuugagaaauauuaguuauauuaagcugucuuucaacauuuaaugacgugaaauuugcuauaucuuucugacuagauuuugguuuuaaacuucugaauucauuguuucuuaaaauugaauaauuuucucuuucuugauaguccauuaugagucuuuauaauaauuuuauuaugaaguagaauuaguaaaaagaaauucuuuagccauacccagugugaaaagggucaguuucaauuuucuccuaucaaggcuuuaacagugagggguucuuguccuaauuauagguuucacucuuucauuucauaacuagaauauguauaagguagaaaaguaauugcccugguuaauaauggaucaucauucucagcaaaaugaaaggcauuucuauaggaguacuccuggacauaguagucucuuuacaagcuaaagugcaguuuuaguuauguuuuaugauuuauuguguauauuucuccagauuccuuaaccuuauuaccuauauccuuuuaaaaaaacuugugaaaauagaugcugugaaauucaugcugaaaaaucacacgguaugucugguucucuaguaacuagaaccuucugaguaggcggacacugguaaccuugcauacuccuuugcuuucaucagagugaacacuucccguuucuuggcaucagugaaacuuacaaugugggugacuucaggugccggacaaccuucuacacagcccucacucgccuucugaugguagaccuggguaaguagauggagcuuugcugacaggucaacagcagugcggaugaaagagugcaguguuggucggugaagcgucucacuuguuaggauuccuuucuccuuauccuugaccauugaucuuacuuuugcuaaucuggaaacugggccugguggcucaggggccacaggaggacuaggucaaggccugagcggaauacagagugagcucaaggucagcaauuuggcaggcccucucucaaaauuaagguuuuuuuuauggccagggauauagcccagugguagaacucuugccugacauauuucagucccuaggacugcagagucaagaacaggaaguguaggaacaaucucaaggacagcuauacuguaaauguuugcccuuguucucauaggauuuuuugcauuuuguuuucuuuuuuacauuuuaaauuguauuuauuuugagaguauauacgugugugcaccugggccacaacacacaaaugggggcugaaggacaaccuuuugggacguuguucucuuuugccauguggguucccgggaucaaacucagaugaucaggcuugguggauuaauuuauccacugagccagcccaacaggaaagcucuucccucugguguucugagauagucugaugguccaguugagccucaggcugaagucgagaaggggcuugaaguucugauccuccacuucuggaggcugagaggacauuacaggccugugcgcugagggccaaacccaggauaccucauaugcucaggcaggccucuuuccucagcuccguccacagcauuccuauaguugccaaaucugcaggggcagaaguuguucuuuuauuuuuguuugagaaagucuuaggaagaccagggugguuuugaacuccuuuguaguugaaaaugaccuuagacuucugguccucuuuucucuaaaucuuacuugguaggauuauagguguaugcaaccaugccuaguuuuauaugaugccaggaauccaguccagggcuuuauacaugcugaggaaaugcucuacugguacuccaucacuaggaccacaaacuggugagugaggccaaugcaguacaugaccugugaggaacgggugaaugauaaggcauugcugagcuaauagggcaacugcauacaucggagcaaaugcaucaaagcggcugaggaaaacugaaguggcuuuuucaauaauuauuguaaccauuaugaaaaccauauggaaaugccuuaaauaauuaaaaguaaaaccacagcaggcuuuggaaauccuccuagugagcuguacaccagagggagugaagucagcauacagaacagacaccugcacuagcauguucauuaaagcagcagucacaggagccaagagagagaaacaaccuugguauccacugaggcuugaauaaacaugcacucaugcucgcgugcacacacacacacacacacacacacacacacacacacacgaauccucuuuagccauaaaaguaagaaaaugaacccauuugcacugccuuuguuguauggaugaaccugagugguugguauuguguuaagugaaauaagccaggcacagacagacaacuacuacaagaucucacucuaugaagacucuaaaaaaacaaggugauaucauaaaauuggguaguaguaguuaccaaagacuaucaaauuuggagacaauauaaaaugauguccugacuuggauaugcccuuucaacuaguuacgggaauaaaguugaagagcuguggcaugcaaucauaguuguagagcgucgggccaacagucucaagcaugcuacagaacuuaaggaacucccagccugucguugugaaguacuuuuuacaaggguguguaaagugcucucaccccuaaagugauaugugcaugagauaauauuaugcuaauuaaaugcuagauuuaauuauguauuuguguguuuuacaauguuuuaaaaacauuucuggcugagcagugguggcacacgccuuuaaucccagcacuugggaggcagaagcagguggauuucuaaguucgaggccagucuggucuacagagugaguuccaggacagccaggacuacacagagaaacccugucucgaaaaacaaacaaacaaacaaacaaacaaacaaaauucugcugggccacucucagagaaacccugucuugauuuuuaaaaauuuuaauuuacuuuuaacugauauaaagagaguguauauauuaccaggguaucuuggaauguuuucauauuuauauguauuuuauaaugauuauucauguuaaacaaaucuucuuuucuuaguuuguguuguuuuuguuuuauuuugguuuuggcacuguugaaggucaaauccaaaggucccgugcauaguaagccggcaguuuacaacagagcuacaaucucaguucaucauuaaauaccuaucuuuuuggacaguuacaaguuccucauuguuaaaaacuucaaauaguuucuuguaguuuuugaaauguccagugugccauuagcauccuauaaugcauuagcacaugaggacuuaaguucuaacuaaaggcccaucgacaggccuccauccaucucuuccccuccucugcagggcccagccucuaauaaccacuauuauuaugacauuuugaaguucuguugggugugagggaguugucuuugugucccgacuuacuucaguuggcaaaagguauacuaucuguauugucucauaugacaaauuuucauucuuuuuguggccaaacauaauaugguguauauaaaacgcccuccauaugucccucauuguucauuggugaaaguaagccugcuucuguuucuugauugugcugaauaaugauguagaaaacaugacagugcaagugucuucuguccuuuuggaaguguacccagucgugggauuaguggguugugauaguucuuuuuuuuuaaguuauugagggcucuccauauagaucaguuuucauaaggccuguccuacaaaucgugagcaaggguuuucguuugccuccauugucuucagcauucaaugucuuucaucuuuguuugauaccauucuuaaaauaaugaaauucugaaucauuguauuuuuuguuuaauggcauccuauuugccucccucaauuccuggacuguugguguuggagucuuguuuucuaaaaacauuccuuaucccauuuuauuuuuuuuauugaaaagcucuauuuaguaagacacacacgaauuucuacacauagguagaacugugaagugggcacuuuucuguggagcuguguuacucuagauuccuguaguucucaugucagucagcuggagacaagagauuuuggccagugacacuguuaauucauagacaauauaguauugaaauuugucuuuuuuuuucuugcaauauugauggguauaccaucaacauaaacaauuuuuaaagugugaucuuauaaaaagaaagaaaaguuuuuucuuacacaaaagacauuaaaccuuaaaauggaaaaagcaguuaaccccuccauggcuauaucauuuucauacauuucaacagaaugagucacgagaaaaacagauaacuaaaaauugagaaaaugcaacuagaauuauuaaggagcugugugaaauugauuucuaaggagagauuaaauguauaacuuggauaagugacaacuagagcuugaggcaaagaaaagugucuauaaauauuugaagaguauaaaccaggcaugcaaaacccaaugcaguaggaguucugauaagggccuucuguacugagcacuagccuguuuaccucugggugcugcuguggagaaaagcucuaaacuccugcucuccugggcaauauuuaccaagcucauggcugaacugagauccaugugucaggcuuagugagcccugccucaccuugaggaacuugaucacuuauuuuccugcauccaacaauuaaaaugcugacuacacuucgcucuuuuaauggccugguugcauagugaacgaaauggagaaacuaaagaguaauauuaguaaaugucuuggagauuggcuuugccaucuauucagaaccugguaauggaacuggaucaagaucucucuuucuauugagucaucaacacaaagacucagccuuaucuucuguuugucauaaacacagcagagcacaucagagccuuaccacaguguggacccuaucccacaauacuuggacaguguguuagauugaaaauugguauucauauugaugaaagaaggaccgcauugcacacauuuaaagucagauuuacuuaauuuugcuuaauauaaacucgugaggcauaaggaacuuaaguaaaccuuuauaauuugaauaauagaauuucauuauuuuccaaauuagauuccuuuuaaauauccagccuauacaauauaaauuauuaauuuacauuuuccauucaaaguuuauauggacaagauguaaauguucuauucuaauacuuuuuuguacaccuugagugaaacagaaagaggcuauaauagaaguauaccucauacauaguagauacucaauauaaaacaguugugucugaguuacagauaaaguuuaacucuauaacagcuauccuuaugaaacacuaugguauaacuaggcuuucuugucuuguuaagaaccagagucauucucuacagaguauguugagauucuucagagcacuuauuuugucuuuucauauuucuuuagcaccaagcucaccauaguuauuacuaggcacuuguugaauaaaggacaggcaacuuuacagcaaccuggaugccauuauuguugcuucuggaaucagcccugccugccaggaucucuguggaaauguuuucgaucauuguccucuccaaacagaguuuaucaagugucugaucacuuccacaaccaaugagcuccaugcagccacuccugagcccacuuaguccucucuugcucucuugagcaggaguguuacuaccucauguuuuuuguuguuguugcugaauguuguugaacacaguuuugauuauuugagcccuugucucacagccuagauugaagagauuguugcugucaaaaugucguauauaugguuugauaguuuccuacuguguucacugccauggaaacaaagaagaaaagaugauauuauaaucaagaguagcacagaccagguguucaaugaaagaagcaaaaauagugggugaugagaaccaucccuaaauuuaaaaagauauuaauaaggguaaacuuuggagagguaagaaucaaguagaaaaaaaaugcuuagccaaccugcuugcauaaacuggacucgauucuuggcuugaaauacaaaacauucuaauugaauccuacaaaaugaauugaauauuuuuauauaagccaugcacauuggaguaauuagaaagggggacagaaauugggugucacauuaauugguauuuacuugaaaugcauuuuggauuauauucaauaauuugcacuuuguaugaauuuaauuagaugcuaugugccccagguugucuuuccaaugaaaaugaggaaguuuuuggcaauaaacaguuguacuguguuaucaaauuguuuuaaauaaacuagacaaagugcucacuuguauggcaggcagaauuggaagccuuugaucaguacaaugauaauguuucaauguggaaaggaugcuaguuuugugcuauuuaaguccccagaaauuaccagagggaugcaggaauccuccuugcaagaaaauguaugugaacaaaaaaauggguggcuggccucagugcaugcaugcuacccuucggagaaccucuuuagagcucccuggguuauuuuacaauuaacuuguugauuuaauaagcuaaagaaaagaauaaaaggagacucuccaacaagcuguucaguguaaaauauuugaacaaacagaacccuucuguguuguuuaauuuaaauggagguaaauuuaguugacaaacccugaagaggagaggcaucgaaagccucaaggaugcucuuuguuuugugaagaaccaaauauuaguugcaaauguuuugccacuuauaaauuuggaauuucagugucaacagucauaucaaaccauauaugcagaaauucuaacacugaacuacucagaaguauuuggguuaggauuugagcaaguguuacauuccuccgauauuuuaaacuauaaaaagaugaguggucuuuucaaugaugagaaaaauauuaauauuucaguggugcuuauggaugguaagauaguucugucuuuaggagugacggugacauacuaugugucugaaaacgguaauugguacuuaaggguguugcuaaccuaacguugaaaaauguuauguaauaaguuaauaacuugaguaacagggaaagaggagucuccagguagcaacuaaagguagaauuuuuaaaauacacagaaaggaacuuuucuccuuuuauauuacguguguguguguguguguguguguaugcaggagugcucacacagugguaggcuuguggaaauagaggacuucuuggaaaagucaguucucucccucugcuguguaucagucauuccauuguuuaauagugaacugagguugagagauacauggacuuguccaaaguagcuaacagaccacauauuuuuauucauucuugucccuucacccuucaccuucucaaucaaguuaagaaauauaacuuaucuucuucuuuauuugaacuguuugaaacaaaggauugauucagggcuugggagcaaugaggggaaaaugagagauuacuuucuaagagucugugaaauagagucacuucuaugguuuuuuguguguagaauuugcuaauuaauccagugaaggucaagugaaauuuguagaugguguuccaugucuacuaauugggcaaacuguauuucuuuucauggacugaggaaaggcuucugaggaaaccuuagcagguaaggggcuugaucagaaauaacuaauguucucauggauggagaauauaucaucauuucaccuguguccaugacuuggcagagacuacuuggaaaguagacaugggagaagguugggagagugggcaguugggguaaagaagcagcuggaaauacuuagacuccauaaugagauaauuaagacuaauuagcuggcccuguaggcagaaagcagcccauuaaguccagauacaguuuuaauaauguaccugguuuugaggguagaguccagagcaccccagggaauagaacgcucagggugaaaugucuagguuaggguucuuaccaaaggaacagcaacucugcccuggaugagcuauuuuucuucuagaaacgaaagcaagcuuugugguuuucuagaacuucaggaaaccucaguuuucucaucuauuaaaugaagauacuuacaggauugccaugugaauugaauaccuaacaucgaguacuuaguaacuauuaacuaagauacauuuauugaaagucagaagcaaacuacuaguuggaccucagacugaggcaaguucagcacucuuacuacauccacuuucccacugaugacacuucugaagguucuaaaauaaccugucuagcccaaagucacagcucauuuuaaaagugaccagaacucguaaaucauuguacaaggauaauggauuuguuucagggaccagccaagcacauuccuugagccuucugcuaaacagagcuuguggaaguggcgucuuccgguagugcugcgcacagcagggccguggguguagacaugguggcaucacccacagcucccugccuuuaguugacuguuuccuucaugcucauucaugcucuugugucuccuugcgcuguucuuuuauuaguugccccuaguuuggaccagaacuuauaggcaagucuuuacuugcuguguuaaauucuuauuacuuagguaacaaauugccacaacuuaauaacuuaaacaauagagauauuauugcauaguucuagauaucagauauauaaauuggaucucagugaguagaacuaagguauuggcagggcuguggucuaagcagucuguccugcuucauggcuuugggaguuccuuuugagccagucucaugcugcuguccuuaggguuugcuccugccuucaaggacucuuaggacccaagugcacuccuucgaacggcauaaaauaacuuucuuucuuucucucucucucccucucuucuccuccuccucccuccuuucuucugccgccgccuccuccuucuccuccuccucuuccucuuccuccugcucuuauuuuuuuugguagcggguaggaaucucauauuaagaacuuguuuaccaagcuggacuggaacucaacaggcuucuaggacuuuacucuauaaccucaaauacucacauauucccauguuagaaugguauccagcuugcugacauaugcaauagauucuuaccagcugucagcuaccaucgucuaaaguuacuguaauuacuugucucuccuugcucacuuuaccaaguccgcagugguccagcccugugugcauuccaaucugaggaaaucagaaaacucgcucuguguguguguguguguguguguguguguguguguguguguuuagaggagaggagggcaaacucagauuucuguucugguagugguuuuguuugcuuuuuaggcucuggugccauauaauugaucccuuuaaaugucaacccaaagguauuuauccccuuuagaauacuugcaggguuguauaaccagcaccauuguaucuccagagauuuucuucuccccccaccucuucuccuggcaaccacuuaacugcuuucuguuuggauuuguccuagaggggacauugaauauaaguggaauuauggccuuugucuuuaacuugauacguuauuuuugaggcuuauccacgcuuuagcauauaucgauagcuuuuccccuuuugauagcuaaauguuccuauguauacacacauauauguagcucaucuauuccuccacuuaaaugagcaguuggguugugaaauguuucuaccuuuuugcuauuaugaaauggugcugcuauaaacacuuacauacagacuuuaguuuuaguuaguuaagugagggucuuccucugugacuuagacaauuauggaccuggagguccuccugccucuguugcuugagugcuugguuuauagugugaaucccagugccccguggcucucaagguuuugugugguaaaauucauacaguugucuuggagucauauggcaauucugcugcuuaugagcaccugcccaacucuuccaccaggguucauuccccaugcugcgcugguuguaccaguuuacaccccugggcaucaguucuugcuucugggaacaggagucaacaauuuuaaacucgccaccacucagagugugggguggggggguugguaugguuugguuugguuugauuuggugcuaggcuuauuauuguuguuguuuucaguuuuuuguuguuguuuagugugagguugguuggguuagguggcuuuuguuugguuguuuggauauuagagccagguuucauagaaugcaguccagcuucaaacucagucuggagcuaagaauguccuuaguccuccucuauugaggaguuugaaacuguagacagaaauauauguauugaggauuugaaacuguauacacaaauauaugaaauguaggaaaaaucaaauaucugacagccaauguauuaagaaguucccuauacuaaaagugcuuucugagaaugaaaaaaaauugguagcauacaaaaauaauaacuuuucuguuuauccauauccuuggaaacucaguaaaggugauuaguuugggaauuuccuaaaagccaacaaaaaaaaucuuuucauggguaauaaagaaguuaaaauguauauuaauacaacaacuuaccauucagaguugggggucaacuuguuaauuaguacuuugccuucaaaucauguugcuuuugugcccuuugacuaaauagaaaaaaaaugucagccuuaauuauuauuuauaaaagccuggcauguucacuuugcauaguaaaaauaugacuacauccuugaauaggacacuccaagacauccaauguuuucuucuuuuccauuagaaagagugagugguaccucugcagacacuacagggagggagaaauccuuaauggaugcugacaaaaguagccaggucuucaucuuaggcaauaagauguaccuugcagucacacaggagcagcaguaagugcgauggagacacuguugcugaccccccaucccaacacuggccugcuuggaacucccugcaugcuuaggaguccacuuuucuugccagcaccgagcugguuuugcccucuccugacuuaagcaacucagaauccacaauucugugccacugacugcacuccauauauuugaugucuucuacugcaucagagauaggggaagaacauaaauuugagaauagaacagaccugaucaggaucucagaccgucgcugccauuuaucagcuggaagauacuugacauacuacuuaacucuuuugggccuuucuguuuccacgggggggggggggggggaagaggcaugaggagauuguauaauuaagugggauggucaguugcaacagaauauugaauauaauaaggacugugagcauguaguucuuugaacaaauucagccugaccaucuucuaaauacuagacacacagccauaaucacaauagaccacgcugugcccuaagaagguuauauucuaauaagacacacauaagugacagugaauaaaagucauagccagucauagcaacuccaggaagaaaggaaugcaggccaggcaguguuggcgcaugccuuuaaucccagggcucgggaggcaaaggcaggcugaucucugaguuccaaguuagccuggucuacagaguuccaggacaggaaagccgguugcaaaaugaaggugcaggaagacuuuugugacaacauugccagcagcaccugcucacauuccuauuuucauuguguuuuauuuuuuuguuuuucaucugaugaaaucuguuuuuuuauuuuuauuaaaauauaauugugucaguucccaagucccuuucuucacuccagccccccucaugucuuccagccucucccaugucaccuuccacucccuuucacagugauggccucuuuuucuuugaugacuauuguuagauacacacauacgcugaguccacuuaauguggcccauguaccugauuauaauuuuagggcucaucccuguagaagcugauucccccuuucgcaguggucaucaguugccuacguuauuugucuagaggugggaccaggucagaguggcccuuccccacuaugaugucuguuaauauuguugucacucaggcagccagcuguuucauugaggugcaugguguaguuucuguauuaucucugagagagagaaauacaguguuccugacccuccgguucuuacagucuauguggccccuccucuucucuuuucccugagcccuugguguagggguuguguuacagauacagccguggcacugaauacucauguucuguugaugucugcaucauacccaguuguaguuuucuguaauggucucauuugcuguaaagagaagcuucucugaggguuagagauccacuuaucugugcucuaguaaaguagcaauaguacguucucuucuaggauccaugacccacuaccagggauuugauuucuaagacuaggcaugguuuccuucggccucaagaauuuuaguugauaaaauagagucaguaaguuauuugguuuuuuuuuuuaaucuguagcuuaaaauauaaaguugcaauacagaagcuguaaauuuguauuuguuuugaauaaauaucucuuugccuuggaaaaguggaagcuuuauugcagaaaucauucccaaaggaaggauauuuauugggcuggcaguuguguggucacacuuuauuuaauuaucauaaucaccuucuaaguccaugcugaacucaagacaaggagaaugcuaaugucugucauuuaugaagugccagcaagggaagguacagaugcuucgucauuuaauccucacagcuaacuuuauaaaguaaauauuaugucucuuaauuacaaaugaggacacugagauuacauggcagacagcuaacaguagcagagccaggacugagugguuucagagcacacauucacucuuccuggcacccuuuugccugugguuaccucaccaccauucuucuuaacaaucauuuuuagaaaacacuuuaucauagaguaagguuguguuuuaaauucaguguacauauauauuauguaccuaggauuugauaauguucacuuccacuguuuacuacauuggccuuugucuuuuuucaguuuuguguucauuucuuuugugguuguguuguuugaacccagggcuuucacacaugcuacccgaggacucuaccaaguagagucucaggccuuuuuaaaaauuuuucucuaauguauuacauccugacugcgguuuccccuccuguccuucucaccucagucuuucucucugacuuccccaucccaccccaccccacuugaccccuguccacucccuccccucagaaaagagcaggccucucagugacaucaacuaaacaggauauaacaagcuacaguaagacaggcacacauaucacaucaaaacugggcgcaacccaguaggaggaccaagaucccacgaguagucagcagagucagggacagcccccuccccacaacccccaccccggucccacuguuaggauucccaugaagucuccacucuaccacuaagcuacaccuuccugggccuuuuuuuuuuuuuuuuaaauauaagguguuuuaaaaccuugaaguagcugggccuggcaguuaacucuuaaucccugagccuccacuucuaauggauguuacaggcuauaauuuguaccuauaaucugacccacccaagacuuuuaaaauuuguugagcaacuguuuuucauucaaacagauuaucucccuaaacacagaaggcacuguuuuuggagcugauacuauaaugcuaguaccaccacugcuauauauacuaauacuguaauacuaguaccaccauaauucuggaauaaugcuauugccaacagugcuguguauauacuaauacuguaauacuagugccaccauuguuauauaagaaacaucuacuuuuuguguauuuuagcauuucaucuuuacagaaaccuuaaagauaguuucauccuuauuuugaagaugaagaaggugagacucagugauuaguaaaauauuuaagguuaaauaauauguggaaaaaagucagauaccugaaucugugcacuccagaacccugcauccucauccuccacaggaagacaguggcacgccuugucagcacuccagaagcuaaaccugguauagugagcaggcuagguuaguaguuacuaauuuacauacgaaaaauuaugaguuuccuucagucccaugaacaccuugaucaaauggugauggugguggcaugauauaaaugacuacaguacuggugcuguuuugagauuugugcucuaaagugaagggggaugcaacagaaauagaagggaaagaggaggcacuugcagaaggucugggaaggguguggccauuuuagaugacuuuuuuggaugcaagccuuaaaaauacaaacuuaugugacaagcuguuuuggcgaugaggaguaauauggucacauaauaucuugacaaagcauagauuauaacuugcucugcuucagucuucacccaauaucuagacccaggacuagaccacaaggaaagauucacuggcuuggcagcuuuuucuguucacuauucuguuggacucgcaagaaaaauuauuauauaaguuuuaagggaagaagcaaaucauaaaauguaagggucaaccagaucagccaccauuuagcagucaauggacccaccacugauugccucugucuguggccuuggacuucgucuguauaaggaugaauguaucugaauuaucuggagagcugugaaaacagaguggcuguuccuaugcccuaagagagcagaucuggguuggaaccuggaaguuggaauuucaugagccuuagguagugguccuacuucuguaccgaacauggggucuacuggucuccucucugucguuuccuacagcaugcuguauuuuaaaccacugguagcacugaaaucagaagauuugaaccauaugguucucuuccaacuuagugggaccuucaaccaaacauguaagcuuuucuguugcuuuguuaguaaaugguucuauguagcaauagaugaaugagagaaucgaucuaauuucugagaaaccgauuuugaaaagaauagcauacaaauuaucaauguguaaagauucuguuuugacagaaucguuaagaacaauauagucuaccuuuauauaaaaaauuaaggaggaguaucucauuuuacucuuugcccauaaugaagaggaaaugcuccauggagaagaguugaaaucuaaacauccugugagagagccucaucuuuuuuccauucauuaauaaguccaucuuuaaagauuugucuguguguguaugcauguuuccagaagaggagcugaggcccauggagcgaggguuaaaggcaccugagcugccugaugugcuccaagcaguacucagguccucuuagccacugagcuagcgagcuugccagccccuggaaguuaauuuuuuaaagaauauaaaugaagaagaagaauaacuuagagcuaccugggcaccugacccucugaauucuuugcggccauggcuccaaagagagagagagagagagagaagggagagggagaggggagaggggagagggagaggagggggaggaggagggggagggggagagggagaaggagagggagagagggagagggagagagggagagggagagagagaggagaggagaggaagagaaagagaaaaagggggagaccaaugucuguaaagcuuucaaaauagccuuuccugagggaucagggaaacuguggggcccccaaaucuaaagauggauggagaugccuggggccugagucaguuaaagccagggagaaaaguggcucuugaguaauguugcuguuucauuugguauagaguaaaaaccagaauaugcaaugagcccaggcaccagcuguggcauggauacagaugcagggugacuucuucucagggacaucucuaaaccugagugacccacucaguggugaggcuaauguacauuagcguacauuuuaaacugugacccuuuugucucuuucauaggugaagaugaggaugaauuugagaauuuuaugcugccucucacagucucuuuugaaacaguguuacaaauauucaacaauaacuuuaaacaggaagaaguaaaggugaguuuuguuuucauacaugaggaaagacaaguuuauucuuuaacaccagaacaggcauuuguguaucuguguacuuguauguaugugaguuucaaacccacaucucuaaguaauaugcuuaugaguugagcuuuaacauaagcuucucuaguuucugaugcaaauagacuuugaggucagugaguguggccaaggacagucacuucacaguuagguggugcagaugugucuccagugaugcugucuguaagagcagagugcccaugggcacaugcuuuaaccaugcucccaccuacccggccgacucugugucucagcgugucuguauagauacacacaugugccaaaacccuacaucucugaagauuuuuaaacaagaauuucuauaaaucaggacuuuauuaaauggcuaggcauauguguauaaacaggagcuggucuucaaguauugcauccuuaaagugaacaagugauuaggguaacugauggcuaaauaaggcuuuaugugccugugggagccauauuaggauugauuugacaagucacuucagcuguggcaacagucauaauaucuaagacaacauuauguuuuauuaguaaaauccuuaaguguaccaagcuguuugugacaaaacagccccauauuuuauggggggugggggggaugggaacaggagcuuugccaaacagaaacaguaucuccugaaauuauacgacaucagugcuaucgcaaacagauaagcacugauuauuagucuuaagaauaauaacuacacuugagagaaguagguaccuuuguugguggugcccuggucauauguuauuguuauuugaaauacauuaaaauauuauccaucuuucauggcuucucuuuuccucucucccuuuucucuaucucauauauauacacaaacaaauaccaucaaaucaacuagaaaagggauaaccuuuggugauauuuauauaauucugaggggaaaaauuauggaaauauuauaccuuuuauuuuaaaauagagauuuugaacuagauaucauuaaauuuuuuuuaaguaaauaagaucucaauuuuucuuuguuuaaauggucuuccuaaauucugugucagugaccagucaaauuaacuguaauuuuuagaugucuucuaaauucuucugaccaacagaaucuuuauagcuuuuuaguagccauuguugccucuuaucaaaagaaucagugauguugaaaagugccaucuuuauaaaaauuacauuugucucauuugaagauuucauuauauuccacgccuguuuggauguaauuccaucuaguuugauagaaaccaucuuccuagagucauuuuuaauggaguuccagugauauaucccuaaacuaccgaguucuuaacgacccuggaaagugacugcuugauuacacuuuaacgguauuugcaaauaaaaucacaaguaauuaaggggaaaucuccaggcuuuugagcaaguuugaugcaugauaacugccugauucagcuucaucuagaguaaugcuguguaggcaacagcuacugagaucaauagcaacguaaugauaguggcagaauuaagugaguaaccugagcgcugccucagaaugcaugcagcugccacgaaccaaggccacacagugcacuccucgcuuccguccuaaauguucaucaaaagacgcccugcaggaaaauggaguuagaugcucuuuauugcugaucgugucucuugccacauuuaucagggaaauuggauuagcaguuggcagcugcagguagacaagauucugcagugauuaaauaugcagcuuggcugcauuuguugugacagaccuuuaguaaauucuacuguaagcaccaucugucuaauuuguaugaagaaaacuuggugcuuacagcugccgguaaagaacaaagucuguugcuuuaucauaaacaaaacuuuuguacuaaauggucuuaaauguaauuuauuagguuaaggcuauuuuuucuaucauggugaauaaauaauacaugcaaaggugcuuucagguccuucauucacacguacuagaaaugaaaacaguucuguuuuguucucuaguaaaguauucaguauuccaauccacaggaggugaugcugcuaaaauauuguuaugaaaaugcuguaggacugccaaauucauuuaauuugcaaccuuaccaggaucaucuaacucucuauuuauagauauuuuucaaaugcagauuuuagguugaaguugaacauuaaguucucucaaaccaaaacacugugaggaaagaaugcugagaggcucuuauuuaugacugugcuuucuuugcuugguccuaauaaaauuuaagugaaugguaaauuuuugucuuuuuuuauuuuucucuucaaaaucaaagaaagaaaggggggguggaaauccggguucugggauauuauuucaaaaugucucuugccucccacccccaucauuuuauagucaaauauaauguacuguuccccuugcccuggcauaguuuucaauucagccaugacgucacggguuuuaaggaaaaugaaugaaaacuucucggaggaagaggagcaguuaaauagaaccugcuaucuuuagucccuucguaaaaacuccucgauguuaaauuauuuaaaauccuugauuuucagcaugcgcacauuaaaaguuuucgcacuaagugccaaauguugcaaacagcacuuuaacagaaugauuuugcuuugaucccuguagcaguuccugaauaauuuaucacagguuauugccuuaauucuggagagggauagagcaauaaaggcagaugaaaacacuccaguugaaacaccuuggggccugcucauuccucugacacggcucuuuuguuggaacuauuuagagguuauuaagaugugucuccagaauuaagaguaugcuguaaggaugaagacagccaucuuaauucuaaagacaaagcacaaugacccuucaccuucuuuuucuuuguuguuauuauauaguagaauuaugaggauaauauuauagcugccccaguagugccacuacaguaaagggucugucagccuucccauuagaaacccuguuugggggucaggguggaaggagcugcgcuucagccguuucccagcccauucgucucacacuuggcacacagacaacuguucaccaugcugccgacugaagcucucagcaguuucuucuugaacucuccaaaaacgaauccauaggacuagaucacuagacuuaccccacuuguccaaugcaccuccgguauuuauuggagccaucaccuucuagaucugucuacccuaaaaucccggguuauuugcuagcucgugugagcuccugguuccggcugucugucucguccgagagcugaguauugaggaaauucuccuguagcuuuuauguaucuguguagauucugugcugugcugagaggaacgcuauuuuuugaauguaaugaaucucuuccauuaacauuacacuuuauugcuugagugaaucuaaacuuaugcuuacuauauacuuucuuugcucugaaguaacaguuuccaaaaguaaaacauuaguauaauuuuauggccacauuuuacuguauuaaaaagacaauagaugugcuuauuuggagaguuuguaucaaguuaguaccuuuaaggaagaaaaauucugaucaaauaaaaauuaaccuuuuguguaaugacauuuuauuaaaagcccuuuauauaaggcaagaaguaaaauucaugguuuuuauugacuaauuuagaauugaauagugggucuuucauauguauauggagauuaaaaucacuugaagaguagccuguguaaguguacauaauaaaaauuuuuaaaagcacuucaauagauggcaaagccaaguagaagccaucuuacagccuagacagcaaucagaauccaaguguucagagaauagauuguuuuagaggcugcaggaagaaaggaagcugagaaagaagacgaguuggugaggaaaaaaaaaaaaacuguauaauaaguggaagcuacgugagucauuuuaaacagcaaaaaugaaauuaggaguuuuuauauucaaaaccuuggguuucugucauucuguccaaucaguuaaaaguagaaauugaguaguuccauagacaacaucagguacauugaaucaccauauaaauaggaggggcagugugucugacugaaaauuaugauuuauuacuuagaaauguucaucguaauaaagauggucagaauucauugccuacuugauaacuuaggcuuuuuacuaaacagguuuucauuuauuaccaaaaucaaucugaaacggucccgagaccauuuuuuggcuuaacacuucuccugaaacaguauauucagaaaucacaguugcauaucucaaauaucacaccuccuuguugggcaauuauguuuauuugugcucuuugcuaugacauucuagcaucuguucauggguuuucuuuuucucuucccaagcaucauccuaaggacagcuuaauuaagaguccagaguaugagucagaucuccuuuauucaugucaaggggguuuguuucgcguucccuucuaaaaccauuuaugaaccacgauuacuaguugucaggauagugcuaugcauuuuugcaaacaaauauaucccucacaauagauuuguagaauggacauaauuauagguagccccugugauagauuuggacauuaagacugauuaauugccuugucuuuaagaauuaaacaaagcuagaguucaauuccagagucuuaugacauugaauacagaacuuuuuuuccuuacauuguuuccugacuugaacaguauggcugcuguucugguuauaucauaauccuguaggucaccuggacaguuuuaucuuauccugaguuaaugcaacuuuuugggggagaucuuuaaaugccagugcagacuaaacuauauaguggaguugauuugagucaagucagucaguugagauuugcuauuaaauaauaucuagauuacauaucuugugaaauuaugaauccugcucuuuuuuuuuucuaauuugucaguauucgguuacaaaaagagucucaauguguuauacuccuggaauuaagauucagcucaguuuauaagaagcaaaguggaguugcucagcagauugauggucuguuuauuaaagagccuaugguuuucuauggaaagggaucuaagcgagacauuuuagcuaaugaaucagaaucagauauguggucauuauugccugauuauuacuccaucugcucugcacuaacgugaaaaucaauuacugugucucuuucccacugacagcguauguugaucgggcuggcaagagaucuucgagggauugccuuugcacugaacacaaagaccagcuacaccaugcuguuugacuggauguauccuuauuacacugugacaauaccagcucugugcacagagggaugccaggccccucucuuucguuuaauaguguggcgcaguagggaagaggaaacaaagcuaaaugaacuaauguguaaucagcuaaaaauuacagcacaguggcagcagugcagauaacugagcgcagcauuugagacccggcucacagaggucacuuucuugauagauaccauuaaauauugacaacuugaagaucacuuccccaaaugguuguuuauguuacaggcaucaaguagcuaauauuuguacuuggggucagugauuuguacauugugauauuuucuaaggaaacucgaagucucuguuccaucucgauuagcaggguuaguuuauccuugagauuuuacucacagugguacaguugagucaucaugaugaagauauuagugaucaugaaggggggaggagaguugucauuugcuauaaaauuugaguuugcuguuacuaaacuguaguguagacuaguguagacaggaggacaaaucccuauacagaaaugucuugucacauaagaauaaaaagagacagaauagguuugaaaucacagcacuucaauuacaguguaaaccucagccaaucauucuauuucuuggacacuugaugucaucauccagcaaaggagacaauccaguacccuagcuuacugugaccucuaagauaaguaacacacucugucuggugucugacacuuacccagugaccaauaaacauuuauuaacauguuaagaguacucuaugagucaucuuuaauccuaacaagagaugacuguuuauacaagucauugaagugugguagcgucauguucuuuauauuuaaaaccagcagccuauaagaaaauucuacuuuaauguaaaugaggaaaauaccuaauaaaaaaauauaaaagaaaaucuacuuuaaagcaaaauuacuuguuuuauggcuuucuuucuuaaaacaguaucucauuugcccaguuuugccucagacuugacagagccaagaauaaagcuaaucuccugguccucuugccuuagccaccuaaguauuggaauuaccaugcccaugcccaacuuaauuuauauuuaagugguauucuuguuuuauuuaagcuuuuuuuauccaaacuuuauauguuguaaaggaaacuucuuagaagcagugguuagugacuaccaaagcuaugccccaaaacauaagagcugagcauguuuuagagagaaugcuacacauuaugaaauuuuuaaaugcuacuauuuagaguacuggcuuaugauuuuuaguugguauggaaacccacuuccucauauuuauuuucuuaaagaucaaacaauuaagguuuuuuuuucauggucuugaagaaucaacuauauaccauauauguguguguguaugugugaguuuaaagauuauaaauuuaaucauaaucuuaaauucauccacaaugaccauuuuauuucucuaaacacccaguuccaaaggcaaaacuuucauuuauuuggaaaaucauaagaacccacuuuugguacaauuuacaugagaccagucucuuaaagguagccuguccagcaguuaggaggguuuuuuuuuucuuguucaccaguuguaauaaagagucaaggucagaaauuuccuucugugucaacaaauauaaucugguuuccauuucagcauuuguccagcagauggcagaaauggaaaaucuugggacuugguguuuuauuuuuuaaacucgaaacugauaucuccucccuuugaccauagcuguugaaguuauuggggucaggggcagagagcaaggugucaguuaugcaguaagcgaugcuacauugccaaaugcaguggcgugcuacuggccuugcuuauaauaauuggguuucaguagcaaaucagcuuccuugggaaaaggccaaaggcuuuucauaauuguauugacaacaaaaugaauaugauaaaugguguucauucaguugagacaagauuuauaguuuuccuuugggcaaaggaugaagagcaaauauuuauaauaauaguaaaauuuguuuaaaaguuauauuauuugaucauucaaaaagcuuuauuaaaauauuuugaaauaacuuuuaacaguuucaggugauaaaguacagauucuuucuaaaguauucaaguaaugcaaaaaugaauaaguauaugauuuuuaaaaaauacagauaugaaagucauuuauucuuccugaaauauugauaugucaaacugucagugaggaucccacauuacugcuggggaaguuuauuugccuuuuauccacauagauguguguucuuuaauuuguuaugcaguucuuagcuuauagaacaaacauuccuguuaagagcacaugucaucguaaagucaaaaugcauuuuauuuauggugauuguuugauaaaaugcuauuuccauguuuagcuauuuaauucacaagcaucucugugaaugccuuagccauggcauuaacugcugcacgaacugcaugcuuaccacugcaucugucccaagcugcacacacugcaugcuuaccacugcaucuguccaaagcuaaauggccugggacuucacagcuaccaucuugauaauuuuuuucaugacuugagaauucaagcaggaaaucauucguuuacaccuuugccccuaaaguaagaaugcagcaguaagaaaaccgcacauuauucaaacguuuccuagguugugcuuagaugaagguuucagaugaccagagggaaacuaaaauauccacauguaaauauuauuuccaggauuacucuaauuuccaggauguggucaaucauugagcucacacaggcaggcaguacuguuugucagugaauauaaacacaguacacaaaaacaaaggaagcaaugaccaaaauuaacaaccuuaaacuccagccuugucucacugccucacagccuguggguccuggguaaguuaguuggagucuuggagucacaguuuuacucccaugacccaggguuaaucaccccaucucacagcucccgacuguagugugugggacagaacaacuccuucgcugcugucacuuccccucuuaaaacaguuagcaaggaugugggcugcguauccauucagcaaagcuggcuuccguugcgcagugugcuugguuuucugaacaguauagguuacugagacacaauucuuuuuguuuuacacuccagauuuuuuuccccucccaguccacccuccgacuguuccacaucccauacuuccuccccaccucccugucuauucuuaccccuaaaugaacuuucaguucaaaagaguccucugcaugaaugacuuacaagaacauauauagaaagcuguaaauguggucaggaaaggcucuguaaaggugaccauguaacacugagucuugcuagguuaaguaagacuagacccuacgaauuacaagggacagaguuucaggugaucauuguuuaggggaaauaguaaagaugcuucguuaagacacagcuuauuucauggcuagaaacagguuguccaggacccuucacuaucagacuccaaaauggauauucauauucuuaggcaguaugaagccugaagaauaaauucugguagcuuugagagacccacauaaucagaagaauaucuuaagaagaaaauaauuggcaguauaugugaaccaagugggacugcaaaaggacuaacccugaagacccacugugaggcuggccugcuuugaauguguguuuuaugcacaagaaauacaagaguacauugcugcucuucagaagcauacaguucugugggcaugcaaaagaaacccuaccgaccaaccaauuacacguguguuauaacagacacaugugacgggaccacaggaacauuugugaagaguuuacuaauacuuuggucaaacugagagagauuucuuaggaaaccagaaguugcacuaagauugaaagauggauuuccagccaugagagaggaagggcaucccgaagucuguccccuccugaacaaagcacagguguuggcauguuggugcugcaucuuaagccucugcacaccaggcuccuccucuucuggaaccacagccccaacccugaguccuaacaauuuuaaugaaaacauuuauguugucauagguauuagaaugcuuucuuaccuuuuuauucucuaguuauauucauuggucuauuuuguguacaugcgugcucuuucccuggcacacauggaaauuggaggacagcugugggcguuaguucuuuuccuacacggcaaggguccugagcauggagcucuagucgggggcaccagaagggccuuuacacagugagcccucuggcuagccuuugcauuuucuuucauacuauuaaauccaagaaggaaauaguuguggugguuuuucuccugauucuguuuuugugguguagcauauucaaacuacuaaaucacaggauggaugaaugagauguguggguuaauccuggauggaugcagauccggugccugccaguuccucacauugucaucgggugugcuaaugucaccauuggugccuuugauuguucauuuaucugauguggaccuuugguucucauugagaaguccaggugacaguaaugagauccaugccuuuccuaccuaagggcuccuguucucuuccuccugccuauauguguguaguccucacaaggccacuggaaaauuaaagcuggguuuugauucucacucuguaaucugagccuggcccucucgcuccgcagcccuuuaaccucccugcuuaguagaccucugcucugcuucccaauaaucgcucauucucucuguggcagucaccucugucagaagcauauuagaauugucacugcucucauuccacacagagaagggagcauccccucauauccucugcucuuagcccagugugaauaccguguacuuuaaaaacaucacggugcucugucuagaaaguaguuggcacaguggccuggguuagguuuugagguuugugucuguuuccuggugaugcuggaguuugugccugagcugucucuuuccagaaccggaagcguccuuuacacaccugccacacugauuaaguaugacucuugagcauaaaaaccauauauucuauuucuaaaucaguccuuaacacaguuuauaauauguagcaucuccugucuauuaaacaauaacaaguuuuuaauucuuggagaaaaauaguaaacuauuugacaguucaaaggaaguuagcagucaagcuaguuuuuucuuuaauauucauguauguguauaugugaaugcauaugugcacacauguguccauguauacacaugcaucacagugcauacauagauaucacaagacaacucacucuuuccaccauguagguucugaggcucaaauagaucuuuuguuauuguuuuuuauugagccuacucuugacuuaaacauacccacccccuuccuggccucacucccugcuccuuccuuuguguuauuuuccccauguaucuuuacguuaguuguggccugucuuauuagaauguaagucccguaagggcaggagcuucuuaguguuuugucacuggucaucccuggagacuuuaggacagcguguuugaggacgucagcacguacuuguuagagaagcugcuuuugugagugcagccugaguucagggucucucugggaacuacugcucuccugcuuggagggccacagcacuccucggacuuuggcaggcuuauuuucacuuuuacagagugauuucuuagagcucagcaugaagugcaguucaaacaaucauaaggcacuucuaccauaggcuuugcagguucacagguuuacaacagcaaauacugagcucugcuuuguauagagccuguacauaggagaagacacugguuucugcacucagagagcuuggaauggagagaggaauucuguaguggggcuagcacagucauacauaggccuuucccaacccaggugggcuagcaguauaaguggugaaaaacgcuuucaggaaucauugucaacuguuuuggaauaugaggagcacauggucauuaagaaggagauccuaaggaaguguggauaccaacccuuuccaagcuuacagaacaagcaguaacuacaaccagccagcccugcuucucagacagauguagucaggagugcucauugagcauaggcaaggaagagauugaugccauuugacaagauaggaaaaacaucccagagacaugaaacaugagcuauguauugaaagaugggaugaggcagaaggaagcaauguacagaaggaacaugaccacuggaguccaaugguuuauuugcagggauuugcaacaagccaaguuccacauagagcagaaauggagggauuggaggcagaagagccucuaugucuugaugaggaacuugacugggaugcaggggcuggguuuaugaugagcuuuuccaccaggagcuuuguccaaaucacggcaagaauuggugaucccauucagcagucccauuccacagcauucagugugcuggaaagagacuuggcagcugucgaaaugaaagcgucaagcuuccugcucuaguuugaagcuuuaauccauauuucuauguuugccaagaaggaggcccaguguggucugaagguccagcagagaugauguuuugcauuccuggcugggcucaaccaagugugcaccccuaguguuaacaagaaugccugcaggcaaggcaugguggcagacaccugagaaacagaugcagguggaucucugagaguucaaggccaccuugguuuaccugacagccagaguuacacacuaggaggaccagagagagaggggauggggggggggggggcggagauuauuguacugugcuuagcagcauuggccuuggguggauuagcacuaacaccaucuuacagaacuaauaaaugauuuaguaccaggaagaugaugcauuacuagcagcccagagcuuuuauacaggguaacugcccagauguuucuuguaacuccagugauagcaaagugaagaagccaacuacuuaauuaaaaauaaauaaguaaauaaauaaauaaauugaacacguguaagugaucuugaagguggggugggucuguaauaguuacuguuucucugugcuuuuguguuucuuaauuuuucauacuaaaaguuuccuucugaguauaauacucagaagccccaauaauaaugacucauauauuuuuauuucucuugagcuaaauuuauuuccuucccuauaauauuaagcauaauucuuuaagcauauuacuuaccugauauuuaaaaguauaucuuucauuuaugcuuaauaucaggaauaaaacaauuuaacuuauggagaaaaaauaaguucaaacuuugugacuaccucaaaaauuuaccuguauaguuaaauaggguaauuaauacaguugccauuaugcaccaaacagaagaaaugugggcuucuguuuguuugcuuacuugcuuuaaacugccauuaguuuucagcaauaugguuuuguucuuauuugggggaugguaccaaggacuugugcauguuaggcagguggucugcuacugagcuauauuccaagaucuuaguccuuccauucuuuaauaauguauaaaagauacccagccuaucucccaguucuucagagagcuauugaacggugguauggagaacccgcauguacuacuccaaucuuaaaacucuuggcagaacugaugcaaaacagguaagcagccaugaccaguccacagagcuugcaucugccuuguguguauuguuguaacuuagcagcagcacagggcagagaucagugaagccgacugauaggagcuuugaaaggaaggaacaaagacuucagacuacuguaggcaugugaggcugagaagaaggaaaguggguagugcacuucauagucagaaacauugggaaauggaaagaguugaacagcuucagccacugucguuuaaaauauucagagucacaagauggaaagaaaaaggcaguuauuguuuuuacuauuuuucugcuuagcuacaauucuguaaaauuuuaaauaaggaagaaaugugggcacugacugcucuuccggagguccugaguucaauucccagcaaccacauaguggcucacaacuauuuguaaugggaucagaagcugucuucugcugugucugaggacagcuacaguguacccacauacaugaaguaaauaaaucuuuuuaaagcauggccugcagcucgguuuuacccuguggcugaguuguagcaguagcucaauuaguuacucuuaagugagagauggaaaaacauauauuuucuuuacuuuuuuuuugaaagcucuuuggauucuuguuuuuguuuuuuaaguuuucucacggguaccuuaaauauucagagaaaaugggcuuuguauuuaauauuagaagcaugguuuguuauugaauauugauauuuagauauagauagauaguaucaaaaaagcauuuaauacuaaggaaaaaauaguaugcuguguuauaaagcauuuugugucugccauagcagguaauuauacauggcacaaaugacuaaauaauugccauauaaaaauuuuuauuucaucaaaugcuauguauaaauuucucuagaacuagugugaauaucuauuuacauuuuucuaaucagauauaucguaccuaauaauaaauuaauuuugaaaagcagcacuugguuuuuuguuuuguuuguugcaaaauuguuuaaaggcauuccauuguaucuuaacagcauggcugcagggcaugccugagucagcugaggccagagaggaggcuaaaagccugcaugacaucagaauggcuugucugucccuuccucuguucaaauuguucuccaccuguagggagccaggagaacugauuuucucagaacuuacagagcuuguuucuccuuagcucaacugaguacagugaacagggaucuggaauuauggaguguguuugaaaugcauuccauuugugaggugacccuggacacacuugugcauuacuaaaaguccuguuacucuggaauuuguuuuaaagauaugacucacacgaugggacuugggaaguuuguaacuguuguuuuuaacuaauuauccaucagucacuucuccauggaaggagaaaagguagaaaaucugugauguaaaaugucaggauauuauuuuaauaaauuaaaaaaugaaccugcugggcggugguggcacacgucuuuaaucccagcacuugggaggcagaggcagacagauuucugaguucgaggccagccuggucuacagagugaguuccagaauagggagggcuacacagaaaaacccugucucgaaaagaaagaaagagagagagggagggagggagggagggagggagggagggagggagggagaaaggagagagagacagagagacagagagagagaaagaaagagaaagagaaagagagaaagaaagaaugaacccuuagaucaacaaauaguaaagaaauuauuguaaauauuuuaucaguagcuuuucaauuggagugggucuuuaaagaauaauuuuuucuuauaucuuuuuauuaguuaaaugcauuuuauacaucaaacauuaaugauauugaguauuuugagaaucaaauaauacauaaaaauuauucaacuuuuauauucauauccuuucauacccuaaaauuaucacuaaugaauauuuaauacuauccauaacugaggauccuauaucuaauguugaacacuaaauuguuucaaaacauacaaaauauucuuugggaguuaagcauaguaaaaaggcaugaaauguuaaaaaugaaucauuaagaaauauauucgaaagcccuucuaugauaccaccuaacauagugagagaguauuuaaaaggcauucuauaucuguguacauugucuaacaaucaguuuacuuaaaaaagaucaucaguguuucuaggagagaaacuauuuuaucaguaaguauauuuuaaaacuuucaaaauagcaaaaauuauaugaaguuaaacauuaagaagaugcuaauuucaagcacagugagaaaaauuaucaauaauauuuccaugaugguuauauaauacuuucauauuuucaacuguuaauauuaaaaaaccaaauaauuguuuuaagauauauuucauuguaaugucucccuuuucauuacugauuuuauuaauuuggauacugucucuuugcccucugguuagucuggcuaagguuuuaucuauccuguuuauuuucucaaagaaccagcuccugguuuuguugauucuuuguauaguuuuuuguuuuuguuuuuguuuuuauuugguugauuucagcccugaauuugauuauuuccugccaccugcuccucuuggguguauuugcuucuuuuuguucuacagguuuuagguauacugucaagcugcuaauguaagcucucuccaguuucuuuuuggaggcacucagagcuaugaguuuccucuuaccacugcuuucauuguaucccauaaguuuugguaugaugugucuucauuuuaauuaaauucuaaaaagucuuuaauuuuuuuucuuuauuucuuccuugaccaaguuaucauugaguagagcauuguucagcuuccaugugugugugugugugggugggugugugugugugugugugugugugugugugugcuuuccacuguuuuuguugguauuuaagaccagccuuaguccguggugaucugauagggugccuaggauuauuucagucuucuuguaucuguugaggccuguuuugugacuaauuauauggucaguuuuggagaagguacugugaggugaugaggagaagguauauucuuuugcuuuuggaugaaauguucuauaaauauguuagauccauuugguuuaaaacuucuguuaguuucacuguaucucuguuuaguuucuguuuccaugaucuguccauugaugagaaugggguguugacauauuauuguguggggugugaugugugcuuugaguguuaguaaaguuucuuuuaugaaucuggcugcccuuucauuuggagcauagauguucagaguugacaguucaucuugguagauuuuuugccuuuaaccaguaugaaguguccuuucuuaucuuuuuugauaacguuugguugaaaguugauuuuauucaauacuagaauggcuacuccaccuuguuuccugggaccauuugcuuggaaaauuguuuuccaaccuuuuacucugagguagugucugccuuugucauagagguguguuuccuguaugcagcaaaauguuagauccuguuuauguauccagucuguuagucuaugccuuuuggggggaauuaagucccuugauguuaagagauauuaaggaaaagugauuauuacuuccuguuauuuguguuguuagagguggaauuauguuuguguggcuaucuucuuuuggguuuguugaagaauuacuuucuugcuuuuucuagaguguaguuucccuacuuguguugguguuuccaucuauuauccuuuguaagacuagauuuauauaaagguacuguguaaauuugauuuugucauggaauauuuuguuuucucugucuauaguaauugagagauuuugcuggguauaguagacugggggcugcauuuguguucaucuucuggcuuucauugagagauuuugcuggguauaguagacugggggcugcauuuguguucaucuucuagcuuucauagucucuggugagaagucugguaugauucugaaaggucugccuuuauauguuacuugacuuuuuucccuuacuacuuuuaauauucuuucuuuguuuaccuacauuugguguuuugauuauuaugugucaggaggaauuucuuuucuggucgagucuauuuggaguucuguaggcuucuuguauguucaugggcaacucuuuagguuggggaaguuuucuucuguaauuuuguugaagauauuuacuggcccuuuaaauuugugaaucuuugcucucuucuauaccuauuauucuuagguuuagucuucucauuguguccucgaauuccuagauguuugggguuaggagcuuuuugcucuuuugcguuuucuuugacuguugugucaauguuuucuaugguaucuucugcaccugagaugcucucuucuaucucuuguauccugucggagaugcuuacaucuaugacuccugaucccuuuccuagguuuucuaacuccaggguugucucccuuugugauuucuuuauuguuucuaguuccauuuuuagaucuuggaugguuuuguucauuuccuuugccuguuugauuguguuuuccuguaauucuuuaagggauuuuuguguuuccucuuuaagggcuucuagcuauuuaccuguguccuccuguauuucuuuucuuucuuucuuuuuuuuauuagauauuuucuucauuuacauuucaaauguuauccccaaaguccccuauacccucucccacucugcuccccaacacacccacucccgcuuccuggcccuggcauuccccuguacuggggcauaugaucuuuaagggaguuauuuauguccuucuuaaaguccucugucaccaucacaagaagcgauuuuagaucugaaucuugcuuuuccagagugaugguguauccaggacuugcaguugugggggaacuggguucugaugaucccaaguaacuuugguuucuguugcuuauauucuuaugcuugucuccugcuaucugauuaucucuaaugcuaccuaccuucugacuggagccuguccuuccuguuauccugguuaugucagaacuccucagaauucagcugucucugggauccugugauucuggcauccuucgauccugagauccuggguguaucugagcuccugggagucaagcugccucugggacccugagauccuggucugaccaagcuccugggauccugggauccuggguguguuagugcgccuggggguggagcuucuucgggugucuugggacuagcuguggaguucgcacccaaggucugcuuagggcacuggcccagacagggaggaacccaugccacuggucaggcagaguuccugggugcccaagucuugcuggucccaguuacuucugguauugggacacauguuguguccuccucgccucugauccuaugauccucaagaauaauugguacugaaugaaauucuuauaaaugaaauugcuagacaugcugauacuugguuucuuuaucugcagaaauaagaguaaauuuugcuauauuucuuaggucucagcguuugaauuuugauguauccucuccuaauggaauucuucucuucagagaagccagcaaaaugauuugcaccuacgguaaauaccuuucccacacuggucucugcagcauaacuuagcaacuucuggaaggaaagacauuaaaguuuuguucauuugaaccuucauguuuauauggauugaugcaguggaugauagugcagaaagcaggacccuuuccugagcagcuucaggcaagagagggagggacauccuggccaaucugauauaauuuuggguggauaaaauugguaugucuguaguaaagaauacggaggaauagucuuaaguuacaguauauucagaauugucauauuuuaucaaggaguuucuggucuugggucuaugaaugcucagacagcuuuguugggaaauacccucacaaaaggcaggaaaaguuuuauugcaagguauguuuggguucuguaccccuagaagcaguguucccaagucaagauuguucuaauggcucauaguuaaaauuuuuauaauuuauuugacaguuuaugccuaggaauuaccauuaugccuaacacuugccaguuaagacaacuuuauuaauaacauuaucugaguuauaagcauuuguuucuuuuguuauuuaguaauuucauacauguauauguauuguaguuagucucuuucccagagccucuuuguuucccugauaaccccuuccuuaugguucucuuaccgauauuuguuuuuguucugcuucauguccuguagaaucugugugaugcuggguuuggaaccaagcuucagagcuugacaggcccacugguggggacaaacuggacacugccucucugcucccagauccagucaguuuucaauaggcugcaacaagaggcaggguuccauaagccccuuccacauccauccguggucaugaggauggagcagacacaaacccucuagucuaguuuagcaugaggugacugaggccaguuuugagcaagguuccuaugugguacauuuguuguaaguguugucuugcaucccaucuucuuuuccuuuggaguuuuguguguuugauuuuuguauuucaucaguagccgccucugaaguguacuucaucucagaaagcuauugauguucaucugcccugaguacgagagaugaauuuuacagagugcugucaggcuuccuuuuguaguucuguaugagugugugcauguggaagcaccuauagcuuuuaaaacaugaaagcguauuuuaaaguacauaaaauaggcauuuuaacuauucuuaauuguauuucacagcacagucugguauucugagcuaucucuuuuguaagcuuccauuaaaaaugcuucuuuuuaauuguacauuugaauuugagcuugcaguccuacgugagugaacaguaacgaaagaaacugucuauuagggcagcacacuacacucucauuuugccuuguaccaauggcuacauuuuaauguguauuuugcuuucauguguauaugugcaccaugugcauaccuacugucugaggaggucagaagagggcaucagaucuccuggagcugcaguuauaaccaguuaugagcugggacaaaaguccucuaagaagguaguaacacacuuaugcacuggaccauuacucuagccuuuuuccccucaaaggaacagcaauuaucacugugaagcaauauacauaggcauuacuugguaacuggcagggcuugcaugauggaaagguugggcucccucucccggaugcuuuggagcuuacuaacugcugcaauggguuccugaaaguagucaccucagcccuuccucuuuggugcagcuggcuuuucauuguagaaugcagcucuggcuagugacaccaagaggaggccuacauacacugucaauccuauaaucuuaaaagcucucuaguguccaacacaguagucaggcacaggagaaggcauugccguaaaacaugagaaacauaacagugugaagauugcauuggaggaggagaagagaggaaaggcaggaagccuugaaagcacgcaaguugacguaggucucacauagcccaggcuggcuucacugccuucacguguggagacuugagcuucuuccuucuccugccuccacucccaaguaaugagauuauauccgaguauugcugaacagacauucaggaauggacuuuguugcuuagaagaaaggcuagaagauuagagucaggaucugcuccucaacuuagaauaauaauuuagguaguuucugguuuuagcggccguugugugcuuccuccuguaugaagucauuugucauauauuccacuagcaauaccucagggcagguauugcuaguucaugaccuugguuaaguugcuucaguuucuucuuaaauggaaagaauaauacauaguuuaugaggugguuauaaagaauucacucauacuguccugaaaggccuuagaccaauuagccagaccagcuauuugugauuacuguaaccagaaauugacauugaaguuguuggcacgaagaagcuuaccagguauuagauagcuagcgguuggugggauuggaagucagugugacuguaggcgguaacuucuccauaucccuuuacugcuccuuaagaagaauuaggacguuuaugacaagcucuuguguuuuggugauuuuugucccaaagcuugagagaaaccaaaguacaagugggaaacuauccuucaacuguguuacuacuggcuuuaacacgugcauuucacaugaccucauagaagacucucccugucucuguggaucccauccuggcuuccaccagccuucuggggccuggcaugcuuuuuuuaccaugcuuuuccucuggagagucuugaaugcucguuggagggagauuguguuggaacccguuggagggcugccaucuaggaaucuggaagaugaaagaguuaacaguagagacugagcagagcuugaaauucuucuuuggguuauccaaggugaaggacaaggccucguaaaggaccagcauauccuacagucccucuguccccauccccacugagcuucccuuugcuccccucuccuagacagugcuuggagucaggggagggguggaccuagagaagcucacuucuuaaugcaucugauuuacugcguauuuugaagacuaucucuucuucacugcucugugagacuggcagaaaaauaauacuuuugauaugcuguuuuauuuaucuacauucugucaugauauacuuugauguaaguuuuuaauuuugcuucagcucucagcugcucuugccguuacagcucagggucagcacugagguuagccacaguagcacaaaacaauuuccuguuuguacagcccagguaacauuuggaugaggauuaaauuuuaccacauuuucuacuagcccuagccuauuauuucuaaugaguuuuaaauugcuucaagaacauguauuucaaaacuuagugcaaugauccuucagccugagcaacuuaauaaaagaaaguucuucucuaaauuuuugguuaaaauguugcaugcaguguaauaaauguuauuacucuggaaaccuacuucucaguuuuaagaaguggauguuuuuaugcucaauuuccauuuguuuaaucuuuucuucccauugccucugggcccugguaucuucaguggcguguauugguugaagagugcacagagggagaaaagcugcucguuuucacaaggcuggcugacguggggucgcuuguauuuuuuccuuuuguaauggacuuuagaaagcuuaggcuguaacaauuuaaauuuuaaaaauagcuggagcaaaauacgauuauuccauuuaccucuugggcugagagauggcucugcagagggccaggguuucauucccacacuuacauggccacucuaauuggccuguaaguucaaucccagguaauccagucaacuauucuggccuccagaggcaccagacacacggggugcagaaacguacaccagcagucaaaacacucauacgcaugcauagauagauggauagacagacagacagaaucucaaauuuuuauuaaagaauaaagaauuuacauuuuugaagcaacaugugcuucuuuaacacucauaaauugaguuuguacaguuuuuuguuuuguuuuuaaagauuuauuuauuuauuuuauguaugugauuacacuguagcuguacagaugguugugagccuucauguggucuggccggcccuucucacuccggucagcagcgcuugcccagucccugcuugcucugguccaaagauucauuuguuauuaugcaugaguacacuguagcugacuucagaugcaccagaaaagggcaucagaucucauuacagaugguugugagccaccaugugguugcugggauuugaacucgggaccuuuagaagagcagucagugcucuuacccacugagccaucuugccaucccacuuguaaaguuuuauacaaaccauugguacuccuuaugacacagcuaacaaacuaaugguuuauucacugaguuuuacagagccccaggagucugugaaagucccacagaaguucucuagggaaaaaaaaaagaagggggaagaggaggccuagcugacuacauaguugcaguauuuguuugugaaggguaucucccauuaagaaaaauuccuggaaugccacauuaggaguagaagcuuuggucauauauuuauaugaagaugauaacaggacaauagaugaagacugcagagguccugaaacacuuagaggucuuguaagaugccaacaggaaauaauaguuguaagaaacacacaguccagggccaugggcguggucugggcauuaugguugacaugcaguugguaaagguuccggaagucuuguggaggcaauaaaaugauuaucccucgaagaccccaacauucguaacagcuaauuuaucaagagaaaguccuuaaagucuacuccauggugucucagaaacuacagggguuagacuaaaccuccuuugcacaagaacacuaaugacuucuuucaucauguggcaaauguuugcugagcaugugcugugugaugcuggaacuuauaaggggugaaaagauaaacacagaaaaagcagauucuucccuaagacagcuugagaccagcaggauguuuagauggaugacuaaugaagaauccacugagcucaugcuaugacuaugcuucacggugcccaagaaaccugaaagagauuucucauucaaacuccaagggcagagcagacacauuucuuuugaagggauaagaaauggucccugugaguggcacaggcacgcacaguccccuuagcaccauugucuaccucuggccuugccccuauauccaaaggagccuugcaggacccaagagcaucuugccuccacauggaaaccuucaggggccccaaaacuagccagcuuggagcccugccccaccaccuauccuaguuggcuccaccugucaccccagcugcucugucugugacagucugcagagacagaaacuuagcauaacuguccucuaagaggcucuacccagaagcuaauggacagagaugcagagacucacacccaaacauuagauggagcuucuuacagaauaguugggaagaagacugaggaacccaaugaggacagagucagcuaaccuggauccuuggaagccuucagagacugaauucaccaaccaaagaggguucacaggcuggaccuauggccccugcacauauguaacagaugagcagcuugguauccaugcaggucccccauauaacugcaacaggggauguaccugagccuguugccugccugccuguagauccuguuccugauccccuaaauggacagcuuugucuggccucagugggaaaggaugugccuaguccuucagugauuucaagugggagugggagggaccaacaccccaaagggggcucccccuucucaaaagagaaggagggauggggguacgugaggggauacugggaggagaggaggggcugauuugaguuguaagaagaaagaaugaaaaagaaauuuugucucuguaacgccuuucauggguauuuuguucccuauucuaaggaggaaugaaauaugacccguuggucuucccacuucuugauuuucuuguguuuugcaaauuguaucuuggguauucuaaguuucuaggcuaauauccacuuaucagugagugcauaucuaaugacuuauuuugugauuggguuaccucacuaaggaugauauccuccagaugcauccauuugcccaagaauuucauaaauucauuguuuuuaauagcugagcaguacuccauuguguaaauguaccacauuuucuguauucauuccuuuguugagggacaucuggguucuuuccagcuucuggcuauuauaaauaaggcugcuaugaacauaguggagcauguguucuuuaccaguuguaacaucuucuggguauaugcccaggagagguauugcugguuaucuauaagauggaacacagggcccccaauggagaagcuagagaaagcauacaaggagcugaagggguuugcaacccuauagaaggaacaacaauaugaacuagucaguacucccagagcucgugucucuagcugcauauuuagcagaauauggccuagucagccaucagugggaagagaggcccguuggucuugcaaacuuuauaugccccaguacaggggaaugccagggccaagaagugggaguggguggguaggggagcagggcggggggaggggggagggaacuuucaggauagcauuugaaauauauauauaaagaaaauacccaauuaaaagaagaagaaaaaagaaagagagaaagaaaaaaaagaaggaaggaagaaaagagagaaaagaggaaugagagaaaaaaaggaauggaaggaagggaccccauggaacuagagagauggcucagggguuaagagcacaugcuguucuuccagaaaaccaaaauuggguucccaccacccacauggagaaguucacaacuaccuguaacccaaggucagggaguucagcacccucuucuggccuccacaggcauggggcacucaugucauauauacagacagacagacacauuuuuuuguucaagaauaugugagcagacucucugcuccucccuguuccagagacaacugcaucuucuugugcagugccagucucaugccuuagacaaaauggugaaggucggugugaacggauuuggccauauugggcaccugguuaccagggcugucgucugcucuccacuuggcaaaguggagauuguugccaucagugaccccuucauugaccuucauacauggucuacauguuccagugugacuccacccauggcaaauucaacagcugagagucaaggcugagaaugggaagcuugucaucaacgggaagcccaccaccaucuuccaggagagagauccuacuaacaucaaaugaaguggugcuggugcugaguauguccuggagucuacuggcaucuucaccaucaugaagaaggcugggguccacuugaaggguggagccaaaagggucaucauaucugacccuucugcugauguccccauguuugugauggguaugaaccaugagaaauaugacaacucacucaagauugucagcaaugcaugcugcaccaucagcugccuagccccccuggccaaggucaucccugacaacuuuggcaucguggaaaggcucaugaccacaguccaugccaucauugccacacagaagacuguugauggccccucuagaaagcugugguguguuggccauggggcugcccagaacaucaucccugcauccacuagugcugccaaggcugugggcaaggucaucccagagcugaauaggaagcucacuggcauggccuuccauguuccugcccccaguguauccguuguggaucugacauguugccuggagaaaccugcccaguaugaagacaucaaaaagguauugaagcaggcaucugagggcccacugaagggcauccuacaacuucaacagcaacucccacucuuccaccuuugauauuggggcuggcauugcucucaaugacaacuuugucaagcucauuuccugauaugacaaugaauauggcuacagcaacagggugauggaccucauggccuacauggccuacaaggaguaagaaacccuggaccauccaccuaagcaaggacacugagagcaagagagaggcccucaguugcugaggagucccuaucccaacucgguccccaacacugagcaucucccuuacaauuuccauccagacccccauaauaacaggaggggccuaagaagcccucccuacucucuugaauacauaccaucaauaaaguucgcugcaccccucacaaaaauaauacgugggcaacacaaauuggacuugaugaacaggagggaaaaggacacaauauuggaucuggagagaaucuaagaaagagauggcuaugauaaaaaggcauugugugaaacuuucaccaaacuaauaaaaaguuuaaagaaccccuuuuauuaaauaagagaaauagacugccaagcaaugguggugcacaccuuuaaucccagagcuugggaggcaaagacaggaaguucucugaaaguucgaggccagccuugccuacagagcaaguuccaggauagacuggacuauacagggaaacccugccucaaaaaacaaagggaagggggagugauacagaacaagaaaacuccaauuugcaaaauugcuagaguccuaaguaaaagucacaguucugagaagugguggagcacugguuagaucuugaagcuaaauagagucgaguaguugaaugaacaguguguggaaagaacauaaaucaaagaaauuuagcaaagcagcaagagagagggaguugcugcucacucggcuggagaaacauugaccaaguccaaguacagaugcuuuaugggcaugugacaugugacuauggagucuggaaggcaguuccaggcuagagaaggaucugugaguuguggauucuugagcaguuuaaaguuacaaaacucagguggaggcaauagacgggaauauaaacauagaaaccuuagauuuaaacccuaguauaggagguaaaaggggcggggggaugucagggaggaaucugcauagaagagugcuugcaaccagcacugaugugagagaaauaagacugguaggacugaaagaagagaaagccaaagcuuguuaguaagaaugggaggagaaauggagauaguuuuccaguguuacuucuuuuuugaggagucuuguugcaaaaggagcaaaucuugcaacagccagggagguuuuauguuguucccccuuuugaaauggaagaagucuuaagaguguuuuauucugaugauaaugaucuaauagcaaaagggaaaugauugcugcagagaaagaggaagcauuuguuacuucagccuuaugcacaaagagcuucagcugauggaauuggcugagggacucacuugcugaggcagccugccauguggguucggggccagaagaaggagacaaccaccaaacccagacacuguugcacuauugcauacuccagaaagauguugcugacaggacccugacauagcucucucuugugaggcuaugccagugccuggcaagugcagaaguggaugcucacagucaucuauuggauggaacacagggcccccccaauggaggagcuagagaaaguacccaaggagcuaaaggggucugcaacccuauagguagaacaacauuaugaacuaaccaguaccccaaagcucaugucucuagcugcauauguagcagaagauggccuagucggccaucauugggaagagaggccccuuggucuugcaaacuuuauaugccccaguacaggggaaugccagggccuagaagugggaguggguggguaggggagcagggcggggcaggggggauagggggcuuuggggauagcauuugaaauguaaaugaagaaaauaucuaauuaaaaaaaaggauaaggaugguagggaaguguagaauuugggacguguucauuccuacaagauuccuagcaaucuucuguaaacacucuacuaauuuuacaguccuaacaauuugcuuaauuuuucuauagauuuaucaaugcuguguucaucacuuguaauuugaaagggaaaaacuguauuccaguccagucuucacuguuuauuuuuacuacagaccacuucugucugggcacguuggauggucuauagaggcaagaguggauucugugaccugagcccuggaaguaagcagcugucuuucacaguugcucugcuccaucguuuugaugcagucucucauacacuguucagccaagccacuaagaaaggcuucagcuugugcucuacuaaauaucaacuuuguuacaaaguuuuagaaagaggaagaagaaaauaugaaucaaugugauagguauuuuucuaagucaggaugcaagguuauccauacugguauaagaugauagugugagauaucuuaccccuugcaucuuccuucccuccacugccacuauccccccaacggcauagagaacuaguaggaugugcacagacagcucacuugagcugauuguguaugaagggccagagagcaggcaaaugguagaauauuggcuuuaccaugaauuauguaauggaagggauuagagggaagugacauuuucuguauuguacauagcuagcuuuaccugcucguuuccagaccacaguucuuccauaggcuuagacuagagaacaggugaacaggugugaugucaugcugcauguuuauuggauacuuacuauugguaagccuucacauaugcugucuucuguacuccacguaagagccuuggguauuauuaucuucauuuuauugauaaggaaacagguacuuauagagauuaguaacauucccagauuacaaaagaguaaguugggugagcuagccauucagcucucuucuccugagcccuauauagcuuugacaucugccauauccaggcccaguguuagggagagaggcuuugccccuacugcuaauuauggcagauguagucaacaaaacaggguguugauuugguucugggcuuggaaagucucauuuccuuuggugcugcugcaguaauagaauagaagcaacucuuaccggcuugaguggcugccagccuaauggggccaauugcuucccacuacagugcugugggacagaucucgcucuuagauuggaacuguacagacuugagguacaacaagcaaaacaaaacauaucuaagagacucagaagagucuuucuaguaaugugaaucuaauuacuagacuuuaagccuuuugaaggcacagucucaauuuuggaacauauuacugaguaaucuaugcuggagagagauaggcuggacugaaaacaguaaugccugaaccaagccuuccuuuccauggucuuugguagcaaccaucgaaugcugggacacuugaguaacgcaagauaguuuccuaaucagacauauuagucaugauuuuuaaagaccauaauagugaacuaaggaaucaguucagacaugucugccacaguucgaaaggcaagugugccaacauugccacauuagcauagcagaaaagauuaggcuccugaaucucacugugggugauagaugaucuaguccguuacauucagaacugucgagucacagucuaagcugagggagaggagagcaggggaaggaaggcuucacaagacagcccccgcuggcugugaagggacacuugcucuuuaccucucccuugaggauagcaguauaaacuaagccuucacccuucuuuucuuugucucuggcccccaacaaacacaagaugugugagagccuuguugccuccagaauuuuacccuagcucuuucuuuugucuaucugcaguguguucuucuucagaaggaaggguggggauaggaccuugauuuauauuuauuugagacaaggcgguauagccuacuuuuuuagacccaaguuuuuguacuuuauccagaacacaucacaucuucugaagccaccugagaacuguaauuggccuuucaaacauaagcuguucccacaagucuuuccuauuguccucugucuagacagagcuugucucgucuauggucacagcagcaguguugcagagugagugaugauucucugcacaccaucgcaaugaacuccucagcgcagagguugauuguguucaguugcuuacccuagcacuucacaaauaguaccuguuaaacaaaugcggucauauugcauucuguauuuguggaucuauaguaucugucucuaaggugaguuagaagaaggucaagaaaggguacaagaugugcuacuaaguuccaagauagacuucugcuuuccagacaaaacuuuuuuucucagaauuagaggcaaaagccacauagacgucugagaccacaagagaaguggcagugcuuuaguaauagaucaaaggggacucucuggacuaguucuauuucaugcuccacuaggaaaaugguccuuuuuaaucucuaaguacacaugugguuaucaugauauaccacaauauaucaagugggagcagguaggguacuugccuagaaugcucaaagucccaguaugauccccaacaucucauaaacuggauguggagaugcaggccugugcucuucuagagucagaagaguuagaaauuaaagaaaaugaagaggaacaugugauguucuuaaaucgcagaaauuuuagguacuaugucuuguacgcccauguuugggaugaugaguaaguagguucaagggaagaguugaagguuggggcucaagggaccacuggcuagcccucuugaaguaaugacguguaugaacauguuggaccaucaaaggagucuaaacauugggcacaucaagaagcaggagcaggaucuaaaaugaugaggugugaggagaaacugaugugugguauagaaugcuguuguuggugugugguauggaaggcugucggugugugcuaagggaagcuguuggugguaugguauagauggugugguaaaugccugccucuugccaggcguuuaguugcaggcuugagaucauuagcagaauuggugguucugagcaagaaacaggaagaaaaagagcgguccaagccuagcagucauuuuucaccauggcucguuucagcauguucagaaagccuugcagaugcuucccuuccaccuccgccagcucccagauggccuuuggggccgcuucugccuccggccaggccagguggugggcgcucggaagcuuuucuucuucagucaagucggcacagacuaaacucuacuacaccucuagaguuuagaaagcuaacuuaauuucguauuaaaagcaacacucacuuuaauaguaaaaagagcuaagaaagaguaugccuauugcuuaagcuauacacuuucagaacacauuucagguacagaaacuauugauuauaagugcuaagugcuacuaaaauguuaaagugauuauauagccaguuccuugucuuguuauuggucagcauauguauuuauucgucgagguucucuaaaggaacggaacugcagcaugugauggcacacaccuggaaggcagagacagguggucugaguucaagaccagccuauuuguuaggcugaguucaacaacaaccaaguuccaggacagcuguugcuauauagagagguccccuuucaaaaacaaacagaagacugaacauagggcugcacacuuuacucccagcacacaagaggcagaggcaggcagauagaucucugugaguuugaggccauccuagucuauguagugaguuccaggacaggacuacauagagaaaucuuguaaaugaaugaaugaauaaauaaauaaguaaauaaauaaaaauuaaauaaaugaaaauuaaagauaagggaacagaauugauagaauaauguaaaugaaaaggggaguuuauuagaaugucuuacaggcugcaguccagauagcccaacaaugaguaucucucaauggguagauuaagauucugguauuugaugaccuagucggccaucacuggaaagagaggcccauuggucaggcaaacguuauaugccccaguacaggggaacgccagggccaaaaaaugggaguggguggguaggggaggggggggugcuuuugggauagcaguggaaauguaauugaagaaaauacguaauaaaaaaaaagaauuaaaaaaaaagauucugguauuuguucaguuaagucuacgagccuacauguuucagcacugccaguauggugcugagguccugaaggauuccuagagagaaaucagcguuagacuccuggagcauagguucuaaugucagcaaaagaauguuccaguuccacguuagaugaacuugccagcaagagugagggcaaacaggcaaaaagcaaaugcuuccuucuuccauaugugugcuugucacuagaagguaugccccagauuuagggugagucuuccaccucaaaugaucugaucuagaaaaccccucacuggcaugcccagugguuuggguuuuagauguggucaaguugacaacuaagguuagccaucacagccuaguauuucaguagaguuuuaaaauuaaucaucuuaagaucuucuaagaccuaaaggaaaaaaagaaauaacacagugauuauuuuguauagugccaguaauucugugucucaucuaauuccaaaucuauagggcuccuagaaauaaaguaaccucagauuaauuaaguucacauaggaaauuaaaccacccagaauuuagaaucauuuacaucucaggcuugcuuucuccucucccucucucccucccuugcucucuccccccaccuuccgcucucccucuccucccccucccccuccauccuucaugacuuagcugguuauuuuuaguaauuuuaaagauaauucuuugagaauuugcuucaauaucuuuuaauuuaauuuaauuuguaauucauuuuuuacacuccauauucacuuccccgcccuuccccauccaccauccgacugcuccacaucccacaccuccuccccacuccaccugaccucuaaacucccuggggccuccagucucuugaggguuaggugcaucaucucugaaugaacacagaccuggaaguccucuacuguauguguguuggaggccucauaucagcugguguaugcugucuguuuggugguccaguguuugagagauguugggguuccaaauuaauugagagugcugguccuccuacagggcuucucucuucaucagcuucuuucagccuucccuaauucaaugacagggaucagcugcuucuuuccauugggggggugcaaauaacuacaucugacucuuucagcugcuuguugggucugcuugagggcagucaugauaggucccuuuugugagcauuccauagccucaguaauagugccaggccuugggacuucaccuugagcuggaucccacugugggccugucacugaaccuucuuuuccucaggcuccucuccauuuccaucccuguaauucuuuaagacagaaacaauuaugggucaaaggugugacugugggauggcaaccccaucccucacuugauguccugucuuccugcuggaggugggcucucucccucucccucuguugggcauuucaucaagggucucucaccucccaggucucuggcgcauucuggggggagucucuccaaccuccuauuugccugagguugccuguuuacauucuuccugcuggcuuuuagggcuucagucuuuuucccucacccaauaccagauuagguuccccucuaucccccacccauccacauucccucccaagucccucccucccucccuccccacuuguuauugcuuuauuuucuuucccaagugggacugaggcauccucacuugggcauuucagcuuguugagccuuuggaauucuguagacuguaucuuguguauucuguauagguuuuuuucucuuccuuuggggggguggagcuaauauccacuuauuagugagugcauaccaugcauguccuuuuaggucugaguuaccucacucaggaugauauuuucuaguuccauccauuugccugcaaaagucaggauauccucauucucaauagcugaguaguauuccauuguguaaaugaaccacauuuucuguauccauucuuaugucgugggacaucuagguugcuuccagcuucucgcuaucacaaauaaggcugcuaugagcauaguggaacuggugccccuguggcaugguagggcaucuuuucgguauauucccaaguuugguauagcugagucuuuucagguagcucuauuuccaacuuucugaggaaccuccagauugauuuccagagugguuguaucaguuugcaaucccaccagcaauggaggaauguuccucuuucuccacauccucuccaacauguguugucaccugagguuuugaucugacugguguaaggugucaucucaggguuguuuuaauuugcauuucucugaucacuaaggacuuugaacauuucuuuagguguuucucagccauucgagauuccucuguugugaauucucggcuuaguucuauaccccauuuuuugauuggguuguuugguuuuuuuggugauuaacuucuugaguucuuuauauauuuugaagaccaagcaauaaaaccacacacuuacugucacuugaucuuugacaaagacgccaaaaauacacaauagaaaaaagaaagcaucuucaauaaauggugcugguugaacuggcugucuguauguagaaggaugaaaauagagccauauuugucaccuuguacaaaccucaaguccaagugcaucaaggaccucaacaugaaaccagauacacugaaucuaauagaagagaaagagggaaagaaccuugaacucauuggcauugagggaaaucuccuaaacagaacuccaguagcucaugcucuaagaucaagaauugauaaaugggcccuuaugaaacuggaaaguuucuguaaggcaaaggacaucguuaauaagacaaaucggcaaccuacugauugggaaaaaaaaaucuucaauaacccuacauccaauagagggcaauauauuuugcaacauauauauauauauauauauauguauauauauauauauauauauauacacacacacacacacacauauauauauauauauauauacacacacacacacauauauauauauauauauauauacacacacacauauauauauauauccugcaauauauuuugaguauauuuacccucagcuccuauuaccucccucccaucucuuccuacucaacuagaaaguucaucuuccccauugaauccaguuuguguugcccagguacucuugggagugguuccugcccugcccugccauguggucagccuaccaggggccuuaacacuaagggaaacuaauccucccucucccagaagcucucaaaugauuuugucuccucauaccacuuucuuucugcuuuuacccuacuacaggaaaucagauccugucucuuggaagucucuccaaagauaagauuuauccaaugaaacucaagggcaucuccaucugcuacucagcucucaagucugcauuguguggaaauuaugucagcuuuggcgucuucaaguuguauggggacaaccauuuugacaauguacuccaggccuuugucaaaaugcugcuuucagugucucacagugacuugcugguaagugcugcugugcacgaaggucuucaugugagacaugaaaugccagcaccacaggccuggaauuguugcagggaagcccggggaauccaaaucccacuacauugcagugcaacauccuuucucuggauuuaaccagcucuggacagcaauagugaugacucauaauucaacacacaggcugaauacgucagagcugucaccccugaccacuggucauccaaagugcuccagcuuccucaugaacaguagauuuaguagugucaguggacugcuuucagcuauguucaugguucacaaagggaaauacagaauugggugcugagucucugccugucauuccacucuagcucagugcugcuuggccuuccuuuguauuacaauguggguguggcagaugguguuaaacugaaaguugagcaaucucaucuauuaaauggucgucauuuaccuugaguuaaucgucucuguccuguaggccacacuuuuuaaaugagugagcuuuaaaaugugaucccucagccucuuuuuugcucugugguguauguuaaugaccuuaaacuuugaaaccuuucagaaacgucuggggugcaaaugugaaugucuagacuugucucaccagaucuucuuuaaaacacuucugccaguuuauacagaagccauuguauguucaauguguuuucaguacuuguuaaaauaaccaaauucagcauugagacuucccaccugcgcccacccagagguuucauggcuuagcuggcgagcucgugugagucauguuccuagaccuuagcugagaagccuccugcaacagagugaaaagcgcagagucaacacugugccucaaugacagagauugcaaaaaguagaaauuggaacccauaaguuaccacguucagcagccucauugacaggauuuuucacuacaguugugguccaccaugauaacccuuggaaguucucagauccaaggguacaugagacuggauuuaccauguaugaaaagaaaugcuuaguugaaggccacacuucagagcuuuuuauugagugagucuggagugaggaucaaaaaccacaucuuaguaagcaugcucacggagauguugucaucucacgagaugccauacugcucuggguuauacaugccaugaguguuaugccuugauaguguguaaauuacgugaguugucccagguauuuucucaucacuugucucaugucuuuagaauaugguaaauauaaaugguaguuaguuuaaaggguuggccuuguacaauauagcgggccgagaugccauauccaggagcuugacauuuccucugucuguuuguguagcaauaccggaagcugagccagucuuacuauccacugcuggaaugucucacccaggaccacaugagcuucaucaccaacuuggagccuccugugcuccuguacguucucacaucucucucagagggacucaccacacuugguaaggcucauagccaagacuguucucuauaggaaagacuucacuucauucucuuaauguauguguucauugagauucuuguccuguuagcggaaaagaaauguuaucggaccaacugaaagguuauuuuacaagauauuacuugccaaugaaaaaauacacuuuaauauuuuauuaauuuuaucaguuuugagauacaguuuaacuaccauaaaaaucuaaaauguucuaaucaaugcguacacaauaaugaaucacaacaccauauaaaguauuuguaucauuacagaaaauucaaguauguccucaucaaauuuauuccuuacccuugacccuacuccaaggaaacuacuuucuuucuuuuucuagaaucucauaugaguggacucuuaauauaggaaauaguuuguaucuuguuucuuugauuuaacauaaugccuuugagaaucaucuguguuguuuuuaagucaguucacuuaugccuuucuuuugaugaguaggauugcauuauauggauuaccacacuuccuuuauccacagaucagcuaauggcuguuaggguuguuuucacuugacaguucuuuguauuccccuugaacaaauaccuggaguaggauuucuggguuguaugcugucgguuuugcaaugcugagaugccauuuuccaauauaaccauacuguuuugcuacaacaguguagaaagcuuacagcugcuccucaucccugagugguuugagugauucuuuucaugcugagccaucauaguguauaugaaaugcaauuucuuugugguuguaauuuccauaauaccagugaauaauuugaagauaugucuaugcucauuuguuauucauauauuguuaguaaauuauugcuacaacaaaaugcuugagaauagauauguuaauguuuugguucauaauuucagaguuuucaguuuguggacucauguuccccucacuuuaggccuaaaugggaggaagcauuugacagaaccaaguuuccaaccucauagugaccaagaagcagagagauguaagauaacauaaaccauuuccuccucagguugcuucuggucauggaauuuuaucacgguauagaaaccuaagugggacaauacuaguaagagcauacacgggggguugugugugcuaauauacuaauauuaauggucauauugagagguuaaacugaccaugcauuucuuacucaggaugauaggauuuugauacagauuuuuacaucuuuauuugugucauauauugguguauucuuuuauacuaauauagucuccuauaauucuuauauacuuuucuauuuucuuuuucuggguuuguuguuguuguugcugcuguuuuggauuuuugguugguugguugguugguuuguuuuucaagacaggauuucucuauguagccuuggcuguccuagaaacugcuucugcaucucaagugcugggauuuaaggugugagccaacaccaccuaacuuguucuguuuuuauagcccugacauguguuaguguuagucuugugccuucauaauacaaacucagagauguguccuccuuugcugucucagagguuuguguagaaucguacaggggcuguuuacuguuuacuagcguucuccaguucaaccaucagacuuagaauucucuuugggaaauuuccaacuacaaacaaaauuucuucaguggcucuucugauuauuugucauaucaccagaauauuugacuguucaugucuuuaagaguuuguccauuuuaccuaaaguuucucuuacauuauugucauaagauuguucauaguagccaccugcuacccagugugucugaaucaucugucuauaauaaucuacuuguuugucugucuguaaugucuggcagcugucagagugucugugaugucuacagugauauccugauacugcucauugaguccuguuuucucuccuccuuaucauucuagauggaguuaccaguuuuacugcaaagcuuucauguuggugacuuuuccacuuucucauuuuuacuuuacuaaguacaaucucuuccuucuauaguuuaguuugcuuucucuuaucuagucugguuuuuugauaaauguauugcucauugacuuuagaccuuuuauaauguauucauauacuaaaucagcauuauuaugagcauaucucacagaguaaacauucugacuuuacuacuauucaauuaaauauuuuaauaauauuuuauuuauucuuugaggauuucauuacauacacuaauuucuauauccacccccuacucgaccccucaaauuuccucagaccccagccaacauguccuuuuucuuacucauuuuaguaacccacuacgguaguuugaauagguauggcucucauagacucauguguuugaauguuugacccauaggggguggcacuauuagauguagccuguugaaggaagggugucacuguggggcggggcgggcuuugaggucuccuaugcucaagcuauacccaaugugaaacacacuguccugcuaccugcagaucaagauguaaauaucuccgcaaccaacaccgugucucccugcaugcugccaugaugauaauggucugaaccuuggaaacuguaagccagccccaauuaaauguuguccuucauaagaguugccuuggucaugaugaugaugucucuucacagcugugaaacccuaacuaagacacccucuaggcccaggcagugcugcuugccuauaugcucauggaggguacaucuacuagagcuugaaaacauaccagucuaaccccccccccaaaaaaacaauaauugucuuccccaggaacugucagcugcucguagcucauuggcuugcguggauuucuugaggcuuacuccaggcuuugcuugaguuuugacuggcuuauugugcagguagccauagcugcugugaguucaugaguccaguggccucauccuauccagcagacagccuuuuccagcacuccuucauauccuuaauuccccugcccacucuucugagauguucccuggguuuuagggauuggggacuuaauacagauguccuguuuaagaucgagcacccuuagucacucauccucagcacuuugauccguuuugaaccucugcauuaaucacuuccccuggcaaaaggaagcuucuuuaaccaaaguuaggaguucaaaucuauggguauaaaccuaaguacccugaaggcugucugacaggacaaccagaaaaaucucuucauugcccuacucaucuucauuugauuauuaggugguuccuguggaggauagugcuuagauuucgguuauuugaagaugcuuuuuguucuauuauugaguguaauuuuauuucauuaugucauagaauauacucaaugauuggucagucggucucucucucucaguugguuugguuuuuguuuuuucaagacagguuuccucuguguagcccuaccuguccuggggcucuguagaccacacuggccuggaacucagaucugcuuaccucuaccugagauuaaaggacaguggauuaaugacuuucugauaaucuauauucuuacugguugguuguauaauuucuuuuaucuacuuaucuaugaauuggcaagagaaaaauacuaaagucuaacuaauuauagcugugucuuagcucucugucucuguuugguucugucagguuuugaauuaaauauuccaaagcuccugucagguacauagauauuugaaauuaugguauucuuuugaugaauuuaccuuuaaauuaucacaaaaugacccucccaaucuuugguaauacucuuuuuucugaaaguucugucugauacuaccauguuuccuuauuacacguaucuguuugggggugaggugcaugugcuguacguaguguuccugucagaggacagcgugcagggcuugguucuugcacugcacuaugagggccugagggaucaagcuugacagcaaggaucuucacucacagagccaucucaccacccagcauccuuuucugaguuauaaaaagugccuuuacauauccuauugauuauuuauagagcacaugcauaccuuauuucuaagauaucagaaacuugauacuuuaaagcauaagucuuauacauucuaugucugguaugaguucaaguuagaaugucaacaaggccuauugucuccagcuuugaaauauuuaauacagaggcagaaagcauuguaaucucucagaauucuacaaagaaaacuccuugagugacucucucuuccaguucuaaggacacuugaguuuacacugggucucacuuggauaacaguaccuaacuccccacugugaaaccuaauauguucacaguuucugggaaugaggacauggacauucugcagcauauaucugugauuagacguguuuauuagagcugacuuuucugcuuuuaauacaguaucggguguuuaacuacccauguauuggggucugaaucugcagaguccauauaugcuuucccaccugaucuuuguucuuacuucccuuucucuuucaucucuuuguuuagaguaaagccuucacuuguuuuaauuuauuggguuuaagucaguagaauguuguuggugguuuuuugguugugguuuuuuuugggggggguuguucuguuguuugauugguucuuucucagacaacugugcuucucuguauaguccuuucuggcugucuuagacaggguuuuuaauccugcacaaacaugacuaagcaagcaaguuggggaggaaaggguuuauucagcuuacacuuccacaucucuguucaucaccaaagagagucaggacagcagcucacacagggcaggaaccuggagacaggagcugauacagagaccauggagggaugcugcuuacuggcuugcuucuccuggcuuguucagcuugcuuucuuauugagcgaacccaggacuaccaucccagggauggcaccacccacaauuggcccuccuacccuaaaucacuaauugagaaaaugccuuaccuggaucucauggaggcauuuccuaaaaggaggcuccuuucucugauaacuccaacuugugucaaguugacacacaaagccagccaguacaacugacccuugucaacaugacucacaaacacaucacuauuaagucuuaacccuugaauccugaaucaaccagaauuauagaaaggacgggcuccaaucagauauauugagggcagcaagcacuugagauaaucugauggcaggaggcaagcauaagaagagaagcaguagaaaccaagguuacuuggcaucaucagaaccaaacucucccaccauagcaaguccuggauacaccaucacaccagaaaagcaagauauggaucuaaagucacuucucaugaugaugauggaggacuuuaaaaaggaaauaaauaacucccuuaaagaaauacaggaaaacacagguaaacagcuagaagcccuuaaagaggaaacacaaaaaugccuuaaagaguuacaagaaaacacuaccaaacaggugaaagaauugaacaaaacuaucuaggaucuaaaaauggaaauagaaacaauaaagaaaucacaaagggagacaacucuggagauagaaauccuaggaaagaaaucaggaaccauagaugugagcaucagcaacagaauacaagagauggaagagagaaucucaggugcagaagauuccauagaaaacauggacacaacagucaaagaaaaugcaaaauguaaaaagauccuaacucaaaacauucaggaaauccaggacacaaugagaagaacaaaccuagggguaauagguguagaugagaaugaagauuuucaacuuaagggccaguaaauaucuucaacaaaauuauagaagaaaucuuccccaaccuaaagaaagagaugcccaugaacauacaagaagccuacagaacuccaaauagacuggacuagaaaagaaauuccucccaacacauaauaaucaaaacaacaaaugcacuaaauaaggauugaauaguaaaagcaguaagggaaaaaggucaaguaacauauaagggcagaccuaucagaauuacaccagacuucucaccagagacuaugaaagccagaagauccuggacagauguuauacagacacuaagagaucacaaaugccagcccaggcaacuauacccagcaaaacucucaauaccauagauggagaaaccaaaguauuccaugacaaaaccaaauucacacaauuucuuuccaugaauccagcccuucaaaggauaauaaagggaaaacuccaacacaaggagggaaaugacacccuagaaaaagcaagaaaguaauccuucaacaaaccuaaaagaagauagccgcaaaaaaacagaaucccaacucuaacaacaaaaauaauaggaaguaacaauuacuuuuccuuaauaucucuuaauaucaauggacucaauuccccaauaaaaagacauagacuggcuacauaaacaggacccaaaauuuuacugcauacaggaaacccaucucagggacaaaacagacacuaccucagaguaaaagccuggaaaacaauuuuccaaacaaacgguccuaaggaacaagcuggaguagccauucuaauaucgaauaaaaucgacuuccaacccaaaguuaugaaaaaggcaaggaggggcacuuuauacucaucaaagguaaaaaucuuccaagaugaacucucaauucugaauaucuaugcuccaaaugcaagggcauccacauucauuaaagaaacuuuaguaaagcucaaagcacacauuguacuauacacaauaauagugggagacuuuaacaccccacucucaucaauggacagauccuggaaacagaaacuaaacaaaaauacagugaaacuaacagaaguuaucaaacaaauggauuuaacagauaucuacagaacauuuuacccuaaaacaaaaggauaucccuucuucucagcaccucaugguaccuucuccaaaacugaccacauaaucgguuacaaaacaggccucaacagauacaaaaauauugaaauuaucccaugcauccuaucagaucaccacagacuaaggcugaucuucaauaacaacauaaauaauagaaagccaauguugacaugaaaacugaacaacacucuacucaaugacaacuuggucaaggaagaaauaaagaaauuaauacuuuuuagaguuuagugaaaaugaagccacaacauacccaaacuuaugggacacaaagaaagcaguccuaagaggaaaacucauagcucugagugcugccgaaaagaaacuagagagagcacacaauagcagcuugauagcacaccuaaaagcucuagaacaaaaggaaggaaauucacccaagaggaauagaaggcaggaaauaaucaaacucaggggugaaaucaaccaaguggaagcaaaaagaacuauacaaagaaucaaccaaaccaggagcuguuuuuuuuugagaaaaucaacaagauagccuuagcuagacuaacuagcgggcauagggacaguauccuaauuaacaaaaucagaaaugaaaaggaagacauaacaacagaaccugaggaaauccaaagcaucaucagauccuacuacaaaaggcuauacucaacaaaacuggaaaaccuggauuaaaugcacaauuuucuaaccagauaccagguaccaaaguuaaaucuagaucagauuaaugaucuaaacagccgcauauccccuaaagaaauagaagcagucauuaauagucucccaaccaaaaaaaaaaaaaaaaccaggaccagauggguuuagugcagaguucuaucagaccuucaaagaagaccuaauuccaauucuccucaaacuauuccacaaaauauaaacagaagguacucuaccaaauucauucuaugaagccacaauuacucuaauaccuaaaccacacaaacacccaacaaagaaagagaacuucagaccaauuucccuuaugaauaucgauauaaaaauacucaauaaaauucucacaaacugaauccaagaacacaucaaaaagaucauccaucgugaucaaguaggcuucaucccagggaugcagggauggcuuaauauucggaaauccaucaacguaauccacuauaaaaacaaacucaaagacaaaaaccacaugaucaucuccuuagaugcugagaaagcauuugacaaaauccaacacccauucaugauaaaagucuuggaaagaucaggauuucaaggcccauaccuaaacauaauaaaagcaauuuacagcaaaccaguagucaacaucaaacuaaauggagaaaaacuugaagcaaucccacuaaauucagggacuagacaauagacaaggcugccacuuucucccuaccuauucaauauaguacuugaaguucuacccagaguaauuagacaacaaaaggagaucaaggggauacaaauuggaaaggaagaagucaaaauaucacuauuugcagauguuaugauaguauauauaagugacccuaaaaauuccaccagagaacuccuaaaccugauaaacagcuucacugcaguagcuggauauaaaauuaacucaaacaaaucaguggccuuucucuacacaaaggauaaacagggugagaaagaaauuagggaaacaacacccuucacaauagucacaaauaauauaaaauaccuuggugugacucuaaauaaggaaaugaaagaucuguaugguaagaacuucaauucucuaaagaaagaaaucgaagaagaucucagaaaauggaaagaucucccaugcucauggauuggcaggguuaauauaguaaaaauggcuauccugccaaaagcaaucuaccaauucaaugcaauccccaucaaaauucgaacucaauucuucacugaguuagaaagggcaauuugcaaauucaucuggaauaacaaaaaaccuaggauagcagaaacuauucucaacaauaaaagaaccucugauggccaugccugcccucaaacuguacuacagagcaauugugauuuaaaaacaaaaaaacaaaacugcaugguacugguacaacaacagacaaguagaucaauggcguagaauugaagacccagaaaugaacccacacaccuauggucacuugaucuuugacaaggaagcuaaaaccauccagugggaaaaaagauaacauuuucaacaaauggugcugguacaacuggcgguuaucauguagaagaaugcgaauugauccauucuuacuuccuuauacaaaucucaaguccaaauggaucaaggaacuccgcauaaaauuagagacacugaaacuuauagaggagaaaguggggaaaagccucgaagauaugggcacagggaaauaauuccugaacaggacagcaauggccugugcuguaagauugagaaucgacaaaugggaccucauaaaauugcagagcuucuucuguaaggcaaaggacacuguuaauaagaccaaaaggcaaacaacagauugggaaaggaucuuuaccaauccuaaaucugauaggagacuaauauccaauguauacaaagaacucaagaagcuggacuccagaaaaccagauaacccuguuagaaaaugggguacagagcuaagcaaagaauucucaacugaggaauaccaaaugacgagaagcaccuaaaaaauuguucaacauccuuaaucaucagggaaaugcaaucagaacaacccugagauuccaccucacaccagucagaauggcuaagaucaaaauucaggugacagcagaugcuggcgaggauguggagaaagaggaacacucaaccauugcugaugggauugcaagcugguacaaccacucuagacaucagucuggccguuccucagaaaauuggacauagcaggaagauccagcaauaccucuccugggcguauaccaagaagauguuccaacuuguaauaaggacacauguucauagcagccuuauuuauaauagccaguagcuagaaaaaaauccagaugucccucaacauaagaauggauacagaaaaugugguacauuuacccaauggaguacuacucagcuauuaaaaacaaugacuuuauaaauucuuaggcaaauggauguaucuggaggauagcauccugagguaacccaaucacgaaagaacacacaugauaugcacucacugauaaguggauauuagcccagaaacucagauuacccaagauacaauuuguaaaacacaugaaacucaagaagaaggaagaucaaaguguggauacuuuguuccuucuuaaaauggggaacaaaauacccauggaaggaguuacagagacaaaguuaggagcagagccuaacagaaugaccauccagagacugccccacuuggggauccacccuauaaacaaccaccaaacccagacacuaggcagaugccaacaauagccugcucacaggagccugauauaccugucuccugcaaggcucugccagugccuggcaaauucagaagucgaugcucacagucaucuauuggauggagcacaaggucucuaaugaaggagccagagaaauacacagggagcugaaggagacugaagccccagagaaggaacaucaauaugaacuaucaaguacccccagagcuccuuggaacuauaccaccaaucaaagaaaacagaugguggaacuuguggcucuagcuauauauguagcagaggauggccuagucggucaucaaugggaggagaggcccuuguuccuuugacggcucuaugcccaguauaggugaaugccaggaccaggaaugggaguggguggguugggaagcagagggaugggggaggugauaggggauuuucggaggggaaacuaggaaaggggauaacauuugaaauguaaauaaagaaaauaucuaauaaaaagaauuucaaucucuuuugaaauucaaagucuuuuuacaauucaaagucucuuaagugugggcuccacuaaaauacuuuauuacuucaaaagggaaaaauauuagggcacagucauaaucaaagaggaaaucaaacucuaaccuaaccguccauugugugggauccacucacaaucuucuggguucuuccaaggacuugggucacuucuccagcucugcccuuuguagcacacaccuugucuucuaggcuccaguugccuguacuccacugcugcugcugguuuuggugaucaucccaugguauuggcaucgcuaaaacacugcugucuucuacugcaacuggacugcacuuuuacaaauagccucucauaggcucuuuucauggugguaagccucagguucucucugcaugaccccuucaguccuagccuucaacugccacugaggcugcaccuucacuaauggccucuccaaacaucagcugcuaacccuucauguuucaaauccaguaccaccugggugacucuuauacauuaccaagucuggcugccaacacaagauacaacuaugccucuggaacagagcuucuuuaugcucucaggaaacacuucccagauuucaccuuagugauucuggucucuucuuaaucacugcuaauuucuuagcuccagcuaaccaacaucaauugcccaguaaugcaaaauuuucccuuuaguaguucugguaucuuguuaaucacagcugauucuucagccccagcuaaccaaaaccauagaaucuucacaaucaaaacaacaauggcccugauaagucuuuaaucuucccucugaaauuucacaagccagaccuccgucuucugcacuguucucaacauuaucuuccaagcuccuacaccacaucccacagagcucuaaacauuccaauggcucuucuagcucaaaguuccaaagaccuuccacgguccuccccaaaacccggucagguugucacaggaacaccccacucccaguaccaguuugucuuaaucaggguuuguauuccugaacaaaacauaaugacaaaggagcaaguuggggaggaaagaauaauuuauuuggcuuacacuuccacaucuauguuuaucagcaaaagaaagucaggaaagcaacucacacagggcaggaaacccggaggcaggagcugaugcagaggccauggagggaugcugcuuacuggauugcuuccccuggcuugcucagcuuucuuauaaaaccuaagacuaccacccagggauggcaccacccacgaugggcccucccacccuugaucacuaauugagaacgugucuuacagcugggucucauggaggcauuuccucaagggagccccuuuuucugauaacacaaagccagccaguacacuggccuugaacguauagucuuccugcccuugcaucugaguagcugggauugacuugcucaucucuaauuaaauauuuuaaaugacuccagcuucuaucuucauggguuuaugagcugccuuuauuuuuuauuggugcuauguauauucaaaaugagcaucuucaaauaaucuuaucaaaguuugcuuuuuuuguuuguuuguuugucacuguagcucuggcuguccuugaacucuuuuuuuuuuuuuuuuuuuuuuuuuaaagauuuauuuauuuauuuauuuauuauauguaaguacacuguagcugucuucagacaccccagaagaggguaucagauuucguuacggaugguugugagccaccaugugguugcugggauuugaacucgggaccuucggaagagcagucggcgcucuuaaccacugagccaucucgccagcccuguccuugaacucuuauguagaccaggcuagccucaaacucgcauagaucugccuguuucugccucccuagcacuggaauuuaagccaugcaccauuacacccuucccauuauaugcuauuggacaaccacagucuguaucuccauguuaucccuaaacuccaguuacacgagcucuaagacucuugggggccugcagcucaauugugccuuuuggagggcaguucuuucaguaguuucuaugauuguaugucaaguucauagauguuuuucuacaauuuuuaaucugcuaucaauguuguauuuuuuuugccuggccccaugaacucuuaguucugugacucagccuccucaauagcugguccuagaagcucugagccuuuggcuuuuuuuuuguaucugguacuuucucaccaagcucaugguuuccuuuaaauuugauacuguuuauaaguuuuauaagaaagucauuuuaggucuuugucuacuggaauaauuucuuacauauuuuccuacguauuuacuuuucuuuuucuggauuauauauucuuauguaugucuugauuuuuuuuauuggauaucauauauugugaguuuuauuguauguaguauuugauuaggauuuuggauucuguucuuuuaguugaguuacuuugugauuaauuucauucauuagagcuggggugacagcauuuauuuuagaguuguugagccacauacuaagagguagcccuuagagaacacugcccugccaguguguuacaugcuucccaggagcuguucuggcccuuuggauuaauuaggagucuuuuagccuucaucuuuugcagcuuuggggaguuucuucucuugugugcaaggaaagcaauagagacucccuuacagcucucuguaacuggaucccucugagauucccauacucugguacuuugcacacauuuauagcugccucagucucccacauuucagucuugccuuuauuuggacugcccuuccuguccugcaguccagacugcuuugggcgugugcuacagcaauuguaaggauuaccucauucauuccccucuccucaggauuaauaguccuauacuucuuguugugcaguaauugaaaacuguuguuucauauauuuuguccuguuucugguuguucauggcaggaggggaaauccucauagcaguuaauccuuuucgggaagaggcagaagucuugucuuucauuauuacagguuagcuugacauccugcuaucuuacauuauaguaauacuaaggauuuugaauccguugcaacagcucuguuauucucaaaguaugauagucaucagaccugggaucugcauuucagcaagauguugacaaauuagcauaugaagggugcugagcacagucccauugcugcuguggacacagggacaguggacacuuacugugugacugaugugucagagugguucuuguguuugcucauuucaccagaagagggcaugggaucccauuacagaugguugugagccaccacgugguugcugagacuugaacucaggaccucuggaagagcauccaguguucuuucauucuuaagaacaaauguauaccagaagugggcaggauaauuaaucuaggagcacuguguguccacauucccuucuggaucauagccaucugaggaacaggaguacuguuuuguuuuuuauucuuuauuauucuuugagauugcuucucagccuuuuggcuaagaucaaguguauuacucuuugagaaucucauucaguauauuuugaccauauuuuaaugccuccuuaacucuuuucagguccuccuagcccucccugcccaccuuaauuccuguucuuucucuucuauuacaaaauaaaacaaaauagacacaaaacaaauuuuuuaagaaagacugauuuauauuggccaacuccucaugagcauggggccugcccugcguguaguugauauacuuaggauuaauccauugaagggcacugauuuucucucuuccagcaacuugguuagcuucuugguuaucuaugggacuuugugccuguuccccuucuccacacugggauuuuuaucuuucuuaaccuucugucggucuuguacaguaucuaugaguucauauacauaucuguuguguugugucuagaaagcacuuucccagaaaucaucuaccacccugacucugcauagaucucugagugcacaaucucuggggauugugugauaaagacaucucacuuagaacugagcacuccaaagucucucccucucuguacguuguccagucguggguccuuguguuauuuacuguguacaagauaauacacuucucugaucaaaguugagugagacacugaucuguggguauagaaauaugucauuaggugucauuuuagugcugugucuauuucucaaacuaauauuauuuucucauuaggcccauggucaucucagguucguccucauuaacaaugguggauuucaucccauugagugugccuuaaguccaguuuuuaaaugugauuggauacucucauaauauccacaccacccucacaccagugggccuaucuuauaagcgguauuguuguugcucacaggguuuguagcuggauaacauugaggauuauuuuuuuccuuugauaacaugcacaaaaucuuccaacacugaccacuagccaguagggauaaagcuuucaguuaaaccccagcuagauuucuuaguucuaugccauauguaugugguaucuuuagcaauagucuuaccaucaagcuguagcaucgaaccaauagcauuaggaauacucaagaauauuuucgggaaaggugucugcuggacccuuuuggccaauaaaagagcaggcauucucaaccauuucuuuauucccaggcacgguacagaaagcacuugcuaaguacuuacuaaaagaguuagguaauauuuucaguauauaggugaguauaguauggcucaaaaaauugucucuaagagucuuucccauuuuucuuuguagaaguuaagcuugguucuuccuuccagccccaugcuccaagaaauaagacucagacucaaaauguauuuauaaauaucuuggucauauagcuaggcucuucucuaacuagaugauaacuuaaaauaucucauuuauuuuaacccacauucugccccauggcugguuaccuuuguucaggugucauguguccaucuugucacagcuuccuggagaaaucuuccaugccuggcucuaucccagaauucuuucugucuaccagaugacccaccucuauucuagccuuuccuauaggucauggguuuuuuaauugacaaguaauacauucauacaauacacaagauauucucucuacaccucuuuaucauaccuuccugcuagaucuaccugauagaaguugcagcuuugacugcugggagccugguagaaaagguucucguuguauguaugguuuugccuucagccucuuauguugucacuuagguaaaugacaggugaauuggacccugugccuucaggaucuauuuguauguugaaaguagccacuuggauuuuuuucucucucuugccaugauacacaagcaaaaaaagagaauuacugguuguguuuggaccuacauagguuucaguucuauagcuuugguguaaaguaaugggauagaaucagaaacuugaaucaggaauguacucguugcuugccuaauauucagaacauaguauuuuuaacuguaguuaccuaguauucauuaauguuuauaguuucaagcuacauuuuguuugucuguuuguuuguuguuuguuuguuuguuuguuuguuuuggaacaaaaucuuacuguguagcaauggcuagccuagaacucauuauguagacuugccuggccuuuaacucacaaagaucccacuccccugucucugcuccugaauacugggauuaaaggcaugcacugucaaguuggcuuucagcuaccuuuuugagcaccucucuuccacuaccuucauucuuuuacaaguacagagcaagccuaggaccugcaaaagguugcucucaaugagucccaauucauugguucaauaguuaucauuuuauucaaaugcuauguacuaaguaguauucuaggccuuggcagugcuaaguggacuaagacaggaaagcuuguauuuucguggugagugauaaacuaaguaaagaaacgcucacacaagaugaugccaagucauaacuguuaaauaauucuagugaggcgguagcuagaggaaguguacaguuccugaagccauggugagggaagguccugggaucagcugugggcagggcuacaguccacauggaaggaaagagcagcacaaagcuaaccauggaugagcugcacugacuggcaaggcagcuuaguggcauggguacuuggcuagaaaaagugagggcaagcaagacuuucagucagccacacaccaccuguaaaauggaucgguaaaauguaugucaaugucaggauagcuaucaugccauuucuaacauucuugaauuggucuucaguguuacuauaauauuaaaagugaagcacugaagagguacauuagaguuuagugggauuguacaucaguuuuucccuucacaaauaguugaugcuaaagagggaagacagcuaugaaucaguuuaguagauaggcuuuguguuuaaggaauugaaagcuaggaaaaugcuuagaaaaugaaagagggugagccugccguugggggagcacugucucagucugugugagcuggauccugguacauugcacagcagugcaagcuugggcuguguguacugcacaccauagaugugaagucagacagcucaaacagccaccuggauucaugcucgccuccuuccaaagcuacuguucuccuccaguaguccuuuuguuuuggaaauugccuuucgaacuacauuuuuccaagaccuucaucccugugcuaugaugaauuuugagcugaagccagauuuuuaacucugccccauaacaucuucuugacucucuguugugcagcucuuguacacaguuaagcuuccagagcaccuuuccauuggugggccuuaguaagcagaagggccauuaaugaugcguuugauuccuguggagaccacuuguaagagagucagggcgcuuggcucucagugcuaaacagugaauugcuagagagaucagagcaccuaauaggcaucacagcauuuccaagcauguccaccuuauacaugggauccuuugcaggguagucugaagagccagaaguggcaucaaaucuaaacauccguggggucugcccacucucugagaagucacugcuugacucugacuccugcaagggaguuuccucugcagauaaagaugggacaacgcuaaugucucgucuucagcacuguuuugaccaaaugccugugauccuuaugauuccauacauuuaaaacgaccuagaaauaacauuuauccuuuucaaagccccaaccauaaaucaaccauaauggaaccccuugcuuuuauugcaaagccgugugcuccaaccuuugagucuaaaguguuuaccuggcuuuucugcagcugacucaguggauuggacccuuuuaaugcaacuugcauggcaguguggucaccaaaugaugugaagucuuuaaauuuuauauaugauugauagcauauugcucuuuacuuucaugaccagggcuucaaauguagaaaaaugaaggagaaaaaaaaaaaaggaaaaaaaacucaagaaguggguguuugauuccugggcugccucccaaaguuagcagagcaugggguuucuuccugcagaguacccuagggcuugggcuguggggaagagugaauacauacaucaucccugagcuuugagaagcuggggguugcuccuuucuuaaaagaugucuuacccuagugaacugcuguccagaccacgaccuucuuuuagccucucauuccucaggaucccguaugggcaaccaucauccugucuguaucucagaagcccucagaccuccucuucuauuucuagaacacagcuccauaauuaugugaccauuuucaagcugggaugccuuuccuugcuaaguauuacuaaacacgggcccuaccuucccuggaguacuacucucucaggcuaguuuagcuucccauuuuccaagucccucucagaccucagcucuaucggacauucauaucuuaaacauaagaugaauaagacacuauuucucagcuucccuuuaccaucuugcuuuuuguuugucucuguuuaguuugacuuaaauuuugguuuuuugaaucaagaucucauauagccuaggucagaucuuccugcguccaccucccaaguaucggaauuacaggcuugugcugccaagcauggccucucagucugauucucuugugaggcuacacuaucugccauuuuuguuucucuuuaguaaucaaaaaauugccagggauugucucagcaugucuucaauaaccaaaaaaaugugaguaguaucucacuagccauacuaagcuucuaaaucacugaagugggaucaacuagagaaucucuggacuuuuagcuccuccucccauacgccugguuccucccccugcccucacuugaguaugcuagacgagugcuauaccgcagagcuucaucuauagccuuuccuuauuuaaaaauguaaaugauaccuaauucucaguaguuguuagaaguugaugugguaagggcuggggguguagcucacuuguagagugcuuaccuaggaugcauggaguccugggcuaagucccuagaacugcagaggaucagcaugguggcuuggaccuguucaucucaggaccagcacugagaaggcagauggaggaagaacagcaguugaaagucauccuugacuccauagcaaguuagaagacaaccugggaugugugagacccugucuccaaagaaaaaaaaugaagagucaguaauucuaguauauaaaggaaauuauaaaugguuacauaaugauuucuugcuuagaaaacuuugaauaacaucucugucaauucaaauuaaauguaucuccauccauuuuugaaugcucucauguaggaacccaacccacuuuguuaaccuucuauucucauucccuacccaucucaucugcaaaccaaagucucacucaccuucaaacuguacccgagugacagcccaguaggaagugcaaucuguguuccucuuauggggcugguagcuaguuuguuuuaguuuuguggguaccaaggaccaaguucccagggccuuaugugugcuguaccacagccagcaccaccuccauuguuauaaaaaaaugaugcuuguguguauuuuuauguaauacuugguuuuaauauaguuauugaagauacagauucaugguccaacuucuuuuuuauuguccaacccugaucuuacuguguuuuaaggauaugucuuuggacaagucacuuaaaucucuaagccucaccuauaaagugaggauagcuauuccaugcugugguagaagauuaaaaacaagcauccguguaaaccguucaacgcugucgcuaacauguagaaagcccucucagcauguaucagcuauuuguuguuacgggagaacuucuuucucauucaacucugcaaagugcuuuacagaaaguaaaaaucucacucaaaaguaacaaugcagucaguaaaccgaagcuguccaguucccaccaugcugauagcucuuguccucucccugaaaggcuucuucuuccuaucucauugaaauaaccuuuccaagccaucucaagccauguccuuuacccaacucacuuugaccaccauugaagcauguucuuucccuccaaaugcagcaguuaggacugggagaggaggccauuucaggaaguacuugucgugcgugcacauacaaggacccgggucagaucccaacucccccuguaaaaugccaggcacggcaggcagcacaguccaggcccagcugugggacgguggagaugggaagaucccugggacuugcuaaucacauuaguaagcuucgggcucagugagaagucccugccccaaaauuaaguuagcaagugauugaauaagaugcccgcauuaaccucuggcuuccugauguguguccagcagcaccagugugugugagcaugugacucuuucauagauuauuuuauacuauagugaccucuguggaaagccauggcagaguuuaagugugcaccuauuuccucugaaguacuuuacacuaacuagaugcuugauaaccagucaaauugaaugggguguucaaguccccaauggggacuucuguccaguucagaccaggaaucauuuucuugcuaguguuucucuaugcaagacccuguaauagacacaaggcuuaaaaugagaaagaagccaaagcccuucucucaaggauuuagaguuucagaguguuuugaaauccuaacucuuuuuaauggagacaauguauugaauaagcaaacaguugaguaacaggagugaauuguuuuuuauuguuuguacagacacaguggucuccuccagcugcuguacaaguuuagacuacauggucaccuaucucuucaagcacauagcaaaagaagggaagaagccacuucgaagcagagaggcuaugcaggcuggucagagacuguuacauuuuaugcaacaaaacccagauguucugcagcagguaaccucacuuaaaguguuucccagaagccaacccugccucuggucuuauaugagcauuuaucaagguauuuagcaauuauucuuguugaaaguuuuccugaacaguggagagugcacaggcugacuucaagguuacccacccauuaaaaucccagugcugcugaggucacugcagaauucccagagggugguuccuuugaggccaagaagaguggcgcagaagaccucagucuccucccugggcccugggcagcaccugcugaagagagcuugaaggaccuggcugcuggaacagcccugcugcuccugcuccuugcagacagccugcuaggagguguccaguccugagaguguaaggagcaguuguucugcagacauuagggagugcaguguucccacacauuugucauaugucauagugcugcaguucccuuguguucagcugugguuucuaacuggcuaacacuggccaaguccaaguuuaugauuguuuuaaauaggucacuuccaccaaucugagaaacuacauacagaagaaaugaaaugccaagaauauuccaaaaagaauaaagccauuuugcagauauaccaucacuacgauugauguuucuacuucuacagaauuuaggaaaugucugguacacuguuuucagcuuucuuuugucacagguauauccauaauagucugauuugcagaaguaaauacuucaacugauucuauugucauuagugagcaacgucaucuuagucugcacacuaaaucacugcacacggacaugaugaaacaagaguaggaagccccagaagaggcuuccuuccgacuguaauggcuuugcuaguacuuaaaugaaauuaggaaagucuuaucuguggugacguuucaacugacuaacugcuuuccaaggacagaugacaagaguguaauucauucauacuuugagaaacuagacaagcgcuaauuacugcaggcccauuauuauuugcugugucccugaaacuauucaacuacuugauaauguuugaaaaaaugaguagacuagaauucauugaagaucuggucagugcaauuucuagcuucuccauggguaacuguuacucaugauggcaugcucuaagucagugaagcucagccuucucucuggagagcgagcacaugagggcucuaguguacuccagccuguaccaguggugacuggcucugcaugggacuagagguguggggcucuucaggaucugagugauaugcuucauuuaauguguacaagaugcaaaaacaaguaagauuuauaaagaugaaauuaaucaaccaguucuauuaacauagaaaugauagaaacucacacagaaggggaggacuaugaaagaagucuuuuuuuuuugaagauuuauuccuuuauuauauguaaguacaucguagcugucuucagacacacuagaagagggcaucaaaucucauuauggaugguugugagccaccaugugguugugaggauuugaacucaggaccucccaaagaacagucagugcuuuuaaucacugagccaucucuccagcccaacagaagucuuauuuaacuccagaauugccuagaaaugugacugucaugguccccaguuuuacagaucaauacacugggugucugaggauucaccagaaaguaaaggaauuggaauuugaacccagguccguuuaguuccaaagcucacauccucauagcucacaccacugagucagggcaugucagaguuauccagauggcugccugcgcaaaacacacaucccugucauggugaggaugcacuucucccacacugcuaccugcaaggcacuacugugcagguacagacaggagucuaccggcuuagugagagaauagacggguacaaauacccaaggguacgcuagaaucaggcccagccuaccaugacaaaggacaaguccacaaccgagugagucacuccugugcgaagucagccauccaguguugucccuuuagcuauggccaggcacuucaaaguugguugaaaauuuuagcaaaaaucaauagguugcaaacaaguaagauggcugugcaggagaucagccagugcgcccuuacucagaaucgccaugcauuuguugguuuaaguaauuucuguguguuaauaagacuugguaaccuuucacuuuacagcacaugacuaaguagugauauaucuuuauuaagcaguggaauacauucuauuuauuugggauguaagcuuucagauaacacuuuaaauauuaaugacuggucucugguagucagcauaaauaugauuugcauuagcacuagguuauaucaucuugagugccucugaugucaacuauuggguauacuaauaucugacaucaucuccguaggucacugacaacuuugaccucuauucuuaugcacaguuucugucaucucaaaagcucuuuugaauugauuugaaauuuugacucuucccuuuaugaggcaguaaaauugauaauuauucagaugggaacugagcacugagugaaaaaucaauuccacccgcucucugcugcguauaaaauuacuucugagucugcuggacugaacggauggccagaguaaaagcagcaggcaggaguagugggaagaauuagcuggacagagcuaauagccuggagggcuggaccuggaaaggagggagugggccaguuggggguuauuaugagcagggaugggcccauugaucaucuguuuacaucagcuuuccaagaccuuauaaaucagcccugaagaguggcagacccaagauucaggcucucaccagugggacuuguauuagauuauucucauuuucacacucagaugaaaagugagccauugauuauucauuggcugcccauuaaaugcuguuuuuauagaugauuugccuaucacagaagguaaugaacaagguugcugcuucauaacugaggucucaguuuucaaggcaucugugucauuaaguaaugccuaacccuauuaaaaggaauggguuacaaauugcuuaacagugcugaaaaacuagacccuaaugacuaauugugccuggaguuuagagaggguuugucagcucuuuaaacuaaacggaugcagugauacugcaauuauuuacugguuugaacuguuuuccccacacccuggacauauuuggcuagaagcauaacugcauggagaguguccguuccaacugcagaagugaucuucucaagcuuccauagagaacccgcaccuggugggacuagccauuugugugccggaaccggacggagagagacaucuuacaugccucucaccuggaaguguguugguuauggccugucaugugacuagagaucuuccaugguuugugaacagacuuuucaaggauuaaaguuuauuacaugugaagagucauugaauuuaaguuagccuguuugaguaagaauugucagcuuacuaguauugcuucaacuuaacaccugaguaaaacccagacugcauaaauuaggggagaagaauuacccaaguauauuuaaacuaaaagcuuaagaagagaccagcaguagcaguggucagacugcuaaucacuacugauuagcaguaggugagagugaacugcauaggaacuuagagauaacauuuguauaugauuuuuuucuauuuaacuacuauucaugcuaaaugcuuacauucaaaaccaauagaucagcauucauuuggguauaugaaaagacaaauggcugagcucaaauuaggugaguguaaaauugagggacacgaugaauucuuuuagaacuuuaggggcacuugaugcagaauccucucugcauagacuguccuuaaaagcacuggcaccuugugcuugcgaagacaguaccuguggcuucacugucccugggugggugcuggguagcguguugauaaguuacacugcgauucuagucuccugucuaaaugcagugcauagcagaguuggagcaguuaggcuugggugucucuuucccagccuugacuaacaaugcagaguucuaaauagaaugcagagagguucuaaauaugguuuucuuucucuucuuccuuucuuuuuauuucaucuauuuuuguauucauuuguuuguuuguuuguuuguuuguuugcuagcauaccauuuaacuagaaggugugaagcgcugucaagagcuauaagaaucauacuucaguaggguuguaagcgaaaagaacauucauccuuuuccucagucagucagucaaucaaugaaaauugcuuuuguauagugcucuucaugacaugcaucccaaagugaauuacagcgaaaggaagaucaucugcucuuuuuuuuucaucuccguauuuagacugaaaugauaucgcucaacauuuugacauacuauucaagacaucuuucauacuuaagaauccauuccuuaauacugaguaggagaaagugccgacacauguuuaacugguguggaggcuuuggccuguggacuuguuuagcaagugucuaaggacagauaacauugagacaaauaaaauacacucauguuucuuauuuaacucuuuaaaaaguaauuagcuauauuuucuaauacuaaugaaaguauuucucaugauccuuaaacuucagaaaggugcccuccacuuaacgagcuaguuuuggcuggaguuuuaacuucuuuccugaaaacguggaaguagacugaaacaggaacauccauaacuuggcagagucaagaauaguuacuuagauuuuuguggcaguugcacucauagauguuaccuuaguccuuuucauagaaauuuaugcauauacuauguauucuuuuuaggaaaagaacaauacuagcaaaauguaagacccgugcaaagcccaugugaggacacugccuucaguuccuuguguauaguuucugacaucaucaucaaguaccucugugagaguuuuagcaucagcguuucacagauguaggaacugaaguagaaaagucaaguauauuucccaugguuacauucugcaacugaaggacuacaccauucagccuuccuuugugucuucauucugcacucuuuguagauauuaguuaucccucacaauggcuuucauuaugacauuuuuguacaggucuauaaugcauguuuaucaugugcccacaaucacacucucuuuuuccucuuucauacccacguuccccuuucugaagaacuaagauguuaccagaggucucucuaaccccaggguugauggacuuacccacaaauaucugcucccucagcugguggccccucgucuaucauacuguguuuugaacacuguaagucgaauugggucaucacaagguagaaugauuuagaguggucauccuuuuagaaaacaaagcauuaggugugcaucuagguguuuguguguuugcacaugaaugcagugccuguagaggcccgaagagugcacuggguucccugggccuaacaugggugcugggaacagaacuuggguucucugcaagagcagcaagggcucugaaccaucaaaccaucucucuguaacccaacuauguacugcaguugggacaaaguagacggacaauagcccaaagagguagguagugugcaaggacaagggaguuuuucaaccagcugguggggaaaaaacaaggcucaguggccccagucucaucucugagacagagcugagcuuccucucccuuauuauuguauacccaaugccuucaccaauucuguagguaggugaggaggguguaaaacuuagcacauguuuccugaagaaaugagucagguagugugacugccuaggggugaguggugaucuuuaugacuuuaccuauaauaucuucgagguuauuuuugaaguuucuuuucuuuccuuaaucuuuucuauuuuuuaaagauuuauuuuuuauuauuauacauaaggaagagagcaucagaucucauuacagaugguugugaaccaccaugugguugcugggauuugaacucaggacccuuggaagggcagucauuacaucuccaaaaaacuagcuagccauugccuucccagacacauuggaauuuguccuaaaacaaugcagagauuugugucucuuaguauugaccacugacuacuaauuaaaaacaaaacaaugaagagagaaaaaaacaucagaacagucagugggcccugugugugagugugggucucaguuucuuaucuguacagucugggacuauaagaacagggagaccugagccuuccaguguggagugcacaguguggacugugccucgcagcucagucccggagcacugccuuagauggcguuguaaucugauuuuuuuuucauaauuuuugagcacuuuugauuuauucuuuuuuaauauaguuauuuuugguuuuccuuauccuauuuugcuuuuuuauuaccagguuuguuugagacaaaaaucaacaguguucucuaucugugagaggaaagaaagggagagagaggaagggaggggagagagagagaucuaacuacuaagaauaaaguuaaaaugcauaagaaggccaggacuaagccaaaacaucuagguaacaacaaggcaauaaaagucuaagaaagagggaagcuggagaaauggcuaagaguuuaagagcacuggcugcacuuaaguccuagcaccuacauggcagcucacaacagucuguaacuccagguccgaaggaucuccuggccucuguggacauugcacuuacaugguacacagaaauauauacaggcaaaacaccuguauaauaaaauaauuguuuaaauccaagagggaauaaaccuuuaacgaaugaaggacucuggcuagagagaaggcucagucaauaaagagcgugucucgccucaugcuugcaaccacagcacuggacaaagccagggccccgggguuuaauuccuagccagccuagccuauuuggcugguuucaagccaaugagagacccuaucucaaaaaggcaggcuguuuaacaccucgauaauuaacaaccaagguugaccucugacuuuugcacacacaugcagacauacacacacacacacacacaaagaaaacauuucgaguauugccaccaaagacaaguugguaaaguccauguuuuaauuuucaaaaauagaaaugucgggaccuaugagacgguucagggguaaggguacuuaccacuauggcugaucccagggauucacgugcuggaagaacagacuucuacauguuguccucucgucuucacgcaugugcgauggugugugagugugcacagaucaauggaugauauagaauuaucuguuccuuuagaacaagucauguuuucuuuuagaaaaauagcuauugucuuaaucuuuuucuuaaguaugucugcuacuuugauuuugguuguuaggcauacuuguugaguaacuauuuaagcuguaauauagaugucaucauauuaauguaacuauaacagucacuuuuauggccucucaaagaucucguacaucuugacacuugcccaggccuccgcacagucucauucuuuacaguggcccgugggcaucuauaaaagaaauacccaaaauauuaauuuuccaaaucacagucuaugggcaucauuuuuaacuguaagucuauaauuguuguacacuaccaaauaauaauuugaauaagccaaauggcaaugccaagauucuaccucaauauaaaauagcccuucugaaacugcagggaaaacgucaggucuacaugugggucagggaaggaagaagcacugccaauauuguucaaguuaacagaggagagagggcucccaccccaugaggauguguguucucaccucuaagcacaguggaaggaugcaauccauugauagcguaacuugccuuauuaauugaaaggaauggaauccaccagauguagcccaagccaguagagaguugggugacuaagcaacagcaaagagaccauauugagcgagccagaauccagucuccaagucauuuauuucagccagugacaguacauuuaaacuccugugccuccgcagugauugaugguuuaauaucauauauaauuuuuuuaaugaaggaaaaccauuuaaauauguuaccauuugcacugguauucuccuauguacauaacugcauuuaaucauuauggggauuguuuuuauacuuguguaauuuguauccacgaaauaacugucaaaaucaucucaugcuguugcuggaaaugguacagugugcuucauacgcgaauagauccauucuccccgcacauaauuaagaguguuggagcuugcaccgccaccacguaggaauuccguguuuacauuucagagaaugaaaaauaagccauggugguuuugcagguucuuguuuucugaggaaauaauauuuaagugccuuaguuuuguaccaguauaugauuugaagagucugauuuuaagacuuuuaauauuaaaauacauaauaaaauuuuauuaucuaauuacaagaggguuuagccucuuauuaaaguugcuaaaucaggccuauauuagcauuauaauggcacaguuugacauggaauacucaaaagucaaguucaaacgggaggggucucuuaccccuaccccucacaccaaauaacaaggaugaaaugcauguauggaagcaaacaaggagcaauuugggaugcuagagaaggaguggaggugucagcccaggaugguacccuuaggcaaggcagcuggucuauguagccuuuuguuuaucugcuacugguuuauguagccuuuaggccggcaccagaaacaaucgcuccuacagggucagcugcuggucagaagcaaaguaagaaaagauuuugcuuccaaacacagcagccauaauuucuguacagcuggcaccugcuacuggugcacagcaugaaggugaaaggucaaagaggcaguuguucaaaacucaagaauggcuuaaagggacuuguagauuaaucugcuuuauuaacuucuguauauuagauaacuauugcugugaaugacaguacaucuuuuugaauaagucacaucucuuucucuuuuaaauuagcuuuugaguaaugaauauuaaauagaaagcauuucagaaguaauuaaaugaaaauagaaugaugucauuuuacaguuuuguuuguguguuuauagaauaggagaauuaugcuuuccaagaauccuuaaaaggagaaaaggggaaggaaagggauaggaaggaaggaaaacaggcagcucuucauaaagaagaaauuggaauaaacaagccagccauuagccuuugucuuuaaacugagaaaagauaaugucucuugugccuuagcauggaaucgcugggugccaguggcuggcuuugacauucccaggggcuccgaaugcuuucuuuaugaauuaaagugacugcaaucugucaucauucuuuuaucuacaguuuagcacagucaguucugcgaccagucugcagcaaauguucucagaauagugaagggguugugcgaaguggaagcagacgcuccuuuuccuccacacucauauaaggcagagagugaguauuuugugaagggaaaaugcacagcuuuauacacacuuagaccgaugauaauuaggcaugcucuguaauagccucuucccccauucuggcaaguaagaugguuuuuagccucuucauugauagugaugaguguaauugacuaucuauguaaauuaaaaaauagaaagaacucagugacuguauccuuuuuuaaaaccucugcaaaaaaucagucacuauagagauuuuccauagguuaagugcugacacaaagucuggcaagguuuuaaacaaacucuucaaacaggauggcuuugucuguugacugacagugauuuuucauccucguuguuuguuuuuaagguuucucguaaaauaaaagcacuguagaggacauguggguuucaugguaagagcagcauucauacauauuucacaaagaaaacuacauaaagucuuuaugcaaguguaagcucccgcucugagcaguacuucucugaaauacagagguuacaccuaacaucaucuuacuacucccccacacacacauacacacacaccccguccaucacccacaguagagccaugcagcuucugcuugaagaucugacugacccuguuaccacccugcagagcccuguguucugggcuugcugggaccuaaaccgucacuguggaaggagugucucugaccauuagaaaaaugugcuaaggaauaagcacaguguaaaugugguagaaacaaugccagucugugcugagugugaggcagacacacacaagugcuggguauguaugggauucaaaugugugcuugcacaugauucuacuuaacccucuuaacucugaaguacucguauaaccauuuaauagucuaaagaagucagccuggucuacagagugaguuccaggacagccagggcuauacagagaaacccugucucgaaaaaaaacaaaaaacaaaaaaaaagaagaaaucagugcagacuuagacgcagcggagcuuguacucuucgggcugagcugaggaguccuucccccuuugagggugcaugguucaagacaggguuucucuguguagcccuggcuguccuggagcucacucuguaggccaggcuggccucgaacucagagauccaccugcuuccacuucuugagggcuaggacuaaagauguguaccauaagcuguugacacuugacccaaccugaguugauuuguugauuuguuugcauugcuaggaucaaacccggaggagccucauacaugcuaggcagccucccugcugcugagcggcauccccugcugcuaggcagccucccugcugcugagcggcagccccugcucuuccuucagaguuagaagcuggcacuuggaugauggucaaccuucaagucucacauaagcugagcauuaaauacucagaaggcaaagcacccaauccuugucguaagcuuagagaggcagcuggucuacaaggagaggaggaggcaggugcccuaagagguucucaaaggaaagaccagacagcuguggugggaggacaaagaugaagaagaaucccaggggacuccuugucuugucuagagagcccuggcuuuuuugccuagucaggaaacaacacauuguagaccuaagauccucacauguuaaaguuucuugacuuaaacagagagcucugaggacccacuaagcaaaugaauauagacucacuuaacacaagauagucaacagagaaugugacuucacguuugaggcauggcuaccacuaaccuagguuugcccuugagaaaucacgugcuauuuagaaacauagucuuccaaugcgcgucucagccuaagacuucucuuauaagagcauguaauuugaagucuguaacaucagguggauugaucaaggccugcaggcauguugucugugugcuuugcccuuugagaguuuuuucugugauacgcauucucaaagucacauucacuggacugaggagaaggaaauaagauggaugaaaauagaugccaugggcuggagagauggcucagcggguaagagcacugacuguucucccaaagguccugaguucaauucccagcaaccacaugguggcucacaugaugcccucuucugguguucugaagacagcuacaguguacuuauaauaauaaauaaaaucuuugagcuacaguguacucacauacauaaaauaaauacuaaaaagaaaagaaaagaaauaccauaacucuacucacuaagauaguaccaucauaccugaaaucuacuguaacucucauaacagcaguaaugagcguggauucuuuaaacauaaaaauguccaugcaucaaccagguggcgguggugcacaccuuuaaugccaacacuugggaggcagauacugguggaucucugaguucauggccagccuguucuacagagugaguuccaggacaggcaggacuauuaaacagagaaaccuucucucaaaauaacaaaaaagaaaaaagaaaaguugggggaggauugguacaucaagaguagacuagugggggcuggagagauggcucagugguuuagagaacugaccacucuucuuagagguccugaguucaauucccagcaaccacaugguggcucacaaccaucuguaaugggaucagugccuucuugugugucugaagacagccacaguguacucacauauauaaaauaaaucuaaaaaagcaaaacgacaacaaaaaagggugaacuaguggaggaaaugugcagagacucagaguugaaauaacuuguucaaaguugcacagccagugguagugcugccggacaccguagucugauauaugugucccacacggguucuugugauuagaaacuacauucccagaguggcaauauugaaagaaagggagagauuaccaaaaaagccugguccucccacccuguuuucuggcuugagaugugcuucccuccucugugugugccuacuaagugguaccauuaaacaucagguucucaccagaggcaaaccaguagaauccaguauaggacugaaaaccugcaaaacuguaagcuaaauaagccccuucaaaguagaucucagacuaauggucuaaauaagagcuaggauugcuggccccuagaucucacccaguuugaccagucacgagcuucuuggguuauguagugauugcugguuuucagauacuugcaggguuuucugugacuccugaagcacaucccuaugguaaggaugugaagcuaacuuuccuacacauuugccuguuaacucugaggcaguucaaccagcagcaagccuuguuugucugcaggcuggucaccugucauugcuuaagcaugccccauguacucgugcaaacaaccaucagaacccaggggcccaugaguuccguaugccuugucaugcuugugggaucuaccauacgggcgugggcuccugaaauuccaucuucauuuaaagccuuuucuuugaaaaugcucuacuuaguaaagacuuacaugcuguguguccuguaggaucacaccauccuacagaggaggaccucuagcauagcugaauuugcuucugggaucaguuagcuaagccacucauggccuagacaccccaagacucaagucuuagagucucucauuccauuguucccucgccguccuccaucacauugggaccagagauaaguaaacaccuccguauauacuuccuggugguccugugagccaggaauguaaaauaauacaccaccaugaaagauagcaauagaaagugccagacuugaagaaagguggcuugggcgaccauaaggaacaccaaaagcaagagcucucuguuaaugcccauacuuaauguggccucucaguucagauggaacacaguggcuccacucagcagcaauuagagauaagugcauucaggaugauuuuuccaagauuagaaggaacagcuugaugguuggacaauaagagauuaauaaauacaugagcuccuuaaggccuguuauggugacucugaaauggccuccacagggucaugugcuuacugcuuauucccagauggcagcauuauuuuagggguucuaagacauuuagcagguaagaccuagcugcaggaaauaggucacaagcaguccuuggauaugucuuaaugccuggcccaucccugucucucuguuuccugaccaccgugagauagaaacccccugaaccaugugguguucugcccagggccucaagccaagaugccaucaacugagcccccuggccaugagccgaaauaagucauuguuccuuuguuuguguuagagcaguuuggucacagugauagaaagcuaacuaauguaagacccaguuuuauucagaucuauaccagaaguagucaacccauaauaagaggccagugauucuuugaacagugacuaagugugagaaacaaaaaggaaggggaaagaaggaaaauccugcagaacaauaccuguauacagcaggcguuccauguguauacagcaggugcucugugcgugcuauagagcuugugguuaaauaguggugacaugugcaggugauagcuuuguagagacgaaggagccaucauccccacagaggcccagccuguuuuagaaacuguggaaguuccauuccaggugcauaaugugcucuuaccccacagaggaagaaagccuucccuccccacucuacacugcucuccugggcuccccugcauuagagagaggcaggagacaaauugacagaaaucuggagggaaguaacucaagugauuuaggagaauggaagggcuggcuuauggggccagauuaaagaagcuaaauauguauagcuugccuaagugacaacuaaauggggcauuugauaagucuauaaauacuuggaagauguaaaugccaggaggaaagggaauuacuuagcauggcacaauggaguauuggcauaaugggauaauauuaagaaaggcaagaugaagguugaacaucaauaaaaagcuuccugacaagaagaaccauuccugacaagggacacuauuagguuaugugcugugggccaagggaaauaaugucagugcccuuccucagugugcuggcagcagagccagcaagguagcaggugaugagcguguccuaacuggggcacagcagccaagcaagugaccuucugccuguggccuccccaucugagaauaggaggaaacugcugcugcuugggagaaaugagauagcccagaugucccacaggcugagaacccauagaggaaugguugucagugguucauacuguaccacagccagagagauuaccguugucuuguaaugacauucauuuccuacagaauagaaagcuacuuucucuugcaaacaucacuagaccuuugacaagaugcaaccccugccuacgugagcagccuccccuacacucccugcacaguccugcaggcagccccuauugcccaacacugcugugcacauuuguacucacaccccucucucccgacaggucaaacugcuccuucucuauagcagaucaaaugcccccucucuaagccucccuugccugccccacccaggcccuggcacaguuggggauccucuggccucucaaagccuccagugugggcuuguuugcagcauuuaguguacugcacugugaaucuucuccucacuuggcuguaagcucuuuuagaacugacacugccuugcucaccucuguccccaggaccugggucagagccuggucaagguauguaucagcaaaugugaaguaaaccaaggaagcaggcucagcacucuugguuucucucaugcauugggcccaugcauuugcugggggagaaagaacuugcaucucuuaacaucuuugagcauucuccccaugucuuggccaguccauuccauauuaucagacaacuguaaauaaaucccuccuagcucauguccuacuuaggcagccauguugcacaugaauguagcuuccuuaacauuucuaggagaugcaggaugacagcaguagacacgcuaacaugaaaagugaaaucuuacagggacccaacaguaaacaaagaccuacaagcaaguaagggaugccgagagcagaugagauagugucccucggggaacauacccacccccgcugguuaccaccaaguauucagcucugaagucauuuacacagagguagcaguauaguccugagcagguuguuuucauauauguagguagcggaguguaugugucugugugaauuugagacuuagcaaaggggaggcagcauggagcaagaagggggaugagugaagggaaaggcaggggaguuacauaauuguauuuugaugugaaaauaacaauaaugaggggacucauuucugaaaaagcagagugcccccacugugaaugcuaggcuauguacauacuguacaugcaugcacaguggaaaugcuaggcuuaacucuuaaugaaaaaugcuuuugagguggcccaugaguuguccacaaaaacacauuuuucccauaggaaaacauuuuuaaauuaaguaacauaauccuucacuaguaacuggaaaucuuuggggccaucuaaccaaaucucuucaggaaacaggaagacugucccgucggaugagcaaugagauggugagccuccuucuaugggaaugacagaugugugaugaacuagcacucgcugccuugauaacuaccaggacggcccucgugccauucuguuuauauuguuguguugugacauaugauacucacugggcaguguuguggugacaucaggaaguagccuguuuuucucacuccuuuugaccuugaguggccugcgccagcacugaagucauuguggcccugcgugccugugcgguuggcugagcuucaaugcugcugguuccauuggugaucuguauggaugauccaaggcagggaguggcugucauuacugagugcuguuccucaggccacaugcacagaagauagagaaaugugauccugcucaaauuagauauuagccccgaacaccugcacaagaagcggcauuucagcugucuggcugcugcucucuauuauagagucuugaaucugggcaucuguucuugauguucugaaucuaucugugguuucagguuccaguuuucuuucucagaacaugaguugaggauccugaccauucuggcugcugaugcagucuuguucaucuuuacugucuugucagugagcucucacaggacaagcuaggagccuggccucugcaguuucuccacagcaagguuagguccugcucuguauggcagaccccagcugauaacuacucuccaugugcuggcccaaaugcccaucugcauuuagcaugcauaaaagaucuuacguagccuggcccuggugaggaucugcuccucacccuagcucugccuugugccaccccuuccauacaaggcugcucauccuucaaacaugcuaagcacucagugcccuggaugcagcugugugccgcuguccgugcucagccgcaccuguccagugcagcaggcuggccucuguaggcacucagcacacgagucuucacuaggcucccacgcugcuauuggugccuuugaucagaggcugcuguaggacauuaggaguucucagauaucgguccauguuagucauuuagauccuacuaugagcuagacauguaucacuugaaggcaaacuagggggagugacguuacagagcacacagcucuucuugacauuccugucuacaggaaaugcagauggugguuuugacugggaaggcuuaauuuuaacaugacguugaaucaaaugcuguuuggugcuggcaaggagugggggggggggggacugaaagggggaggggagagagagaagaccaacccagaucgugcugagcagcacgccccgcagccuccaguaccccagguuuucugguuuauuuuaauauggagagcugcucuaugagaucugcagccacuugaaauaugauuuacuacguguaaaaguuuccgauggauaaugaagauucaggguugagccucgcaguguaguguagucaauucuccugcuguugcucuccaguacaucucugccauugaaaugaauaauuuauuauaauuuauuucaacccuggaaaauaaaacuguuuuccuagugaugugugcuauaacauucagaauagacacacugcaugcagaacucucaauuaauuaauccugaaguuucauucuugcuugaccuucuccuaagcugggagacuggcagguaauucuuuccccaauaagccaugauuaaaaugaauguuuugagaaguagggguaagguugguaauggagaauauugaaagaacagugaagcuagguuguguuuuccuuagauacuacauucacugcaaggguuuuaaauguucgggacaauucaucacuuagagcacgagcaucccuuaacuuucugugagaggagccaaggauacugaguuuccaaauaacgcagguccauuugugaccagagcuggcugagcuuacuggaccuggggugccuuuaaagcacccccuacaaguuuuaaagcaaggcuggcacuguguaaaggccgagcaggugaccucaccaggugaccucaggagagacaggccacccaucacugacugcaggcuucuucagaggaggaggcucaucuuacguuucaucccauugguuugcauuuuaaacgcuaaauacuucaaugccagcacaucgggauggcuugauauagccagguauuuuaaauuuaauguaauguagaugguaguucucgguucaucuggagaggcagaggaauuuaacaaaauaugugcuuauuuacccacuguguucauuucucacaccaucuacuaauaucacaaaggaagauggcagaugaagggagcaguugacucuccuccccuaaagacggcuaguaucuaauuggagcaggaucacauuucaauaucucugugcguguggccugagggacagcacucagugaugacagccagucccugccuugggugcacugcaaaccuggaagcauuuccuccuucagcuguauucugacucccugggcccgaaccucuaucuaggguagacucuggagaaagcaccauggagguagagagauuucccuuaggcuuucaaauccugcugcauugcucaggcaauugugugggguggggugcuuugguuuguuuuguuuguuacguuguuauugguaaggucagccuuccucucaucucuuccuggccuucugaaaggcuggugcauucccuagacacaggguagcucuuaagacuuggaugcguuuauuauuagcuguuccucagaacgucaccagaguacggcacagucaggacacugaagcuuggcuggggugaggaugacucuguguccuccaggcauuagcacacagacugugucccucacuggguccccuugcuuguccuuccugguuuccccucagcccucagggcuaaggcauagggcugcuuugucucugucucucacucuucuucuucggccuggcuuugcuaguucuccucuguguuaaccaaaagucaaggcccauuuuucacuugccucacaagcagacgcagaagugcagcauuaggagggaucaugagcacuagcaggggcuggggacagcagaguuccuaaguggaccucacccugcauggccagcacucguccuccacggccccuauauccaugggacacugaaugggccagggugggaaccuuaguuuuacuuugggggguugcuuuuguuuaggggguccauuuauuacuagaaugugugcuaguuauaguauuaagcauggucaggugcuagccauagaaauaucuacuuuauaggaagcguuauauccuggagaaaauuagccuaauuuacuaauuccuaugguguuaauuuaaauuguacucucagugggaggaaaaucauuauuucccaugaaauguucaguggaucaaguuccaaagacauucuuacguuuacuguuguucacuuuccgagucugucaguauaguaacuaaacuuguaaacguuucgggugggaagcagaaaggcuugcugaaaacuuuucagaagcugcuagagcagauaggugccaugcccaggccccuagaggccugcaguagggccagaggcucugagccucacucagaacagccugggcccucguggccauaggcuggcagaaugaauucucccagacuuuugcauuugacuguuacauccuagcagcaccuuaaccaaggguguccaggcccuuuuugugauagcuaaugcucuccaaagguuuaccugagaauggagacagcauggacaguagacuccauaaaugcuggguuuguuagguggugagaaaacucaucaggccccaccugcuguuagguagggcugcucuuucucucuggcuuauuccucuuuggccuggcuuugcuagaugaugguggugccucagacuguggccugguaaccugaaaaccccagccaugggccuuccucgaaucuccuggcuuagagagcuuggucugaauucaaaaacaagguccuuugaaguaacaggucuauguuaagacauugaagcauucugugugugggccauagauuaaaccacagcucaguuuucugcauagugcucuccaucuuaaagugcucgcugccuuagcaggaaagugcccaauguaagcuaggacuuggcuuauuuuacuuccgcaaacugcagagcaggcacaugugacaugaggguguccuaguaacugcucuauguggcccagggcuucagguggggucugcucugcucugcacuuguaucucacaccuuugucaaaagcaugaucagaagucacacacugucacuuucuccuucuaggucacacuucugggugguuuuugugcuuagauguguuugcuugcaugguugcacugucacacuaucacuuaaacccaugcuuucugggcugccuccugcuaagcugauuucugggacuacaacuccacaugacguuagacaacuuugaggagaauauagucaucucguuuaccugucuaaccuaggugugaguugguauucuucccugugccaugaaauuucauuggcuuaggccagcagaagcuaagguuacagaauagcaacauuguguguaaggcauacuguguggcaaggacaggauagauguuuuguuugugcagaggaaguuccuccucaaagcaucccuuugaccccagcugccacagucccugcuuccugucaggacagaaaggcaaacgccgugggagaaugagcagggucagacuuggcucaguucucagucuaacgccuguugcugccuccucauugaacaaaacuccagccaaacucuggaaggaaggagugggagggaugaggaucaagugaaguaguguagaguaugauuuuccugaggaggcagccccauugcuacauaaccccaucccugcuuuggcaaaacagccacuuacauuacaguggguaaagcauaugguuuggaguauaggcguauuuggcagcguagccaaagcaaauugagagcggccucccacccacccugcagcuguguugggagugagaagacaguggagaacuagauaccggcucucuagccacugcugcauagaguacugugcugcaugggcccucauggccauaggcugcauggucucuggugauagaaugugaucagagccaagauggcuccuuucaguguccuugaccucagagaccacgcccuaaacgucacacugccugcagggaaaaaggacugugcuuuagcugugcacccagccuucuuccucugugugugugugugugugugugugugugugugugugugggcggggaggaggggcggggggaggccucagaguccagaggaauuuacaccacuguuugggcuguuuuaacacuacucuaggauuauuagaaaaaauaauucuggaaauuggcugccacaucaaugccauuuaagaagauuacucgguacuuuacauauuuccagaaaaguaaaaaaggaaaaaaaaucauccauuuuugccaacuuuauuuuuagaaaaguauuuuauucaaacauccccuuucuuauuacagacauaaauacaugcauucagacaaaugaauacacgagaggaccguauaaaguaauuggcgcaucacuccaggaugcuuugucaguuacuggaagaauuuggugccucugacuuuaaucuucuccauuaaaauauccauucugcuucagcuugugaaacccauaauauuuuagacugucucuguggaucuguuaguuuugcuugucaauuuaauuugugcucuaugacuuuggcuggcucacuguacuguucaugggaacaugugaucuacaugaauguugagcaugucaggcauggaguuucagccucuccagagagacuggacaugcagucuguguuguguauaggcuggcagauuccaucuguaaccagccucaucacugagguggugacagaauggcagcuguggaacuacagagaugcacacugcuggugucgcuacgcccucagagucugcaggaugcagacucagcagcgcuuucccagugccgucucauuucaugcucagcuuccuugagcuggauuauuuccuucccucuucagaguuaauaaaaagagacaucgcaagcgccguucaguuacuugccaaagaucacagaauaaauuagauuaccaaaacuuuuugccaggggcagggagauggcucuggagguaagcaagcacuugugcaaauggaggagcagaucccuagcagcgccuacccagugcacgagugcugugcgagugcuguguccgccugugaguccagugcuccagaggccggcaagcuggcuggcuggcuggcuggcuggacggacagacggacggauggauggacggacauuauccucacgcuguggguucagcaauaacuaacuuaguaccucaguaaguacauuugagaacauuugagggagacacccaaccucacccuuacauacaacaaacacaugcacgguacacauucauacuugugcaaaaaagggaggaugcuaaaagcauucaaaguaaagcaggucaucgaagcccagcagggguggcaucuguggggucugacucuaccaccacccuuugguuugcccugcauuugcguuuucucuagagcuaugggagcagauaggcugcagcaggagaaaucagcccacuucacagccauuugccuggacucccuccugucaugccucaugccuagggcacauuccccauccuucaccaugcccacaagcccaucacuagccaccuugcauugaggguaaagucuagacucaguggucuucuauucuggccaugggguuucccuucugucuccugccacccuaaguuccuuacucuucauucccaccgucuuugccuccugucuacuuaugaagaacucagagguuuuccccuccacaugcugcucuucuuuuccuacaccuauuccccauuauuuucuuccugcgacuucccuagcaagcuucgagggaagcucaaagaguccuauuagccaggcaugguggcgcacaccuuuaaucccagcacuugggaggcagaggaaggcggauuucugaguucgaggccagccucgucuacaaaaugaguuccaggacagccagggcuacacagagaaacccugucucaaaaaacaaaaaagcaaaacaaaaacaaaaaaagaguccuauuaucucuucugugugccuuaaccucgggaguuaagaguguggauaagugaguacuuguaacauagcagugagugagcaauuaguaauggauaauuugguaaacaaccgucugagcuagcaggaaacaccacucuggagucacucagugcugagcuacagagagacguccauuaacaucauaaacuguuuggugagguaagaagcagacaggaaagugaguugggccuuuaccugguaccuagcacagagcaaagcauauaagguguaugaagcagggaaugaaccuccuggcucaccaagaaggcucucaccaagcuuuuuggugguagagacuuguccuugaggaggcagggucugcccagaguucacauugccuucuaggcuuccagagugagagccaaguguccagggaaagcccccugccaucagaaagguggcaggauggaaggaguacacagaaagucugggauucaggcgagcucuaagccaagggucccaguuuucaugugccucugucuucuagaugaugucuguccucaugaacaccauugucuuugaggauugucggaaccaguggucaguauccaggccucuccuggggcucauccugcucaacgagaaggugaguguccuuacagagagggccacaggaggagggagaggggcccugaagaccacaggcuagcaggcugaggccuugagagcccaaagaucuucugguguuagaggccaaagaggcccaccagcugcacuguguguggcuugcucggcaguaucccagaggcauccucaccugccuugccauucuaaggcaguucugagccacggcucuuaggccuucuccuccagccuuuuuuuuauaucuagggaccccagccacaaccacagcugaugacagcggcagcccuugagggacuguggguagagccguaccccucaucuagagaguaugcaucccagccuccucugcucugcccacccucaacugccucccaagccccuggcuuccuuuggaaaucacccucagcagccagugggaacagugcaguacugcucaggagaaugaauugucuauacaauaagauaguaccgggggaagacagugagauuagaggcagccgcauacauuaaaauucaaacuaaaaucccagccuuggaaggaaacuaauagaagaggaaaaucuaucaaaaagagaagcgcugucucaucacucaccugugcugaaggauccaauuuuagccacauucaauagcacugccguucaucuucccgugguguuacugugauuuaaauccgagcucuauaaaggagagcaguucuuuuaaaaugauugagagggaauaagggcaaauucgguguuuagaaaaagcuuaugacaucacaauauuauacuuuacugauggaggcaauauuucauggcuuaggaugaaaaacuaauaauuuucuauuuggugagagucacugcaucauuauaaaaggggaaauaaguaguuuugugcauucccaaucuuguucaggaagacauugugguuuaaguauaaugccucugauauauaguauuuaaguauuagucugacuacauauuaauuaugugcguuuuuuuaugugaacuguuuuaaugcaugaugggaauuaaauaucaugcagcuuuggcuugaagagauaaacauauaugacuggcaaaauguugucuuuggcugaaauucggcuguuuccagugauuaggagcucggcuccacaucagagcuuaugucugaauaaaagaccauggacccuagcagaaaaaaaggggggccgagcagcuauuugugcccagguaugacagauacuguucuuagagccagcaagagcucccagagucgagcaggccccucuagagcccugccucagcagagcagaccuacggaacccaggaggccagacuuggaacacagcccagagcucuuugagaagugauucacugaagccaggaaagaugaugaggccggaggggagacccuuggccuugccuucagucaccagagugcucccugggcauuuccaguuaaguucuucuccucagccuuccugugacaaguagaguugagaccccagaagaucauggguucgugccccacaguggaggcaagggccccaucaggcuaagcaaugaccauacaacagucacagcaccggauucuaaugagcagggguguggggcuggcacaugccccuggguacacugcacaccucugcggcuggauggaccuggaugcagaccccuaaacacccaugagcccaaguagaccccaagugaccuggcuuccugccacuucccucccaccagguuuggaguuaaaaccugagccugacacugcucugucucccaacaguauuucagugaacugagggccagucugauaaacagccagccucuccccaagcaggaaguccuuggccagugcuucaggaacuugauggaaggaguggaacagaaccugucugucaagaacagagacaggugagcauugcccagugggguacuccaccucugggggcacuccaggucuguuggaaagaauuggacuauaguuagcacagcucauggauggaugcagcucuccuauuauaccuuguggucuuaaacccaggucagcuccagucacuacaucuuaccgaguauuugcucagggaugcagagauuaauaaaauacagucuuuaucuuuaugcaguuuauaauccaacaggaaggaagugaggaauaccuaacuagaaagagcggugaagggcgacucaugcugucauuggugaugagaaaagccugccuggccuuugaacagcaggccuuggggcaguaggcccugaugaaaugguauuccugccuguguaagcugugacagaaaagcaggcaacuccucugcugaguguccucggcgguaacaugggacugaugguggcacugaugguagugggccaguguuggguucuuccucugccuauccugagagugcuugguacuguuguccaguaagaucuaaccacaguaggccugaguuaauuaauugauucguucauucauucauucauacauacagauaucaguuucuagaacugcggcacugguaaccuggggugaacaaauugcucugagucccugcccuccuggagcuuaugcacuguggaugggacagacaguagucagugauagggaagaaacuguucagugagagaacugcccccucccacaccuucaucaaacacuguaugguuuaaaguacacauugccagccauccaggaggcagugcaucucagguaaugaggcgaggucagcugcggugcagaugucuucacuuggcuacucauccuuucagaauccgacuccgucagagucagaagccggggggggggggguauguuuauuuuuuguuuguuuuguuuuuccauuaauguauuuauauauuuauucauuuuaaaucccaauugcagccccugguucccuccucccuuacauugucccucccccuauaccgaaucccccucuccucuaagagagugggugucccuucucgguaccccccacccuggcauaucaagucucugcagagcuaggcauauccucucccucugaggccagacaaggcagcccaguuacaggaacagauuacacaggcaggcaacagcuuuagggacagcccccacucugguuguuggggaacccacaugaagaccgagcugcacgucugcuacauacgugcaggggguaagggguuagguccagcccacguacgcucuuugauuggugguuuagucucugagaucucccaaaggucaagguuuguuguuacuuacuguuggucuuccugucaaguuccuaaccccucaauccuuccauaagacucccacaaguucuauccaauguuuggcugcaggccucugcgucuguuucagucagcugcugcuggguggagccucacagaagacaccuaugugagacuccugucugcaagcguaacauuaauagugucaggaacuggugcuugcccaugggauaggugucaaguugggucaguuauugguuggucauucccuuggucucugcucuaucuuugucucuguauuucuuuagacaggacacauuuuaggucaaaaguuuugugggugaguugcuguccuugucccuccacuggugguucuggcaggcuacagaagcuggccacuucagacuccauauccccacugcuaggagucucagcuaaagucacccccauagacuccugggagccuccccaaucccaggucucuggcuuguucuagagguaccccuccauccccagcagccaaugauuuccauucauuaucccagccuucuggccacccuuccccacaccugauccugaaccccccccacuccccuccccauucccucucccacccacuuuccuuuguucgcuaugacuauuuuauucccccuucuaaaugagauuuaagcauccuugcuugggucuuccuucuugucuagcuucucucugggccuguggaguggagugugggcauccuguacuuuauggcuaauauccacuuauaagugaguacauaacaugcauguccuuuugggucugaguucucacucaggauauuuucugguuccauccauuuucccauaaaauccaugauguccuuguuuuuaauagcuucuguauucuuuuucuguauucuuucuuugguugagggacaucuggguuguuuccaguuucuggcuauuacaaauaaagcuauuaugaacauaguggagcauguguccuugugggaugguggagcaucuuuugaguauauucgcaggagugguauagcugggucuucagguagaucuauucccaauuuucugaggaaugaggcacugcugagcuggucugugaaauaggacuggcaggucucuuaguuucaugaaagcagcuguccuugugccuaguacuguguagagaaaauguucucucccucucucucucccucucucucucuccuucucucucccucucucccccucuccucuccuucuccucucccucuccucucccucucucccucucucccugacuuuuuugagacagagauucucuguguagaucuugcuuuccuggaacuugaucuguagaccaagcuagccuugaacucagagaugcaccugacucucaagugcuggaauuaaaguuguguaccacuaccgccuagcugagagaauguuuuucaggcauugucucacugacuugauaaaauucauucuuacauuuccuuaagauaguuaguuauucuuacuaaguaccaagacaaguggucaacucuucauuugggauaacuagcuaauacuggugaaccagaucuuggaccaaggucuucuaacucagugcuauuuuuaggucuuguuuuguuuuguuuuguuuuuaagggugauauauauauaucucacccaggcugguuucaaacucucuauguacaccuaugguaacuuuguauuauuacaauuauuugggguguuagggggaucagagaaccacuuggcagaaguugguucucuucuucccccaugugggucucagagaucuaacucauguuaucuggcuuggcagcauguggguuaguuaaccugcugagguaucucacuggccuccagguuucuuaucuuccuuuucccaaaugcuuggauugcaggcuuggacaccauccccgacuuagguagcacugggaaucaaacuaaaggcuucgugcauaguacacaaacacaguacauauguauacacacacacacacacacacacacaccacauuugcaccuuuugcuaagauaggauuucaccacauagugccagccaaccucaaacucaaacucacggucccucuacacugcuuucuaacuucagguauuacagaccugagcuaccacauuccauccccaccccccuauuuuucauucacuaaauucaguucuaguugaagauaauaauaccuacuuuuggggagaccuauaaugauuaaguacccauauguaaauucagucuaguaugagacauaacuaaauuuuguaauguuuuaguagaacuucaaaugcucuccaucccuaaauugcugagaguggcuuucgugggagugcugguauucagugggagauggugcugguagcagaagagcaguggcugcuggaacucccagcacugaggagccuccucguacggaguccccuccuggguccugugccccacggugcccuuccucuagagcuucuuacggccugcguguucacugcuucucuuuccacagguuuacccagaaccucuccgucuucagaagagauguggcagaggcccugcguagcgauggccacacugaccuaagcagccuggacaugaugagcugacccagcuccugagcgugggcugugcagccuuugucaagagaaucuggaaggucuggguuccagacuacgaugcuggccagcccagaagaguguauuuuucagaacaagcagcuaaagcccuacauuuuuauaagucugagcuaauuauaaaaauuuauaauagugcacauacaauguaaauucaguauucaaagcagcacauguuucaagucuaucuggauucccacaaugcuaaagggucuagaaacuguauucaaccaaagaacauaguaaaccaggcuagugccugugaccacggcuguggauuuggugaagaugcagcccucacuucaguguggguucugggucgagacagaugccaucugaaccuguugaauucaaucuuuacaucuggaaaaugcaauauuagggacucggggcugugggcauugacaaggagcuugggaggaagcaccauaaagccucccccagaacugcacacaggccuuucugccucagcaauaucugauaaaguucagagacaguaacacaauuagaugacuaacaaacaauguuugcuuuccacuggcauaaaucuaaagugguucagucuagaagaauuagcucugcaauugcugccugcagagagauguguuuaggacucuggaagccuaguuagaaguucuaggugcacaagcuccauuuaacuugaaggaaagcugaggguggcaaguuguaucuggaagcagcucugccuucugaccacccagcagaguucagcugccaccuucugcccuccgcccucccuccgccuuccacacgcuuaaccacuguuggaugugacuucauccaaacauaggaaaugaaggccuuuacagcuugugacccaucaaaccuaagcuauuaauuuggaauugccacugucaggcggguuuccuaucucacugcacugacuuuggcguucaggcuuacaauaaacacugcggccauaaugucugaucagac

SEQ ID NO: 5930 - RNA, 631 nt, Mus musculus
caugggcaaaggaaauccuaagaagccaagaggcaaaauguccucauaugcauucuuugugcaaaucugccaggaggagcacaagaagcagcacccggaugcuucugcuaacuucucagaguucuccaagaagugcucagagagguggaagaccaugucugcuaaagaaaaggggaaauuugaagaccugacaaagacugacaaggcucauuauaaaagagaaaugaaaaccuacaucccccccaaaggggagaccaaaaagaaauucaagaaccccaaaugcacccaagagaccuccuucggccuucuucuuguucuguucugaguaccaccccaaaaucaaaggcgagcauccuggcuucuccuuuggugguguugcaaagaaacuaggagagauaugcagcacaugacaaacagcccuaugagaagaaggcugccaagcugaaggagaaguacgagaaggauauugcugccuacagagcuaaaggaaaaccugaugcagugaaaaaggggguggucaaggcugaaaagagcaagaaaaagaaggaagaggaagaggaggaagaggaggaagaggaugaggaagaggaggaagaggaaggugaagauaaagaggaagaugaugaauagu

SEQ ID NO: 5931 - RNA, 1341 nt, Mus musculus
caucccgagaacguuccgccacaggagaugcacagcggagaggcucaguauacuucugugggaugaagaccggcagagugcgggagccaccggacagacccgcaucccuucagcguagccggcgcccagccccgaggcuccaccaaugaggcugcgcgcucccggucgcgccgcgccccgacccgcgcccgccuccggccaaugacaguccucuggccccgcugccuugcucccgccgucccggccuccgagcucaagcucccggggcgaacagcgaccgcgggcugggcguaagggccggauggcggccccuccgccccagcucccaccugccgggacgccgcuacagccgcgccaaccagagcguacuccgcggccgagcguagcccgcuccucugcgcccgccccacaccguucccaggcaaggggcugggcucggggucgcggccuggagcuccaggcccacagcccggcgcacugaccugaaagugcagcgccaucuucccggagcggcgcaggccgcgcggcccgagggccgaggggagggggagcgaaggcgccgcgcgagcccggccgccgcgggauccccccaagccgcucgcucccagugcucggcgcgcuccgcucggagcccgcagcgggacugggcggggccggcggagcgcggggaggagggggcguguccuucgggcuccuccgcccaaccgccggugcgcuccuuuuacaaccgcugcauccucagagugagccucugaccucugaccuuuaacuuuuaacucaccaccacgacccaacugcccgccucagcugcccacuuaguuuuggagacugggucgucggucucacuaugaauacuguaauacgugaaccaggcuggucucgaacuugaagucacagucaucugcaugcggccugagugcaggcauaggugguguguguuacugcccacuuuggcuccuaaaucugugguagauaggcgaagagacugcucagcaguggagagcacccucccacauguucauaacugcauguagcuccagcuuguggaaauccaacugcuuuagcaggcaccugcaucgcuuucauacacauaauaauaaaccuuaagucuaccacaagccauauugauuccugacagaacucugaaacaaauacaugacucccaaaucccacaucugcacagauguucuguuccucuaacacacagccuuugacccccccccccauaugcuauccuuaacucuuguuccccaaugcccaacucccauuguuuauuuuuuuaacuuuuugaguaaguuaagcugacauuguguaugaggcauuaaaauuauaaaauucugg

SEQ ID NO: 5932 - RNA, 2358 nt, Mus musculus
gccaaaugcaucuuaaaaacaaucacuugcauggugccgaagggaucagauucuuaggcucuucccucugugguaaugaagugggauggucuugugaacuguauucuuggagcaucugagccgggucaaauauaucuuugugaucucuguagguucuuucagaggcagggggugaaaagcuggcuccucugugcuugaaaagaaguauuuaaaauuccuuugggaagaagaaugauguuugauggcaaagaguccaaagauacaccccugguuuagcggguaaaauaguucuggcagagggagagggacuguggagucacagguaacaacagaucauugcacagugucuuucuucauggaacgguagcuuuuccuugcacugauauaccguagucuuauaacccugguucuugguagacagaaucugaggugcaugcauugcauccuuuugggagagcuggcagggaccaaugaagagaacacugaguugaggcggcauggcuuuuagacgcgguugugcuguuuccucugggauguaucuuguggucucugacccuuaccuauauuaauaugggaauagacugauugaaccucgugauguccuagcuacuucuuaagucuaacuuucuagagauguaaaugaugugugugugaucacguguccaacucguuagcauccauuuaaaugaauuaugucacauuuccagaacaccuucauauuuuuaaucuuauuuuuaacccucccacaaaccugugaacuaggaaggguaaaugcuuuugucccauuugauauauuaggaaacuuaggcaaauagagauuaaguuaauggcggaguccaggucuccugacucucauuucuggguuccuacacuaaauuaagcuuggauuagucuauugggauaagugugaaaggguauacagcugaauucuuuguggaaaaaaaaguaaguugauaaauuauauuaaauuacuacaguagauagaaaacaaacuuguauuucccugguggagaauuugccuuugaaccccacugugaaauggauuagaacguuuuguuaggauguaagcaauguacaaaugcagaaaagguacccaucucauauccuucuaaauggauaauuccuccugggacuucuuuacauuccgaagauucauuuauuauugcauucuaaggacugagacuuugaaugccacugcaucugagucuacguuuuauugguggcaccugugguuaucacuuuccacccuuuuccucuccguuuccuuuguucugcuucauagacaagauuugauuuaugaacgagagcuguuugauucuucaagauauaguuuggugaauugguucaauaacuuguuauugaaaagcaaaauccaucagggacguaucugccuacuucucaaagaagacucucuuagagacucuuuauuuaccaccagcgccucagcccuggauuuuaugaggacauagccauaguuuguuuguuugucacagaugucugugaaaggguucaaucuaaaagaccagcuuuaaggcauccuguaacauuugagaaauuaaacaaaugucuuaauucacaagguaacgugcacauccagauggugaggccguugccuuuacugcaacacagagccgauuggggucagacuuccagaagccauaagagugagaaaggagccuuuaaucccaguacuugggaggcagaggcaggcggucauugaacuggaggccagccuggucuauagagagaguuccaggacauuggggcuacacagagaaacccugucucgagaaccaaacaagcgaacaaaagaaugggagagaucaguguuuggagcuccccucuuuugaaagucagaucugaagcauuacuguuucucaacuaugcuccuucucauuccuauuugacaacucuccccaacccccagcccccacccccgcccccaccccagcccccacccccccauccccucaccugccccccccaccugcccccauccccacauccgucccgucaguuuuuaaaggaggcuuuggaauuguauacuugaccuccucaagagguuaucuacaaggcauucuaccugccguucccacccucuguaaaagcugaacacugucacguggggugagguuugcucaccugggauguucuuugguuccuucacuugguuuucaacucagugucucaaacacccgggauuggaaugaagagcagcuccgcccucggacacgcccucgcuguucaguugcagucuuacauuggaugccauuuuguccugcugcggucuucucagacuuagacuuuuaccuguuccuucuugacaccgacauagaagauucaaaugagacaaagggg

SEQ ID NO: 5933 - RNA, 28200 nt, Mus musculus
uacuauauauuuauuuuauaguuucacauauuuacaacuuuuauuuuucuguagcuuaaaaugaggccucagugaaguuauauuuuaaacauuuuuauuuuuaaaaaaaaaugcacagguaugaccuacucacucaaccacacuuccccuccccuagccccuccccuuaggaauguauaugacagauacaaaauacaaagagauucuacuaagaacucuaauggcgcaacuacaccuauuguacuccaaugaacaaagcgaauccuaaaauagaaacaucuguuaagcgccaggcacucaagcucacagaaacggaacgaugggcagagccaugcugaugaaaaggagggcccgugggugaaggacgugaaaggaaagaacaucuacagccccgguuuguuguagaaaggacagggaaagcugaggguucauuagaaaaggaagggaaagaccugaagacagcaagagucuuugaaacaauugaggcugcauuggaaccuuauauaggcgauucccguggagcaagagagagagagggcacacaagagcuccuaggucagggugacccuggcugaacucagaaaagacagcucacguggguugugcaaugugucuuuccaucguucagaacagucggaaccagucagggccaguggucugcugcucaggcaggguaauccacucaaaguaguccagcuagaaagguugggaaaagguaacuauuuaagauaagcuacuugugucccaguagugccgcuucuuaucuaauagacaucacuccugccuagucacuggagcacagggauaaaagcuccucuuugaaggaggcagggccuuugccaccggcaaaauguuccccagcaucuuggucaacaggucagcagagaggacagguugacagagcacucucuggucuacuugguuccuagccaguaugugaguaaagguggcuagcuaguacacuugacucagcaagucuucauggacgcauucuguauuaggaauccagaacaaguuucaaaacuuccucccguuuuccugauguggaaaagggguuuuuacauagguuaggacuaagguguauaaaaacaaaauaauaagauacguggaaaaacggcaugaagcccuggaccccaaaggauuuauguuuuuuucuuuuaguuuauugauccacuaauuuuauucauuuacaucugauuugugaauaauaggauguauuagaauuuggggacaauucuucugugguauuaaauaacacuaagaacccaucugguauuagguugaugaggcaagguaaccaccaaugaauugacgcaaacccacauuucauauuucaaggaaaaacaaaaauuagaaaacacugguguuuaaauaggcaagagagcauauuauaagggccacagagauguaaucaguggcacuaugaauucuuuagaaaauaaaccccuuaauauauguaaucaucuucccacauuuuuauggagugaaugcagaccagggauccagagagcaaauagcccugaguagguucgcagucuuggguucuguguauguguguggaggggguguucuguccaaaauugaagaagaaaaggguugccuuauaaugacucuauuauagaaucuggucacacuagggcuucuacacaacuuagaauaauuguuacauuagcccauuuguagcuuucuaagcugaagugcacacacauguucuagaauacccuuaaccucauuaugugaugcaagaguucaauggcgucucaaaaauacauguaguaugcccaguaaaauacauuggccaacauaaaaaucaaaggaaauaguaguuuggaguaucgauccacauugcugggguuuugaauugugaaauaaucaaugauucugcugaucuucucucggaagacaaacuuaaacuugucgcuggcuuucauugucaagucacuauaguugacauugucaccagagauuucaaugcuggcaaagcuaaucuuccguuuaaagcuggagauggagcuguugaugauguuggugauauugacuucuuccgaguccuucgcuggccccugguucauagacaauaguuagaucagaagacaggaaacagugagguacacagauggcaucgugaaaagguguguggucaagguagcagaccugggccuaaaucuuagucuguuauuauucgaaauuuuagugaccuagaucccuuuaaggugugauuuccuugucuggaacaugcuaaugauaugaauuguuccuuugugagacgaagggggaagauuaagaggcauaaaacuguguaaugcacccaguagguauuugguaaauuucuagucuguuccagggagaagagauucuuagagauaauggaaacccauugugucaugugaucuuuguuacacacaaauuccccugcaaaucaggggaauuuccacuagucaacaaggugcagauagcagacaauuugaggucuuggcugaguugcuuuaccacuuugguaucaucuuccuuaguuuugggauacucagaugugaagaauacagcauauaacccauagugcaucuguuauuacaugcauacacaugaggggacauacuggugucuucuggagaagaucuugggaacucuccaaccuucaccugccagucuagaaagucuggauugguuuguguuauuagggaagucuauacggaagaaaacacaugaaaucacacucugcacuuggugguacaaauguucuuugucuuuggggcuuggauuggucacaacaaccaaacacaguaacagagccauugguucuuccgguugcaucuucacuauuagaugcuugugauccuagcacacagcuuaaggugacacuuuucugaaccggaucccuauuauuuuuguuuguuuguguguaugaacuucgguacauuaauauuuauuaaacuuagucuccaaauuaccccagggucugguagagcuauaaagaguaauacuuaaugggguguccuguugcuuacugugugaggaaagcaauucaucacacuggagcaaagagguuuugggauagauugccaacucuacucucuacucuccuugucucugggauuuuguuacaaaguaauuucucccauacauuuuuugauaaccuaauacuuguauaauuuaagaauauaaaauggcaucacaagaauuaaguaacaacuauauauuaauccaaagugugugaacaucuaagcaugucuacuuugauauuaggcuuuuuuuucuauagaugcuuauucuuauucuuucauguugcauaugaauaauaguuuccugcuaaaaaauuaaagucugauauccuauuuuauuggguaaaaagaaccaauaaauuugggucaaggggcaccaugacuuccaaaugugcccaccuuaguggggauaagauccauuagaacaaagggacuuaaacccugaucaccuucagagcaagcaguccaugcccguccaagugauggaucagagacaacgcccucaaaauccuuacccuaucuuugacugccaucugcuguaaggagcuguagugagcaacugcauacuccaguaaggccccaaacacgaagcugaagcagaugccuagguacacaucgauggccuuuaugaagcaguugguguuggguagggaugugcgggagccgaucaucagcguugucauggauaacaccguugucacuccuggaaaaacaaguaggcauguuccaugcugguguuccaugaacacaaucccccacuacccugccccaaccucgaucaucuggcuggucaguuccacucagaagcaagaugaggguaggacucaggaaaaguauagaucucaucuuaaaaagucugucaucuucuggaauugaguugauuuauucaucuugaacagaaacguaagugacauagcuuucuaaauaugccaucuccugucuucucuuagagauggauagccaaucuguacucacaacagacuguuugcucacaagcucgucucuccugucacuacaaaacacauuuaaaaagacgauccuccugauacuaccuuucuaucugugcaaagggauuucucaagauacuagcucuucuaacggcccccaacugucaaugaaaauaucgauagaauuucaaaaagcaccugauucaccuaguucuuagaaauugccugcaggaacugcuuaccaaugcagguucucgcaggaacugaaucgagggagauccaaaaggagacccaggauaacaccaccaggaagguggaagggacauagguuuccagaaugaaauacaggacguuccuccgaagcucaaauugcaaaaccaaucucguauaguuuccuaagagugugaacaagagauaagaaaucgugucuauucuugcagaagaauaccugcccuaugagaugcuuaaugaaaucacaaucucauugcaucuucugguaccaaaaucuagucaacuaugagcugccauucugguuaccauaagugaccuuuacauugucuggcgagggauuuacagggcugcugcuaucuaaugcccacacucauguucuuuuccuuauacuuuucuuuagcaaagaauuccuucagcaccaggagcacugauuuucuucacauccagcucacuagacagaaccccagggggcaaaccuauguuucucagucuugcauucacaagguaagcuuuuuuuguuuguuuuguuuuguuuuguuuuuuuguuuuuucgagacaggauuucucuguguagcucuggcuguccuggaacucacucuguggacccggcuggccuugaacucagaaaucagccugccucugccucccaagugcugggauuaaaggcaaucgccaccacacccugccacaaaguaagcuguuaauagauuccugguuaaugaagauuauuuaagacagcccauuguuuucaagaugacuauuaaauauaauuuagcuuucguguguaugcauguguaugugugugugugcaagcauuuguaugcuugugaagaccagagagcaaucuuggguauuguugcucaggcaccaucuaccuuuugguuugagacaggaucuugaccuggccuggagcuugccaaguaggcuugagggcuggacagggagcugcagaguucugcugucuuugccuuucugguacuggaauuacaaaugcuguguccagccuguuuuuuuuuuuuuuuaaacuccaggggauuccggggauugaacucaguccucacgcuugcaagguaugcgcauuacugaccgagcaauccacccagccccuauacuuuaauuuuuguugauuucggagguaucauugcaggaucauacuuaggaaaugaccaguguacacacacuacauguggagauaucaacaggcaccacccauccuguccuuucucuaggcacagcugugccacacauuuuuuuuuaaggucaucuagacucaauuaaguacaugguaagguuuuagagaauauaaauauugaugagacggagcauuccuaacuugaccaggaggaaccgagaagaaaacauugcuguuuguauauaaaaaucauaccauuuagaaaacaccuacuuaaagccaacaacucccagagacccagcuuuguacaugaugaaucaguaauaucaauaauggggugaucauaugguauugcugcugucuucuucaccuaggaacauguuauuaaagugaccagugcucucauuagaaacaugagugacuuuuaugcaugagggagugcuguguuugagcagucggaaaaucccagaagauaaacagugaaacgucagugcuggccccgagguuuacucuccagcagaccaugucaacccugaugucaaccccgaguguggcauguacagaaaacuaggucccaugccagcucccuuucccuacuccacaguacuaaugaguacucgcccuucacaggaauagagguguuuuugccugcacauaugucuguguacaaauguuggguccccuagaauaggaguuacagaaaguugugagccaugaugugacugcuaggaauugaaccugggaccucuggaagagcagucagugcucuuaaccucugagccaucccuccaaccccuucucuaaggaguuuuuauuccaugugauggcucacaagaguuaccugucuccugcugggauacggugaccagggugaaauacuguuggauuguguacugagcaaggcgcagguuuucaaguccacgcaccgagucauucccucucagccaggagaacuccacaucauugccaucguaucccccuggcaaacaagagggagcccuggucagugcaaggaugcugcagauugagcuggugugggaaaugcuacaguggagaccagcaagacuucucuccugguggcauuaagucuagaggagcacaccaugcaaaaaguuggccaggagccucaagcacugaggggugaaauccuuugcuaugcccauuuuucauugguguugagaaguaguucuauuguaagcauugcucaaaccugguggaugauaaaaauggcuucguucacuacugaacgacacuuacaaagcauaugaucacagggacccauguuagauucugccugucagggcagucuaagcuuugauaacguugucugggacuucagaaguggucuauucauauuucccauuaguauaaaugcaaaacuaaaacagucuguuaccagccacuuuauaucugucaauauuugcuuuugaaaaauguuagcuuuacuaguaucuguugaugguacugcuaaguuacccuuuaugagcccuuacacaacacaucccucaugaucucacaauccuguaggauagacaucucugugcuucuucagauuuaagauggacuuuggucuuuacaugucugaaauuguaauugauccuacuauuaguuuaugugugugaagcagagcuugcaaugucuccuaaaaauaugcuuauucacuaacuauugcaccuuagacuugaggaaucauuagcccacuauaugggaaaacucucggguucuaagggguuucuuaacucucucaggauacagacaagcaagagacaaaacucagugcugugccuugcucaggaaaggguagucucaaagcucauggauggugguguaaucauuucaguaucuauuacuuagcaagcaguuucugggacccuugcaacaccguccucucuacccccggccgagaagauguacgcauaguuaauaagcacaggaaagagaccuaaccucaucagucacuaggaaaaugcaaagcaaaaccacacaguacuucacacucguuaagauagcaaucauaaggacaagaagaggaaaacauugaggauauugacgagcucaaacauugugggugggaguguaagauauacaaccacuuuugcgaaacaaaaugccuaagaacccaaauaauaaggguaucaguugaaucagaacaguaacccuagauauuuacuuaagggggauaaagugccagucacagaaagacuugcacagaacguggagagcuuuuggggucacuuggcaggaauuugauaucaggccaggacaaagaaguaagcucaaggugggaauuggacuuugggccaggucucaggaaauaggcucagaugaagaauauuuacauuugaguuaaugcagagcucagagcagcucaucugaggcauguguggcaguccuuuugucuuggccauccugauugguguuuacaggauuuuguuuauugccuugcuugcuccuugaccuauaaauggucuuauuauuuugcauguacuuaaagugguauaaaagcagacuggaaaaaaaauaaacucacuuucgccucagaacugccuggggucaugcuacaguguugucuacauuuuaauccucgcuccugcccuggagaaccuguugacugacugagcuggcuuggucaacagaaguguucauggcagccuuagcuacagcggccagaugugagaacaacccaagagcccauucacggaaaagcuggaaagaaauaguacugagcaaucaaagggaauaaauuacugauaacaggucacuguauucuaugaaaaacagcagacauaaaacggaaugcaucguuuuggucuuacuuauaugaacuguucaggagagaaaacuucauagcagcagaauguaagucggugguaccuggaggugaugggaggaaacugggguguucacaagaggcacaagggaccucuggaggugacaggaaugcuccaacaaugcaaccuagcaaugacuacacacacugauaauuuuacugaaaacuuugggucacaaauaaauuaaagaugggugaauuuaucugggaagugguggugcacaccuuaaaucucagaacuagagaggcagaggcagguggaucucugauuuugaagccagccuggucuacagagcaaguucuaggacagccaaagauacacaaagaacaccucccccucaucaaaaaaaaaggugaauuuuaugguacauaaguuauagaccaauaaaccugauuauuggaagaugacugaacaagccugguccuguuacuuuuuccauuccaguuauuaagaagcugagacucgggggggggggggcuggggggugucauuagcuaacaucauacauacaacuggugauauugcccauccguggccacaaacauaaacaucuuccuucauugcuucaaagguuacugagauaugaugcugguguugggaccaacacugugcuaagaagcaucauuauggagucaguaaccaguaggcauuaucuugagacaucugagcuccuuuggaaccauccaaaacugaauggaagcuagccauugaaauuacgcuggaaccucagaggaaugaagacagcucucaggagaugaagagugcaaauuucugccuggguacuugguuucacccuuagaauuaauuaauuaauuucuuucuuucuuucuuucuuucuuucuuucuuucuuucuuucuuuccuuccuuccuuccucccugccucccucccucccucccuuccuuccccccucccucccucccucccuuccuuccuuccuuccuuccuuccuuccuuccuuccuuccuuccuuucuuuuuucaaggcaggguuucucuguguagcccuggcuguccuggaacucacucuguagaccaggcuggccucaaacucagaaaucugccugccucucaauugcugagauuaaaggcaugugccaccacugcccggcuagacuuacaguuucuauuuacuaccaucuuuugucccugagugaaugugggcgauuaagaugauguaaauucuuuucuuuaguggaugugugugugugucuuacugagguguuguuguuguuguuguuguuuuuguuuugauuuuuuuguguuuuauaccuaaaugccugcuaauaagcauucugaggaagcuuccucuguuccuuggggauggugucugugcgugcagagugcugagguuuccuggagaaucuugccccugggauuugggaugagcccagucgugacacauggaaggcaauuauuucuccugugcugcaugggaauggcuuuucuucuugacaaccucaaguugccuucugccaccaaaugacugcauugcuucaagaaggguuugcaugcacuguaucaauagaauaguuagccugccuaagccuuuaauuaaauguguacgucugaaaaauggcuucuucucauaaugguucuucucuccuggaguugcccaugugcgcccuuauguguagaguagccagugguccccaaggcuugccuguaguugcuuucuacuuugaugccuuaaugagucacaucaguggcuacuucccuagcauaggugcccacaccugguggcuauucagagaagcuuacuaaggcaacgcgagacugcuuuaucaaucccaagggauugacuugaccuaaacccacuuagcgugaacccacauuuuccauuuuaggaaauuccuagguuauaauuuagaugcccuguuuacucucagcgcucuguugaagcuuucccuacaucaaguaaguucuuuuacacgcuggaggcaguugcaucaucaaugucagugauuugcauugcguauuuggcuuuucugcucuagugcuggggacugagccagggccuuucccuugcuaggcaggcuucccucgcaccccagcaccccaccccgacacaccccgaccccucuuugugcuccuuaccaaccuuugcuauuccuuuguuccugugguucugugcccugcuuuuuguccucucagcuagcuggaacagaucuggaucccuccucugauuucagguggcacuucccucugggcaucucugaccccuaccaggcucccauagcaacauuaccuuucccgguuaucacucagucuuucagaauuauuuuaaguccugugcucucuguaaggagauggacuucuugaugacaggugaaucauuuuuaucuuuggauugcaagcauuugccaccguguuuaacagagaacaggcgaacaguuguugaauggauggacuaacagaagauaggcagaugggacucaaucagccauccagauuagccggagacuuuagugggaaaauauguggaacugaaguauuagacagagucaaaauauuuuccuuaagacccagaggaaaagaaaacacuggccuucauccuaagaaaccaaaaggaggaaacugggucugcugucugauagucacguugugguucagucugauagucacguuguaguucagucugauagacacguugugguucagucugauagucacguugugguucagucugauagucacguuguaguucagucugauagucacuuuguaguucagucugauagucacguuguaguucagucugauagucacauugugguucagucugauagucacguuguaguucagucugauagucacguugugguucagucugauagucacguugugguucagucugauagucacguugugguucagucugauagucacguugugguucagucugauagucacguugugguucagucugauagucacguugugguucaaucugauagucacguuguaguucugucugauagucacauuguaguucagucugauagucacguugugguucagucugauagucacguuguaguucagucugauagucacguugugguucagucugauagucacguuguaguucagucugauagucacguugugguucagucugauagucacguuguaguucagucugauagucacguugugguucagucugauagucacguuguaguucuuuuuuuuuuuuuuaaagauuuauuaauuuauuauaugcaaguacacuguagcuguccucagacauuccagaagagggagucagaucucguuacggaugguugugagccaccaugugguugcugggauuugaacuccugaccuuuggaagagcagucgggugcucuuacccacugagccaucucaccagcccccacguuguaguucagucugauagucacguuguaguucagucugauagacacguugugguucagucugauagucacauuguaguucagucugauagucacguugugguucagucugauagucacguugugguucagucugauagucacguugugguucagucugauagucacauuguaguucagucugauagucacguugugguucagucugauagucacguugugguucagucugauagucacguugugguucagcuuacuguuugggaggauuugggacgcccaaacaaucgucacauggucccucagucugggaaguauggugauuaucgaugcauauuagaaaaaccuagagaucccacacaauuccuuaaaaccacguaauggcauacacugggaaaauguacaccccaguucacaaacaagccaggguaacacaauccccaugggcuuugcuggccaguagaagacuccuuggaauuguccugccccuaccugggcuccagccccaguauuucugcuucucgaguuccuuuagaaaaaugauaaauugugacgagucuuaauuuguguaaucauaagguaagaaaacaacacuugcagguuuguuuggaagcuaccuaccacaaaggcagagugggauuaucaccuuagcuguuccuccuaccaucauuuuccaacuagcuucccuacuuccucaguugcacaguaaggaauagcuggaggcuacagugaauuuccauuaggacaaggaaaagaaagcuuccgaggccucaggcugccugaagggaacgaggcauauuuaguaacaaauggaaagggggcuaaugacgcccaggacuucugcaucagcuucuauaggguccuaggguugauuugguuuugguagaacaaaagugguuauguggacaggcauagccauugaaugauucaucuggagucauagacccucugaggauaaguagccugagagaucuguuuucaucaagaaguuuucuauaaaauagaaauacucaugauucuaugguuauguaugucugcgagaggauacacuccugggaauuugacagggaauuagcucuuggaggcuccuaaaaguucugcagcgaugacgauuguucuuauuuuaggcuauguagaccaugccguguagucucuaucccaaaugcucaguucuguuauaacagugugacauaugcaaaugacuggucaccucucucugcaauacaacugcauuuccagcaaugggugaugggccagauuuggcagaugaauucagcuugcugaucaugaccuaccuacacuaucagcuguguuaaagcauuuucuucccucaucucucuccucacagcuggggacauuugguacuaacgcgcaacaguucucccucaaagauacaauguugcaguuugccuucgagcggaauccgacucucucuggaaguauuggcugaacagcucaauccuuuauggaucaaagacaggucauugacauaggauacuuuacaaaaaaaagauggaagucacccaggaaagucaccuggggccuucuccaggauguauacucacaacuuucuagcugcagcuugcaggucuguguguccaugggguauuuagacagauccauguuacauguaacuguuguugugauucuaaaaagaaaaagaaaagaaaaaaagaaaaaaaaagaaaaagaaauaaaacaaauaagcgggcucagaaagggagcugccaggagagcaaauucacauuucuuuuggagggcugcccugagacaagguuugcucagacucuucuggggacauguggcuuggagccugcauccaagcauucauuccugagguuuuccguucucaggaacaugcauuggauucaguaaaaacuggaugcagacuggaagaaugcuggcagcucagaggcaaaacauccacaacaugacagaacacacucacucuccagcagaauauauuaguagaaaaauagaaaugcauuuuuagcuuuagucaauuuauuuuaugaguaugaggacauuggguccucugggacuggagcuaggaaugguugugagccaccauguggguguuggcacucaaaucuggguccucuggcagggcaacaaggacugagccaccucuccagcuucuggggaugcuuuguaaaauucaaauuaacuuuucuuucauauaauguauuuugaucacauucuuuccuucuuuaguuccuacccacucaaccucacagucucauucucucucaaaaacaaauaaacaaaaauaaagacaaaacaaacaaaaacccucucaaacaaacaaacaccccaaauccaaaccaaaaugacagcaggaaagcacacagguaaaaccaaaccaaacaaaccgcauggacccuguuuugcaugggcuaauuauuccugagcaugaggccugcucugggguaugguugacaccuccagagucacugcacuggagaaaaugacuuuuucccucacccagcagcugucaauuacaaauagcuuccugguuagagugggaacuuggugaacacuuccucuuccuggggaugcuuuuaagcuuagguuuucaguguaaucuucaugauaacccuuugcagggcuagaccagugaucacuggauuugcuuacacucgcaaggcucugagugacagagcccagacaggaguccuggucuccuggauccuugguggcaucgagauauagagaaaucagaggacacagcuccugggcucaccuaagugugcucaacuaauagagugaaguccucacaguagagauuuuaaaaggcaggcugcuaucuuccuuuuuaacauucacacuuuuaccagauuuauuaaguacagugcuggguacucuagaggcagauauguucauggcacaguauucaacuugauggcacucuacauccccuuaagggaggcagagagaaacugguugcuuacugcaaaccagucucuguacggaggacaucacaugcauuaauccuuugaauaguucucuauaagaacuguuauuacuuuuguuuaguuguugaggaaccugaagcucagagggucuaguaacuugccgacguucgcagagcuguuuaggacaggaguaucauggcaaguucuuugucaacugugauucauugguaacugugcuauaugcuguagcacauaguggaugcauacccucagguacacaaguauacaugcacacacuuugugugcaaacagguucccauggaagcuuggaaaaaaggcagauuggagagcaaaggagaauuaggcuucuuaaaagagggauugggguuugggcuggucucuguaaaacucaggguugcugaggcaugcccagaaaugcuguuuaucuguucgcucaguccuugguuuauaacuucagguccuucuugugauuaaaggucaguccauucauauuuacuaauugaucugcuccccaaggacucagaaagucggagugugcacagccccugcacaggauaaaucauuuguucaggcugccuuacacaucucccaaagccucguuccuguuccaaccguugaggggaauccauaagauagaaggaacguuaggucuuggcaauuuggagaggugaccuguagcugcaaguagguagaaucuuugggauucacaccuugcuuuuuuuguacaaacaugucucagacacgcagagaugcuauguagagauacccugcucuacugagccaugggaaaggcaaauuccuaacauagacuucucugcuugcucauuucucccuugucuucccucucuccucuucuccuacuucuuguccccuccuccuguguguguguguguguguguguucuugcacauguggguuacuagcauugggaugucuuccuugauuaauguuuaccuuauuuauuuguguauauguauguauuugcuuguguguauguuugucugugguuacauauguaugagagucugcaggaaccugcauaugugugcauucauguguguguuuguguguuugugugugugugugugugugugugugugugugugugugugcacauggaggccagagguuggguaucuuccucaaucauucucuaccuucuauacugaggcagggucucuuagugaaccuggaucuuauggauucagguaguuuagccagauguauuucucuagagauccugucucuaucuuccaaagaccgaguguacagagaggggcugccaugccaccccacuuuuaagugacugguagggcuuagaacucuaauccucaugccugaccaacaagcuuuucauucaggaagccaucccgaccacacccuauuuuacuuuucuuucaagacuaggccucucauugaaccuggagcuugaagccuagggcuggacuggaugguuaggaaacccuaggaucuuucugccugccucuagcccucagcacuggguuuuuagaugcacacccuaggcucagcuuuuggucuuugaacucagauccucaugcuagcuuucuagcugcuuuucuuccuuuuuggcuaacuuuccucaucuuaaaggcuuaguucauaacccaaugaagcauauuuuaacauuaucucuaaccauuaaccuacaacggaggacucaacuuggguccuggcaccggauacuuccuuuguuuacaagccgguacucucagggacggggcuugucaguucuuccugggucuccugcuuggggccuggaaccuagcagcuacucaguagguacauuuguagcuagguucuacagagaagcccuucugaauggcgcuggcaugcauacaaaacaggaauuugugaggaaugagaacaggauuugguauuggccaaaguacacaggguguacaugucuuuuccaugcguguuuuccuccaaccccagacucccagaugccugcucaccuaagugcguacaggacugugccguuggagaagaggcggaugagccuguuucccacugugacuucauggaggaaggacuucuuggacucuacaauguaagugucuggcacccagaggaacuccacaaggcgggcaucuagaguaaagcucuuguugccuucgaacacuagccgugggucuguccaacgcugccggagguauauaguggcuguguaguccuagggggaaagccggaaaugcaaacgaugggcaugauuagggagaccccaaaaacagaaggaaagggguuaaguuucacuccccucccuccauauauauucucuauauaugcauauauuauacuggugcgguacucaucggcagcaaugaaagaacaaagugcauuauuuauuuuagauaauaacuccuauugucaaggccgacuuucagagucuuguccuacuauuguaugacauaaagcucacacugcccgagaacacagucaucacugaacugaugaagguuuugaugacuuggguugcaaacugccuuccuccuggcuucaucuuucccaaguucuuccucucacauuggucauuacauuguaaguuuuaucagcugucccucgacugaaagaccguguggacauguuuuuauuccucagucaaucggucacuuccuuuucuacuuucucucuuccuggccuuugagucuguucccuuccugauacccagaaaaccuauaaacaucuacugucuccacuuacaagacagaacucuggcaucugccacucuguuucugauuuacuugaaaggacauuacaauugaaagcaaggagagggagcgggggaagggguggggguggcacugguuaccauguuacucucugagaugcuagagaugcuggcgauguccagagucagugcuauccgaacugggucaccugagaaggaagaaaaaaaaaacagaaagacuuacauagaaacacaaacacaagcucuccuccaucuaaccaccaauugcauccucugcuccauuucagacuccgcagccgguguaucuacauuaguggguuggaaacaaaacucgagaaauuauaaaagcaauacccacauauuagaaauauuugaauaaucugaacuauaaaaauaaaauuaauuuuaucuucccaggagcaaccaguugguaugaaaaauauaaagaguuauacagggacaucaugauucauaagggaggucgcaccauuauuaauuaauggguauuuuaaaaacauuuuaagauuaauuuacuuauuucagagagaaagagagagagcuggggagugccacacacugugggaguucauucucaucucuacuuugcuuuaaggcagggucucucucuuauuggugcuacacagcaagcccaaggcugccuggucagagagcucugaaaggucuucagucuccaccuccaucuccucauaggggugcaggggugccaggauuacagauaugugucacuauagccagcauuuacauugauucagggaacagaacucaggcuguguggcaagcacuuucaccccugagccuucucccuggcccauuaaugcauauuuuaaagagguuagugguaagguucuucuucuucuucuucuuuuuuuuuuaaagauuuauuuauuauuauaucuaaguacacuguagcugucuuuagucacaccagaagaaggugucagaucucauuacagaugguuaugagccaccaugugguugcugggauucgaacucaggaccuucagaagagcagucggugcucuuaaccccugagccaucucuccagcccgguaagguucuucuuauguggaagauuuuuacuguggugccuauaggggcugacuguguagagugggucagagguuuagucacgugauuuuacacauugacuucccuuucuuuccacaaagggaacuugccauggcacggcauggaagacugaccaaagccaagcuccugcuggccccacaggcuuucuuccuucauucacuuucagaagcccuaaguuucagcuugccagaaccgugccaccauggcuggucuuagccacagucuuuagugagccccagcccuggggcuuagggagauuuaaagacuccgcugaggaccauuuucaguucugaagacuggagcacaggggccauuauucucagaagccagccaggccaggccucauucaacuagagauguggaagaagggccuaggagugugaaccgugauuuuagaccuuggcucugaaaucuucuagcucugcgacagcaagagggaauacaugcagagugcuugccaguucucuccaggagucucagaaaugacccccugcacacggccuccggccugacaccauaccugccaggcucugacaccugcccaucaguagucauccaggcuuucucauucucuucuguaaucccagcuaauguuggggaggggacaacuuugcucgccagguuaauggauaaaggcgcucucacuuguauuaaauagcugagagagccccagggaacugugugguguuggauagcuuuugaagauucaacucucucucucuuucucucuuucccucucucucuuucucacacacacacacacagaguggggugguggggggaggggaaggggaaaagagggggagggggaagggggaggggaagggagagagagggggagagggagagggagagggagaggagaggagaggagaggagaggagaggagaggagagagaagagagggagcuaugcaucuauugcugcccugugacccccaagcacauuguuauaccucucugugacauuuccuugugugcuaaaugauacauaacuugcuguucugauucccaaccuaaauucacguggaaguuuaauugauguaacuguaguaagaggugggagcuuuaagaagugauugggcuacaggguugcggccuagcggucaggacuggugcuguuaaggaagaaaguucaucccucccuugucuucuucagcgcucucaccuuuuacugcgggaugauacggcagccagaccauuaaaugcugaauaccagcauuuaaauacuggacacgcuccugcauuuggguuucuuauaaauuacccagguccaggcauuaugcuauagcuguacaauacaggaggcuaaguaccuaucauagaauuggagagcaugaaaaacaguggggcccaucagcuucccucucugaagacugcacaguugaaagcacacagaauucuaguccaaugguguuuugggcuuagucucccccuaauagucuagccuaagccuggucacaguuggcugucuuuaugccaacuuucauaugucuuaugaaagcuugcuuucauccccugaaacuauacaaacaagcugugccaccagagggcaccuuucuccuaggaaaaugguaaaagccaacuccugggcaguguguguaagugcccacuugaagaccauugcuuuauccuagaaaauacuauggagguuuugucuuucaaggacuucaguggccaagaggcuggguguccaaaagcuacaggaaguaagggcacauccaugggcuuacagggugcccagcaagacaggauccauuaggagauggaguggacugucaccuagcaugcuguugggccuucucuccucuguccauucacuucagguagaacugggucucauauuccuuuaagcccacucuaggagccucgcucucagaacaaucucuuugcccaacaucccugucccugguuggccuguugccaugcaaacaugagcaguacuguacugacuuaguuauuugagggcuauggggcaagaaaaacugaucuaggcaagcucuuuagaugcacgugcuuguugcuaguguaaggcaugggaacccgggcauguggugacucucuagguccuugacauaaaggacucagauccucucugugggaccagauguuguccagaucuacagcugagcaggugagagugccugaggguccuggugucugcacugaggaaucugccagcaacugugcuguaaggcugggcaggcaagugguagcauggaccucagccaugcagaaaucuacgcaugguagcauuuuaaggcaggggugauccaaaaugcucagaggcagaguccucugcuggguggcuuugcuuagggaugccuuagaggucuucccaaacacauuuccaucgucacgccuauuuaagacaagcuguccaggcuuccuugcuucucuugucuccucaccuuguggccugagagcccuuucagcuucucucucuaagcuuacucuuuauagaccaacaaauaccuugaagaaucaaugcccuccugucaucugaccaccaguggacuuguauucacaugcuguccuagaucugaccagagacugucaccauuagaggagagaggcaguagggcagguacaguauagcagggaaaugaugugacucaggggugugcuuaaaacaaggaggugggcuaugaaggaaucagggagaacccuucagaggaugguagccuugucuccaagaugugauggaaacugccauguuucuagaaaggcaaguuggaaggguaacuuaaggcagauaaacagucugugcaaaggcacagaagccaggagaguaaggaugcugguggguguuuuaguggcauauuggagaauuuugugggaggagagaauggcaggcugacggaggcuaggcugacuaguuccuggaaugccuaggcuccugggacacgcgcuuagauuucaagcaggcagaugacccaggaggagauccagguggaaaugaggggaggccauuguagguggcagucugcaggcaggaaggcccggugggcaaugcuagugacccauggugaauuccuggaaccuuggauguaguggggaaggaagagaguggcacagguugccagaggcuccugcacccaccaccaugguggagaccacaccucuaucuugcaaguggagggguagagugcuuuuuguaaagguagcacgaaaaaucacagacaauuuuuuuuauccauccuucccaauuccuaaaccaguugcccaucaggacggagucagcaaagcccccugaaguccucugcugcauuuucucacugugugaacugaugcccuggucauaaaggauaaccuaccaccgaaauugggccugaggaauuuguuauauccugcagugagguucucaaagccagguaaggaaagcuugucacuucugcugaccuccacauugaccugguuccccuggaugcacguccuggaaaagagaaugacuuuugaugccuauguuguucaaauauugauaaacauacauugacaugagcuuaauuggcccucccuugugugugugugcuccuucguguacguguauauagguucacauaguaauuuuccuaaguagaaaucucauguuuucuaguuaaugaauuuauuucuauuuucuuucucacuugcuauagagaaaacucucaugauaauuggcaaacccuccaaguaucuuuuuuuuuaaauugauuaauugauuauguauguauauguaugcacaggcauauguaccuauacaugcacaucaugucuuucucuauuucucucuaccuauuucuuugaggcagagucucucccugaaccugggacucaauuuucuuugccaggcuggaagacagaaacccccagagauccucuuaucuucuucugacucggaagccccaaaauuuacuagcauuuauggggugccaagcuuguuacauggacacuggaaccuggacuccaguccucuugauuacacaguaagcacccuuagccacugagccaucuccccuauuucuuucaccaagggccuuauugaaaacaaacaaacaaacaaacaaacaaacaccacaaguccaucuaccugugaccauuuuagaaacuuguucucuaaaacagaaugaaccacagagaucuuguuguucgggugcuucgggaaaugaggggacuagguuuuggcuugccacaaguuaaaugggaaaugcuugcaagccuuccugucacauggucauagcagagcagcucacucugagccauucugagguagugccgcucaccucugagugaggagacucagacacaggaaggccaaauagaggcuguagcucauguugaaggagcugauucacacacaaaaagguugaaggaggaaucaccuagggagacaagauggggcgagaugagggggauaguccaaagguucaccucccuccagccuggcugucuucaugaguugccaggggcaguauuuucccaacaugcauggggaacagccucguugcaacuguuuaguuuagcaccugcccacugugugucauccaguacacugucauuugggaggcuaauauuuuuacccaucccagauaugaguggaauuuauacaauggcucaucagaacuagcacccauagccaguccacagcacauauuugucuguguauucgagaagcuccacacuguccuuacugcaucccuguuuaacaccuccaacucuacauucuuuuuuuuucuuuuuuuuucagauuuauauauuuauuacauguaaguauacuauaguugucuucagacgcuccagaagaggagugucagaucuaguuacagaugguugugagcgaccaugugguugcugggauuugaacucaggaccuucggaaaagcagucaguacucuuaaccgcugagccaucucaccagcccccaacuuacauucuugcugaccaaaccagacauuguccuguuuaguccagcauccagaccuucuaggcauguuguauucuuaccuaaccuuccccaugcacagugggcagguccaucccugucuuauaucaaggaaacaggcucaaggaaagcacauucaaccuacgaaugccagaggugaguucgaaucuagagcuggcugccuugucugaugccuccaggaccagccacagccuaugcuuuucuuggccugaagaugcucagcacccucauaaucuccuauaccccacugcaggaguacugacaccauucgacugcuaugugccaaugugcacaaaaggaccgucgaacaacaugcuccagaggccuggcucccucggugugggaucuacagacauccgucagagagcagggauugcuagcuaacagagcagucuuggacaugcuaugcuggugacauacacggcagggugguggccucaaguucaggccucuuccuagguauuccauucugguaccugcuuaccugugcuaacccuggugaguccucccacucucuagaauguaagagaucuggagcuuugggccauauugagccacuuauuuauuaaguaacaugcuguugacaaaaccaauaauuacucauuauagaaauaaaaaugaacaaaaguucauuaagacagaaguguauacuguaguguaugccagggcagauguauaggguuuuuuguuuuuauuuuuaaagauuuauuuauuuauuauauauaaguacacuguagcuaucuucagacacagcagaagagggcaucagaucucauuacagaugguugugagcuaucaugugguuguugggauuugaacuuaggaccucuggaagagcagucaguguuuuuuuuuuuuccugagacaggguuuuucuguguagcccuggcuguccuggaacucacucuguagacugggcuggccuugaacucagaaauccaccugccucugccucccaagugcugggauuaaaggcaugcgccaccaugccuggcgcagucaaugcucuuaaccacugagccaucucuacagccccagauguauauuuuuaugagauuuacuuuuauuuuaugugcaugaguuguuugugcuggcaugugugucuaugcaccauaugcaugcaaugcccauggaagccagaagagggcgcagaauugucuuggaacaguaguuacagauggcuguuagcuguaugugggugcugggauuugaacccagguccuccagaagagcagucagugcucuuaaccacugagccaucucuccagccccaguacauauuuacagauaggaacaaacaugucccuaugguguaggaugcugagaguaggaacaaucagucuuacguguguagggaguucaaucucaguauguuccuaaaacugcuuuaaagaaaaaaaaaaaaaagaaaaaaaaaaagaaauugauuuuaaaagaccugucucaagaaacaaaggaaaugcuuagucccucugucauuucucauaccccagauguugcuguuguuaacaauguuucuuaucccaacauacaccuguauucacaaacacacacacacacaguuuugcauaaaaaauuaaaaagggaaguugagugcuuuugcgcuuuguuacugcuuuauauguauaaauaaacacauuuacgcauaaaaacugaaaagcagcgcuuguccgugguuguuccuuugccccacuuggguagagagcugcuguuuucugaacaccugcuaugcuaccgcuaccgcuuccugagcuaagucccucuccagucuucacagaccucugaccugaccaagaugauucucaucuacaaaggagagagcugaggcuuugagaggaagugauguccccaggguuacccagcagguaaggcgcagcucaaguguaaguagcgauccaagucuuucccuuagccacagaaaccagaaaggagcucuugucugugguagcugcagcuucccaugucagcuucuacagaucugccucccuaagacagcaggguugcucagaccaugaacaugcgaacacuuuuaugccacguguccuacuuaugaguaccaauuauuuucagaguuucuacuuuuauaaagucagcaaugaccaccuuggcaugcaagauauacucuauccuguuccuuuucacaguggaaaaaagguggcugggggggugggguggagcucuaaagacugauaaagaaauggaggcuugcucauggccacuggaaaccacacaccaaaaccaucagcuguaaaaccagcauucaugcuugcuuucuuucaugcuuuuuccuagucccuauuacucuccuugcccccagcauacaauuuaagaggguccauggaaaggcuugcuuacccuccaucucuuuaacauuucaaaggguaagugagcuucucuuaaaacccagaugcaugaccagcagagguccugucuggugaggucagagauacgagagcagaaagguuucugcuccaucagaggggagcaagccauaagucccacguccugucaccacccugcauuaggagcucaggcagcuugauguuugguguaaugagaaagugagccaccaguuccccucaagaggauacugcagggccagggugggaacugcagagauguuuauguuaauuugauucuagaagaguguguuacaacuuggccaguuggauauaggaagcugacaccucuagaagcugauaaaaauggaugcuugccgggcuggagagaagguucagcaguuaagagaacugacugcucuuccagagguccugaguucaauucccagcuaccucaagauggcucacaccauuuauaauggaaucugaugccuuuuucuggucugucugaagauagcuauaguguacucauaugcauaaaauaaguaaauaaaucuuuuuaaagaaaaaucgaggcuugcccauggccacuggaaaccacucgguuuuuccccuaagcccuugguaucugcgaauuuuucccaguguggccugaacugguccuguccucaucuaaggagacuccucaguuuucccaccuucuguaagaaucugaaucugccuuuaucaagaacauuuggggaaccauuuagucuuuaucuucaggcuugcugugaaauagguauuuccuggugaccagucuauauuaggaagacaauauugacaacuugggccuccaaaacuucucuaaggacauguaggcucugguggcugcauucuuucugcuggcucuacuaggggcccaguaugccucaguguagcauggaagagcagugggcaagccugggugucauccuggcuaucugguucaggagaggaaccucggacuugugauggauucagcguagaucccacuuuaguuaaguggccacugucugaacaguauuucccaaguccuugaucuguacagaggucacaucuggcaccaguuuacuagcaugguuuucucgggcagggcccacaccacuaacaccuuucucacuucagccugacauggagaacucagaacauaccgggcacaagaaagcaguagugagccgggcggugguggcgcaugccuuuaaucccagcacuugggaggcagaagcaggcggauuucugaguuugaggccagccuggucuacagagugaguuccaggacagccagggcuacacagagaaacccugucucaaaaagcaaaaaaacaaaacaaaacaaaacaaaaaagcaguagugaguuaggaggcuagaaugugacaucuuuucuaugauggagaaaguccuugguuccccagggaucacaugugacccugcuccuuaugucaaauccacuuuggggaucagguccuggaaguucagcaggagucaccagcccauauagcugaugagccaaucuucaagguacuauuuauaugucuacugcucuugauguaggcucaguccucucuuuuggauacaggcaucagagccagcacuuaguggugaucaaagaccaugagaggguagguggagauuccagccuucagcaguugcgccugcaagguggauuagcugaauccucuggcuaaaaucuccuaucuguguguagaggagagccugggcuuuggaguuagaucaagcugagucauaguuaaccucucagcuuugguuucccaccugacaaaucagaauaaacauaaacaauaaauaguacuuuccauuugcuucacugguucuauucucggugucuuccguugggggauuuaguaaucucacugguucaagaacaauuugaagcugaaacuacuccuugcauacucggcugguaccacccaagaagaacaggucacacgcaggacuugagugucaccugggaggcagugacucugagaagcagaggugauucugaugggaauucccaccucugcuccaucacagaaaugccugagugcucuaugcucuagccuccuucacacucacuucuguucccucauccugucacuucagugggugugucauguguggguaggcagguguaguugaaaggucuuagugcccugaaucuuccccaagaaaaccaugaaggugugccuugugccuguuggucuagccuggcagcagagaggaaaaugaugacauuuccagugccaggcaggguagugccaaccugggucucucacucugacagagggcaucgcacuacacucuaagaccugaggcagaguuagggcucagcagauuccaggccugccucccucccucccucccucccauccaccccagcagggcucacaccugcagcuccuuacugccuucuuuccaagcacaagggaugccagucguucccuuaccaggcagcuguuacagcagguguuuccagaucucaggcaggacucucacacagagcauacucuuuugggucuccaggguccuuuucaucucaguccugacucuuuggguguuaaguaugcacccagucuccgauggaguggcgcgcucucucucuggagaaguuggagcugcug

SEQ ID NO: 5934 - RNA, 2019 nt, Mus musculus
aggauugggacaugcagaccugugaguccaaaccccuuucuaucuuuguaagugacuugucucauauauuucauugcagccauugagaucugacuccuguagugaaugaguuaaguaaacauuacugaggaccuacuauguguucaagucacuccuaaggugaugcuuccuuagagagcuccauggaccaucuuguguaggagaaucacaugcuccagcucucuggccagugcuuugcuuuucuucaucaccugagaugcuuaccaaaggcuuaugaaugaaggggugugaaggguugcuaggcacuggacuagagaagguagugaggcuugacugcaacccugaggucuugggaagagauguagacaggacuggaggagagcugagaaagggcuggggaggauguggagacaggguagggaagagcaagagugaaucagcucagugaccugggcaggugugauggugacacaaugggaccuggaaggauagaagggagaggagaagaagguugccacaaagucuugaaaggcagacuagacaggguuucucaacuuugugcccaaagcuagaagcaacaucaggagaacucauggauacuuuggguaccaggaucucaguggagcaguucauuccacacuuggaaaagaaacugacuuagaaggugcccugaggucaggagauauggcugucacguugccuaaggaggcaguccaggauggugugggagcuacaaagcccuuucuggucuuccaauucugagaauauccuucaauucugagaaugcccugugcaggagaaagagcagagauggucuaagaucccccccuggcugccuaggguacaggugugugagauggugggcagggugaggagggaggcauuaggcuaaggccucaugucaacaucauucaacuucauccuuacccuuuguuagaugugaugacagucugcccacgugacccugaccaguucaacuugcaauaaaucaaggggaugcuuuaaagacuagaaccuuacugcugcugcugcugcugcugcugcuacuacuauuugagcucaggcaagucuugaauucuuugugauccucuggccuccuaagugcuggcauuacaaaugugagccaccaccacaccuagcuuaaaggcuggaauuuuaaaaucaaacauuccaggguucuaaucucguucugcuagugccuaugucuggauccacaccuccuggagagugugacuggcagcacccugcugguauggcuauugagaggcucagucaggacacgagacaggaggauguucugcaguucguaggagugcuuuuccuugguacuuucucuucccuugaccuuccugguuccugcaguugugauggggcuucagggaggacaagaugaugaggaaaaauaccaagaagaggggagacuaccaaugaagauccagauucugaaguucaggauggacuuugcaacccauguucuugguuuuccagaucaagucccugaaccagugaacccggaaggaaccugcuggugaagagggagcccagacagaggagaagcaagagacggacuugguggagucuguuuugaaccuacucucucaagggcuacaguggagcuuaugcauguggcuuuggggaaacggaacccuccguuggccuuuggaauucaggaugugcacaggcauagucaacacucacuccuguguagcuugguagugauaaugcuucugucucuccucugcucagggagcucugugguaacagaagaugaagcauggugagauacugugguccuuucauuuguguuggauggaagaugccccugucagcugaggauccucagcaaagggguuagaagggagcagagagaagacacgccuacaaaggccuugccauuaagcauagaggaugauggagugaacgguaguccaauucuaacauugauguggagggccauaccuucccaugggauucugccuuguuaaagucagggcauugguaaauucucugaggaacaaa

SEQ ID NO: 5935 - RNA, 24489 nt, Mus musculus
cgugagaaacgugaguucucgcgggaaccguauucaaaaauccccggcgcuuacuuagcagugcugcugccgagugaagagggaguuauuucugugcugagguggaguuagugucacgaaucugggaguccagugcucuccggacaggccuccgguugcagcagccaggaagcgugaggagagagguaagggcgagcgucgggaagggugaaccgggaggaggugggaggaacgccuguucucaggaaccugaguucucuggagccgccuuccgggucgguguagucuucggucggaccgcuucgcugcggguuugacugcagaaggauaaauacggugcuggguggucugggaccuccgagucuugaauucuccaguacccuuagccaguggugcagucugaauuaacuuacaauuauguagcagacacacaggacggagucucauuguaacaucucauucgcuuauguuuuacuuauuuacuuuuuuuguuguuuuucuuuuauucacauuauaucccaaucgcagcccccuccccacuuuccucccagucccgccccccaaucccuauccccacuacuaccccucccucuuuucucagagaaggggagucguguccccccccccccccaguaccaccucauccugggacaucaaaucccagcggaguuaaauaagcauguuccaaccaggcgguccagguaggguaagggguacaauggcaggcagcagagucagagacagcccugcuucaauuguuaggggaccugcaggaagaccaagcugcauaucugcuacacauacguagggggccuagguccagccccugcauccuccuuaguuggugguucagccucagugagcccccauggguccagguugauugacuugcaugucuuccugugguggccuugaccccuucagcuugcucaauucuauccccuacucuuccucacgagacucccagagcccugccugaugccugaugggccuuugcuucugcuuccaucugcugcuggguuaagccucucaagacacaguuauguuagggcugcaaacauagcacggggucguuaauagugucagggguuggcucucucucaugggauggguuucaaguugugccauucagugguucugcuccaucuuuaucccugagccuccuauaggcaggagaacuuugggcuugaaaguuuugcuuggguuuguuuauuuaucuauucaaugauuacagauugcagugguaacauuuuggauguuuggguuaaauguuuucacuuguacuuauuugugaaaauguaacuacccccaccccccaaaaaaaaguuuaaaauccguuuggcuggcaugguauuucuguugaugccuaguaagaauucauguguucuuaaucuaguuagaugccuuuuacucuuuuuguuuuuguuuuuguuuuguuuuguuuguuuuucgagacaagguuuuucugaauagcccuggcuguccuggaacucacuuuguagaccaggcuggccucgaacucagauaucugccugccucugccucccgagugcugggauuaaaggugugugccaccaccucccggcuuuuuuguuuuuguuuguuuguuuguuuccuuuuacucuuuuuaucuuauagaaucucuaagauagaugaagcaagaugcucacaaaacuuuuucacauugauguagccaguuggauguggaagugagcuuugagcucagauagcuagcucauccacagaacuugcugacacuuaaaugccuuauacggguuggguuuuugagaaguuguggugaaaagugauuagcacacuaggcuuuggagcuccacuuugauuuuuaugucauuuagccacaucuguguaucgccuacuauuuucucucaaaccuauccuauuuuguuuuguuuuguuuugauuuucugagacaggguuucucuguguaguccugucuguccuggaacucacucuguagaccaggcuggccuugaacucagaaauccaccugccucugccucccaagugcugggauuaaaggcgugcaccaccacugccuggcucucaaaccuauccuaaccaggcuuuugccucacuucuccaccuugggccagugaccugcaguuuccaguuucucaucuaauuugccuuaguaucauuugccgugaugguuucuuuccaccuccuggaggaauuuugucuuuuuggcucccagaaacauuacaugcuuuccacuuacuuccugaguaguaccugaggauacuuccggucuuuccuucauagcagccuucuguucugagacuugucagcaguuuugcucaucuucuagugauaaggaaucuuaaggacuuaauguuggcacucuccaaauuuguauuuuuaguacagcauauucaagucauacugaaaauaugaauucuugcuuucuucccuguaacauuuuuuuaccucagugucucagccgaggguagcuccauucuaguaauugcuuaggcagaaggcuauauucauuuuucuuuuuaccucccagaauccaccuaucagaaaauuguauugacuugaccuucacaaguuuuguagaguuccgccauuucucacuaccuacugugcugucacugauaagaggaauuguccugcaauucagaaaucaaauucuaauacccuuuugguuuucuauggcaguacugcugaccauauauguuucuucucuugcucugaugucacuacauuuagucccacguucagcucacguaguuauauuuuaucuuuccaguagguugagaacagacaucauggaggcagauaucacaaaucuucggaacaaacucaaagagugugaagacgagcgacugaaagcugcacacuauggccuacagcucuuggagaggcagacggaacugcagagccaacuggauaaaugucaugaagaaaugaugaucacagcagagguaggguccaguauacuaguuuacaaggaaguacaucggaacuaaaaacuuguuuugugugguagcuauccuuucucauuugaagaccuaaacugucccaccccaacuguguugaaaaggaauuuccaguguucuuuccaacaguugguugccucugaggucagccugguuuccuugcuacauuuacugccuggugugguucaauccaugcucugcgucagugaccucacuccuuuauaguucuaaaccucugagugcuccauggccuuucaccaagccuuuaguguauuccagugccugccacugaugggcgucucaagcuugacacaaccacucucugucugcuaacuggauguucacuugcuuugguaagaagauuggcauucuggauaguugcuugagccugaagucaaggggucccacauuuuauccaucaauaaaucaaaggacuugacucacaucuuaguuagguuucuacugcugugaugaaacaccaugaccaaaagaagcuugaggagaaaccguugauuucaucuagagaagucagaccaggagccuggagccaggagcugaugcauaggccacggagggauggaugcugcuuacuggcuuggccagccuguuuuuggacaccacccacagugagcugggcucuuuuacaucaaucauuagugaauaaaaugccucacagacuugcauacaggucagucuuacaaagguguuuucucggcuaagauuuccuccucacacauaugucuaaguuuguguuaauuugucaaaaaauaaacaacucacacagccaaaaugucugccuaagauacugcagcucuagcccagaccacagccaucuuuccauuggacugcuguagccuacugacugcuugccagcuuccaccauuaccauucauacgucacacauucaaguggccaugagaaaauaacaagguccccuuucuuccuuuccuucugaagccgcacagggcuuucuauuguauucucagagucugagcucuuaacuuggcuuuguauauccucguguucuggccucugccuaagugagcaccauguuucaaauguguuuucuguagucuuuccuguacuggcuuuauacugaacguuucuucuggagucauucauccacucuucuugacucugcccucaaccacagacugucaguuaaauguccugucagcaugauggcuauacacugacuguacaaugucaaguugucaaaauuugcucuuauuccucuccuacugauuaucuccagaguugcacgcugcaugagagggaauuuugucuauucuuauucacuaauauacaccuguugccuggcccacaaagauuuuucaaauuacuaaaucaguuuaauauuaaauguuuagucuuuuaaaacugaacuacagaauuaugcauauaacagguagacaucacuaauggcagcugucauuuuuccaaguacgauuuacuguucuuaauaaguacuagauggcaaaucaugaaacaaagauuagauaucucagaauggaaacagucaugcugcacaguuguuuuggaaauaccucauggaauuugggugucuuuaaaauagaagagcuuuggaugggaggggagguugaugaaaauaauucuaaccucuuuucccuuaguuuaauugaauuuuauuuauuuuuuuguuuuguuuuuaauguguuucuuuuggggggggcuucgagacaggguuucucuguauagcccuggcuguccaggaacuuacucuguagaccaggcuggccuugaauucacaaauccaccugacucugccuccgaagugcugggauuaaagacuugugucaccacugccuugcuuguuuuaauguuuuaauuauucuuugaaaauuuuauacaguauauuuugaucguguucuuccgucacccccaaacucuucucagauucucucuaccucuccaccuaacuucauacauuuuucucucucuuuaaaaaacaaacaaaaccauggaguucaauuuguguuggcugacuacuccugaggauggggcaugcccuagauagagugugguugauuacccagugucaccccauugaagaaaacugauuuuauucucucccugagcugagauaugcucuggcgguuuaugaaggccucaaaugugcugucagagcuucuguguuuuuaugcgcaucugcccuguugugccuggaaagcacuguuuuuuuuuuuuuuuuuuuucuugacauuauucaccaccucuggcucuuuguuugcuugcuuguuuuugguuuuucaagacaggguuucuuuguguagcccuggcuguccuggaacucacucuguagaccaggcuggccucgaacucagaaauccaccugccucugccucccaagugcugggauuaaaagugugcgccaccacugccugacuccaccucuggcucuuaaagucuuuuugcccccucuuccaaauggauccuugaaccuugaagagaucugugcucuuuuagcagaauaauaguuauagguuucccccuagggcccaugaccuaucuagccucggauucuuggcuucauugacagugucagguauggguuucaucugguagaaggggaugggagggcucaaauccaaguuagaaaguggcugguuacucuccugacacucaagccaugacugcagcagcaggcuuaacuuggaggaagucaugaagguuuuuagcugagugagaucaguuucgcuuucgcacauugaacacuaggcagucaggugaagcuucuagauuucuccauguuguggaggacaaccaauaaccuuggcaauagucuguaauauggcuagugggggaaggcaccuaugggacucuauuguccaacagcucaaaaauaagcaucccauugcugguguuggguuuuauuugggaguauauauggucugguuuagguauuacaccuacccagaauuauaugaugacacuauuaaacacccuuuuuauagauauauacaucucaggaagccuuuauaguuguuuuugcaagauuuuuaguguuaguuguuccucccccaaaucccuccucuccccugcuuuaucucauuuaaaacaaaaauuagaaggaacuguaauacuuuuuuaaccauagcauguuuauaguuauuuuguaaauguaacaaugcucugaaaguauuuaguauuuuuuucuuuuaguauuuuguuguuuuugaaagcaaucaaggaagaacaucucauuaucaacuaguaaugcuaaccaggaacauuugaguacugguaaaauauccuuuuuuucucuguucuuagggauugauagaccaucaugcuaugggguuuauccuuccuugauagagaacugcagcaauugcuauuccuccagcauggacuuugacauauuucuccugucuauaguuguccauaaauaauacauggacaguucuagauauaaauaauuuauguaaaauaauaauuuauaaaucuguagugauuauguucugcuugggacaugaaacacugucuagcagguguuguuccucuuuaugucuuguaaggucaugagucaucuaacacgaugucauaugccucacaugacuacugucacauuucaucucaucacaugaacauuauacuaucuagcaucuaagaauggugacuguauguaauacaguaagauuuugagagaaaaaugacacgaaacuuuaaacugcucuuuuuuauuauugguuauaucauuaauuucuuagugugccaaauuuaaaauuaaauuuugucaggucagauacuauauauugggugugggugagcaugguguauguagaguuugguauuguuuguggauccagccaucgggcagggcuucuggaaacauuccuagcagcauguaagauacacaugccguccaaugcugagcuuggaugucuggcacaaggugaucucgaacaugcuucccuuguauucugugcgucccagcaucuggauccaugagcauuuucuccugcugcuuugaaaauguguuccuauaccaguucccuuagaaagccucuucuuagccugcccuugucuucaguaccagucacuguagcuuaaaguugcugaguguuuuguuuucgaugaaucuugagguuagacaccguguuuuaccuauuucugggauugguacccggcacauuugcuugcuuuuugaguaugcacagaguggauagucguuggaaaggagguccgagugucuccagcgaguguuucacugagcugguugcaguguuucugguccugugauaccaaagguuuccuuuacuuuuucuuguugucucgcaaguggauucuaauuauggaaagauucuguuauugugcuguacugaauaaaaaacaacuuacuguucuaauaaccagauaaauucuuaguuuuugauuagugugugaaaaggcuuacuaccaugacaguuauuguuuagccaagagcaagaauguuucaggaaauccuuaacacucagcagucugagguuucuuuuggauuuugaaauccagagacugccuccuccauuacuguuuguauguuggcuuccagggccacagagaccgcgaauuggaaggcaaaagucaguaauuuccugggauccgugccuuuucuucuuucagcuugaggauuuugagaucccugugauauucaaauacaccuuuugggguucauuaagacugauuggaagguuugggcuuagaggucauuugguaaaaugcuuuccugagucuaguucccagacaugguagaacaaugucuuauuguuauccaucccagcucuggagagucacaaguagguggaucccugggacucagcccacuggcaaucccuccuacccuacuugucaggcaggcagguuuccggucagugagagacucugucccaaaaauaagguggccauuagcugaggaacaauaccugagguugucaucucuucugcaauaacaugcauguacaugugugcuuccccaugugagcaugcauguaacccugcucaaaaaggaaaagacagauuagcuauguuagucccaguuugacaggugguuguuccuuggaaagcagcaaaugaaaugggucugaagcagcuuaaggugcuaacugacaauauccaaugauugaagguguuuggguuuguuuuuccuuuaugcauuucaauguguuuucagaaauacaaccaagagaagcaugcccuucaaagagaaguggagcucaagagucggauguuagacagccugagcugugagugugaagcucugaaacagcagcagaaggcgcagcuggagcagcuagaggugcagcuacauaggagccaccggcaggaagugagcgaccugaagaacaaggugugcgucuguucagaguaagauacccugugcuuacaggacugucuguaaguacuggaugugugggcgcuuaaguacgagcucugcaaaacagcuaagauaaguuuucuagcuuaaugguuugaguggaaacacugagaaacaagcuguugaacaaucaguauacauacuagucuucuaauuacaugcaguaauuuauuuaauuauuuaaauuggguagcugaauauuuguauuugaaacauuuguaauauuagugaccaguguagccuucguauauagcaugugaugugguucgccuggcaagauaacugacuaguccugcagcagugccugcaguuguguccagcuguucugcaguacagagcguccugccuggggagggaaugugcuuuagaggggagacuuuguaaucauccaguccucacaagagcucugugaaggagggaacauugucuccauuuggcagacaagagugcuaaggucaggcaaacugagaaaauugaacaaaauaagaaccacaaauugucaggauacccuggaacuggcuuugugcgcuuggucuagugguaccuuauacacuggcuccauucuagguacagacugggcagcuguugagugcguccauucacucucaaaacaccaacugcccggugccuucuguuucuaucugagaaauguagggccuugcuuacaugaaguuuguaacuugauuucuuuuuagauccuacucuaugaaaacuugguaagguuuucuaaugccuuaauuucucagaagucuguuuuucaauucuuaguauuuucuauagugucucuaaauauuuuuccaugucuauuuuuaucucuaauuuuucauucaacuaacuauauuuuuccauuuuaaauaaugguaucgguaaaaucauauuuaaguaaauaaugcuuuuguguaucuugccuguggcucuggcagguaguaauccuguuugcagcuaaucugauaugaaauguggauaacuagaaaugagguucccacauggaacuagcagcaucccuaauuaccuaaguagauaugauaaaggaaguauuuggggacuagguaaggcaaaaauaauuaaaauuuauagaagaaaaaguaaauuuuuaaaaauuaugauguugcugauauucucaaaccauuuguuauuaguaucuuuaagguuuacucauuauauuuuucuuauuucucacauuuaaucugucauugaauuccaaggaguugacuuauaaaguguuaugguagcuccugucucuguaguccagaccgucgggacuaucagcagacuacugugguuucuaauugguuaccugcuuacagcgugguuacccaugcugcugcugccaccacugcagcaccuccuccuccucuucuucuuccuccuccuccucuaccuccuucucuguuccuccuccucccucucccucucccuccuccucuuucaugaagaugaggaguacuucccauucuuuacagauaccucaugguuagcucuaccaccuucaguugcuucuaagaaaaccagggcuacuuggauggauaguguggguuauuacugaauuuuuugaaaagacacuuaguggguagagauguaacuuagugagagauauuuaacuugaaaacccaagaagacucugcauucaguucccagcaccauggguuggggagggagagucacuuugcucacaucacucagaugcagcaaguuucuguacaguagcaacuggaaagucagguauggacucugaauacggcuuucagaagggcaauggccuuugaguuuggagguugugaaucuuucugucucuuuucuggauuuaguuagaaaaucugaaaguggaauuggaugaagcaaggcuuggcgagaagcagcugaagcagaagcuggaucugcagggggaacuucucgcucacaagucagaagagcuccggcuccugucugagcagagagugcucaguagcaugucuucggagcugcuggcucuugagacugagcugacggcagcggaaggugugaagguaauucauaacucaggcgucuucuuguuuuacuuuagaaugucucugcauguaguuguaauuaauuauucuuaagaacuagcuugaggacugacauggcuuuugaugcaaccaaaaucaugcugcagaacuuucagguggacugcuucauucauaaaauaauuuucuauuuuauggugaugugagacagguuuuauauuauagaaacccuggcgucauuuauaggcuuuuauucugaccugaguuugggucuuaaaagcccaauauaaaauauuagcauaguggaaauuaaaaugugugucaauauggauuuuucauuucaacuaaagauaaauaaaacuuaaaauucacaagauaaggggggcauuuccaagguauuuuuguugguucucugcuuggaagaaagaaagaaagaaagaaagaaagaaagaaagaaagaaagaaagaaagaaagaaagaaagagagaaagagagaaagagagaaagaaaagaaaauuaaaauaugcuuggauauacuuggcaaccuuagaaugguuuucuuuugauguggguugggaaccaauaauaaauacugaaucaacugcugagugagaaauuaugucuguguuccugcugaacagaaugcccucaaagaagaggugaaugaacugcaguacaaacaagagcagcuagaaugucucaauacuuccuuacugcaccagguagacaggcuuaaagaagaaaaagaggagcgugagagagaagcggucucuuacuauaaugccuuggagguaugaugagggccacugcacucccccuuaguagccccgugcccucugcuggacuccauuacugaagcuggcuucuuuuccaccuagaaagcucguguagagaaccaggaucuucagguacagcugggucacgcacuccagcaggcggcggaccccaauagcaaagggaacucgcuguucgcagagguacuugcaagccuucuccugacugaguugacuagacuggcauuccauuuacuacaggaacaagcacguugaucuuuuccagguggaggaucgaaggguggcaauggaacgccagcucaacuugaugaaagacaaauaccagucacugaagaagcaaaaugcguucaccagagaucagaugaacaagaugaagguauagacugcuaaaggcuuucaaagcugcaguccuagcacugcguaugcaaguauauacaggaaacauuuccuucaggaaguguacucucaggauuauuuguugaauugcaggauucucauuuuuuauuaaaaaaaaaacaucuugggacagcagcugcugauagcuuuagugguuccucagugagucuuucuuguccagcuggaaugagagaguccauuuuucucuuacaacauggugucuucuugagcacaacacuguuuccugcuucaccuagacuuacucucucaccaguucucacaugaaggccuaggcuuuauuaagucuguacugcucauggccccuugucccugcagcucauuaagucaguguagacugaauuggaaggcucuuuuucauuuccuuaucccggucaacugagagguuauggggaagcugguagcaccaaggaaaacaguccugucugcaccugcccuguggcuccggccccucuucccuuuugccugaugcugcugaagagauauggauugcuacaaagacucccucuuguuuucucuuuguaaguguuuacaacgcacugaggaaauucaguaauugaacuugagaguuaggcgaucuacuugagaugcaguauuaggucuaaagucuaagugggaaggugguagccaccccacgccucuuagaguuguccuggacuuaacauguaguaaaacaccuuuccaucuuugucauuuacuucuguagguaacuuaauaguuuccccacuuaauuaaaaauuuuggaaaauucucaguagacccauagugguaauucaagugaugaguagcagacaugguguggacaggcucuuguaccaucugaagggcauacugccaggccacagcauguaggcuaauguacguuucacagacacauacguaauuguguuaaagaccucagagaagcauuaaaaaaaaaagucaaaauaaauacuccaaaguaauauccacaacaaaacuuuaaugcaaauguuuuuagauuaugagaugaaaaagaaccauuuacuuuccaacgugaguucaaaucuuggagcacaaaacaguaaucauacaagaacuauguuuaccaggcucucaguugugaucggcugugugugugguuucuuuucuaguuacaaaucuccacauugcugaggaugaggggcucgcagacugaguuugaacagcaggagcgguuguuugccaugauagaacagaagaauggugaaauaaaacaccuuuuaggggaaauuaauaaacuggagaaauuuaagguacaugucacagcuuuucaaaagcauagccaaacucugugaauugaauuucucaaugguuuuuagcuuccauaguuuaucaugcaaucaacuuucaggugcagcacaaguugacccaagguaaacucucuugaacucgcagcagucuuacgucagccuuguaugugugaugugaagucaguuccagcaucauguguuaaauuuggccccagugaguugcagguuuaucagcuaucucagaaaccaaguugcuacguguaugugcacgcaucucuccacauuucuggguauugguuuaccucuguagagcaguguuauuuaacuuacaguguuuuuguacuauaugcuuuuauuuuuaguuuuagacuuuauuuucccuaguuuuuucuucacgaugcucuaguuacacuuucacauguuugcuuuucucuuaucuaaugaacaaccaccuuccccacccacccccauuauacuuauuuuggaauuaggaagauuggggguucuauagucuauaaaauugcuugcaaauuuuugaagaaauuuacccccacccccaagagaaaugcaaauaauuuucuucaaugcugggaguagggggugggauaucaaaaauaacguaaaggauuucuucuccgugguuucccaguuuauggcuuucucuaacguccagaauugaacccaggagucauugcuuuuuccauuguaagagcuagaagaaggaacagccggggguugagggggcggggagggcuggugugguugggagccuuagucucagaauuaaacauauuauuuucauguccuggucacauugagccacuuuccuuaugugaaaaggggggcuguugauucuuccuucuccaaaaggcagguggcuauggaggacgguuguuagcauggcagccucaaacuuaggagcaucuacuuagugguggcagcugccgcuauagcgagccuggugugcugucuccuuuguauaaccagaguguuugcuuucacuagaacuuauaugaaaguauggaaucgaggccuuccacaucagacaccgcuugugugcuagaagacagcaccuauuacucagaucuacuucagcugaagcuugauaagcuaaaguaagugguggcgagugugauacagugaagggcuuugcgugcugacagugguauugcugauuuauuucuuguuuuuaauugucaagaaauuucagaagaaaguccauaaaaauaucuuugugcagcauauggguuuauauaaaguauguauuuuauguucagcaucuaguugguaagugaaagguuuucuaaguuucucaauuagaacuuaagaacgaaucccaaauaauucaaaacuuaauucaugugugcauuugggaaaaauauuuucuuccucuguuuccuuucaaggauuuguaaaagucuuguggagguugcauuguuaggacuuauuuaauuguuuguuguuucuuuuuuuaaugcuaaaaaucucagaaaaaaaaugccuuuuuaacacgcaagguuuauuucaccaugucaguggcaugcauucuuuucauguucuuuauucuuuccuguuacuguagcaaagaaaaugaaagcacaaaggacgagcuguccauccagaggaugaaggcuuuauuugagagccagcgggcccuggauauugagcggaaacuguuuacaaaugaaagacaccugcagcucucagaaagugaaaacaugaaacugagagcgaagcuagaugaacucaagcugaaguaugaaccggaagguguguucuauaggcucuuaccuuucagauugggaggaacccugagaaacuauaaaccaacuugucauuaugucucuaguacaguggagcugucaaauguguaggaaaacuaagagguuggucacugcauaagcaugaauauaaucauguuuucucuuaggauagcugaguucaacauacugaauagcaagaacuugagcuuuucuccuuuaagauuguagcaucucagcugggcaugauggugcacgccuuuaaucccagcacgcgggaggcagaggcaggcggauuucugaguucgaggcagccugguccugaguuccaggacagccagggugauacagagaaacucugucucgaaaaaccaaaaccaaaaaaaaaaaaaaaaaaaaaaaaaaauuguagcaucucaggguguuccaacggguuuugaaguuacuuugaggaagggucucacugaguaguucaggcuggccucauauucauaaucuucuuuauucugccuccugaauggaaucaaagauguguguuucauuucguugaagcagcugauaccgagagcuagaccaguuacagaagaacuagcaagacuucuguucuaggacuuucuccuuccuuccucucucccuaacucccucagcccaucuuucuccccuucugaugaaccucuggaggagcauuccaggacugauggaguacugugcauguuaggauccaggcucuuuagauguugucuguugccauuccauugaccagaaacuagucaugugucccaggacucaccaccagaaaugcagagaagauguaguuuugaccucaagagcuauccauauugagaguucuaauuguuuuucuucugacacauaguaauuggacacaagggugcaaugugauguuuccacuuauguauuguauaauguucaaaucaagguaaauuaauauccauuccuguagaaacaucucagaauuacucaugauuuuaaguugaauaucuuauacuuuauccuuuugaaguugagaaaacucuuugaaaguuuucuuccuaacucugacuuacaaaguacguuauuguuaacuguggcugucaugguguuagagcucccaggcauaggagaucacauaauaguuacuuuuuaagcauguauuuauuauugcaugugaguguguaccuguauguaugugugcuuacacagcacagcaugugugugcugaucagacaccaacauuguaaggcuggaucccucuuucuaccucugcaguuccuagagcaugaagucgcauucucaggcucaugaggcaagcaacuaccagugagccaucuccuagccccuauuuugccuuuuuauaaagucagauuguuugugagguauuuugguuugggguuuuuauaauuuguagacacuaauguuguaucaggcguguaauuugcugauguuuccuucuacccuguagaugcuuuucauugcuuccuuugcuguuccagggaucuuagggugauacagggccucauguuuauuuuugcuuugauugcuugugcuuucuucacgagcucagucaugcagccaucacucuguuuucuuagcgcaguuaauugaagagcuccuccuuucccugucccauguucugacguugugaacauaugagcugagugguggggguugguuacuucccagcucuuuguucagucuguacucguguuccuucuauugcugccuuccuuggggucugaaaacauuucaugggaccuggguuuggguuugguuuuuguucguuucuguucagaauugguuuuuuccuaauaugugaucuucauaugcaguagagaagaugggaauucuacagcuguuggauagacuguuuugugaguuuguaucagcuccauugaaguguagaguacacuugaaaugcaccauguugcugauuuuaucuggaugacuuccauggcuguaagugggguguugcccuccacaguuguugcuuguccagcugucccucuaauacagauuugaucacgccugcauggcaugcuucuguguauaguuauacuacagaccuggucugggccccuuuauuguuccuccaugucccagccuuaugguuuugaugugaaguuuauuugacuugacaaauaucucacuuucucugguggaguacaucuuuauucauucauuuuuagccucugcauauccuuguagaugaccaagucucguguuggcaucgucauuugcucuuguuuuuguaaucccuucagcuacucucugucuuacuagauuaugugauccgucugcauccagggcaauuacugaccacuaagaaccugcugcugcugcugcauugcggcugguuuucuagugugccuuuucuuccuuucuuuucuccuaccaucuucacugcugaguaacguuucuuagucauuacguuugguucccugccuuagauuuuaacuuuuuacuuauaaugaccaugaagcccauaaagaaccucuuaauauguaaaacaaguuaugcugaacagagcugugaccguuuucacuacaaaggcaaaaccaaaacaaacuacccuucccuuagcuucauuucucuucuuguuuuuaguuuuguugucaaauuuuaaaucauuuuauauuucuuauccuguaagaauugauuggaauuguuccuuuguuaguguuuuuaaaucuuccugcugagagcacaggggcuguggcucucaacuuugaauauucaaggauuuucucugaguauuucagggguuaaaccuucagauacuucuuccacacucaaaauuuauuucuauguauaugaguguuuugucugcaugucugucuguacaccauguacaugccuggugccugcagagaucggaagaugucagauaacccggaaccggaguuaagaauaguugugagcugccauaugguugcugggaacugaacucagguccucuggaagagcagcuagugcccuuaaccacugagcaugucccuccuccccagcuucgcaugguuucauggugcacauuugcauugucucuuauuuuuugguuuugguuuugguuuuucgagacagggauucucuguguagcccuggcuguccuggaacucacucuguagaccaggcuguccucgaacucagaaaucgccugccucugccuccggagugcugggauuaaaggcgugcgccaccaccgcccgggguaucuucucuuucuuuugagcauccuuuagcuuuuauuagggaaggguguccggcagcuuuccccuucaguaucugaaguccccugcagugcugccauucucucaccugcccugugcugcucuugaauguucucuuugaccuuugagaauuugacucuguccagacuuuugaucuucccaucuuuuuacauuucuuggguuuauagaguuuucuguuauuccuuuggauaaacuuugcacuuuuugucauucucuaguuuucuucuggacaccuuuggaugguaucuccuaaaaugcugacauuuucuuucuuccuucucacucauuuucguuuucuucuuuauuuucaagcagccuaucuuuaaagcucacuauucuuuacucugguugaucaguucugugguuuaugucaucuacuucaauuuucacugguuuuuuuccuuauauuuuuuguuaucuggaaggauaauugauggaaauaaagauucuuauuccaccuuucaucuugacuuuuuucuucccucccucccucccucccuuccuaacuuugagagguucucaaaguuauauaugcagucuuggugaguguagaacucguuguauacuccauacuugaauucgagaaccuacugcugaugccugcuaagugcuggaauuaaagcugugcgccaucauuccugacucagaguucuguccauuuugaugggggaaauauccuacaucuaauuacucaggaaauagccugccuauccagucuuugcagcugaucuauugcaaacaguggguuguaugguauagagguugaaaguuagaaagucaguguuaagaaauguaugaauucugugcuucugacccaucuccuccccagaaggcuggguuaacuaacauguuagguuuaaggauucuucaccagguccuuugccuaacucggcagucaucucugggaacucuauuaagucucaccacuagggggagguguucacaauagaaagauuuuuuuuuauaguuuuuuuuuuuuuuuaaaggcgucuuuauccuuuuuuuucucuuugacuccaauaggcuccccugauuaagaaucacccauuaugacauugccauguuucugccuugaugauaauggacugaauuucugaacauauaacccaccccaauuaaauauuauccuuaugaaaagaaaaaauuacccauuaugaauuucuaaggucugccaaccuagcaaagacucgagguggugggagucagggugauugagaagcacagaggaaaagagagguggggucuggcugaccugagagcagcagcgcgagcagggagccuuccugugcaggaccucaggccgcugaugugcugauguugaaaaugaaagggcacauugaugugucggugggaggaaggcauuagggcaagucacugaguggcugugggacccucauaggggaucaguaggccaugaggauaggggcucugcaguagcugcugggaggcagggugugguugggacuggggaaacgugcaucacacaaguggccagcaucugaauauauuuuauagaugaguccaguaggcauacauuaccaauauucagaguuccauccuucauuucaucucuacaagacaguacugaaugaagcagguuugguguucuuuaauuuaaagauaucgaagugcagagaaguuacugccugagaucaccuggcugcagugugggacccgauccagaacuccuggacucggccacugcugccuucccucccagagguuucaggaagauggccugcauuccugcugucaccugcacauccuggucagccugggcuuucuagauuacagaaucgacaaggaaaacauugcagauagucuuagaagacagaguugaugguguguggggcccgagcuggaguucagcgaggguaaagccuggaguccuuuccuggaccacagaaagagaacagugaagagugccugccagagagacggggugaaaacagaggaaggaagcagaaaugaagaugaccaggagagugaaggaggcuggaaggagagccaagaaaauggggacauaccacguguguggggugcucaacaugcaguauauacuuacaugaaaauuaaaaguauauauuuuaucaaagagaaaaguauaucuucagaguaccaaaaagagaaaugaguuuauguauaacucacugaguuuccuuggguugugucuuuguuuuauucaauaagcauauauuuuaaugacuguuuuucagagagaauugaaguaccuguacucaaaaggaggcgcgaggugcugccauugaauauaaccacgccagaagaaacagaagaaacagcugcugccagugccacugaggauggaguuucuagacucccaccucacagggaggaggaauccugucuuaauagcuuaaaagauaacacugugcaguggaaacagccagccucuucaugugugcagccagccagccucucuccucauaagaaccugcaucuggauacacagccgaagaaggagaagaagugugugaagcuuguggauaguccggccaacauugaggucuuacaugaacaaagugggaauacccccaauucucccaggucagugucuuucugccuggcugccaguagccuucuccaucauuccuuucucaccgccugcauugugccguguggcucugucuauguucccagcacugugugcacuggagcccugcagucugggcacugugugcacuggagcucugcagucugggcacugugugcacuggagcgcugcagucugagcacugugugcacuggagcucugcagucugagcacugugugcacuggagcccugcagucugggcacugugugcacuggagcucugcagucugagcacugugugcacuggagcucugcagucugagcacugugcacuggagcccugcagucugagcacugugcacuggagcucugcagucugagcacugugugcacuggagcccugcagucugagcacugugugcacuagagcucugcagucugaguacugugugcacuggagcucugcagucugggcacugugugcacuggagcucugcagucugagcacugugugcacuggagcucugcagucugaguacugugugcacuggagcucugcagucugagcacugugugcacuggagcucugcagucugaacacugugcacuggagcccugcagucugggcacugugugcacuggagcucugcagucugggcacugugugcacuggaguccugcagucugagcacugugugcacuggagcccugcagucugagcacugugugcacuggagcccugcagucugagcacugugugcacuggagcccugcagucugagcacugugugcacuggagcucugcagucugggcacugugugcacuggagcucugcagucuguuugagcacugugugcacuggaggucuacagucuggguggccuuccuuuguuuuuuuuucagagggucagguagacucaggugacugcaggaggagggggcugugaacagcaagugaugcuaggcaguuauacuucccaguccacagagcaaagacagcucagcccagcuuuccagagugucuugcugggugggauaaauaaauaaacuguuguuuuucucuuaguucaaguagccaugaaagaaaaaccaacuuucucaaagggcuuuccaguagucuaagacauuuagacuuaaguuuuuugguaagaacagguaaaaguuuuugugguuuuuccauauuuauacuaagcuuucagaaauaggcuuugaugcaugcuugacauuuuuaaauaucaaagcuaauuuaguuucauuuuuauuucaaaacuucaaagcuuccagcuuucuguguaauggaguuugugacuaacaaaguaugggagggucugugagggaaucauuguuccagggcucucucugucccuugggaaagucaaacucauagagaugagaagguagagugucuggagcccaggcaccugauacagcagggucagggcagugguaaacguggaccugaucuagauguccaacaccccagguauuggugaaggaugugugguauguauacagugcaaccguggaggccacagagcuggguaauuuggagaaagaugaauacaaguagagcugcucaugcuaaacuaauuaaaccgucucuuaaacaguacauucucugauuugugacacccaaacuuuauaugugcauaaaaucauauaugugcauguaacaugaaaacagaagcaaagucugaagggacaggcacaggaaggauaggguggaacacagguacccucacacuugcacagaaaauuuuaaaaagugaguaaggaaagugaaggagccagaucguuuuaaggagaugaaugaugucugcaugcaguacagugacaacuguauuuaaaauaaagcuguauacauuuaaaaguugagcauauugaugaacauuggcaccaugaaaugagcucucugggaacugcuagugcuacgugagucucaaaaaagagugagugcaaaaucagacauuuaacugcaauagcgagacacagcccacccauaccaaaaggucuccuaaugagcuucaugugauuuaaguuuccaguacuuaaguuccagauuuaaguuuccagugaauacgaaacaaaguauucacuggaaaaaaucaucagcugcuaguauuaguucauuggauuuuauaaauaauguuuaaaucuauaggacacaugaaauuaaaacuccguauucuagcacauauucccagccucagacaguugugagaggagcucugcaggcauugccugugacgucugucugauggagugucuggaggauuucuugguggccacuguaccuugccgucugcugugcucguuuaucuuccugcccuuugcugcuugaggaacaguacacagaagcauaccaccaaugcucucaguacacaguacauagaagcauaccaccaaugcucucaguacacaguacauagaagcauaccaccaaugcucucaguacacaguacauagaagcauaccaccaaugcucucaguacacaguacacagaggcauaccaccaaugcucucaguacacaguacauagaagcauaccaccaaugcucucagauugcacaguggaaaagcuuugaugaaaaaaaaagaacaagaaaauaccucaacauuuguuuuaagugugugaguccaccuacuaacuuaaaacauuuccaacccagcuggagagauggcucagagguuaagaguguugguuguucuucagagguccugaauucaauucccagcaaccacaugguaccucacagcucugaaugauaagaucuguugcccucuucuagugcaggcauucaugcaccuagaacacuguagacguaauaaauaagucuuuuuuaaaaaauuucaaacuuccgucuuuucugcuuguuuagcuuagacacacaguucaaaguuaacuuugucacaguaaagauggacuugcuaagaacuggaagacugccugcuuuagucaaaugaugagugcucuuccaugaagaauuuuuagacucuuucaaacaucuccugcacugguuguuauugcucaccugauggaaacucagcuuggaggguuucuguuuguuuuuucugauuucuugucugagacaaacacguacuugggaagccugggguuguggcuuuuuauccuugugcuuaacuguuugaaugugguaucaaccuuagaauauugcuuuaguguuuugaauguuguauucuguguucuuaugauggguaucuccuuuuacuuacuauucuagcuuaggcauccuugaccuuauaucagacuuaaagauacuuauuaaaaucuuucuaaaaguuaagccugcugauauaagaaauuguuuuagaguuagccacuuaguaucauaguagagucuacuaauaauuuuuguccuguauaucuaaaacagaacucccccguuagucgccguauuuagacauacuaggcaugucugucuuuuucguuuugaccauacuugaauucagaguauauucuuuaauguuuguagguuaacugcagaaucaaagcuuccaacagaagugaaggaaaggauagaaacuacaagcaaauugggaaaaggagcuuguaagaaaucacacaacaucauauauguguccucaaagucagccccagaaacgcagugcucacagcaguagugaggccugcgcgcugggccacgcuaaccaucgcuccuaugcgugggacacccuuguggagcuuugcauaggucagugcugaagccuggcgugcucgcaccgcugugaccaagacuuccgauguggcugugauucugacccauaaguccuuaacugaugauccuucucagaacugugggucacagggaacagaccagaucagaagagaaugggagaauuuaaaccuacuugcuguguuggauguggaguuugaacaugguuaaauaaucugucauaagaaccaaaaauuagaaaauggaacacuuaaaauuauuuauaauuuucuuuguacaucguuuugcacuuagauuuuccuugucuuguaaaaauaaugaaauuggcuugaaaauauauauuacuacaaaauguuuuaaagugugaaguaccuauauucauauguguaauuuagauuuuaugacucaaacaucaauaauuuugaaauuuaaaauaaaauugcaguaauuucuucuau

SEQ ID NO: 5936 - RNA, 1366 nt, Mus musculus
aggcacauuugccgguccggguuuguaacgugcagcgaucauggccagccaucuggaacucaacaacggcaccaagaugcccacccugggccugggcaccuggaaguccccuccuggccaggugacugaggccgugaagguugcuauugacuugggguaccgccacauugacugcgcccaggucuaccagaaugagaaggaggugggaguggcccuccaggagaagcucaaggagcagguugugaagcgccaggaucucuucaucgucagcaagcuguggugcacguuccaugacaagagcauggugaaaggagccuuccagaagacacugagcgaccugcagcuggacuaccuggaucucuaccuuauucacuggacaacgggguucaagccugggcccgacuauuucccacuggaugccucagggaacgugauaccuagugacaccgauuuuguggacacuuggacggcuauggaacaacuaguggaugaagguuuggugaaaacaaucggugucuccaacuucaacccucuucagauugagaggaucuugaacaaaccuggcuuaaaauauaagccugcggugaaccagaucgagugccacccguaccuaacucaggagaagcugauugaguacugccacagcaaaggcaucguggugacagcauacaguccccuugguucuccugacaggcccugggccaagccugaagauccgucucuccuggaggaucccaggaucaaagcaauugcagccaaguacaauaaaacuacagcccaggugcugauccgguuccccauucagaggaacuugguagugauccccaagucugugacaccagugcgcauugcugagaacuugaaggucuuugacuuugagcugagcagcgaggacauggccacucuacucagcuacaacaggaacuggagggugugcgccuugaugagcugugccaaacacaaggauuaccccuuccacgccgaagucugaagcuguggcgagcggaucccugcuccuccucaaguggcuugcaccuguucuuucugccucaucugcccuugcaaguguccugugucucugcacuagguggcaccuugcaaaccagauggugagaguuaguuaguuugacauagagucuggagggcaguaccaguagccaagguguuucuuccagccuuccuuggucuuucuucuuacccaccuggaggacuuuaacacaaguacccuuuccaaccaaagagaagcaagcuuuagaguccaagccgugccacuaacacuuaaaugugagugcuuagaacuguaauccuuugggucagacuucuccuugccucaaauaaaaacuuuugugaaaaaaaaaaaagaaau

SEQ ID NO: 5937 - RNA, 15983 nt, Mus musculus
uguuacaugcuagcaaguauuuauuauuauuuagaaguggucaaaagacuuacaaggcucauuauuauaaccacauguaugaaacaucacuuaguaagauagaaggaaagagacauauauauguauuuauauuaaaaaaauacacacacgugcacucucucaaguguuugccacacagugcuaugaaguaggcaucaggcuauacagguucugauauacauaacacauuaaagaaucaagcguuuaaaaaccauacuuacaguugcaaaaauaaaguuuucuuuucuccaagcauuuugaucugggcucaagcaaagcaaguaaugaacaccgaugauuaucaugagauucuacacacacugaagcuaucaauauacaagagccaacaaacaaaacaacagcaagaaaggaagcuguaggaaugaacaaugcauuucauccaaagucuaacagucuguuucaucccgcccucggacauuacagaucauaauuuacauuacuuguauagcgagguaagccagacaaaacaaaacaauccacagaaagucaugaccgcucucagccgguccaacauuccccuagugcaacagcauuguuuaccugaaggaucaugugucacaauuaaggaguacucauacaaaacuauuuccuuuauucuugaaaaagugccacauacuauacuuuucauuuaaaaaaauacacaacacaugagcuaaugaaagacagucugucuccaucucuugucgaugaggaaaggccagagagauucuuugauuccaguucgaaaugguguccucuggccaaugcccaacgucuccaauuuggagcaaucgagcugagcauuuuuggggcgcugugcuccuaugacaggacugucaguaaucuuuaaagaaaaacaaaacagagcaugaguaaaggaagcagcaucuugaaagcuuaauaacuuuauuucaguuuucuucuagugccagaaaacugguuauuaucagagcuauaaaaaaaagaggcaugcugccauuaaggcagcacacagugugcaccugcagauuaucagaagccagccagugggcgucaccugccaccauguagauggcgucaguugucaggcuuuggagcagguaacccccuccaccucccagccaccucaccagccccaccuagucucuagacuucaucacuaugcucagacuucucuagggauaacuuuccaccagauacugacaugcuccaagcaaaguucauugugacuagcuauccaaaaaagaaaagcaauaucaaccaacacaacagccuuaagaagucaggagggggcgggcuggcgggcgggcgguugucgagacuuacaggucuuaaguggcugcuggggagguugaaggcaucugcaauugcacacgccauuucauacuuggucaucugcucauugccagaccagugaaagguucccuuaauggauggauccugacaacaauuacaaggaaaaaaaaaaaaaaaucaacacaguuucaauuuucugcuuccauauaguaagguuugacagagaaaguuauuuugaaagguccaagaauguaaaccuacuuuuaugaaauauuaucuucgaaagaccuaaaaucaauguccauaaauauucugacacuaaaaguaauuuauagaaauaagaacguuuugaaaaauacaaauugcuucaauuuuagacagugacuaauuuuaaugaccuuuuuaaauuauucuaagguagaauuaaaauuuaacauaguuuugagacaggaugggcaagcacucugccaucugaaccacauucccggugccacguuuuucuguuuuaggcaguuuugcgauguaaccuuggcuggucugaauucaguauacagggauagcaggccuaggauucacaggguccucuuuccuuugccucaaaugcugauauuacaaauucgcaccacuaagcucagucagaaaauaauuuugaaacgaaccugauaaacacaguaacacacagcaguaacccuagcauuugggaaagcugaggcagaacaacagccuugaaugggaggccacccugagcaauaaaaacccugucucaagaaaccagaagagaugaacuaacuaguuaaguacuacuauuccaucuauuuuaagaaagggccaguuuaugcucuauauauacucacauaauuuucauacaucaaaaacuguagucaugcugcagccagcauuauuaguacucuaaauuaagcugugcccaaucuuuuacuaauacuguauuuagugccaauuuccccaaaugcuuaaaauucauuccuacccuggguuggaagauggcugagugcauaugagugcuuacuggucuuugcagaggaccuggcuucucuggacacuugcacacaugugguauacacaaauucaugaagauauacacaugcauaauacaacaaacaaacaaauaaaaacaagaacuugaacuguguguaguuaaucugcuaggucuuuaaucuuagcauuaggaagacagagacaagauuucuguguuugaauuuauuuccugcauacaaaccucacgaauacagccucuacaauguauaacuugcuuuuguuccauuuuccacuuuuaaguagcacauucaggggcuggagagauggcucagcaauuagaacacuggcugcucuuccagaggacucaaguucaauuccccccaaccacacggcagcucacaauugucuauaacuccauuuccaugggaucugacacccucacagacauacauucaggcaaaacaccaaugcacauaaaauaaaauuaaauaaaguauuuaaaaaauaaagcaaaacaaaacaaagacaaaaacacauguucuggggcuggagagauggcucagugguuaggaacacugacuguucauccagagguccugaguucaauucccagaaaccacaugguggcucacaaucaucuguaaugggaucugaugccuucucugcgaugugugaagacagcuacaguguacucacauacauaaacuaaauaaaucuuuuaaaauaacaaaaccauguucaacuuucagucugugauaauccauguacacacaaguugaagcauggaagaaaagcagaccuuuuacuaagacagaagucaggccccauccuucaggacucaccagcauccucuucucugccagcugccggcacacacuggcuacgucuuucacauguguggggaaccucugcugccaaugguccauguuugcugacuuguugcugaacugcaccuugucgaacauaacagucacagcacuuucuucaagcuuuucaacuuccccauacagaacaggaauucucaacacagcagccccuagggacaauacaugaauauuuuuuauggcugacucauacauuuccaaguuuuggcagaaagagaaauuguguggauguaaacaguagaaaaguagaaacuuugccuuuuaauaaaaauacacuaggaugguaaguaguagcucauacuggaugaacuuaaggaaaaucaggaauauuuuaaguaucuacuggcauauacagaauuucaucuaguuuguuauuauggucaugauaaauaaagccuaucuggacaaccaaaugaaaugaauacucaugacugaugaacaaaacaggauaauagcacugaaguacaauuuaggaucaagaacaggugggaagccaucuuuacaagcuacauauuugauagaaggaguauaaaaguuuuccuaacuguguaagcaugcuguugauuaugguaauaucguggcugucccuagaagauacacaaccaaguguuugaggacugauacaccacugaauauggccaaguauacgcgcacaaaaaagcaucaaacagaaacugaucaaucugaguguaggguugauugcucauacucuuacaaccuuggaugaagaauuauucagaauuagacuuuauacuggucccaggugagagguuugauagucuuuggaugacuagcacuuuaaguaguauuuccuuuuauaauuacugagcaaguaaacaaaggucuuguuauggucugaauguuguaccagaaacuauauacugaaauuuaauuccuaguccaacagugucugggugagggggauggcaggaggggcauguuggugugugggaguggauguugcuguggggaggugcacugggguaaugguuaggucaugaagacagcacuacaaaagagcuuaauggggagccaucugguuagggucuuugaggccaagcauaaacgaggccuuuaccaccugcgggcuguuggauuucacagccuccacaauugugagaaguacauuccaguucucuauaaauaauccguucuccucauuguuaagaagcaaagcaagaggagacuucugcaggauugcuggcucauuuauaauguaccuugucugccauacugcagauuuaacucugggccccgugcacgcccagcaaguucucuaccaccgagucagaauauuacaaaagcaaaagcccugacaaguuaaaugccuguaacaagggcaucacaagcuggugguaggcugucagggguacucuaugauauaaagcaucaguuuccacaggggucaugacguugaacaugaugcugccacagacagaaauuaaguugaccaggguacuuccacagacaggaagaagccauggcagaacugguaccacauauaaugagaagcaagucagaguauggaucaaaacagaaacaccugaaaaaauauuauacaaaaauuccugucuuaagaaccuucauuuugugcuugucuuccugaggaaucagcacaugagagagauuucaugcucccaguuuuaaaguccuuauuguuuuuaaauaaguuauuuuuacauauacauguguaaacauaaacaaggggaaaaaagaaaaagaugguauagaauaccuugaaagauguuauuauacuuauuuauguguaugugugugugugugugugguguguggugugugugugugguauguguguacaugugugaaggucagaggacaacugcagggagcugguucucucugcccaccacauggaccuugacaaucaccuuugcuuacugaccucucaccugcccauacugucuaauuucuauuaaccuauagacccugguuucccuuuucuuucuuuaauuagaagagaugccaggagcucacuauauagcccaguauauccugauccuccugccucagcuuccaagggcugggguucaggaauguaaaacuuaaccucccaacauauacaccaauucuguauauuuuuaauaaauuaagaacaugucuacucaugaacaacagucuuaaaaaaaugaucagagucaaggacccuggaucuuaccuaaauuauucuccaggacugcuuuuucuccaucuaauuuuguuuuuccauauagauucaggggacuugguauaucuucuucuguguaagggggauuugugccaucaaacacauaaucugagcuaauguagaugagaaaugcuccaaucgcagcuacagaaagagaagauaaauccacugcauuacuuuuguggaauuuggaguguuuugugugucucauguuuugcuuuguuuuccuugagauaaacaaaaacauauguaagacagcuaugaaaauuucaucuuaaaaaaaaaaaaaaaaaaaaaaaaaaaaacccagugaaggaggcucuggagauggcucagcaccuacaggcacuggcugcgcuuccagaggcccugccuggguuuggcuccaaggacccacaugaauguucagaaccaccugcaaccccaaucccaggggaucugaggcccucucuucugggccccaaggauaccaggcaugcauauggagcacagacaccacgucuugaaagcacaguccaguggcaauguagccuuaccugccuccuuugccaaguucccagaggcacccacauucagcugggaagcagcaucuggcugacucucaacaacaucaggucuucucucugcagcacaaugcacuaugacaugaggcugaaacaaacagaguuuuaacccaaaauggagagaacagagaaccauggcuuccuuaggguaacuucaggggaagaaaaggcuccuuaagucaacaugccuucaauuaagaauaaauugguuuaacuuguuuuccuuuuauuucacuuaccuuuuuuuuguuuguuuuuuguuuuucaagacagagauuuuguauaacccuagcuguucuggaacucaaauauucaccugccucugucuaaagaacugggauuaaagcugcgugcuaccaccauuucucuuacuuuuuucuuaaaacaauaaagaaacauagaaaacacacacauauucugcaaaggaaagaacaauuuauuuuguugaauguuuauuaggcagugcuagagaucccagaacuuaacacuguaccuuagccaggugcgugaaccccugagcuauauuccuagccaagguaaaaacaacuuagcaauccuuagacaaaaacgcagaaaaaagcuauuaguaacucccuauaacuaaaauaaaccucugucccauguagugggaaaguaaccuuggacaugacaacugugacuguacucaccaaaccccaggccccacagacagccaagugcucugccaagaugcgaugccccaacccuaacaguuaccaaacucaugacaaacggcaaguaguaucaguugcgaguuaaauucauaaauucaagcuuuuuugaccacucauuuaacaagaaucagcuauuuacagaaaucacauguccacuugacuauaaaagcaguaagcccccaugucuuagcuauuuuucuauuacuguggauccaaagcaacuugaggaagaaauggcuuaucacuuacagcccaaaguccaucaccaaagaaagucaaagaagggacugguaacugguagcaaggaaauggaugaacucugcucacaggcuugcuccccauagcauguucaaccuauuuucauaagcaacucaggcucagccacagucauauuaaucacaaaacccccacggaccacacuguuagaggcauuucccaauugaaauucccuuugcagaugacaacuaaccaccacacaccaguaaggccacagacaaggucuucacaucugggugaaagagauacacaucaaaacaaggaugcagaucuucuaaagaaaaggcuuuuuuaaugcaagaacagagcaagaacuaagauugguguucaaugucugugugcuggaggcuggaacgcacauggcuaacaaccauuuauagcuccaguuucagaggcuggagagagaucucagugguuaaaagcacaggcugcucuuccagaggauccagguucaguucccaacacccacaaggcagcucagaacucacuggaauugcaggggaucugacacucacagagacauacgcacagacaaacaccaaugcauacaaaacaagaauaaauagaucaggagaucaggcacccuuuucugacuuccacagguacuacauguauguguuauauagacauacaugcaggcaaaacacccguacacagaaaacaaauaaaaauaaacgagagacagacagauagacuguccacacacccauuuucucaaaaauugcucaaggauugcuaagaauuguuuucaaacuugaauguggggaaucugggauguuucaaauacaauauccuaggcccgccccagacuuaaaacaucacacucugggcaugcagucugcaaucaggcuucuguguguuucuaauacucaugcuuccagaaucacacuuagagagaaccaaagcugaaaucggauggcaaggagaacaaagucuucauuuuccucuaacuuuugucagguuacagcaaacagguuacugaaguuccccugaucauacuuucuuaacauuaaagcagaaauauuuccacccccccccaacccccaccccguucccagacagcacccuaacacuucacggcaagcaucacaaggaaaguacugcaucaacacaagccaugccuccccacaugcuguggaggacagggaagaggauccagcucugggacagaacaccugccagcacgcucgggaaccucuugccucaacaccaagcaccacuccacagcaugccacacaaggacacucugcauugugguggcucaacgggucacaacuuucaagcacaacuucccgcaaccaaaccaagcacacacuuucuguauaagccaggcaaguccuaagagaacacauaacaacugcagacauacaagcccauaccuggaaaucaugaaugaggugaugaacagcuucagaauccaacagguucacuuguucgaauuuuggucuugcucuucgaaagccacagccaacggugugccaguugcucugcugaaacucuuuguaaacugcucugccaagaagcccaguggcaccaguaaugagaacccgccggcuagggauguucacuuccuccuagaagaauaaagggguuaaagccauaauucucuuaaaggcauuauuguguaccacauaccugaaauguuaacuauuuuuuuaaauuaauuccacuaccuaaaagucaguuuuaaaguuagauuaaucaauccaccugcaucaacaacugcaagacuuaaugaguuuguguuuauuuuauuugcucugucugaguguuuuugcucuguaugcauauguguguacuaccugcauugccuggggagaucagaagacgguauaaaaucaucuggaacuggaguuacagugagccuggguccucugcaaauccacacagaacucuuaaccacagccaucuuuccaguccccacugacaaucagccuccucgagacaaggaagacuuguuuaugagcacaccguuuuuguagaagacaaacauuggauggcuuacaauuauccauuacugcagaucugauugcccucuucuggucauacgugugugugugugugugugugugugugugugugugagagagagagggggggggagggagggagggagagggagagagggagagagggagagagagagagagagagagagagagagagaaugaauggguagaagagauggcagaccuggguuugauucccagcauucaaauggcagcuaacaucuguccuuagcucccguuucagaggaucugaugcccucuucuggcuucuguggguaccaggcgugcacaugguuaugguacacauacauacacucauguacauaaaguaaguuuacuuuuuuuagaugaguaagaauaaaguuuuaguaaucaagaaaaagaaccugagaucacuaacaacuuccccauuugauuuagauuucauauuaacaauggaaguuacuuucuuuaugauggaugaagugaucauaucaccccauaauuagucaacaggcguuucacaucuucuaagauauucugaaaaugcacaaggcucagaugagucacauuuugacaggacugaaaaucggucagggcuggagaaauggcucagcugcuaagagcacugacuacucuuccaaagguccugaguucaauucccagcaaacacaugguggcucacaaccaucuguaauggguucugacacccucuucugguuugucugaagucagcuauaauuguacucauacauaaaauaaauaaauaaaucuuuaaaaaaaagaaaauuggucgacauuucauaggaguuuauuuggaauaaagucaacuaauaugucccucggucagcacuaaauuuacuuacacaaaauacuuaugacuaacagauacagauagaaaaaaaaacugaaaaaacauuuguguucacaguaaaaauuuaaaauuacugcuuaaagaauauuuugauuuuuguauacucaaggcaaaguuccaaaaauugaguaacacuuuccugccaaauucuuaaguaaagccaacuuuuccuuuuuaaaaauaauguuuucagccagcagagagucacacaccuguagccaaagcaugagcucuggggcucaaacuuucauuagauuuuaucacaagguccuauuucuguuaaagucacauaauucugaguuggaaaaaaaaagugugcacacacacauauauacaggcaauauccaaagacauuuucggguaaaugauuuaguaaacauacauacuuuaauuaaggacccccaaaucagcuguuucuagcauuuaacaaaagcugaaauccaaagggcagggaugggggagggcagcauagaaaaaaaaaucuauuaaggauuuuaauucaaugaauuucaaaacauuuuuaaaaaaacauuaaugagacuucaugugguguccuuuauaacacuuggcucuaagccaggcaauuuaugaaaaugaagacuugauccggcaaaauguuuucuucgaacuuuggcaagaaaauaacucuccaaaggcuuaacucuaaaccaggugcagugaugaccucagugaacaggagggugccagcagccugagcauagccugcucuacggaggggauuccaggccagugcggcccacuaggcaagacccugucucaaaaacuauacuuguacacguacacacacacacacacacacacacaccacacacacagcugaaauaaacggggucaaagcaugcuaagucuaguauagauucacaacacuguacauguaacaaauaccaugaagaggucugggaaaacaccauaaaggaaaacagauggggcuggagagcgugguuugagucccaacaccuacacggcagguaucaacaauaugugugacuccaguuccuuggggagccaacauccucuguggaccucaaaggguacugcaugcauguggugaacaaacauacaggccaaacacccacacacauaacauuuaaaaaccuaaaaaaaaaaaaaaaaaaaaaaaaguugcucuugcagaggacuggcauuggguccucagaguccauccugggcagcucacaccucccuguaacuccagcucuacuggaauggacaccuucuauuggcccuaguagguaucagacacaugguacacggcuauacacuuagcaaucaugcauaauugaaaaaaaaaaucaucugaugcaggagggucucaaugaauucaagaccagcccugaucugucugggaaaacaaauacaaaacaaccagaaaguuucacauucacuuucaacacuuucaaguuuucacauucacucucuaccucucuaacauccuuggacacccuugggauuuaagaaacaagauaucuagauugcuuaauaggaauggaauucagaggggaacagcucaacucccuguacguacacacaggcaguguucuuaacaggaauugguaucaggcugccucacuaacauuaacuaugccaagucucagcuggcaacaagagugaaugucaguugcacagguugagagagcaacaccagcaugcagauuccagcugucugcaccuucugccuguuaucugcuuuuaugaaacagggucucacuauguaaccuuggcuugccugauaaucauuccugccucagcuuuuagagugaugggacugaaguauaagccgccacgcucagcuacuguaccauuuuuuuuuuuaaugaaaaagguugcugggugugguggcaucaucaaucccagcccacuggagguggagccacgcagaucuccggggauuugaggacagccaugaauacacagugagacuguuuaaaacaaacaaacaaaugcaacaacagaaagaaaaaacaaacaaacaaacaaaaaaccacccuaaaaagcaaucacaucuccucaccacuacaaacuuccugaguacugagauuacagacaugaguuagcacacucaguuuaccacucucuacuuuucuuuuacugaacuggggaaaugcauuaagccuacacgaauacaugcucauacgcacacaccuuuggucacaugccgucaccagucuggaacugcaaauacauucgaacuuuggcuaaggcccagccauuuggagauaauauugaaugugcaucacgcaaauguaaaaauuucccauuaucaacugguugugguggcucagaucuucaaucccagcacuccucgaggcagaagcaucugaguccaaggccagccuggacaacacauacugaguucuaguuuggguuucuauugcugugugaaaacaucaaagcauuguuuggcaggagguacuuagcuuaccauuuccacaucacuguucgccccugaaggaaguuaggacaagacccuggaggcaggagcucacacaggccuugugaaaacugcuuaauuccucagccagcuuuccuaaacaacucaggacuauaacagcccaggggcuccguccucccaagucaaucgccaauuaagaaaaggcgcuacagguucaccuaauaauagccuaaucuuauggcgguauacucuuaacaagaaucccucaucucaauagggacucccuuaucucuaguaacucuagcaagcacaggacccucccccaaauuaaaaguuugcauuaaaaaaaaaaaaaaaacuggccacauccuaggcguuuuuauaucagcaagacacauuaguucaucgacugugcuggauacauucuguaggucaguaaguacuuaacgggcuugaaacacgggaccguggaccagacuuggaaacaugcugggggaaguuuaccagacaugcaauuucuuucagcagucuuccaccacgcaaaauacagcgguucagaaaacguagaagcuaaaagcccaacacuggaauuccugcucaaaccuuccugaauaaacucgaggcggugcccgucugccuaccagggagccugagcguucacagcaccgcacagucggaaauccugacagccuuaaaagugccucaaggaacccgccccgugcaaacuaugaauucaccaaguugaccccgccgacaccgccauuuauggaaagucacucucccccuguccuuaaagauccaggaacacaaaacaaagaugaugacuacugaaacgggagccagcccgcgggaggcggcgggaggcaccgggagucuccaccuccgcgcuccccgggcugcagcgggcgugagcgcagcccuacagggagagagguaaacaaacucaaaggcgccaccccggcuccaugccccgaagcucaccuccaccagcuggcagcagccggggacgaaguggauggagagcuccuucucccggcccaccaugcccgcagucuuugcgccgcuucagucgcgaccgcaagcuccacuagcgcagcacugccaggggccgcagcgcccgcgcccuuggcccuccuccccuaggcccaggccgaccccggcugccgcuuccggcuuccgccgcccuggccgcgccuguugauuggccgccucucgccacgcguucaaaaaggggcggaaccucaagggacgcugucagcccaugugccaguucuuaaggagauagagcguuagaacgcaggcacuggugccaagcgauggaugcaggcuuccuuggguuuaagaguguuggcuuuuuuguuuguuuuuuuaaaaucucuccuacuuauuccuucuuagugaaggguaaggaaucgauucgccuagguuugcagacugcgaaaugccuaggagucaaccaagcauguauuauagaaaauagacuaaaacaucuguaaaguuaggaggcaagaagguaaggguugucccgugaacacagagcuaaggcuggacugaguugguuuuaggcaguccgaaccucaggcuggccuugggcucagagaaagaccugcaauuucugauccucucuaguuuccuuguccaaaggcaucaaaggguuacaggagugaacaaccaaccuaggcaaggugcgguucguccuuuaaggcaagaagaaagaauaaaaauaggacugugcucagagucauuaacaucccugaaagcuauguuuuucuggaaugcuaaaaaaaaaaugcugugaaguuugaaaacuguuuauuuuuagcuaauuaaaaauaaaaaggugugggagagaauguuacuuucuaaaaggcagguucuucguauuuccccccccgcagaaccacaggagaaacucaacugugcuaacaagcccagucaacuuuuaaguagauuuaacaggcguccuggcugcccuuuggaggcuucacuuaggggacgacgacgcccggggcugcuggagccaagccaaggaggagcugcuaagacuuaaaaugagggagccaaggaagggcggaaugccaggcgcuccuuccagcccugugugguuguucaaaaguuaaucagaaacaacagcucgcagggucugacucagcucucaacuguaaccugcagguuacaagcuccgaagcacagcaacaggcaagccagugaaauuuacccugaaaaaaagcccgggcacacuuuuucuccgcccacucucuacccaacaaucuauucccauccagacacccacgauaagggauuucaaaacucgccccaaaacgugaccacugccugaauuacccccaaaggccucauuuucagaauccuuuugguuuauuuuuagacuaaggauuaagcugccccuugggaaaaguuuuccucagucaggugauaguuuuucucccacccccccaccccacccccccccacuaaagaauuuauucccucacucuuuggaagagcaaacaaaggcagccuaaggcucccuacuuuucgaauuuuuuuuuuauaauccgggucuuaugguuauuaaaagggcuagcuaucccaacacuaaauuauaauaauaauuagaaguccgagggagggacaaauccaagaucccucauccuaauuaaaagugagaauauuucaaguuucugguugauguguguguaguuugcuuccuagaggggaucauaaaauguacucaauaggaagacucaaaauuuuccacaauuagugugauucucagagcaaccuugugaagagagugagaaaauguuugcuugccuauauauaagaguacgguuugacacaagucaggcaaaaguuggguauagcuuauuuaauaagaaaaggcucuguuuacagccaaugucugacuuccgauggggguuggggagucacgucucaaagagugcaaacuggaacugaaagucccauuagcagauucaagcuccacaagacaaaagacaaaagacaaaaaaccugggcaugcaccacggguuaaaucuugcacuacacagagccuucacuacaguugcacucaauguggagaaugaaauuaucguucugcuucacgucuuauuuauuaaacugggcuugauuuccugggucagaaacccuagauaguuuauucuguguaccaagcuuacguuucuuaaggaaauaaaugguaccggcuagcauuuuauuuacacccuuucugcucguagcagcgguuuggaaucgauuuuagcgcaucgccgagccgccaccgagucuugaauugcuagcucuuaccuguuccauggccuccggcauuucaggcaugauuccagaacuauuuuggggaaacgcagcgagagggaucugggcgucuggcuccucuggcccggucuuuguucgcuccgcccgcacggagcacacggacgccaaaaacgugaggcgcagcuccgcuugaccuuuuaaauuagcauuuccauuccaacccuggaaucucgugcagcuuuccacagugcaguaagcuagcagcugauuccuccugcuaguuuugaaacuacccaaugagaaguuucaugcuuaacugcaagucaagggaggacccauuacugaaauccauauggcagaacuaaaaacaaacaagcaagcaaacaaacaaaccccugcaauucccugguagaacuuguugacuuugucucuuguagaaagacaagaaugagccaacgguugggaaguacaagcaauugauuccuguugugaaauauuccacacguuucacacauuacgguaacg

SEQ ID NO: 5938 - RNA, 15983 nt, Mus musculus
cguuaccguaaugugugaaacguguggaauauuucacaacaggaaucaauugcuuguacuucccaaccguuggcucauucuugucuuucuacaagagacaaagucaacaaguucuaccagggaauugcagggguuuguuuguuugcuugcuuguuuguuuuuaguucugccauauggauuucaguaauggguccucccuugacuugcaguuaagcaugaaacuucucauuggguaguuucaaaacuagcaggaggaaucagcugcuagcuuacugcacuguggaaagcugcacgagauuccaggguuggaauggaaaugcuaauuuaaaaggucaagcggagcugcgccucacguuuuuggcguccgugugcuccgugcgggcggagcgaacaaagaccgggccagaggagccagacgcccagaucccucucgcugcguuuccccaaaauaguucuggaaucaugccugaaaugccggaggccauggaacagguaagagcuagcaauucaagacucgguggcggcucggcgaugcgcuaaaaucgauuccaaaccgcugcuacgagcagaaaggguguaaauaaaaugcuagccgguaccauuuauuuccuuaagaaacguaagcuugguacacagaauaaacuaucuaggguuucugacccaggaaaucaagcccaguuuaauaaauaagacgugaagcagaacgauaauuucauucuccacauugagugcaacuguagugaaggcucuguguagugcaagauuuaacccguggugcaugcccagguuuuuugucuuuugucuuuugucuuguggagcuugaaucugcuaaugggacuuucaguuccaguuugcacucuuugagacgugacuccccaacccccaucggaagucagacauuggcuguaaacagagccuuuucuuauuaaauaagcuauacccaacuuuugccugacuugugucaaaccguacucuuauauauaggcaagcaaacauuuucucacucucuucacaagguugcucugagaaucacacuaauuguggaaaauuuugagucuuccuauugaguacauuuuaugauccccucuaggaagcaaacuacacacacaucaaccagaaacuugaaauauucucacuuuuaauuaggaugagggaucuuggauuugucccucccucggacuucuaauuauuauuauaauuuaguguugggauagcuagcccuuuuaauaaccauaagacccggauuauaaaaaaaaaauucgaaaaguagggagccuuaggcugccuuuguuugcucuuccaaagagugagggaauaaauucuuuaguggggggggguggggugggggggugggagaaaaacuaucaccugacugaggaaaacuuuucccaaggggcagcuuaauccuuagucuaaaaauaaaccaaaaggauucugaaaaugaggccuuuggggguaauucaggcaguggucacguuuuggggcgaguuuugaaaucccuuaucgugggugucuggaugggaauagauuguuggguagagagugggcggagaaaaagugugcccgggcuuuuuuucaggguaaauuucacuggcuugccuguugcugugcuucggagcuuguaaccugcagguuacaguugagagcugagucagacccugcgagcuguuguuucugauuaacuuuugaacaaccacacagggcuggaaggagcgccuggcauuccgcccuuccuuggcucccucauuuuaagucuuagcagcuccuccuuggcuuggcuccagcagccccgggcgucgucguccccuaagugaagccuccaaagggcagccaggacgccuguuaaaucuacuuaaaaguugacugggcuuguuagcacaguugaguuucuccugugguucugcggggggggaaauacgaagaaccugccuuuuagaaaguaacauucucucccacaccuuuuuauuuuuaauuagcuaaaaauaaacaguuuucaaacuucacagcauuuuuuuuuuagcauuccagaaaaacauagcuuucagggauguuaaugacucugagcacaguccuauuuuuauucuuucuucuugccuuaaaggacgaaccgcaccuugccuagguugguuguucacuccuguaacccuuugaugccuuuggacaaggaaacuagagaggaucagaaauugcaggucuuucucugagcccaaggccagccugagguucggacugccuaaaaccaacucaguccagccuuagcucuguguucacgggacaacccuuaccuucuugccuccuaacuuuacagauguuuuagucuauuuucuauaauacaugcuugguugacuccuaggcauuucgcagucugcaaaccuaggcgaaucgauuccuuacccuucacuaagaaggaauaaguaggagagauuuuaaaaaaacaaacaaaaaagccaacacucuuaaacccaaggaagccugcauccaucgcuuggcaccagugccugcguucuaacgcucuaucuccuuaagaacuggcacaugggcugacagcgucccuugagguuccgccccuuuuugaacgcguggcgagaggcggccaaucaacaggcgcggccagggcggcggaagccggaagcggcagccggggucggccugggccuaggggaggagggccaagggcgcgggcgcugcggccccuggcagugcugcgcuaguggagcuugcggucgcgacugaagcggcgcaaagacugcgggcauggugggccgggagaaggagcucuccauccacuucguccccggcugcugccagcugguggaggugagcuucggggcauggagccgggguggcgccuuugaguuuguuuaccucucucccuguagggcugcgcucacgcccgcugcagcccggggagcgcggagguggagacucccggugccucccgccgccucccgcgggcuggcucccguuucaguagucaucaucuuuguuuuguguuccuggaucuuuaaggacagggggagagugacuuuccauaaauggcggugucggcggggucaacuuggugaauucauaguuugcacggggcggguuccuugaggcacuuuuaaggcugucaggauuuccgacugugcggugcugugaacgcucaggcucccugguaggcagacgggcaccgccucgaguuuauucaggaagguuugagcaggaauuccaguguugggcuuuuagcuucuacguuuucugaaccgcuguauuuugcgugguggaagacugcugaaagaaauugcaugucugguaaacuucccccagcauguuuccaagucugguccacggucccguguuucaagcccguuaaguacuuacugaccuacagaauguauccagcacagucgaugaacuaaugugucuugcugauauaaaaacgccuaggauguggccaguuuuuuuuuuuuuuuuaaugcaaacuuuuaauuugggggaggguccugugcuugcuagaguuacuagagauaagggagucccuauugagaugagggauucuuguuaagaguauaccgccauaagauuaggcuauuauuaggugaaccuguagcgccuuuucuuaauuggcgauugacuugggaggacggagccccugggcuguuauaguccugaguuguuuaggaaagcuggcugaggaauuaagcaguuuucacaaggccugugugagcuccugccuccagggucuuguccuaacuuccuucaggggcgaacagugauguggaaaugguaagcuaaguaccuccugccaaacaaugcuuugauguuuucacacagcaauagaaacccaaacuagaacucaguauguguuguccaggcuggccuuggacucagaugcuucugccucgaggagugcugggauugaagaucugagccaccacaaccaguugauaaugggaaauuuuuacauuugcgugaugcacauucaauauuaucuccaaauggcugggccuuagccaaaguucgaauguauuugcaguuccagacuggugacggcaugugaccaaaggugugugcguaugagcauguauucguguaggcuuaaugcauuuccccaguucaguaaaagaaaaguagagagugguaaacugagugugcuaacucaugucuguaaucucaguacucaggaaguuuguaguggugaggagaugugauugcuuuuuagggugguuuuuuguuuguuuguuuguuuuuucuuucuguuguugcauuuguuuguuuguuuuaaacagucucacuguguauucauggcuguccucaaauccccggagaucugcguggcuccaccuccagugggcugggauugaugaugccaccacacccagcaaccuuuuucauuaaaaaaaaaaaugguacaguagcugagcguggcggcuuauacuucagucccaucacucuaaaagcugaggcaggaaugauuaucaggcaagccaagguuacauagugagacccuguuucauaaaagcagauaacaggcagaaggugcagacagcuggaaucugcaugcugguguugcucucucaaccugugcaacugacauucacucuuguugccagcugagacuuggcauaguuaauguuagugaggcagccugauaccaauuccuguuaagaacacugccuguguguacguacagggaguugagcuguuccccucugaauuccauuccuauuaagcaaucuagauaucuuguuucuuaaaucccaaggguguccaaggauguuagagagguagagagugaaugugaaaacuugaaaguguugaaagugaaugugaaacuuucugguuguuuuguauuuguuuucccagacagaucagggcuggucuugaauucauugagacccuccugcaucagaugauuuuuuuuuucaauuaugcaugauugcuaaguguauagccguguaccaugugucugauaccuacuagggccaauagaagguguccauuccaguagagcuggaguuacagggaggugugagcugcccaggauggacucugaggacccaaugccaguccucugcaagagcaacuuuuuuuuuuuuuuuuuuuuuuuuagguuuuuaaauguuauguguguggguguuuggccuguauguuuguucaccacaugcaugcaguacccuuugagguccacagaggauguuggcuccccaaggaacuggagucacacauauuguugauaccugccguguagguguugggacucaaaccacgcucuccagccccaucuguuuuccuuuaugguguuuucccagaccucuucaugguauuuguuacauguacaguguugugaaucuauacuagacuuagcaugcuuugaccccguuuauuucagcugugugugugguguguguguguguguguguguguguacguguacaaguauaguuuuugagacagggucuugccuagugggccgcacuggccuggaauccccuccguagagcaggcuaugcucaggcugcuggcacccuccuguucacugaggucaucacugcaccugguuuagaguuaagccuuuggagaguuauuuucuugccaaaguucgaagaaaacauuuugccggaucaagucuucauuuucauaaauugccuggcuuagagccaaguguuauaaaggacaccacaugaagucucauuaauguuuuuuuaaaaauguuuugaaauucauugaauuaaaauccuuaauagauuuuuuuuucuaugcugcccucccccaucccugcccuuuggauuucagcuuuuguuaaaugcuagaaacagcugauuuggggguccuuaauuaaaguauguauguuuacuaaaucauuuacccgaaaaugucuuuggauauugccuguauauaugugugugugcacacuuuuuuuuuccaacucagaauuaugugacuuuaacagaaauaggaccuugugauaaaaucuaaugaaaguuugagccccagagcucaugcuuuggcuacaggugugugacucucugcuggcugaaaacauuauuuuuaaaaaggaaaaguuggcuuuacuuaagaauuuggcaggaaaguguuacucaauuuuuggaacuuugccuugaguauacaaaaaucaaaauauucuuuaagcaguaauuuuaaauuuuuacugugaacacaaauguuuuuucaguuuuuuuuucuaucuguaucuguuagucauaaguauuuuguguaaguaaauuuagugcugaccgagggacauauuaguugacuuuauuccaaauaaacuccuaugaaaugucgaccaauuuucuuuuuuuuaaagauuuauuuauuuauuuuauguaugaguacaauuauagcugacuucagacaaaccagaagagggugucagaacccauuacagaugguugugagccaccauguguuugcugggaauugaacucaggaccuuuggaagaguagucagugcucuuagcagcugagccauuucuccagcccugaccgauuuucaguccugucaaaaugugacucaucugagccuugugcauuuucagaauaucuuagaagaugugaaacgccuguugacuaauuauggggugauaugaucacuucauccaucauaaagaaaguaacuuccauuguuaauaugaaaucuaaaucaaauggggaaguuguuagugaucucagguucuuuuucuugauuacuaaaacuuuauucuuacucaucuaaaaaaaguaaacuuacuuuauguacaugaguguauguauguguaccauaaccaugugcacgccugguacccacagaagccagaagagggcaucagauccucugaaacgggagcuaaggacagauguuagcugccauuugaaugcugggaaucaaacccaggucugccaucucuucuacccauucauucucucucucucucucucucucucucucucucccucucucccucucucccucucccucccucccucccccccccucucucucucacacacacacacacacacacacacacacacacacguaugaccagaagagggcaaucagaucugcaguaauggauaauuguaagccauccaauguuugucuucuacaaaaacggugugcucauaaacaagucuuccuugucucgaggaggcugauugucaguggggacuggaaagauggcugugguuaagaguucuguguggauuugcagaggacccaggcucacuguaacuccaguuccagaugauuuuauaccgucuucugaucuccccaggcaaugcagguaguacacacauaugcauacagagcaaaaacacucagacagagcaaauaaaauaaacacaaacucauuaagucuugcaguuguugaugcagguggauugauuaaucuaacuuuaaaacugacuuuuagguaguggaauuaauuuaaaaaaauaguuaacauuucagguaugugguacacaauaaugccuuuaagagaauuauggcuuuaaccccuuuauucuucuaggaggaagugaacaucccuagccggcggguucucauuacuggugccacugggcuucuuggcagagcaguuuacaaagaguuucagcagagcaacuggcacaccguuggcuguggcuuucgaagagcaagaccaaaauucgaacaagugaaccuguuggauucugaagcuguucaucaccucauucaugauuuccagguaugggcuuguaugucugcaguuguuauguguucucuuaggacuugccuggcuuauacagaaagugugugcuugguuugguugcgggaaguugugcuugaaaguugugacccguugagccaccacaaugcagaguguccuuguguggcaugcuguggaguggugcuugguguugaggcaagagguucccgagcgugcuggcagguguucugucccagagcuggauccucuucccuguccuccacagcauguggggaggcauggcuuguguugaugcaguacuuuccuugugaugcuugccgugaaguguuagggugcugucugggaacgggguggggguuggggggggguggaaauauuucugcuuuaauguuaagaaaguaugaucaggggaacuucaguaaccuguuugcuguaaccugacaaaaguuagaggaaaaugaagacuuuguucuccuugccauccgauuucagcuuugguucucucuaagugugauucuggaagcaugaguauuagaaacacacagaagccugauugcagacugcaugcccagagugugauguuuuaagucuggggcgggccuaggauauuguauuugaaacaucccagauuccccacauucaaguuugaaaacaauucuuagcaauccuugagcaauuuuugagaaaauggguguguggacagucuaucugucugucucucguuuauuuuuauuuguuuucuguguacggguguuuugccugcauguaugucuauauaacacauacauguaguaccuguggaagucagaaaagggugccugaucuccugaucuauuuauucuuguuuuguaugcauugguguuugucugugcguaugucucugugagugucagauccccugcaauuccagugaguucugagcugccuuguggguguugggaacugaaccuggauccucuggaagagcagccugugcuuuuaaccacugagaucucucuccagccucugaaacuggagcuauaaaugguuguuagccaugugcguuccagccuccagcacacagacauugaacaccaaucuuaguucuugcucuguucuugcauuaaaaaagccuuuucuuuagaagaucugcauccuuguuuugauguguaucucuuucacccagaugugaagaccuugucuguggccuuacugguguguggugguuaguugucaucugcaaagggaauuucaauugggaaaugccucuaacagugugguccguggggguuuugugauuaauaugacuguggcugagccugaguugcuuaugaaaauagguugaacaugcuauggggagcaagccugugagcagaguucauccauuuccuugcuaccaguuaccagucccuucuuugacuuucuuuggugauggacuuugggcuguaagugauaagccauuucuuccucaaguugcuuuggauccacaguaauagaaaaauagcuaagacaugggggcuuacugcuuuuauagucaaguggacaugugauuucuguaaauagcugauucuuguuaaaugaguggucaaaaaagcuugaauuuaugaauuuaacucgcaacugauacuacuugccguuugucaugaguuugguaacuguuaggguuggggcaucgcaucuuggcagagcacuuggcugucuguggggccugggguuuggugaguacagucacaguugucauguccaagguuacuuucccacuacaugggacagagguuuauuuuaguuauagggaguuacuaauagcuuuuuucugcguuuuugucuaaggauugcuaaguuguuuuuaccuuggcuaggaauauagcucagggguucacgcaccuggcuaagguacaguguuaaguucugggaucucuagcacugccuaauaaacauucaacaaaauaaauuguucuuuccuuugcagaauauguguguguuuucuauguuucuuuauuguuuuaagaaaaaaguaagagaaauggugguagcacgcagcuuuaaucccaguucuuuagacagaggcaggugaauauuugaguuccagaacagcuaggguuauacaaaaucucugucuugaaaaacaaaaaacaaacaaaaaaaagguaagugaaauaaaaggaaaacaaguuaaaccaauuuauucuuaauugaaggcauguugacuuaaggagccuuuucuuccccugaaguuacccuaaggaagccaugguucucuguucucuccauuuuggguuaaaacucuguuuguuucagccucaugucauagugcauugugcugcagagagaagaccugauguuguugagagucagccagaugcugcuucccagcugaaugugggugccucugggaacuuggcaaaggaggcagguaaggcuacauugccacuggacugugcuuucaagacguggugucugugcuccauaugcaugccugguauccuuggggcccagaagagagggccucagauccccugggauugggguugcaggugguucugaacauucauguggguccuuggagccaaacccaggcagggccucuggaagcgcagccagugccuguaggugcugagccaucuccagagccuccuucacuggguuuuuuuuuuuuuuuuuuuuuuuuuuuuuaagaugaaauuuucauagcugucuuacauauguuuuuguuuaucucaaggaaaacaaagcaaaacaugagacacacaaaacacuccaaauuccacaaaaguaaugcaguggauuuaucuucucuuucuguagcugcgauuggagcauuucucaucuacauuagcucagauuauguguuugauggcacaaaucccccuuacacagaagaagauauaccaaguccccugaaucuauauggaaaaacaaaauuagauggagaaaaagcaguccuggagaauaauuuagguaagauccaggguccuugacucugaucauuuuuuuaagacuguuguucaugaguagacauguucuuaauuuauuaaaaauauacagaauugguguauauguugggagguuaaguuuuacauuccugaaccccagcccuuggaagcugaggcaggaggaucaggauauacugggcuauauagugagcuccuggcaucucuucuaauuaaagaaagaaaagggaaaccagggucuauagguuaauagaaauuagacaguaugggcaggugagaggucaguaagcaaaggugauugucaagguccauguggugggcagagagaaccagcucccugcaguuguccucugaccuucacacauguacacacauaccacacacacacaccacacaccacacacacacacacacauacacauaaauaaguauaauaacaucuuucaagguauucuauaccaucuuuuucuuuuuuccccuuguuuauguuuacacauguauauguaaaaauaacuuauuuaaaaacaauaaggacuuuaaaacugggagcaugaaaucucucucaugugcugauuccucaggaagacaagcacaaaaugaagguucuuaagacaggaauuuuuguauaauauuuuuucagguguuucuguuuugauccauacucugacuugcuucucauuauaugugguaccaguucugccauggcuucuuccugucuguggaaguacccuggucaacuuaauuucugucuguggcagcaucauguucaacgucaugaccccuguggaaacugaugcuuuauaucauagaguaccccugacagccuaccaccagcuugugaugcccuuguuacaggcauuuaacuugucagggcuuuugcuuuuguaauauucugacucggugguagagaacuugcugggcgugcacggggcccagaguuaaaucugcaguauggcagacaagguacauuauaaaugagccagcaauccugcagaagucuccucuugcuuugcuucuuaacaaugaggagaacggauuauuuauagagaacuggaauguacuucucacaauuguggaggcugugaaauccaacagcccgcaggugguaaaggccucguuuaugcuuggccucaaagacccuaaccagauggcuccccauuaagcucuuuuguagugcugucuucaugaccuaaccauuaccccagugcaccuccccacagcaacauccacucccacacaccaacaugccccuccugccaucccccucacccagacacuguuggacuaggaauuaaauuucaguauauaguuucugguacaacauucagaccauaacaagaccuuuguuuacuugcucaguaauuauaaaaggaaauacuacuuaaagugcuagucauccaaagacuaucaaaccucucaccugggaccaguauaaagucuaauucugaauaauucuucauccaagguuguaagaguaugagcaaucaacccuacacucagauugaucaguuucuguuugaugcuuuuuugugcgcguauacuuggccauauucagugguguaucaguccucaaacacuugguuguguaucuucuagggacagccacgauauuaccauaaucaacagcaugcuuacacaguuaggaaaacuuuuauacuccuucuaucaaauauguagcuuguaaagauggcuucccaccuguucuugauccuaaauuguacuucagugcuauuauccuguuuuguucaucagucaugaguauucauuucauuugguuguccagauaggcuuuauuuaucaugaccauaauaacaaacuagaugaaauucuguauaugccaguagauacuuaaaauauuccugauuuuccuuaaguucauccaguaugagcuacuacuuaccauccuaguguauuuuuauuaaaaggcaaaguuucuacuuuucuacuguuuacauccacacaauuucucuuucugccaaaacuuggaaauguaugagucagccauaaaaaauauucauguauugucccuaggggcugcuguguugagaauuccuguucuguauggggaaguugaaaagcuugaagaaagugcugugacuguuauguucgacaaggugcaguucagcaacaagucagcaaacauggaccauuggcagcagagguuccccacacaugugaaagacguagccagugugugccggcagcuggcagagaagaggaugcuggugaguccugaaggauggggccugacuucugucuuaguaaaaggucugcuuuucuuccaugcuucaacuuguguguacauggauuaucacagacugaaaguugaacaugguuuuguuauuuuaaaagauuuauuuaguuuauguaugugaguacacuguagcugucuucacacaucgcagagaaggcaucagaucccauuacagaugauugugagccaccaugugguuucugggaauugaacucaggaccucuggaugaacagucaguguuccuaaccacugagccaucucuccagccccagaacauguguuuuugucuuuguuuuguuuugcuuuauuuuuuaaauacuuuauuuaauuuuauuuuaugugcauugguguuuugccugaauguaugucugugagggugucagaucccauggaaauggaguuauagacaauugugagcugccgugugguuggggggaauugaacuugaguccucuggaagagcagccaguguucuaauugcugagccaucucuccagccccugaaugugcuacuuaaaaguggaaaauggaacaaaagcaaguuauacauuguagaggcuguauucgugagguuuguaugcaggaaauaaauucaaacacagaaaucuugucucugucuuccuaaugcuaagauuaaagaccuagcagauuaacuacacacaguucaaguucuuguuuuuauuuguuuguuuguuguauuaugcauguguauaucuucaugaauuuguguauaccacaugugugcaaguguccagagaagccagguccucugcaaagaccaguaagcacucauaugcacucagccaucuuccaacccaggguaggaaugaauuuuaagcauuuggggaaauuggcacuaaauacaguauuaguaaaagauugggcacagcuuaauuuagaguacuaauaaugcuggcugcagcaugacuacaguuuuugauguaugaaaauuaugugaguauauauagagcauaaacuggcccuuucuuaaaauagauggaauaguaguacuuaacuaguuaguucaucucuucugguuucuugagacaggguuuuuauugcucaggguggccucccauucaaggcuguuguucugccucagcuuucccaaaugcuaggguuacugcuguguguuacuguguuuaucagguucguuucaaaauuauuuucugacugagcuuaguggugcgaauuuguaauaucagcauuugaggcaaaggaaagaggacccugugaauccuaggccugcuaucccuguauacugaauucagaccagccaagguuacaucgcaaaacugccuaaaacagaaaaacguggcaccgggaaugugguucagauggcagagugcuugcccauccugucucaaaacuauguuaaauuuuaauucuaccuuagaauaauuuaaaaaggucauuaaaauuagucacugucuaaaauugaagcaauuuguauuuuucaaaacguucuuauuucuauaaauuacuuuuagugucagaauauuuauggacauugauuuuaggucuuucgaagauaauauuucauaaaaguagguuuacauucuuggaccuuucaaaauaacuuucucugucaaaccuuacuauauggaagcagaaaauugaaacuguguugauuuuuuuuuuuuuuuccuuguaauuguugucaggauccauccauuaagggaaccuuucacuggucuggcaaugagcagaugaccaaguaugaaauggcgugugcaauugcagaugccuucaaccuccccagcagccacuuaagaccuguaagucucgacaaccgcccgcccgccagcccgcccccuccugacuucuuaaggcuguuguguugguugauauugcuuuucuuuuuuggauagcuagucacaaugaacuuugcuuggagcaugucaguaucugguggaaaguuaucccuagagaagucugagcauagugaugaagucuagagacuagguggggcuggugagguggcugggagguggaggggguuaccugcuccaaagccugacaacugacgccaucuacaugguggcaggugacgcccacuggcuggcuucugauaaucugcaggugcacacugugugcugccuuaauggcagcaugccucuuuuuuuuauagcucugauaauaaccaguuuucuggcacuagaagaaaacugaaauaaaguuauuaagcuuucaagaugcugcuuccuuuacucaugcucuguuuuguuuuucuuuaaagauuacugacaguccugucauaggagcacagcgccccaaaaaugcucagcucgauugcuccaaauuggagacguugggcauuggccagaggacaccauuucgaacuggaaucaaagaaucucucuggccuuuccucaucgacaagagauggagacagacugucuuucauuagcucauguguuguguauuuuuuuaaaugaaaaguauaguauguggcacuuuuucaagaauaaaggaaauaguuuuguaugaguacuccuuaauugugacacaugauccuucagguaaacaaugcuguugcacuaggggaauguuggaccggcugagagcggucaugacuuucuguggauuguuuuguuuugucuggcuuaccucgcuauacaaguaauguaaauuaugaucuguaauguccgagggcgggaugaaacagacuguuagacuuuggaugaaaugcauuguucauuccuacagcuuccuuucuugcuguuguuuuguuuguuggcucuuguauauugauagcuucaguguguguagaaucucaugauaaucaucgguguucauuacuugcuuugcuugagcccagaucaaaaugcuuggagaaaagaaaacuuuauuuuugcaacuguaaguaugguuuuuaaacgcuugauucuuuaauguguuauguauaucagaaccuguauagccugaugccuacuucauagcacuguguggcaaacacuugagagagugcacguguguguauuuuuuuaauauaaauacauauauaugucucuuuccuucuaucuuacuaagugauguuucauacaugugguuauaauaaugagccuuguaagucuuuugaccacuucuaaauaauaauaaauacuugcuagcauguaaca

SEQ ID NO: 5939 - RNA, 6287 nt, Mus musculus
cuuaaaagaagaagaaauuaaagaaaucacaucuucauuucuugagaaaauaacugauuugaaaaaucaacucagacaacaagaugaagacuuuaggaagcagcuggaagagaaaggaaaaagguaagucaggcuagaccuugaaugccauggaacauguuuuuuguuuuuuguuuuuuuuguuuuuuucuaacaaauugaaaauaaauaauuuuuuaaauuuaauuuucccauacagaacagcagagaaagaaaauguaaugacagaauuaaccauggaaauuaauaaauggcgucuccuauaugaagaacuauaugaaaaaacuaaaccuuuucagguuuguugcuuguuauuaagccuacuuguaggcuggaagaugacucugugguuaagauaguaccuacucuugcagaggucccacguucaauucccaguacucagauggugguuccaaacuggcuguaacuccaguuucgggcuauccaacaacuucuucaggcuuucugggcaccguguugcacagacauacauguaguacaacacccauacucauaaaauaaaauuaaauaaaauaaaaauagauaaauaaacuuauuuugaucuguuuuaagaauguauuuccucccuugaccauggcuuggugcuucugcaguaugucuucaugguuacaauagucuucaaguuuuaucugguaaugaccucagcgguagagucugcucggcauguacaagggccaggguucaauucccaguacuacacaaaaccaaacuaaagugauaaaaauggcauuuuguauuacuaucauuuuuccagccaacugacacauuuagcagacacuaaauuuuaauguaguuguuaaaauauaagaaaugcuuucuaaucaauaguccuugaaggcucuccugguaggaacaucaggcaguauguuacccugugauguguuuuuccauaugauaugauccaucccaguaguucucaaguuacuguagcgaucuuuuguguuguguuuuguccuuugguuuuaagauaagguauugcucuauaacccaagcuggccuggugcucacugugccaagccugggaucuacuccccuucucccccccaaguucuagcauuaagaauaucagccucuaugccugacuaucuuuucccuugagauucuaggcuggccuagagugcucugcggagcuccauuugucguugaauuccugaccucuugcuucugccuccugaaugcugaauuuauggucauagaccaucauacguggaaauacccugaucuuuuuauaagaaaaaaugccaggugugguagcacacaccuuuaaucccagcaacucaggaagcagaugcaagaggaucuuuugaguuugaggacugccugacuguaaguuccuggacagccaggacuauagagugagacuuuauccccaaacuagcaaacaagccuacaaacaaacaagaggaaggucuaauuggacuggaagcagguguuggaaaaguuugguccaagcauggucacaaaugugaugcuggugugaggcaggagcaagugugcacauauucagcaagguguaguccuggucucaguacuaauaugugcaaaucuaucuuuuccagcaacaacuggaugccuuugaagccgagaaacaggcauuguugaaugaacauggugcaacucaggagcagcuaaauaaaaucagagacuccuaugcacagcuacuuggucaccagaaccuaaagcaaaaaaucaaacauguugugaaauugaaagaugaaaauagccaacucaaaucgguuuguaaaauaaugaucauagucauauauauauuaaaaaccaaaaaacugaacaauuuauagaggaaaauuugucugagaacuaaugacuuacuuaguguugaccagguugauauucaguuuuacuuaguuuuauaacggcuguuauacuuggaaacuguauaaaauuuuacauauucauuucuacuuacaauauagccauuccuuuuuguaaauuccauaaagauaaguaguauucgaaagaaugauuauugaauuucucuuuccuuuuagaaagucuguuuauauuuauuuuuggcauauauuauacaaaacaauggguuauauuaccugagauauggguguuuguauuauguugauuuugauauuuucugguauauacccagaagcuguaagcuggaucauguaguaaugcuaauuugcguuucugaagaacuuugauacuaacuugcauagguccuggugaaaagagccuggcaguccuccaucagcauaagcccuuggcacuuacacgucuccaauuuugagauuugauaagaaugcaguucccuauggaugggucagcagaaagaaagccauuuugucacuguacaacugagaggacaguggucgggagccaucuugagaagggaccuauuguuuaaaaggaaacuaccacggaggccugcgacugggaaacaaucacaaguagggagccugaaguuaaccugccacauguggcuccugaggugggagacagccugagcaguugcccacaagccauaguucaggcaguacgugguuuagcccaggcagugacucgauaagcuaagguagcccugagcccaagaucaguggcucacuggggcuuccgcucuacagagcaguucuguagggucuaaggacucugaagaugugaccccaggaggcuacucucaucugucuucucugcaguauucuccuugggcagacucggagcuaguauuuuagcacaagaaacuggggacagggaaauaaauaacccucucucucagugccaccucuacccuuggaacugugggucuuagugacuuacaaggaaagggagugaggaauagccucgguuucucccaguuuugcaucuccucagaaccguuaugugcuagagccagggagaucaggcucagugauuccacaccuccacaagugugggugagcaaaagagaucuauccuuaauaauuuucccacagacaucggucaccucagcaaguaggggcugcuggcaaaauggccucuaugugguuaggagucuuugggaguuggggaaagaaaagcuugcauucuugacgaugcaguuucuaguaaggaguuccuugguuucaaaugccaggcaagcaaacuuuuguggguuuuucugaauaaauaguucuuucuucuuuuguuagucugcuuuuaggacagucuccagaggcagaacacaauugcuuaacucuuucuguugucugguuuuacuaggaagccugccacaaaccguuaggcugucaaaccaaaaguugaauugggggcaauuuuuuuuaaagauuuacuuauuuauuauauauaaguacacuguagcuguccucagacacaccagaagagggcaucagagcuccuuacacaugguugugagcuaccaugugguugcugggauuugaacucagaaccucgggaagagcagucagugcucuuaacugcugagccaucucuccagcccugggcaauuuauuuuuacuucauauuugaucagaaaagugcacacauaacuguggaaggacaagaaauuuuaaaauucuuuauuuugccagagcuguuccaaaucacuuuguaauuuggucuuagugaauaaguaauagauauuuuugccauuugcauuuauacauaagcaacuuucuggaauaugucuacaaccaugauaaccacugugcacuuuagugauuauuuauauuuuucuuucacaggaggugucaaaacuccgaucucagcuuguuaaaaggaaacaaaaugagcucagacuucagggagaauuagauaaagcucugggcaucagacacuuugacccuuccaaggcuuuuugucaugcaucuaaggagaauuuuacuccauuaaaagaagguaaaaaaaagugugcuuaugcuccugucauucgccuuuuuccucuuuguuuucacggcaguuggugacauaacuuuauaaccuaugaaacuguugguaucuucuaauguagaaggaaugcuuaccaaguugacgugugcaauaccauuuucuccuccccuacucugcuucugucuauccagauccgcugaccuucaagcuccauugcaucuucccuagucugucuuucauugcuccuaccagcagucucccucugaauuacauuucucuuugccaaagguuaaucccucuguauagagcccacauugaaaccuaaguauaucuuagauccauaaucggcuuuuacauuucaagcuuagagaggcuuuuuucuuuuucuuuuuuuuuuuuuuuaaagauuuauuuauugauuauauguaaguacacuguaguugucuucagacacuccagaagagggagucagauccuguuauggaugguugugagccaccaugugguugcugggauuugaacucuggaccaucggaagagcagucaggugcucuuacccacugagccaucucaccagcccgagaggcuuuuuucuuaacagaaacuuuguauauugaguccuaacuguuugaaauaccaaauauauauuauauguauauauguacuguacuauauguguguaauauauauguauauuauacuaugauauauuauacauauaauuaugguacuucuauaguaccauaucuaaaacuagauuaguuuuaguuuauaauggcuuaggaauuugguuugguuugauuuucaaggauuuauuuccaggcccaugaacauacuaggcaaguuguaccugagcuacaucgauagccuggcucaucuguuaguaguuuuaauauaaaagacuuaaagcuccuugucauacucuuuuucaggcaacccaaacugcugcugaguucagaugcaacuucaagaaucauggaaguauacgucugaaauacuuguugaagauuauuuucuucauuguucuugauauuauguuuauaguauauauuauauaauguauuuaauuucuacugccuagucuuagguauaugaaacgguaauucagcauuuguucucugucuuagucaggguuucuguuccugcauaaacaucagaccaagaaacaagcuggggaggaaaggguuuauucagcuuacacuuccauacugcuguucaucaccaaaggaagucaggacuggaacucaagcaggucaggaaguaggagcugaugcagaggccauggagggacauuccuuacuggcuugcuuccccuggcuugcucagcuugcuuucuuacagaacccaagucuaccagccuagagacagcaccaaccacaaggggcccucccacccuugaucaauaauugagaaaaaugccuuacaguuggaucucaugaaggcauuuucucaccugaagcuccuuucucugugauaacuccagguggugucaaguugacacacaaacacauuacuauuaagccucaacccuuacuuucuuauuaauccccaugaucaaaauaacuuuaaaagucccacagucuuugaaaauucuuaaaauuucaaucccuuuaaaauauccaaucucuuuuaaaauucaaagucuuuuuacaauuaaaaagucucuuaacuguggucuccacuaaaauacuuucuuccuucaagagggaaaaauaucagggcacagucacaaacaauuaaaagcaaaaucaaacuacaaccucaaacgucugggacccuccaagggcuugggucacuucucuagcucugcccuuuguagcacacaacuugucuucuaggcuccagaugccuguacuccacugcugcugcuguucuugguagucauuuaugguacuggcaucuccaaaacacuguugucuuugcuguaacuaggcuucaccaauagccucucauaggcucucuucauggugccaagccucaaauccuuugcaugaccccuucaguccugggccaucaacugcuacugaggcugcaccuuuaccaguggccuuccauggccucucacaugccaagccucagcugcucuuuaugucuucaaaaccaguaugacucuuaaacauaaccaaguccagcugcagcuaagguagaaccuugucuaucucuggaacacagccucuuugugcucucagaaaacacuucccuccuaugacuaggcaggccuuuuacucagaucuccuugcuuaugucucccaauuacuaggauuuaaggcaagcaucacauggccaggcucucaagcaaaucugaaaaacuuuacauguaugauuuuuagagaauuuaucaucugcauauccucugaauguguguguaauauaaaauaaaguaauauaaa

SEQ ID NO: 5940 - RNA, 6424 nt, Mus musculus
auauugaggugacaacaugucaauuuauuagaaaaaaguguaagauuuucaaucuguuaauauuuuacucauaagcuuuucacacauuucaauuuuuuuuuuuuuaagaauuaaaaaacacagaggaugcaagacuuuuuuucuagaccaccuugucugaauguuuaaaaugaaaugaagccacugacuuauacucaggggccucaacuguugucugacauuaagaggcaauuaacucuuccguuguuagggguuuaucauuuuucaauuucuugacauaaucacuuaggcagcaccaaaccaguuagaacuuuucauuaacucaaguuauccaaaguacuucaguguacuuuuuuuccuuucuuaaaauuuccaguucuguccuuuccgugaacagacaagcauauuuagacaaaggguauacaacucuuacucagaaauuuacucaacauuauuuuuauaucacacacauacaaaaaaaauauuuuuccaugaaggcaccuuuuucauuucauaugauuuguacuccaauguuuuuuguaguaaaaauacaauuaaauaugaaauuaggaaaauguagccuauaaaacuuacugcagagcaguaaaaguuaucaucuauccacauuagagcugcucugccuccugugcaaaccauaucugaaugugaucuuuacaaccauauugaaauacacuuggcaaucuuuaacuguagacacuggcugcuccauccuucuccucaucaacugcauuaaguugccagcaccugccgggauccacgagacagagaaacacuaagcaauagcagucauuucucaagguuugagaaaucugguccgcccuucguguaguucccugagauuucugcuccacuaaagucaaaaccaggauucugaaagacauaaaauauuaaaacuuacaaggauaaguugaauucauaauugacaaaaaacaaaaacaaaaaagucaaaaaauaagaaacaaugucaaacuugaaaucaccuaagguaaaacuaagaggccacuccagcuuucagacuauaaacacuuauuagagugauaccugcaccugugugagcaccauaaaacuggauaaugaaacauuccuuuccauuucacaaacaaauaaaaucuguuuauuuguauaaacacauauuaaaagcuuuuuuccuuccuggagggcacauuauggacuuaacacagcccuugaaacuaagcaaguacuuaugcugagcuuuuucauuuuaaauuuaauuuuuacuccugagccauggucuagcuguaucacccaggcuggccuugaacuugagguucucuucucucacccucccaaguggcuagaacgaagggcuguaucaccaagcucaacuaauagucagcgguguucugaagcuuccuguguggcaugcagaguucuaagagugauauuuacacuagcauauugauacauauuguauaguaugaaguacucauucaagcuuuagacuuuucaggggaaauuucauuuguuuaauggaccuuuuuugaacuacuauuuggaaaauaccauuuaaacaaaugugaacuucaaaaauuagcaaauaaguuguucuagaggagcuuauauuguagcagggaaauacaaauaagaaaccauaaauacagagcacagaacuugggaaaugugauuuguccaagagucagguaauaaucacuuuaggcucugcagaguacaugaacugucuuacucaauuacaaaaaacugcaacguguaagguaacauccugaugaguaagcacagguaugucucaguaaaacccguggagacaugguuaggguuaggguuaggguuaggguuaggguuaggguuaggaggccgauuuuccucaaaccacauuuugucaaccugacucaguguuaaagcuuguaagugcuauaaaaaagauaaacaggaaguaugauuggagaaauaacuaggagagaaaauuauagacuuuaaugggauagucaaaauguggauuuuuauuuguuugguuuuguuuuuguuuuuagagaugaagauucucuguauagcccuggcuguccuagaacucauucuguagaccaggcuggccucaaacucagaaaaucugccugucucccaagugcugggauuaaaggugugcaccaccacugcccagugucaaaauguguuucacugagcaaugagcugaaagcuacagaacacuccagucagaaucagcggagagccaggcaugcugguacauaccuuuaauuccaguacuuaggaggcagaacucuuuagguugaaggucagccugcuacauacacauugagacagucucagaaaaacaaaaagggaaaaacaaaggaaggguacggcaagaaaguguaucaaugaccccauuaagggaagaaagaaccuggagaagucuaagaacaauacauuggagaagaacaaugcaugaucugacuugcccuaucaagacuucugccauugcuaaaguccgaggacugcuuguaagaguccaggaggugaguuagcacuuuauucaaguaauccagaccagaaugcaagcagauggggcagugugaagugguagcauagugaaugggaguggaagacaaugguaagaacuaagguagacaucaggugucuccuacauuuguucucccugcuuccguuacugagggagugucucucaagaaaccucaaacucccacauucuagguacugcagccagcuagcucgccugggagauccuuuuucucugccgccggagcacugggcucaggcggccaccauaucugugcagcuucugcaugguuucuggggaucgucuaguaggccuuugguccucaugcuugcaugguaagugccauagccacugggcuuucucugacccccuccucccaacccuaaaucaugaacaaccagucuccacuaacuacaauaaaaaguagaauaaaugugggagcgaaauuagauugcuuagauugcucaccuuggacacaaaacgucuggcagacagaaaaaugaguauacgcaacaaggaaccgagaagucuaggucagacauauaccuggaagucagcaugaugccgguggaaacuaccacuaaaaaaggccgaucaagaggcagaagcaagagguggagaauccaaugaagggacagcucccuuucauacuauauaccuacagcgguccaguucuuuagguuaauuauucaugaauuacuggugugcauucagcaucggucuuacagaaaugcauacauuugugaaauuugaaaccuacauaauaagcaauuuucuaaccauucacuuuaaaauucaccuaaaaggcuuuuuacaccuuuguauagcuuaugacccccugugcguuugaauggaguaucuguacacacucacucccacaucugacuuacuucuuucuggaaucgcucuaauguaaguuuucucugcauuuggucuugcacccaggggucagcugcauauucagacucuaaaagagaaguccaacaguuugcugcaucucucuugguuuuugucaggacaaugcggaccauuuuucuguccucuaagauaaaaagaaaguaguuacagagaaauuacagugcaucauuaaacauuguacuuuccaaaggcuauuagguacuauuuuuuuuuuuuguuuuugucuguuugcuuaaaguuuauuuauuauuauauauaaguacacuguaacugucuucagacacaccagaagagggcaucagaucucauuacgggugguugugagccaccaugugguugcugggaucugaacucaggaccuucggaagaguagucagugcucuuaaccgcugagccaucucaccagcccccuauuagguaguuuugauagacaauugcucucaacacguuuuucuccaucuuucacagcuacaaagacaagacaauauaaaggagaaaugauaccaugauccaauuuuuaaguguaugaaucauaacagauuucucuuacccaaaguccauguuccuucaucagcaauuguagaaucaaacaguuuccccuggaaaaucaauauaagguaauagaauuacaguauuucauuaagcuuuauaaauucucaucauuaagauuuggcucauuccaagcuaaggcacaucuuaggccaaguuccccuaccuguaggugcucaaccuugaacuuucgccuaaucagaguccaguuuacaaaucugacaacuuuaccauggaagaaacacacagggaccaccaccacuacacaaaacaggagaagacauacuacucuuuaugauagaacgcaacauuaacauauaaaacgcuuuaccaauuaauuaauaugaacaagacagggacuccuacuaaaacuagaaaaaauguccuauuuuuuguuuuccuucuuuuguuuugcauuuuuuaaggggguggguguucccuguguagcccuggcugcccaggaacuugcucuauagaccaagagccucaaacucacagaaauccugucucugccuccugaaugcuaguauuaaagguguguacagccaccaccuggugacuauguuuuguuuucuugaagcagagucugucaguccucagccuguucaucucaaccucuuucaaggucacauaucagauauccuacauaccagauauuuaaugacagauucguaaaugcaaaauuacacuuaugaaguaucaaggacacuguuuuuauuguugggggccaccacagcaugaggaacuuuuuuguuuguuuuugaagacaggguuucucuguaaagcccuggcuguccuggaacucauuuuguagaccaggcuggccucaaacucagaaaucccccugccucugccuccugagugcuaggauuaaaggcgugugcccaccacacccggccaugaggaacuuuauuaauggagcgaagcauuaggaaaggcugaaaaccacugcucuauggagucauggagcuggcuuaguacaucuggcuugcuggccuaauucgcugagcugagaucuaccugccuaagguucccaaaugcugggauuaaaagcgugcaccacaacaccugccuuaaaagugcucucucuuuuaaacucaauguuauuaaagcuaguucaaucucuuuugagaagcuggcacuagaaaaggccaguuucuuaaaaagguucaaaucacauguugcagaaauugauauccaauuagcuguugacuaauuuuccuucuccugcccaagguuacaaaacacaguaucaugucuccguucaccacuacauuauacagucauccuccaacaggcuaugcaucuaaucuagguguaaaguauagccugauuguuaugugagucuuaauaaauucuuaaccaaaaacggggaaaugugaccagauuaaaaauuuggugaaauuagguaacuucacacaccuuuucacuacgaugaagaucaacaugcaagaaacuuguuauuuagaaaaccaaucugacaucuuggaauccucaucccauuacccuagccuugcuuguaagugccuguauuagccuacacgucaugaacagaguucagaauccuuuugucuagucucugggacucccaucggugcccagaagacgcauauucguucuuuugaccuacuuagccuucugucagcaggaacuccggaggaaauaaaagcaccccaaaccuauuuuagaaauaaaguggagaacaaaaucuuugaguucuacccgcgcaaaaucugcucugugggugcagugcuccguggagaccccucgccagaacaauuuaccacuucuuucuaccagccaggaacuaaccuugccacacccagcagucaucccucugacaccgugaauuuuagggcucggggugcgggaaagccagaagaaggaacucgggacaagcccuggcuugcuaccuugaggaucucgcggccacccacggccagagccacgugccgacucugcaggccgcacuggauguccugcgcgcgagugccggggggcaccuggacuucaaugaacaccuccuccagggucugguaccacuguccccacggagucccgcaaggaaccaccccgcugcgcuccucaaacggggcggacauucugaagacgccacgcaggcacacggcuccgggagagcacuacaccggcgggacuaggcucugggcuugcccucggcgccuuggggucacugcacaugcgcaagaguccaaacuggcguguccgagugugcaaaauucucccuuucagagcccauuuaagacacucgugagcccuggugaaaucgaccgaagccuagagauguugacauccaaagaacacugacgccggaacaaaggagaaaagugccugcgaucuuuaaaccugugugacgccaaaauuccgacgcguccaccggccugugaagugcgcuugcgcgaacugggcuacccaguaaaacug

SEQ ID NO: 5941 - RNA, 6762 nt, Mus musculus
guugcauuucaaucauuuuauugaaagguguauucaaaacauaaugguaguugguuaguuaacuucuguccacuccaaaucaauauuguuuucagacugaagccuaucaaccuuuaggaagaacugaaguguucucaguguaacgugguuuacagagguuaaggauaaaauacacccguucuuugguuuauuguucagcuucucaauggauaauuuucuuauccauuacaugucaaaaugguuccagcuacucuagguugacucaggcuguccagggcccugagcugcugccuauguuuuaacaguguggaucauacauucaagccagcauggagacucugagcacaacggcucuuauaauuauggaggugucuccuuacgucccauaagacuuagagaaagguuuugcagauaaacucagcaauuuuauuucuuuuaaaauaaaauucuccauuagaagcaauggcaguuuuauagaaacagucuguaguaaaaaugucuggaguguuuuaucaagccuaaacuaacuuuagugcaauaaauacauuuucagagugauaauucauccaguuauuaagacaguaaagacaauucucucaaaugggauuagauugaagcagcaguucugacaaauuuuucuuuuauuauggauacaaacaccuauucucuagaagaaauauuaaagguaacaaauuuucaaaacuugugauaucugcuuuauauaaaacacccacaauuuuaaauguaauucucauagcaauaaaaaaaaaucccaccuguaaauuaacuauuacuugguuaugggugccaagaaaccauuuaccgcuuaaguaccccuuuuaauaccuuaaaagugcauucaugaaauguugguuuuuauguaaaccucauaauuuaaauuuugagauuuaaauuaagcaguuuaccauuuuuaauaccaccuaagaauauauugaucaaaucugggaagucagaugaacuuuagaaugaagguucacaguuuuauuucacauuuaugucuuuagccuugauuugaaugcuuccugggugaauucaaaucuaagcguagcucucccaagcuuagaaucaggaguuucccuaaccgugaggccauucugccaaggcuacuguggcaaggugcugagguuucucagaguaaauccuguaccguaggaaacucaggucagaguggcagaaagacuugagggaccguuuuugcugcugcuguaauccugcuacauaggcaaacaacacagacccaacuuaacagaaaucugccuacaaacugcgagcugcuaaaggugaacuggugauaucucagacgcaugaucauguauuuccugcgggggguggugagguaugugcauaugugagagaacuugggaguucuucguucucuccuuccaucauguggguccugaagaaugaagucagguugucaggcuucccuucuaaaccaucuucccugacuucccagcaacauuuaccccugguguuugguuguuuugaguguuuuugagacaaggucucuagcugucuuggaacucacuguguagaccagccuggcuuugaacucagagaucuaccugucucugccucucuagugcugggauuaaaggcaugugcugccaugcauuaaggaaaaaauuguuuuuaaucauaaaaagauaaaucuuugcuaugauuaagaaauuuagaugucaaaaauguguauguaucagagaccaauuuuauauuuucaugcauauaauuacuuuguauuaguccaaaugcuauagagguaaaauacuagcuauagaauuaagacacucuggcaguuuccagaaaccuaacaugggcaugcccuauauuacuuuguaaguccaucacccagguuuguacuucauuuucauagucgaugggcagauuaaaauuuguucauauaugggucacauugcuuguuguucugcaugggcuuaugcaacuuuaaauaagcuacaguggggugguacguaauuuaaagaagugcuauuucaguaacuacuuuuaaaauucgaguuuaaaguauucucuuugcuacuacgcuaaucuuuugaugaaaaguauuagcguauaucuagggguuugauaugucuuuucucuuaaaacugcuacgcacuguacacagugaaugccuuccaguauucucuaucuagaccagucaacaauucacuuuuccuuuauguuuucaucccauauucuuuauauugaagauaguauuucaauucuucaguuguagcagaaaaugaucauacuggaaaauuuucuguauacagagaauaacaaccagauuuaucaacuaacaaauggucucaggaaucguugggaggugaguuauucuauaauaacugugcuucaguugccgugcagugcguccagacacaauccauuucaacuucugaccguuagguuuggagcacuuguuugaugaauauucaguuaaacacuuggaaacaagcucuugccagaaggucaaaucucggccacuuaucuguacauaaauuaaaaaaaaaagccccacuguauuuauaguaauauauucucauuaauauccacaucauccaaagggaacuaagggagaaccauguaagcuucagaucaauacacagcgucuuguucuacuuuagcacguacaguggauacauuucucuuguagcuugcuaauaggaccagugcuauaaccuuggcauaccuuggaauguuucugaauacauucuacuccuucuguuaacucuacguauuucagugcuuggaucuccaacgcaaggauagauagcgccagcacagaaggcugaaaaggauaaauauaaaguaaaugucaaugacaaaaauagguuucuguaauuaggauuaaucauauaaaauauguaccuuugccuuagaaaauaugauccugcaguggcaggccuuaaguugggcuucuagucuuucaaaauucagaucguuucuccuuuaaaaagaaaaugggauugauuuuauguggacauaucuaguuggcaguuuuaaaaauguauugaagguaguuuuuaaaauaaaacucauacacacuauauaaaaauuauuuuaagaaaaggaaauucucuccuaucagugucaggaacgucuuaaacgaguuuuaaaugauucuggucaaaaaccauuuagugaacaguaguauaccacaaauaccaugauuuuauuucaauaaaaauucugcaucuuuugaauguauuucgauaauuuauguuaaauguuuauuuccuagguucuguagaguagaaacgugccacuuaucuguacauaaauuaaaaaacaaaagccccacugcauuuauaguaauauauucucauuaauauguuucuuaagaaggaacuuucacuaaaugacuggcaggcaucuuuucacuucuguuaggcagcaaaguacaagggaccauagguccuuauuuugauccgaauucuaugaugaaaaucccgauuuuaugaaaccuucagacaguaucccuuugauuuccaagcuuuuuuuuuuuuuuuuguucgaaacaaauuucacauaccucucaaauggcaaggugucgugaacgagugaauaauagagcugcagaaauugaaaggcaguaguagcuuugacuuuccaacacacuuucuccaacacaaucuucuccauucucaucaggucugaaaccgugaaccuauacugacuuauucggaucaaaucagucgccagugggacauuccuuuccucuucagucgcuuucacagccaaauaaaagcagcucaguccaacacacccaagaugcuucgccuguaccuacaaacacaccagugucuuuacagugcuucaguaggacacagagggaaccuaggacgacucagaccgucauuaugaaaaguauaucaagacaaaucgcuacaacagauuugacaggagccugacagucuucuguacccuacuugaaaccaguggcuuuggguggauagggaagauaguugcugucuuaagaguuaagcuuugaaagccauaugaauauuuugucaguuacugggaaauaacuccguaaacccuuccuuuucuauugcaugcaaccuggagcuggaaaugccagauggcuaagggaauuagaauuuuuauauauggguaguaauuaagaaauacacccuaauuccuaauccacaaccuaacauucagacuuuaacggagauuuaacuuuaaaucuaugaugugaauagaugaguggaaauauccagucuaucaagaaagguuuugauuggggcuagugugguggcucagugggaaaggcggcugaugaccuggguucaauccccaggauccguauuccugcagugguccucaucucuacauaauauugcagcauggguguguccauaugcacacaaacacacacaaacauacaaauauauguaagacaguuuuuaagaaauuucuauguuuuuguuuuuuguuuuuuguuuuaauuuuuaucuuuugaaauggucucacuguguauccuugacuguccuggaagucacuaugucuaccuggcuggccucgaacucacagaaaccugccugucuuugccauccgagugcuaggauuaaaggcauuucaccaggcccuuaauuuuauuuugauuauuccucuguguaagggagaguuagcuaggagggcgugugucugcccuaguguaugugugaaggucagaggacagauuuggggacuugguucauucucuucacuuaaguguuccagggacagcacucagacuugacucucugaggccuguguaacaaguacucucuguguucagcuacuuugcuggcucaagacaguuuguuacauagagccagcuuucccgcuacuggaguacuacaauuaauggcuugauguuaaauuacuuucuacuucaguauacaacuaauaagugauguuuuacaagucuucauuauggaaaggaagcauugccacauuugaaagugguuuuuguauaccagcccuaauccagaaauuugauggcuuuuuuuccuuuuuauuaauuugaugugugugugaguguguuugguacauuugugcaugugccagaggaggcuagaagagggccucagauuucaacugcccaccuagcuguuggaacuuaauuuagauuuucuggaagaccaacaugcacuccuagcuacugagccauuucuccagcccucugcaauuugaucucuuaaacacauggagcgaaauuaagagcugagauauuguaacauaaacauaccuucauuuuagacaagaaucuguccaguaaauucacagcuagggaaaaugucuccgugucaaagccaaagaacugaguuagacuaaguagaucuuuuacuucaaagucccguaaucuugcagucauucugaggccauuaucaugggccgacucaauuaguuucaagccgcagaccuuuggcugacaucuagacuccuguuccaacaggguguucagcugguguagcaguuucugagagucaguugucaguacuucuaucaucuauaaauagaacaaacccagaaaagagcauaagaacccugccuggcuaucucugcauuguggcaaaaagugcuuuauagugcaugcccccuccaccccccaccccauuuccauuacgucuaagacgaagacacugcaaagccaaggucuguaaguauuuuuaccuucucccaguaggucacauuccuaaauugugaguuuguauaggacauaaacuauggcuuaaaaauuuuuuuucucuacuuaagcaaagacuucuucauugucaguacaugccacaaauagauacugccccacaugauacacccaaacuaaaagucaaaugauaguacauacucugccauauauguuaacaacgugaaccuuaguuccuuaccuaugaaguagaaauacgauuauuaccuacaaucucauagcucauagauuggguagcuuaaaaggagucacacaaaccgcuuagcacacaggugcccauuuauuuccagguaaugagcuuauuuuuacaccugugaaaugagggugacaacaucuguuucuuggaguggcugugaauaacacacgauaugacucaguguggcacggugcuuagcacucagugcuccgaauagucuaacgccauuuaaaaaccaaaagaaaaaguuaggugaagcuggggaguugcauugguggaaguaugcauuacacuuccucugaguccugggcacaaccuaagcccuggauacagaggacgauucuucccugggcaguuuaaagaugugacaggaaggucgucuuggugaggaaccacuaacucaguucaggggugcagguugggacugggaggcaugacauaggaauaccgcucccgcugcgccucucucuaggcgcagacuagcccgggcuugcguuccggagugcaggguucugagauccaccccauaguccccucucaccuugacagccacgucuucaccacggugaccacccaccccgggccugcucucagcucgccccacguccccgauccgacaggccuacuaaggggacggacuagggagugggggucaagugagcagaggcccggggaggggccggcgucccgguggagggucccucagcgcccugaccaaguacugccuuccucggggucagcgcgcagcgaaggacugcgccgggcagugggggaacaagcuggagaccuggcucucuagcugggacgcaucuacgucgcugauuggugugguucuuuugauggauggucucug

SEQ ID NO: 5942 - RNA, 1086 nt, Mus musculus
gaaccugcaaugcaaaugugcuauuguuagaggcucuuagaagcugucuugagaguuaacaauuaccagguauuccuugugacucuuguaacuuuacacuuccuugugacucuuaacugguaucuuugguaucuuccaacaacgcccuccccacuuccuuaaguuucgguuucuuccuuuaaauacccccuuacccagcuacucggggugccacgguccucuaccccugugugguguaugaccaugggcccgagagcgcucuugaauaaaaauccucuugcaauuugcagcaagacccguuucuugugggugauuuuggggugucgccucuccugagucagaacgugggggagcccucacauugugggucuuucauuuggugcguuggccgggaaacgcgaccaccccucacacccgagaaccgacuuggagguauggggauccccucuugcgugcgugugugccggccagugucucuguuuugagugucuguuuucugaaacgaacauuggaacaugugcuuguuguguuggguuguuugugucuuguccuauguuucugaaguacggcgaagucugaguuuggauccgucugaguuuauugaacuugugccuugguuuuccgguugcgagaucguggguucgagucccaccucgugcuuugguuuuacaccuggcagagugagaaacaagugagauucucugguuuugguugucuagguagaaguggacgacgguguuuguagacgauggggugaugggguuuucugaaaugcgcgcgucuguauuugcagcuguccuuuugggccguaaggaccggaggacuguggucggcagacgugcuaagaggaccacaggcuguggcccugggggacgcccugggagguagggagagucagggacgccuggcugucuccggagaucggucagagggaccgaguucuguugaagcggaagcuucccccuccaacaucgucuaauucuuuugccugcuuguggaggacaagaaagggucgagugugucuggaucuguugguuucuguuuuguguguuuuuguguauguguuuagagcuauguaaaaaucua

SEQ ID NO: 5943 - RNA, 2249 nt, Mus musculus
auucuuuuuuuuuuuuaacuuuaaacaaaauuuuauuacacaaagguugucacauaauuggauacuucucuacuuuguacacaaucauucccacccuccacagaaaggcugcuucugaacucucauguggugacacagugcuacaguccugaugcuaacagaacaguagagaugccucagugauuuaaguugaaagcaggacacugguauauggcucuugcacccagcaucaggaauguacaaaugucuuuauucaaaaauacaaaauaaauuaucuguaggcauggacaaugacagcaguaaaccauuauauaucaucaaaggaaaccaguaacugaugauuacaguggucagccagccuucucuucagucauuuucuccaggugacuucucugaaguuauuggugaggaaccugccuugagcuuccugucacaguucauugauaagggcaaagcacuacucuaggaguuagagcaugcugccucccauacccccucccaugccacccauugcacccauuccaggguccuucucuucuuuaggaauuucugucacuacagcuucggcuguaguuagcaaggaggccacuccagcagcauccaguaaggcaguucuuacaaccuuuguuggaucaaugaucccuuuuuccaccauguucacaaaaucuccaagccuggcgucauaaccaacuucugaggaacucugcagaauuuucucaacuaucaaagauccuucaacaccugcauucuuagcaaucgucauugcaggaauuuuaagugcucuuuuaauaauuucuauaccuauuuucuggucuucauuagcaggcuuuaaugaauccaaggcugggaugcaccgaagcagagcgcagcccccuccuagaacaaugccuucuucaacagcugcucuuguagcauugagagcgucaguaacucugucuuuuuuuucauucacuucaacaucacuuguuccuccaaccuucaacacagcuacuccaucugaaaguuuagcaagucgcucauucagcuuuuccuuuucauauucacuaguugugaugucuagcugcucagugauuucuugaauacguuuuucaaugugagcuuugucaccuuuuccuuucaaaagcauggcaucaucuuuggugacaaugaccuccccaacuuuuccuaagucaugagcuugaacaucuucaagauuuagauucaaccccucuucuccaaacaccgcaccaccaguagcaauagccauaucuuuaagcugguucuuccuauuguccccaaauccuggagcuuugacugccacaaccugaagaccaacuuuuagccuguucaaaaccaucgugcuuagagcuucuccgucaacgucuucggcgauuaugaccaauggcuuccgaugagcauuagcaauuucaagaguagggacaauggacugaacacuggaaauuuucuuuucacucaacaagacauaggcaucuuggaauucacacuuuugaccuuuugauguguuaauaaaauacggggaaauauauccucuaucaaacuucaugccuucaauaauuucuagcucaucauucaggguuuuuccauccuucacugugaugacacccuuucuuccaaccuuuuucauugcaucagaaaugauguucccaaugucuuugucuccauuugcagaaauuguagcaaccugagcaauuucuucagggguugucacagguuuagacuguuucuuaaguucagcaauuacagcauccacagccaacaucacaccucuccggauuuccacuggauuagccccuuugcugaucuucucaaagcccuccuuggcaauagaucgugccagaacaguggaagugguggugccauccccagccucuucguuuguguuauuggcaacauccugaacaaguuuagcuccaauauuuuuguauuuauccuuuaaaucaauugacuuugcaacagugacaccaucuuuuguuacuuugggacuuccccaacucuguucaauaaucacaguucuucccuuuggccccauuguaacagcuacagcaucggcuaaaaggucuacagcuugaagcauuaaggcucgagcauccgcaccaaauuuuacaucuuuggcauaggcccgagugagaugaggagccagugcccgggacacuggucucaucuggcgaaggacuguggguagucgaagcauuucugcggggcggcggcaggagagcacaaggcgaggcaggccgucuguggcgagugag

SEQ ID NO: 5944 - RNA, 2172 nt, Mus musculus
uagagaaaugacaguagaaagagccagggaacuggaagccaagaaaacagagauaaggagagaugguucuuuaguuaggaacaaguaacugagugggaugugguucccagaaccacaccaggcaguuuacagcucuuccggccucugagcaucugcaccaugcgcacaaaacggccuccccaacucacauaauugaaaauaaaucuuaaccaagcagacacaagaucacauaaggugggcaugcaagccuggggcuguugaacuuugugggaugcaucuccaaaguuuaacaaugacccugauggaugcugugcgcucuggcucuuguagaggagucugccaggcuggguagcugaaaccuuggagaucuauucucacaguucuggagguuagagacuugagacucagaugugguuccuuucaggccucuuuaauugacuugcuguuagaggaacugugccagagcagaccaauguguucaugggaggaagagaaaaaacgguacugcgaaaugaccugaaguuucaagccacguggagggaguguggcugguaccccagugagggcaagaugaagaugagaagagaagaugaagagaagaugaagaugaagagagaagacggcagaacauauuucuccacugaugcucauggagaugugaauuuugguaaguuaagagacugcagaguccagagggcagucugguaaucugggugugagauauguccuguaugagauggcuuaucuuagucugcauccuauugcugccauaaagacucugaccaaaagcaaccuggggaggacagaauuuauuuguaagucagggcaggaacucaagggcuggaaccuggaggcaggaacugaagcagaggccauggaggagugagugcugcuuacggacuugcgcaaugcuucacuuagcuugcuuucuuauauuuuuggcauuagccuagcuuuucacagcugagccaucuccucagcccuaaccuguuuucuuguaccacugaggaccaucugccuagggguuguuccacccacagccugugugggcuuucccucaucaaccauuuaugaagccaaucugauggaggcauuuuuuccaauggaaauuuccucuucccugcugacgguggucugugucaaguuaacaaaauacuaaguagcaugcugauguuaaugauggacacacacacacacacacacacacacacacacacacacacacugcauauuuugagacagccgucucccuauguaucuggggcuagucuugaacucaugauccuccugccucagcaucuagauucuaggauugcaggcgugcauccccacacccagcuacauauuuucaucaacaugcagagguggguugcuucugauaccaaacuucuuagacuccaugggauugugugaagauuucccacaaguucucuuccuagaagcagaauagcagccaacagguuauuauucuuggucacaacgagcaagaguuguuaggacuaagccagaggccaucuuccuugcuugaaggauucucuucagggucaucuugcuggugguugcaugccuagcacaggggaagagaucugccccuggaugcacaacguugccagggaaaguagacaagaaaaugacaggcacaacgaauucccugggauacaugacuacugggagagcagaggccucugucugucaucuguccuuuagaguagccauuccugaugguugucuagggaaccccagggguacucaagacuuuuguaggaauucaugagauugagucuauucuguugauagcaccacccgcuuaccucuucucucucuccuauucuuccacaggagccugguggcauuuuccagacaggacuuuaagugugaggucacagcugacugaaugcagaagcagcuccaagauuccagcugucaucuaugauccagacguuaacgagccaugcaagcgugcgaagcaacgccagccuucucacuuguuuuccuuccuuugagggaaagguuguuuuucauagaauauuuuguguuaacguuaacaggcuuauuauagucauguuuaagucaaccaguaaauauuuaaaagguuuccucagauuuauuuuuuuaucacuauacauauggacagaaucuguacaaauacaaccauuuguagucuuuaguaau

SEQ ID NO: 5945 - RNA, 6013 nt, Mus musculus
ugaguuacaguuuaaacugcggugugccgggucguugguggcgcagucuucggugaguuuagcugugagcucgucgugggugagggcgucuugggcgagcuugggguggcggggagggcagacccgggacuggagguugaagcagggucgggacgugugcuucacucggccccgcgucccgaggcgcucuugucgugcucgacccacagcaacgcuguuuuuacuuuucuucuucccuccccacuucaggaucucaagcagcccuggcuggucuugaacuuguuauguagcaggaggccaaauuugagcauccucuuggcuucucuuuauagcagagauuguaggcuggagacaguuuugaugggugccaacauaaacugauuucuguaagaguugaguguuuuaugacccuggcgugcagauuuaggaucuggauuaagccuguugacuucuccagcuacuuauaaauuuuugugcauaggugcccuggguaaagcuuggucucuguuacugcguaguuuuuccagccguccucaaugccaauauccuaauauucaggucucucccuuagaguaauccagaauggcuacucuuaucuuuguugauaaggauaaugaagaacccggccgccguuuggcaucuaaggauggguugaagcugggcacuggugguaaguauuuccugccuugagauacacagguguugugaauggucccagccuacaguucccaauguaaccuaggggggccuugaacuucugauccuuugacuccaccugcccagugcagugauuacaggcaugggccaccuugccuggcuuaugcacugccgggaauggaacuuggagcuuuucaaaugcuacuaagucacguguccaggcgcucugcuuaaaucgguuuuuugagacauagcuuuaacuggccugggauuugcuaugcagaucaggcuggccuugaacucaggagauccacuuaccccugacuccuaaauucugggauuaaaggcgugcgccauggugccuauguucauacuuauugucuuaaugagguuauuuagagugcuaaguaacugccccaaaugaggcacagguuuguguguaagaauugaguuaaguuguauggccuaaucuuuaagagcaauacauuuauuaccuuuauuuguguauguguggggucacacgcaugccguggugugccuguggaggucagaggacaaccuguggaaauugguuuuccuuauacuguguggguucuggggacugaauucagguugucugguuuagccgaaagcuccuuuauuuacccacugagucugugauuuuuuuuuuuuuuuaaugauuaucccuuuuucaacagucaaggccuuagaugggaaauugcagguuucaacgccucgagucggcaaaguguucaaugcuccagccgugccuaaagccagcagaaaggcuuuggggacagucaacagaguugccgaaaagccuaugaagacuggcaaaccccuccaaccaaaacagccgaccuugacugggaaaaaggugagugcgggcuaugaacaugaauauuuguacauguguuggcacuuaagaaaaguuuauuauuuuuauucauguauacguagcuguagaugaauacugcaugugugcaguuacauaaggaggccagaagagggcgcugggugcuuggaauugagucugacuccuuuggaagagcagcaagugcuuuuacccucugagccauccuaagccccacugcagcacuucugaugcuuagaaacuuacuucccaucugccucucuuccucucaguaggagguaaagagagguccacaaacucacagagaggagucaggcugguacuuccaguugcucagcaucuugagaucgcagcuuuuaggaguagcuaacccugauuuugccucagcuguucuuaacuaguaccaggaagcaguugguuagaggccaugugacagaugugugaaguacuuagcugggcuugauaagcaccugcaaucccagcacuugggaggcugaagcuggaggagggguuggcuggaggcuagccugaacuacaugcccccacucuggcauacauacacauagaucggaugggaucaagagcgcccaggcuucuguuuugacuugcuauuauugauugucuaccugauaauucuuuggauguuuuagguucugcugcuacuuaaguccauauguuuaaggaacacaaacuuguuaauauuagccaaguaaauaauuaagguaacaguggcagaaaaauuacacuuuuaugaggucaaauugacuuccaggauuagccacuauucuggggugccucaagucuguuuuguccacuguuagguuugaacaguugaguugauuagcuuuaaauuaacccugcucaggauucuuaauaauauauguggacagguacuaagaggucugacuuaaagaauacuuuuauuuuauguauuuggauguuugccuguaugguauauguauugguuaggguuuuccugcuaugaacaaacaccaugaccaaggcaacucuuauaaggacaauaugaauuggggcuggcuuacagguucagagguucagcccauuaucaaugugggaagcuugguaauauacaggcaggcauggugcaggaggcacugagaguucuacaucuucaucugaaggcagcaaggaccaggguauuaaagcccauguccuuagugauacacauauuccaaugaggccacaccuccuaauaucaucacucccugggucaagcauauacaaaccaucacaguauguaagugugccacgugccugaggaagaccugagacaucgcuucaucuggacuggaguuacagauaguugugagccacccugugggugcugggaacugaaccugagucuucuguaagagcagcaagugcucggaaccacagagcaguugguuagaggucaugugacagaugugugucuucccgucuccuuuguguguguguguguguguguguguguguguguguguguguagggcaggacagggccggugcgugugaugguaugcauauccgagucaggacaacuuccaggaguccauuuucuccucaccuuuacacugaguccugaaaacuaaggacugacuucuuagaagacagcacacaaugaacacauucaaaguagugaugccaucauuggaagaggcuguccaaccgcaagcuaccuugcagguuggcgaaacugcauucucucagugcuuguucucuuggguuuuucuagaucaccgagaagucuacuaagacacaaaguucuguuccugcuccugaugaugccuacccagaaauagaaaaguucuucccuuucaauccucuagguaaaaaugucuuuggcacgaugggcaggcccucaguuugagauuucucuuagacucuaacuccgugcgacucuaacguguagcccuagagucugagacugucugaaccugacuuacuuugaauacauagacuuguucagggggacucacuugccagagcaucaccuucugucacgggggagaaagggagcagagauguugaggaaaaaguuagaaguucaaggucaucauugugugaguucaaggccaaccugauuuacagagcaaguuccaggacagacagggcuauguagaaggacccuuucucaaaaaaaaaagauguagauacccgaauauugaaacauuuugugucucguggugcaaccaugacggugcauugcuugauaucaccucugaugccaucagaaagggccaaguagagcugcguuuggacaugcacgccuuuagucccagggagaggcaggcagaucucuugaguucaaggccagccagggcuauguagagagacccuuucugaaauaaaccaaaaaagaaaaggccaaguauaaaguaauauaagauaaaaauuugaaauuaaugucaugcuaacuauuauaggugaauguucuacacuucuaaacuuauuacuguuucugaauucugucauuggugacaaaauuuuccuugaagugugguagacuucccucauuccuugaagggaguaugggacaaguacauucucuagauuguaguuuaacuuucagaugaaaacugccuuccaggaaaaaacaaaaaccaaaaccccaggcuuggcuugcggcucagaucacuguaaauccguuuucugugacaucggcacgcuugucauguuuucuggugugcagaaguucucauuacagaaucuuugacagggaaugggaagcugcucuguaguucagcguugaacucacagugauguugcuccucucucacccucucccaugcucagauaauagccacaucccaccaugauacuucccagaaccuguuagagaauguucaaggucugggcuguuaaaauuauacuuuuuuugggcagugguggcgcacccuuuaaucccagcacuuaggaggcagaggcagguggauuucugaguuugaggccagccuggucuacagagugaguuccaggacagccagggcuacccagagaaaaccugucgucuugaaaagccaaaaaaaaaaaaaaaaaauauauauauauauauauauauauaugaauaugaaagaaaauuauacuuuuuuuccccaaguauggcaaaaguaauaguuacauuggggcaguaacuuuauuaucuaacuggcuuuuguuaaguuggcucuauuuucuauuuuuuuuuuuaaauuuauuuaucuauuuuauguaaguacacuguagcugacuucagacacuacagaagagggagucagaucucguuacggaugguugugagccaccauguuguugcugggauuugaacuccgacccuuuggaagaacagucgggugcucuuacccacugagccauuucaucagcccuaggcucuauuuucuaaauggcgaauaguggcaaagaauaggcugacuggauguacuucccuaccccaugcuuggcuucccuuuguggcagacuuugagaguuuugaccugccugaggagcaccagaucucacuucuccccuugaauggcgugccucucaugacccugaaugaagagagagggcuggagaagcugcugcaucugggccccccuagcccucugaagacacccuuucuaucaugggaaucugguaagggaguccguucaaacucgggcuguaagcaacuugucacaugacacguuuuuguugucgggacugaauuguacaggugagucucugggcagcuucgggauauuggggccaaguuuagaauaagaacuucccucagucauuguguaugguugagucccaaaagaagguuuucuggaaccuuggccagccuuuggugauagcagugggugaaguugaacacagagcugcuuaggcuaggaguugaagucugugguaacugagacuggaugagcacuccagguuccaccuguggcugucagaggaccaguguagacugacaguaacuugucaaccacugaaagcuuaaggcuuuaguuagaacgggugugugugugugugugugugugugugugugugugugagggagagagagagagagagagagagaaagugccucaaaugagauggguugccggucugauuuuaugauuuugugagacuuuaugcucaagagaacaaguagcuuucgcguauuuuaaagaccugcuucuugacuacccacacugaugccgacacugaugcuacauguaaaagaucugcaugugugcgugagauucauuagaugaauguaggaugaaaguuagcagcuaauguuuguuauggaugauggcuagaaaggaagugcagaaucuaacgagaaacuccucuucuuccagauccgcuguacucuccucccagugcccucuccacucuggauguugaauugccgccuguuuguuacgaugcagauauuuaaacuucuuacuucuuuguaguuucuguauguauguuguauuaauaaagcauuugugcauauguucagauugugaauacuuaaccaacccc

SEQ ID NO: 5946 - RNA, 14253 nt, Mus musculus
uaaauauucucaauugcaucuuuauuaacaaaagaaaauacacaaaauagacaccaauaaccgacuuuguguugaaccacccaugucgagguagagauagaacacaauuuuggccuuuaugaucagagauccauuugcauuauaagucugugugugugcgcguguguggguacaagcguggcauacguguagaggucagagaacaaccuguuccuccggagcuguucacuggucugguacuugcagauuuggcugagcuggugagccugagccuuagguauuuuucucugccuccccagggcugggauuacaagcauacaccacugacugcaucuggcuggucugcuuucucuuuaccauccuugcaaagcaaggccuucucugacugagccaauuccccaagccugcauugcgguucuaaucucagucugaaugcucacaccauggaaagccagguaucuggugcuuuucuccugccugucugagaugcugacgucacacaguguccuggaagucagucuggaacacacucgcugagucaguguccccagacuaugcucucacaguggaguggugucagcauugucuuugccauguuuccaggcaaggcaggcugaagaucacagcagcagcaugacacgucggaagccauccuuacggucuuuaaagaaccuucagucucaaguggcuuugcucuuguauuuuuaccaagugauaccugcuggguacagucuagguaacuagaugucuuagaucuuuucaacuuuacuuuuguagcauuaaacagaucagaauuaaaugacauacaauaguaaaaaacacaucauauaucauaaaucauaaaagugacuucuaggucugaaaguucauguucagcaagguaagugugaagcagucaacgaccauuaaaagauguaagguauaaggaaguguacgaaaauccaacguuuaacaacugaaugaaaaauagauuuauuauuaggauuaugggggacacagauauuugaugcccggcagauuucccucugugcugcagauaaagauagaauauuuuuguuuaaaaccaagaaaaucuuagauggcaaaaaccaaaugcuguaacugcaauuauagaguuaaauuacuaacgaugucacuacuagaaucacuaguaauuuaagaacagggcucuggcuuugagaggaccuacaggguggggcuacauucaagagaccagaggacugacggcauguacauagcuggagaccucacuaugaacaaaugacuuuguuuuucucuuccuuccuuccuucaucucuuucuugaaaucaccuugcuauguagccuaggauaaucucaaacuuuuucauuuugagacaaagccucauguagugcagacugguuucaaacuugcuaugcagcuaaugcuacgaggcucuugccucagucuccugagugccaggauuacaggugugcacuaccauacucggcugaccuugaacucuugaccccccugucuccaccacucucaggugccggcauuacaagacgagccaucaugcagacuccacaagacacuugagaggaagagagucaaacuuuccaaaucauuaauuaggauggaugauuuuaacccuaaucacaacuggaugcucuugcuugcuugcuugguuucuugacuguugagaagacuuugagacuucagaaaaauuuauuaaugucagggagcaagaaggacagauaaagauuuucuaucucucggugacaaggagcuggaaagaacaugcuguguauguguccaauccugacgagucacuguccuaggaaagaggccauggggucaucgggccucugccguuucauccuguaggccuccaucuccucuucugugggcucucggguuucauagaugcuguuguagggccgcuuccgcucgucaaucugcaugaucuccuucacgugaagaaggcgagccuccucugcauucagugccugugucgagaugugaaaaagcagcaccaugaaucuccaucacacccgaccacaaaaggccccauggaauagaguguucuaucaaaccccacugucugaaagaauggagucagccccugcacuaugaaacaacaaccacuuacuauuuggcucaucuauuauuuuccauagaguacaaaguguucuaugauguuuuuuaagaaguuaaagaaacucuguuaaggggcuggcgagauggcucaguacauauaggcaacugcugccaagccggaugacuccagcuucaucuccacaauccacaugguggaaggagagaaccaacucgggccaccuaccuucugaccucugcaugaguguacacacgcgcacacacacacacacacagucagacucacaugaucugagcaaacaaucacucaggguggucuccucugcaggcaggcaggaauggcagcaucagccccaagcgcccacuccccacccccgcccccgucuggcuugcugcgugucacuuuccugacugagaugucacaaaguaccuuuuucaguuucuccugcuuccguuccucaucgucgcugucagaacugcucuugcgguguuucuucuucuucuuuuucuucuucuucuccucuuuuaguuucuccugauguagcugucagggagaaugaaaggcuacgugaguacagagcucaggcacguuuccacacccgcuugcucaggacuuagugaucccgagcagacggucacacacugaccuccaggagggccugagguuucuucacagacucuucugcagucgcaccaguuauaauacacuccucugaguucuguggggaaagaaauguaauuucaguugaagacuauaguuacgaaucauuugaagaacagguuagaacuugaaacaugagaagguaggauuuaugcagccugacugucuuacaccuuuaaaaacuagaggacaagggcuauggcugugccuugguugguagaguccuugccuagccuucgaagcccugggccccaucccgagcaccuccuaaagccaggccugagcacagucagaagcucaggggcaccgcuggccagggugacuucucggcuagccaugccuacaugaaaccccaccucaucuccuuacucaucuccuccacacagagaaaagcuagaggguaauacucacaacgcucuccuucccagcuucuccaguacaguaggaauacuuaaaaaacgagugacaacauuuguauccccagcggccuucuuuccaguaagauccccagauaugcuguagagagagacagagacagagguuaucuggaaaggagccuggggauagagacucuuccaucccgcugacaggaguauagaaugaugcagccaccuugaauuuauuuccauuguuggguaaaacagagacagagggugggucaacuucaaaugcuggaaagcugggcacuguaguuauaauggucuaaguucuauucuuaaaagccaggcaugaucccagcauggagacagaacauucaaguuugagccagccuggguaaaaccaugucucaauaaacugacucccaccccacaaccucccaaaaaagucuaugaaaaaauuuaguauuugauucucuuaaggugugaaacauuucaaaccgaagguuuuacuguuaauaaguggcuuugcugaacagugcguagacccuuguuagacuguauuuugcugacagugugugaggucuguuuggcucuuucuacucuacauaguacagcuacaguuuuaaguuuacugauccuugauguuuaaaguuuuguuaguuuagguucacaacaaauggggucaagauuguagcucaguggcagaccaugcuaagcaugaaugaggcccuagguccaauccccagcaccaaauauauauauguguguguaugugugugugugcgcacgcuuuaugauguaaugcacuaaggaacacaguaucaucuacuauauauucuugccaaaaauuuaggcucuacuaaaucugggcuuugacccucaauucuuguuuuaaggcauguagggaucgggggagguuaugacccugcuaggaaacaggcggaugcagagcaggacuuggucaaugaucaauacaggcuuaaccgagagaaggaucagaggguaaugugcucacacacaaggcugaugggccugaguggacuccugggaugcacacaccaguggacggaggacgucaacucuaacuuaaccccugcacaugugcacacucguuuuuagaagacgugcuugagugaaaugucauaccugugauuuccaaauauuucugccaaaaacuauuaaauacaacuugcauguguguacauucaaacccagacaaaguauaaaugguacaacauacaaaaaccguguugauucuggguaagcaugcagaugaaauaauauuuuuuuuucacuucagaaagcagaucauaaagcuaagcuaagccgucagcagcagcagcagcagcagcagcacagagaagccgauggucagccugcucaagugugugagagagaaacagcccggagcccagcgagcacugaccgugugguuauugaucuucacgucuuccucguacuuggagcaggcgacagcccgcuccuggccuuuaaugacugugccaugccuggaguacuccacguagucuucugucugggcuaagagcagcucagcuggaggggcguccagguguucuuggccaccguacuaaaggacauugagcauuuuaaaacacauuuuauaaccaaacuuuuauaucaaaucuuuaugguaaauaaaucuuuccggguaaauaagaaguuucccuuguuaguuaucugguaguuucaagauggccagagauuuuugugugcacaugcccaauauucuuugccucacaacuuuacuguuuccccaucaagaguuggagccaauuucuccaucccuggaguuuggauguguggaagcuagaaaaugugacgaaagcaaagguguguuuuguacauggggacauacuuuguggccuugcccuggagcccucagaaagcauuuuagaaugcugggcugggauugagaaagcaagacugugacgcaggugugagcugugcagguucagggacccacugccauaacaacgugugagaaagaacaggcauuuaucuuagcacuccaucucggaggguugugagugaugcaaaagucuguaccaacugaguuggcaggaggacaggaagagaagccucauggguuaaaaggggcucuccguacugcacaccaagcuuaaugccucuaacgcaguagguaaagguuucuuagccuuaccuuuuccaggaugcuuuccuucugcugcucuuugaagucuucuuuuuugacuuugaaggacuuauacagcagcucuaguuuugucggaucugccuggagaugcacuucagaccccuugucguaggcuucccaagcaaacacuagaagaauuuaaagugucucaaugaguugauagcuccuugugguuuugcauuuuuaaagcaagcuuuaaguagccaucacccaucucccucuuuucuuucugacugcuggcuuuuucugagacaguugccuuaagcuuguggcaaucuuccugccuuggugucccagguaguagggucauagacauaugccaucaugccugucuucagaucuccaguuuccuucuuuacauugauuuaucugcaugugcaaaugcucaugccacagaacacaugagaggccaggggacuccuccauucucucgauuuaccauguggaugcuggggacagcacuccggugucaagccugacagcaggcacccugagccauccugcugguccucaucccuaaagucuaaauaaaaggccuauaaaguguuugguauagaacaaacacuuacguuguguuugagccauggagaugguaucuccuguguaucgaacaaaguuaucuccagcguagcucacucugaaagcacaguuguuagagacugcuuuaagaaaaacucacuuauaaaaucaacuuagaaagcucagaacccuuuacaccaaagucaguaaguuuaacuggauacuuacucaucuggauucuucccugcauuggcguaaggauucucucucaucgcucugguuuuuggaucauaauaggcagaauuuggaucuaaauuucucaaauacugaaaggaaaaauauuugaagacugaguuaccacugauuuauagcaagaaaggccucagcugggcagaagaguaggcucugauuaacuaagcauacguguagguccuguacaaggagaagcgacguugccggccuuccaaguaccucuaauuacacuaaucaaaccacacacagacacugcacaggcagggcaagugcggaaccucuaucucucagagccggaggucaggcugacgugacuuacuuuugcaauaucuucacgaauccggagauugcgaacaguaaugcgucucuuagagucgaaauucugcccaggcaugucaaugucauccgcauauuugucuucgucuucauccucacuguuaugauccuuuuccugaaaggaagaguuggggacgagaaaacugagcaaaaagacgcagcacugugcucuuguuuucauuccccuuuaaacaaaggcucacugugugacuuaaaguuaucacaugacugcgauuacgccgagccagugggacuaggagagcuugcagccagaaggaccagcacgccuuaccaucugagaguuggguuccucuucuccccacugguguuucggagaguucugcaucaggaaagaaggaaaacaacuguaaauccuuuucauuuagauuacuucaaauuuaaaaaacaugcuauaaauggguauaugggagaaguucgcugugugccuagcaugcaccagacccugagucuaauuccuagcacugaagggaagggaaggaggugaaauggagggaagguuggcugguuuauuucaacaacacgcucuaguacuucucaccugucccaagcacauacacucugacacaguagcuacugugaacuacuuuauugauauagaaugucuuucauauguacgugucugugggugugcaugcacauguguguguguuuccuuggagggccgaagagaacacugaguugcuuggagcuggggucucagacagcuguaagcugccugacgugugugcuguuaccaauggucuuagguaaccccugugaaccaacuguuugaccccaaaaggggucaugacccacagguugaggaccacuguuuuaaagagucugaauauuuugcuugacuaucuuguaucuuuacuuacagcuugcuccacuaauuuuccagaggcuaacucuucuugcaguuucugugcuuucaauguccguuuugccuaaaaaauaaagacauuuaaauuuuacuuacaacauucagauggcaauuuaaauguaauuguacauacuuaaagugggugaauuuagugcuuucagaaaugguccucuugggaaacagaggcagguagauuucugaguucgaggccagcauggucuacaagugaguuccaggacugccagggccauacagagaaacccugucucaaaaacaaaaaacaaaaacaaaaacaaaaauaaaaacaaaaaaaaaaaacaaaaaaaaaaaaagaaaagaaaaagaaaaagaaaaagaaaaagaaaugguccuuagagcuagcuguaggauuuugggucucaaagaaggaggaggaaaaggaagaaggggaggaggaggaggagaaaggacaggcagguuuauagagaguuagccucuugcaugaacaagccuagauuuaucugcagagagagccccaacaacacuggcaggcgcugcugacucacagugacuggcugaccaaucuccagcagggucaggucucuuuuuguauguuucaaugcucagaaaaacaugacaucuagauguuuauaugcugucccgugaucuugccaggcaugcuggcacauguccauauuccucguacaggaaucaacuauucgaaucagcuauucuuacaugggaugugagacaacuauaaagcagccuuagacacaagcugcagcuagggaugaagacugcagaacuucuaaaagccagaaucagcuguguguggugaugucacaccuuucuuuaaucccggcacucaggaggcagcuagccagaucucugugaguuuuaggcuagccugaucugcauagugagaucuaggcaagcuaggguuacaugaugagacugccauaaacaaccaaguaauagaagaucuggaugucagucuguucuuacaggucuagugucuuuggucacacuggaacuaaaaacucaagaaacugcugccagccgggugugguggcacuugccuuuaaucauagcaucugggaggcagaugcaagaguucaaggccagccuggucuccacagcaaguucuaagacaguuagcacuacauagaaagaccuuguuucaggggguggggagggggugagggauacacugcugccaaguagggccaccacaccacauucaccauugaauuagacaugcuacuauaagaaauggcaccuucuucagagcaccccaagaugugcaaaagcgcugucagguuagagacaccgcagaauggaacuucucuagggaaguagaaagcagggaacugcuuaccagaucaaccuuggcguauuccucgacaaucuucaugugcucuuccggauuguagccauuccagcggucucucuucccaucauagucaaacaucagcuggggcuggacgugcucgucuggagcaauguuaguuccugugaauuuagcuccaacccgccucggucucugaaaggcagcagaucucucccuaagaacuugcagcacacagaagacucccugcaacguuuacagaguuggcgcaggcacaccacggcauuuuuagugucuuuaguuaccaggcagacuuuggacaggaaacuguaaugauaccagacuaaauucaagcaaauucauuuuuauuuuucuaaaacaacuuuaggaaauagaaguuuuccaacaaggggaaaacaaaaggcuagcugacguuuucccaccaggcuuggaggaaacuuaccucaaagcaaucuuuccucuugugugucauggcuccacaauucucacaugcaccuuugcgguacuugguaguuauagaauucuguucaaggacagaaaagaacaaaacaaacuucuuaucagagguaacuuuggcucucacuaucuugucuacuaaaagacuuuauuuguuaaaaggaagaccaggggcuagagagauggcucagagguuaagagcacugucugcuguuucagagguccugaguucaauucucagcaaccacaugguggcucaaaaccaucuguaaugggaucuggggcccuuuucuggccugucggaauacaugcaggcagaacacuguaugcuguauacauaauaaaguaaaucuuuaaaaaaaggaagaccagguagccuucauguucugagaugaccaaguuuaaagguuuuaauaauauaaaagaagaaauaagaaaagacuggaacuaacacuguguacacugugaauuucaacaccagggucacacaauaccuuccuacuuuaaacagcaucacauucaaaguucuuaaguucuucauaaaaaaaaaaaaccuccaccggcaaaagggcacacaggcugccacccacauaccuccuuuacgccucgcuuguaccacuccccagaugaacugaacugcuucuguuucucuggcuguggucucugaugcuuuaaagugggucucuuugauggaucaauguaccauggaaccgaagaaauauacugaggaauaugaggguugauaucucuguaauaaaauuuaagugaaauugugaaaaaggaaguuugaaaauggcauuuuaaccacaaagguagugagcacagaggcuaagaacagaaacccugccgugggauggagagggaagacgguugcuaucuccauuaacugaagaacuaagaauaaagauguacggugucauauuacaccgaggaacuuucuaauagagaugcggagacuuagguacaacuggaaggagacggagggagggguuagcgagcucccuccaucggagcugaaaguuaaacuagugcacacagccgacugaguaaagcaaucacagaagcauuacaauucagagauuugaaaaauucaaaauaagagcaugggaaaguagccacuuuaggcugggggcagaaaaaaggucaaaaaggacaacugcuagucacuaugagcucuuuaguagcauuugucuacuaaacuacauacuuaugagucugaggagaugagaaagaagaacacacauucugcgaacaauaaaggacaacccccuaccaaagcaaagggugggcccccgaugaacuggggguggauuuaaacacaccagcaacagaagacuuacuuucccucuucaucgacuucugcaggagcauugcccaguuuccucuguucuucuagcuccuucuucuuccuccaguccucucgggucaucuuuuucggcuccuccaaacucaucuccuuugaucccgucaugggugucgcacuaacuggguccacagcggccgccgacauggugaacugguauccucuaaacaagagaaguuuguacaguaauggaggucuccuggaauacacccugacacuacugaacggugucugagcacggugagcuuuccuagggucucucucgcuuacacuuuuuuucucccucuuacuucacaaacuuuuuuuuuguuuuuuguuuuguuuuuugagacaggguuucucuguguaucccuggcuguccuggaacucacucuguagaccaggcuggccuugaacucagaaaucugccugccucugccucucgagugcugggauuaaaggcgugcaccaccagacauggcuacuucacaaacuuuuuaugguguugugaucaaaacuggguccuugcugcacuaacagcauucuccagucuccuauguucuuauucuuucaaagugccuauaaaggaggguuucuuuacauuuuauuuauuuuuugugugugcaggcguguggaagggucggguaaggaccgagcgugccauggaguguaugggaaggucuuuagugggauuuggcuucuuuguggguucuuuccucucccauccuucuucauccccuuucuuuuaccuuuucaacccccuaucacuagauaaaagagaggaaaggagagagagggaagaaaagagaucccugaagaaagccaggagucagaaaggaggcaagguuaucauuagcauacuuccugcugauuggggcacugaguuccuuggggcaaguuugaucuuuguugucaggauaucugauuuuuuuuucuucuugucugcacaagauuaccuaacaaaccucaacccccagcaaucaacaacaacccccaacaacuaacaacccaccccacuucuuggggcucuagcauuuauuuacccucuaaguccaaguccccagaauuccaaaugucacaugaacacagcaacuaccugcaguugcuggcaaagccucugcuagggcaugaagcaaaucacagucagcuacugcaacaguccgaagcagccccaccugggauuaaaaugauaacauauucuuauaauauuucuauguuuuuaaaagaaaccagaacuccaaaauuaucacuacagaggucagagaucaacuuguaggaguugguucucccccagucaccacgugggucccagggaucaaacucaggucaucaggucagcagcaagugccuuuacccgcugagccaucucacugguucuaacgguuucccuuacucaaaaggcuuuacaaacugggcacuguaauauacaaccuaauccuagcaccuggagagcagagggauguggauauucuggaguuggaggcuagucuggaacuagguuggucuacauauugaauccacagcuagccauggcuauauagugagaccuugucucaaaaugaaaaaaagucuuuacguauucuuagcgccaauucucucaacacuccaauuuguaagcagagaaagccauguauauaaaauuuuaaggagcuggagagacggcucagugguuaagaacacuggcuauucuuccaaagguccugaguucaaaucccagcauuacaaccauguguaaugagaucugaugcccucuuuuggugugucugaagacagcuacaguguacuuacaaauaacaauaaauaaaucuuuaaaaaaaauucaaagacuuucauacagauguuccuaaauuagcccuccugcaugucucaaacuuaucuuccauaggaaaacaaacaaacaaacaaacaaaaaaaccccaaaaaccuaaaaaaaccagagcacaucacuguuccccuugaaggcccaaugccuuaacaauuaccaaaguucagggcuggggaugaagccucaguugauagagcguuugccuagcagaaguuugauugccagugcaacaaaaacuaggccugguggugcauacuugauauccagcaaucucgaugugaauauaggaucagaagaccaaggucacccuuggauauauagagaguucaagacaugagaccuuguuagaaaaaaauagagaugggucugucuacauucagggaugccuagcauaucuaguucucucugucucugccucucucucucucucacacacacacacaaacacacaccacaaaaucacccauauucauagugugccuauuuuuauaccucugcuuugcacuccucugcucuggucacugacuucauuuccauucccgaccauuccaugccuucuuuugucagagauucucauucuuuggcuucuauaacauguuacugguuuuccgugaacaccucuccuguucucgacuucucugcaggcucaucuauuugcacacguuuauuuagaggcugauuccuuacagagcagcaagagccucacucaccacucuaaacaauaccaguugccaagauucaggaggaacaguaucccacuacugggguuccauacuaucucucugcccuagacuuuucauuugaucuucaaaucuacacaaccaacuguguacaugacauccacacccagaacacuaaguauuuauccacagcauuccuuaaacuccaugacuuuccugugaaauugugucugccuccaucucccgaguucuggcuuuauaggcauaugccaccauagaggucuguguauggggcaggugagacgguucaccuacugcuccuguagacaacccuaacucaguucucagcaucuaugucagguggcucacaacugucccuaacuccagcuacagggauuccaagaagacuacacacguucuuacaagggcaaacccaccuaccuacuuauacacauaauuaaaauaaaauagacuuaaaaauaaaaacagaaguguuagaaauccgugguaguauauacuagaagcacagauuuaaucaucuucauuuuaacaguuaccauuucuuuaauuuaccaugcagaccgucaccaaaucuuuacaaccacccuauuuuauggugaggaaacaaguuuggggcggggggggggggguuaacaccuucagauaacaagacauuagugagagacgacagaucgcaaacccaagccugacuuuaguuggucuuucaaccccuguuacaaaccacagacacuggagugcaggccugucacauucaagauuaagagggacugaaguguuuugucauuagguuccacugcucugcagaggguccggcucucuccgaguuagaacuuuaacagcucccacucacugaugcaauacggacauucuaauuugacccucacaaaauaagaucaucuccaccuaacggaaaaaacugaaccucaaaggaacucuuuuggggacagagggcucagcuucgguacgggcugcucaggauguccggcuuacagugaccagggcuuuuccuugaggagucagccucgguccggcugaacgcgagggcggcgccugcguccugggccacagucuccacccggguccgccguuccacgacggcucaucaccgcgaggacucacugcaggggauacccgcuccccgagguccccaguucgucugcucaaucucagaaccccaacuuacccagucgcgccgcagaccacucaaaaccauccgccagaaacgaagcgacucggcaauguuuacuuccggguucccugccuucuuccggcu

SEQ ID NO: 5947 - RNA, 2000 nt, Mus musculus
uuuuuuuuuuuuuuuuuuuugagaucgaucugauguagcuaaggcuacacucaaacuuagugcagagccaaagcuggccuugaacuccugcuccuccugcuucagccucugauguauccaccacaccuugccugccaucuugguucucuuugacucauuugccaauccaagagaccauagcagggacggccaggaagguuggccacacgcuacugagucagauuuaacggcgauagggcuuuucugagcagauggaugucucauggaaacagaggaaggaaagagcuggaugcagaagaggagcugccauuuucucaaccagcauaggaaccugcacauucguuuguuauuuguguguguguguguguguauguguguguguguguguguguguguguguguguguguguguguguguguguauguuucggcuccugccccuccaucuccuuuaccagucucucuguuuguguguaacugguuuggagucuauuguaucugucugcccugggcuugggcuuuugagagaaguaccuccacuggggccccagaacuagccugauucucaggaccagauguccugcaauaaacacaucaccugcucuuggucucugcugccuuugucuggacaucucuuagcaagucagcccuuucccacaucucucuacucuaccucagugggagucuccuuugggugagaggugaaagagauucagagguuuaugagauuucucaugccugugacagaaugacccaauaaaauguuuauuucugcucaugguuugaaaggcaguccacuguggcagagcagccauggcaggcaaggggagcuugugacagccguggcaggaacaucuucauggaucaggaagagaaaugggacaggaaguagagucaggcugucagugucaaggcuggaucccuagagaucuacucccuccagcaaggucccaacuacaaaagguuccacaaccucccaagacaaggccaccagcugaggaccgaguauucaaacacaugagccugugaggauccuuuuacauccucuggaccugaguccuacccucuaagcaggaacugacuuucccugggcagaagaaugagugaggcuugaccucccaaccugcucuccugcauccaccauugcucuucaaaagcaaaccaguaauagauuugcugcaaggaauugacgcgcacagccauggaagcuggccaacacagaauucuuagacuucacgucagcagguaacaguugauaugacacagcggugaagucuaaacuuugcaggguuggccaucaagccaggaacuuggguaauuucuuucuugcaaccuugaggcagcguuccuuuucuggaaaacuuuagucauugcucuuaaagccuucagcuagcucagugggaccccauucaccugcugcucuugaagucacacaucuaagaaaauaaucacauccgggagggaaaaaaucaucagagcaaugccuagacuaguuuuucauugaacaacagcaucacagcuucacagagugaaaccgcauaauuagcuauaguuaguagcuguugggagacaauuggccaagccucuccuaaccugucuuccuaccuauuaaaauggggguggugaccacacuuaccugccugcuggggucucgugaucaacaacagaaugugcaucaaggccaguaucuuuaaaaugaugggugguuauuauacaguuccucaaagauaagaugaucugcuauuuauuauaacaacaauugcauuuuguuugcaguaacggcagacuuuguugcccaggcugguuuugaacaccuggauucaacuaaccuucccaucuuggccucccaaguagcugagacagauacagaaggacacugcuuagcuaagacaccuuucaagggcugagaauguagcucaguggcuggguggcagagcacuuggcuaccaugcacagaggucugguuguaguuugcaguaccacagaaaguggaaagggcg

SEQ ID NO: 5948 - RNA, 6904 nt, Mus musculus
cggagcggacagcuugcaguuggggggccgacgguaccuuuuggauagguccaugaggaccccggagaagagcuucuccccgaggcggaacgacacgacgagcgcguccucgaugaugugguccagcgugacccgcaccuccgagccggggaugaggugcgacaccgccgaguccccgcccgccggcggcacgagcgccggagcugguggcggccgcggcgcguccucgggcugcucgggggcggccggaggcugcucgggcggcgagaccgggacagccgcgggcucgggcggcuucgccuccucagccucggagcuaucggccagcucccccggcggcggcggcggcggcgguggcggcagcggcugcucgucggccugaggggcggacuggcgcccgucggccucgccguccggcaccgccgccuccguggccgugaccgggaggggggugccggcuucgcugccgggaaugggcucuagcuccggcucggccucgccggcgcccccuuccccgggggacgccgcggucgccgccgccucagcagccacggccgccauuuucucgcugguuucucccuccuccuacucgggcugcggcggcggcggcggcagcgcggcugggaucccgaggccuuccccucccucccgcuaacacucucgucccgcccuuucccugaugcucgugauuggcaccgcgccauuggcuccgccuuccacccccuuccgcacuucugucaacccauuggucagaaggagccgucugucgcgggcugagucccgcccccucccucagaguaggaacuucccauuggucaggugaguugucaaguggagaaucuaaaaggaguuugaggggcgggcugaaggauggcaaaagcggcgcccugugcuuacagccuguaucuauugguuaguaggggaaauaccgcuuuaggauugguuuaugccccugcccuuacucggcccguucuucggaggugggagaagggaagaaaacgcgagucgugccaguucuuucaaagacuccccaaggggggaauagcgggagaaugcagaaagggaaccacuucccaagaaucuuugcgcagagauccuuagaauaaauguuauuucuaggcuuggauuugcuuguggccaagugugggcacaacaggcuucuguugggaaagauaacuaaaguuccgaaaauaauccugagacacuuuuugggugccuauucacuagucagauuacgaggugcuggaaacagggcgauguacaagacauucuccaugaccacaugacaggagcucccgcauacacacaagcgguguuuuccuugguuucacucuuuaaaauauaaaggacuaaacucuaggaaccugcuaauuucaaaaaaggaaaauucuaacgagaagacagacaacuggcaugcuaaauugacuguaguccuuagauccacggaaagaguucacuauugaagccuuuucuuuccuuacccucuuccuugccgugugcagaaagaaagaaagaaagaaagaaagaaagaaaggaaggaaggaaggaaggaaggaagaaagaaagaaagaaagaaagaaagaaagaaagaaagaaagaaagaaagaaagaaaucuaggcauaguugccgguggggcagcucuugggaggcacaggcagaaauggcaaaauucuaguccagacuuaauacaguuucaggauagacucaacugcaaacugagaucccaucccaagaaagaaaagaugagggcuaggggagcccuccaguguccuaagguccuuguuuuugugguuuggguuuuuguuuugaaacagcgucucccuauguacuucuggcuugccuggaacucacagagaucggccuccuucucucugccucccaaguguugcguuuaaagaccaauucuauuugaaaucuguuaagucuagaaggagccacuguacucauuucuugcagauuguuccucagucaguccuuucuaauaggagcaaucagaggcacugaaaacaccuacaaaagagaaagaagauauuuaccaacguggagggaagaaugaaaugucaaagauuaauugaauacuauauaucaauaucuaguacaaucuuacaugguccuugcaauucgacaagugcuauuauacccauuuuauuugaaaacugagacaaaaagguuucuaauguuguuuagcuaauaaauuacacggucauaaguccagguauuuuuuuauagaaaagacaaaaugacaauaagcaaauauuagccaacguucugucuauuucaagcuuagcaguucucaggaaaguaaaaguccaauagaagaugccagucaaggagaauucagaaucucccuuuacagccacagggaaaauggaguuuguuuagagaccacuguguaccacugacuuucccaaacccucucauuugaaguccuguguucugggggucuagagcaauggcucagcagugaggaccaugugcuucuauugcagagaaucauaguugguuccagcacuccaggggauucaaugcccuccucuagcuaccuugugcacaaaccuacucccagacauacagagaugaauagcuaaaaguagugaaaauaaccaggcaugauggugcauguuuuuagugaaggagacagagacaaauggaucucaguucaaggccaucuugguuuauauagcaaguucuagaccaguguacuggcuaguuuugugucaacuugacacaggcuggaguuauuaucacagagaaaggagcuucaguuggggaaaugccuccaugagauacaacuguaaggcauuuucucaauuagugaucaagggggaaaggccccuuguggguggggccaucucugggcugguagucuugguucuauaagagagcaggcugaaaaagccaguggaagcaagccagugaagaacaucccuccauggccucugcaucagcuccugcuuccugaccugcuugaguuccaguccugacuuccuuuggugaugaacagcaauguggaagaguaagcugaauaaacccuuuccuccccaagugcuucuuggucauguuugugcaggaauagaaacccugacuaagacaaccaauuagggcaucuaucguaaugagacuguaucuuaguaaucagcuuuuaaagcacacuaauauguuuuaacucucuuuacaaaugaaaaaacugggccuuccucaacaaacaagcaaacaaacugugcuugcuaacaugcacacgcauugguuuugauaccuagacagaguaagaaagccaaaaacaucucuuacggggauuacguuaugcuuacauuagacauacacaggucuugccuuacagaauuuucauuaugacucuacaucuauaguucaccacaaucagcuaauuaaacaauaacauauagucuauggagccaugacacccugaauucucacacuguauaaucucccacagggaggaaaauaagaguuggguccugguaccucauuacuucucaacguaauuacaaaauucugcagugacuaguuuaaacuuccaauuuaucacagauuguggcaugcauaacaaggcacccuccagggcuacuguuuucauugugcagcucaagagacucuacucaccucauuaggucagcucuucugcuuugccaucaggacccuaucuccaauccuagucuaucuagucuacucucuacaaaucuucaagcuuucuaauacuaggaaggucuaguccgaaucuuucucuuauucauucaaaaacauuaaaggacuacuacguaucaguagcugcaaacaguaagacaaacagaagguaugccauaagaauauuaaaaaauugagcauugggccuauuuuuucuaauuggugaguuacaaaauaauacuuaagacaaugaaagauucugagaaauucuauaagugaaagaaacagacugggguaauaaaguaguuaggcaaggcagaagaaugcacccuuuaaagaagauggguaaaaaagggccuuucugaaucaggacacuugagggugcaacggaacacacagagccagcucuuugcauugcuggcugaacauucaggucacaaaagaauagcagucucuuaaagccccaaggccaaagagggcuucccuggucagaaagagaaagaagaccauuggugguugaagacaauggccaagaggaugaguagguagaaugagguuggaaaagaaauaaugcuguguaagagauucuucccaugggaaccccaggucuagcagagaaccuggcucuuacauuugcagcuagguacuugugcccucagguuccuucuggaauggaaaugucguggagagagauuacugagaggcaugugcucugugggucucgagagguaggcgggagaauagauggauaaauaguuggagggcuggauggauguaugggugggaagaaaaagaagcccagcagggguggcagugcuccagagggguggugcggacuguggggacugugcuugcauaauggcuuagcucuguguuguggcacagccccggggaaagaugcagcuccuccagccuggugggagccuggcuguagcaguuauggaggaccucugacuggaagcuuuguugaugugcagccccuggaugauguuccucauguaacaucugccugucaccauagucuaacaucucauugugucuuggacccagugagugccugggcaagacgcugcugcccauggagacguguugcugccagacauccaggaaugaugguggccucaaggacccugcacccaugacuucuccacuggacaugagcagcauccccuggaagccagagauuccagaacacacacaccagcagcaccucuucaaggagaggaaggagaagccauugcugccuuucuacugugagacaacuccaucaguagccacugacaguguggaacaacuaagcuacccacaucaucaugaauuaucucaacacaaaacugaccuaggagagcauuuggcauuuugaaaaucagacaggacugagagauacuuggcuauacacagcacaagggccuucccacugagaagaccaaguagcugugaagggcaaaaaccacuccgugaguuaaagcugcaaagcggucacucuaccacacaaaacaccccucacucauccaauaagcagaaguccacaggcugcuucaucucugcuuccuccccagucuaauccggcccaaauccuaagugauaagaacucaucagguaaaccaggcgugggggcgcacgccuuuaaucccagcauucgggaggcagaggcagguggauuucugaguucgaggacagccuggucuacaaagugaguuccaagacagccagggcuacacagagaaacccugucucuaaaaaacaaacaaaauaauaauaauaaaauaaauaaaucaauaaaauaaauuuaaaaaauaauaaacaaaacaacaacaacaacaacaaaaaaagaacucaucagguaaacagagacccuuuggaccaagacugaucuguaaguuuauguuaaacuggagguuuugcuagcuagcccuacaaaggagcccagaggcugagagauguccaggccaccugaguagcugaagauccagaaaccucaaauugcccaagaaugacguuccaaugauagaaggcaaaaagcacacacugugaacccacaagcucagcccccaugacuugaguauguucaugcucauugcuuucuagaaggcauugggcagucccagcgacucugccgauuaaccucagcucugaaauagggacacagaauuuuuaaguagaggcuugagugacauccuacaaagcgauuauccuuugugaaugaaacuguccuguacuggaugaaaaaaaaaauguuagcugugcuguuuggggaaccuugugaccuauuuuguaucuuuuguucuagagagggacauuaagccuugccuccugaguaaauaaugcuuacacaguucccaaaccuagaugucuuguuucuuuucccaugaccaucauaagcaucaacagagauauguaccuauuaaccugcacagcuguguccuccugauguuuucuagccuugucagcaggacugacccuaucugagagccggguauacauaacaaccagacuuaguaggacccuggcucuacugaagcuagaggcuaugugcuuuuuauuaaccugauaggccucugcaguuggugccuugcuauuaaaugucacagaacaaauacuaaucucucaggaccucucuugcaaaugaacuuagcuuaacuucaauuuggucaaaaacuuccuaugggaaaaagcugagucuacuaaguccauauugauaaauacauccuaacugggcuugugcuuuuguguucuuuauuccuagagcuugaagcucauuugugcuagguaugugcucacuaagcacccguagguacuagauauauauucuuaaggguaaagguggcagauacguagguaaacuugagguucacuugaaaucaccuuauuuugauuuccuuauuuaggucaaggccugggauuuugguuugugagaagaagaaagaagaagaagaagaagaaggagaaggagaaggagaaggagaaggagaaaaagaagaaggagaagaagaagaagaagaagaaaaauucagaucuuuucuauaucaaaaacauuuucuaccaaaugagcugcaugcuuuagguuacacaucuuacugaggacagaaaacaaacaaaugccuuuuuuucuuuuuccuugcugugaacaggccugcuguuuugaacacugucacaaaugcuugcuggauuuuguuuggggcaauaauauguuuaguuaaugagcuaaccucacuaagaagcccugcagucuaaaauugucauaaaaauuaaucuaucugu

SEQ ID NO: 5949 - RNA, 772 nt, Mus musculus
auuuuuuuuuuuuuuuuugagucgaugagacucgcgcuacaucaaggcgggcugaaaagcaaaauuuuuaaaaauguaaaccuucgcucaaaacugagcgauaacaaggaggggggcgaggggaaaaaaaaagaaagggaaaauccaacgaaaagaccaaaauuaagaaaaaacagagauauaugccuggcuguuggggguuguuugguugguugguuuugaguuugggugcuuuuuuuuuccuuuuuuuuuuuuuuuuuuuuuuuuuuuuuugcuuuuuuuuuuuuuuuugccuuuuuuuuuuucuuuuuguaguaaucacaggccguuggagaacaggaggggcuggaguuuccuuuuguagcgguaccuucacuugaagaagcaggaagaaaaaaaaccacccugaugacaauuuaagaaacaauagauacgacucucgaagccggcuuggcuacuugaagugucauuuuccacaaccaggcaaguuuuuuucucucucuuuuuuccuccuccucucucaaccaaagauguuucuuuccuuuccgugcguguagaugaggacgcugguugcuguagacagauacaccggaggggggggggggaaggggagagagagggaaagaggaaggggggagggaaagagauagaaaaagagaggagagggagaaagagagggguggacccugcuggauggagauucuguuuucuccuugcuaaaauagaagugauuugcaggcucucccuguggaauccaguuugacucucccca

SEQ ID NO: 5950 - RNA, 949 nt, Mus musculus
cuuuggcaagacaggucuuuuauuuaaaaaaaaaauuaaccaaacaacaacagucacuuacaacaguaaaacaagacgccccaguucucuuucccauggcgaucgaucauuucuaauagccgcgagucccaaucagggacccuucuccgcuugcuugccguuuguguagaaaauuagcgugcugaggucggguaccaucagcuggccgaggcuagggaguuuccuggaggguggcugaggcagcgaacaaccuagcaugccuucaugcauuuccaccugcccacuuacuugcgagauuuggaggcguagucggagccuauucccacgcccuggccuucgaaguaguaaauugcgcacuuucucuuuaaccccgucucauuucacccacggucacguuuccucuccacgcagcgcguuucaaguggaguaaagauuguagcguuucaucucacacccaaaacccaaacaaaacuuccacaccucugaguucugaugacccgcugucucuggaaggggaggacagggacaugaguggcauuuguccgguucgucagccgcucuugagcuccugaugggucauggaaggagcccaggggauguuuugggagcagagaagguggguguuggggggguucgcucgcguguccugggugacagggggaugcgggacacagucuggcuuagccaucuaacucugcgucuuuggucgcagcggggugggucuggcccgggcucacuuugagaagcagccgccuucuaaccugcggaaauccaacuucuuccacuucguccuggcccucuacgacagacagggccagcccguggagauugagaggacggccuuugugggguucguggagaaggaaaaaguaagugggcgcagcgcagucccuaguagucccgggcucagaaagcaggcccaggcgccuuggaagccgccucccgugug

SEQ ID NO: 5951 - RNA, 92848 nt, Mus musculus
cagcagauggagagaacucacacaguuccuguccacaccaaugguaagaaugguuugaucccuucccucugugagagccuugcagacucacggugcauugguuuugagaguuccuggccugguuuugggggugggggauggggaaaggaacugacaaauguaggugcgagacuccccuuccagagccuccucucccuuggaguuuugcuaaccaacccuauacagauuauuucuggcuaucucuuuuuucuguucuucauucaucaacuaaggcauguugcaccaggcuuuguaauagcaaauauacagacucuaagugaaacccagacauuagcuuugugaccuuuggugaggggacuuaaugcuuuucugguuugauuccccucccccagaggggagauagagaugaagccaauaccuacccccuccagauggucgccuaauuaucacuguuauucuacacugugucaauggaguccagauuagccucaaauucaccacguagcagagauuaaccuugaacuuuggauccuccagccucugccccauaagugcugggaucacaguggugcaccacacuccuggaauuacgagguccuggggauggaacccagggcuucaugagugcaugacaagcauuccaccagcugagacacauuuccaguccacagcggacucaugacaagaucaacuaucagaggcccuagcacguacggaaugucaauaaaagcuaaguccuaagugucugcuacuguaauuuucuuagugauagccaucauuugugggcuucaucuuccauugcauccuaaacccuaaccaucccaaauucugcucucuccuguccccaaccuauacagcccaaggcuucccuccuucucuguaauccugucuagacuguuucuugggcuugguguucuguuucuggaguacagaagcccuguccucugggaugcuggaucugcaaccccacccccuccaccccccaccucccgugucagaaggccuggacuaaaggcccagauuggagucccgauaggaaaacaaguucuuuuagcacucauuucagucccuuggaauuaacucuuucacagccugacuccaagaguagucaauccuggaagguagagcuacaaagaguugucuuggucacccaaaguacuuagcauaaagcgggauagaguaaacuagcuacaguggggcagaaguguguguguguguguguguguguguguguguguguguguguguguguguuuaacacuuucaaccccaguccuguaaucucccaggccucaagaaugguugauuacuucagaaauucggaucaucccuuccccuggguguccuucaccugagucagcgaugcucccggggggcuucccucgcuccucccacugcugucccuccagccaccaccaacccccuccuccgcguggcgccuccccuccucccauuccaggcagagcccugaggggcuaggggcggagcgucugggaugugggcuggguggcuuuuaggccggcguuugcuugaaaaccuccgccgccgcuaggccgggggcaggcaauggcaggggaugugugauugcggacagugagagggccguugcuaucaugcccgggcgcgcgggcgucgcccgguucugcuugcuggcucucgcucugcagcuacauuggccgcuggcggcgugcgagccgggauggaccacaaguaaguggcagcgcgcagauggguucugaggcgacuaggggugguggugaugacugagggucugagagucgcucuugcaugccggcagcuccaugaccgcuaucccugcggacuccgccacuccccgggugugaguaucgccacccccaagccuaggagcccaggcuuuguucucuuguggugagccacgggaggucguggagcuagugcgcucacugcaaucagaaagcaguaagucucucucucucucucucucucucucucucucucucuuugcuugccuuccuuucuucaucuccccguguuuucuuacuuugggcuucucuuuccgcugcucuuccuaucuuugcuguuuuucuugagguugcucgucuccgcucugccucucucucaucgcuauuuugcgcccgcugcucuagcaaccccagagcauccccagaggagcaccccaagcauccuaucccgaaucggcgagggaaccacucccuggaucuugcugggggcgggggggugguggugucaaaagcauaccagugggauagaaaaucaaagguuuccgagagauuaggguagggugguuuacugguuaucucugccuguacacuuagcaucucugaaagaccauaaaagaaccaugcgcacccauuaugcagaucguaagcugaaguucacuaacaaaaacccagguguguauaaguacgccccacauugaagaucugauacuggaaaccggagcuuucuuuccaccucacccaaugccuaucuccucuuggccucaguuuucaugugaagaaaauggaaugggcuccacgcuuccaguuuggacgcuggauaaugccuauuucucacaacuguuuucccaggcaccgcucccucccgggccgcaucccucagagguucucauaggauuucgcggaagggacggucccggaggggcaaugccuggcuucugucaucuugacccgggagagcuuauuuagccuuagcucugaggcagcuggagagcugggcugacuccagacggucgcgggugcuugcuguaccaaccgucagcguuuuuaaaucaagcuaacgacgcccuaguguacgggcugggcaggcugcagcccccgccccaucccugcaagaaccugacccgaggguuuccuccacucaacgcuccagcuccuuugccuuggauaggagaaggcucuuccuuuuguuggggugugggguuccucggggaagagggagccagguccuguucgagucugauuuuccagccuaccauuugcacagaagaaagacaggaaaguaaacuucacgggaucuggaggccuugagaacagucagugagguagagugacugcagacccggggagaaagcaaaaucuacgaguuguaaagugacccaugauccccaaaugagcaguugcuauuaauauuuuccuuucccccuuccuguccuucuaugacuauauacugaugaaucuggaaucguaccauucauacacuuuaaaaggugcuucccaaaucaugacaucucccaaaacuaugauuuuaauggcucuaaguucuaccaagagaccacagaaauauaauuuccucaaaguuaaacuccuggcucuuauacaaaugugacgaagauuuuuuuuucuuucauuuaugaaguggccaaagcagcugcuaaagcuggucaaaagcaucaacauaaucaauaucaacauaaucaauaccaacauaaucaauaucaacauaaacaauauccccggugauacagggaguggcauagggaauuccuuugggugagacagaaucaagcaguuguugguucucccucuccuauuccugaagucacuugcaucuuugucugucacaggcgugcaguuaauguuaaacuucaccgaauacaggccaucccaccgaaagcaaacaagugagccagagauaacauucucuuacccuuuguuaagugacgcuccaggucugacacugaaagcuugaucccacgugcucuggccuuauuuucaaguugugagcaacccuucuccaguuacguugccuuacguguacuuaaacuggacuguguguaaagagauugcccucagugcuuuucaccauccgagaccuuuugucguucucuucuauccuguacagcuccuuuuguuuaagagucuagauccaucagucucuguagaggacuaugucucacuuguucccucaugaacauuaagcaccuagcguaguagcauaggguuaagaacucaggauguuuuggguaaauaauguaaauguaucuaucucuucugauuuguaccaguguaaacaaaaccaauaagacuuuuuuuaaggauacauuuugauugcaaauauaucauauuuuugaaaaggaauuuaaucagugguaauccaacacuuuuuuguuuguuuugggguuuggguuuuggaauguuguuuguuugagacaagguuucuuuauguauccuuggcuguccaggaacuaggucuguagaccaggcucccuuuaacucggagaucuuccuaccucugccuccugaguacuggaauugaaggccugcgccaccacugccuggcuccagcuaccuuuuuuuaaaauuuuuuuuuuggggggggggcuuuucgagacaggguuucucuguguagcccuggcuguccuggaacucacuuuguagaccaggcuggccucaaacucagaaauccgccugccucugccucucaagugcugggauuaaaggcgugugccaccaugccuggcagaaccuuuuuuuuuuuuuuuuaauuuaauucuucucugggacaggaugcuguguagguggaugcugucucagagaucucuagauagccaagauggccuuagaccucuaguugucuugcuggaauuacagauguuugccacaaaagcucagucaucuuuuaaucccuccugcgguugaugaggcugaguuagaaggaacagaacacaggguuccuuggugacaucucugggagucuucagaucuacucaguuucagagauguaauuugcuuagggaucaggaaauucuuaucuuuuaaaagaugaccuguagggcuggugagauggcucagcgguuaagauugccgacugcucuuccaaagguccugaguucaaaucccagcaaccacaugguggcucacaaccaucuguaacgaaaucugaugcucucuucucgagugucugaagacagcuacaguguacuuacauauaauaaauaaauaaauaaauaaauaaauauuuuuuuaaaaaaagaugaccuguaaguaguguugaggucuuccauucuugaacauggcucuucuguggcuuaggcuucuuuucucaggaauuugcugccuaccucuaucagucccacuaugucaacucgggauaucuuaauggggaauuuccuucacucuacgacaaacucauagacccauucccaagcccuuuuaguugaggaaaugaaaauucacagcaacccauucccaagcccuuuuaguugaggaaaugaaaauucacagcaacacugacaggaacugaggcuggagagaugguuuagcaguuaagagcacuugcuguucuugauagaacccagguguguaggauaagaaaaaaacuggaggugagaagguuuggaacuaaggaagugaaauauaacuucgaauucaacacuuggaagguuaaguuaagguuaacaauuugcaagugaaugguaaugguugggaggcgaagaagucaccuuuaccucuggcccucccagggaggugagugucacuuccaagggggaaauuaaagcucuuugguaacaaaccugagcucacacccuucugcaucuccucagcaccucaccacaucaucaccuuccaggaugcuauccaaguuagagccacaucuucucucaccagagcuccggugcgcccccuagcuuugcugccacccuuucugcuucuccucuguccuuguccccuacucccuauucucccagcaggcagggucaccuuucaaaacaaaaacaaaaccaauacagaucauacugcucuuguggggcuuuuuuuuuuucucuaaagacaucaaaaccuuccagguaaugaaacccagacccugcucaugccucuauguuauuacaaccacagccgucucacuuagcauauauauuucuuaccaacauccucugaguuacccacccuugcuuagcauauuuaccaauguccccugacuuuguaggcuauuucuccuuccugcgugugccuuagcgagcccgggcccacgucuacaguugacacucuuuacucuuccccagauuuuugcauaaauggcuuccucuggucccucaggucuuaaacaucaucacacuggccauccuguuuaaaacaggaacccugccagcuucccuuuauccuguggcacaaucuuauuauuccccccccccaccccccccagggcuguuaaguagcaccugagaaucuuugcuuauuuccugacucuucacgggggacacagaccuuguuugccuagccuuuaucacuuugucaccaaggcccaguggcgcccagcaggucuucugagaccacugggaggagcauuuuccaggaagcaaugacugccucagaagugcuuuggagcaccacuugggcuucugaacaccaugccugcuccugagugcccgagauguggagguuggguuuucuuaugguuauguugucuuguguuggcaggaggaagccaagaagguagcccuccgcuacagcaugaacucauaauaccucaguggcggacuucagaaagcccugggagaggaaagguaagauguccaagcuccuuggagaagcaggaaugacaguuccucuagcugugucaacuuaggauaucuuagcggggacuuuccuucacucuaugacgaacucguagacccauucccaagcccuuguaguugaggaaaugaaaauucacaguaacacacgaacugggcuggagagaugguuuagcaguuaagagcacuugcuguucuugauagaacugggguucagguccaagcauccagaggaugguucacaaucaucuguaacuccaguuccaggagaugccucugagggcaccgggcaugcauauggugcucauacauauauguaggcaaaacacucaugugugcacacacacacacacacacacacacacacacacacacaccccuacacacacacauacacacacacacacacacaccccuacacacacacacacacacacacacacacacacacacacacacacagagucuuuuagaaauacacagauuacgugcaaaugugugaauuugccauagaucuugauuggacuuuuucuuuuuuugguuuuucugucuuucuguuuucugagacagguucucugaaauccugucuccaucuccuggaucuaggcuugaaggcauagucuagggugucaucaugugccgagcccaguucucuuuugaggcagucuccaguguagcuuaggcugaccuguauguaaaucuuaaucuaccugcuuccauuucgaaaaugcaaagaucacacugugugucauggguacccagcgauuuucuuuuucucuuuucuuuuuuuauuuuuauuuuuuguuaauaagaggcaagauagggagcuaggauuagguuauauaucucaaaauaucuuccugauuccuuggcccagagcaguagcaaaauacacagauguugccaagacagucagaacaugguccaccaagcagacucauauugaggauguucucaaaagggaaauaugguaguugcgugacaguaacgucuuaugugacuuucuacuuuacuugagcuuccucauuuacaaauccaguuuuagugggaauaaagaggaacagagauguggagaagggcuaacuuucuuuuucagcgggaccuuuuauguguccuacucuggccucuaaguggagacuaugcugcuucaccuucccaguccuagcacugcauggauaagcacugugcccacuuugaaggacucguuucuaugaucucuuaggggccaaauggccugugguuuauugggcaacagauaggagcaagauuaaagccagggaaggaagugucaggaaagacuucagacaauuguggcccuggaaucuggaaagauaaacagaugagaaacacccagaauuccuuaagugacuguagagucaugcagacaugucccccaaguucaccgcuugggcuuaguaagagaacuuaaaagcaggacaauaaaaguugggaacauuuuacccgaaaagcaaagaaaaaaaaaucaugaacucauuucauccuaaaguaggaaaggcugaaaauagccuuaaggaaaugcuagacaaauuaauggauggccguucucaggcagauuauuuuuuuuaaguguaaggucuuguauauuucauccacuaccauuauugccgaagaauggauaugauccuuuuuauagagguuccuuuguuaccuccagauguuggauguugggcauccucaggaaggauccgagaaacaaagcggaggaccagauccugucauuguucccagccauugucuacucagaauguggcucauuguauucuacaaggaucagcagcccagugccuggcacuauaaauauauggagagagggagagagagagagagagagagagagagagagggagagagagagagagagagagagggagaggaguguguuaguuuacucugauucuuauuugcaucugaauaauucauugauuuauuagacaucgcuuagacacugacuguauaugaagucuaauagagauuuuugaggaugaugcauauacacaggacaagcuugucccagaugguguguagcuguuuaauuuugcccucaacagaagggauuugggggucucucagggacgugugagcauuggggucaccuuccagugcuuccucaggcccuguuggaguuccaggagggaagcuguccguaggcgagcuggacagggaagcuccggagagcugagaaaugcaguuucacuguuguguugugcuggaucuguucccuagaaacagggaacaucugauuuuaaaccucugugucugagcacacuccagaaacagagagaaguacuuuuggaucaccuaaauaaaaauaaauauuagcucucaugugucaaguaaugucucuguggggggcacaugguaucacuugcucagugccaagauucuuuuuuccguguggcccgucacaugggugccaccuucaggccaggguaaggacuuguuugacuucuguagucaugugcucaaaugcccacaggggcugugcguccuugauucucaaugugacugggcagggcucucacuccaaaaguccccagggcaaaaccacaagugggagccaccagccacuugccgaauuagugcuucagaauuagggaagggagugccugggcacccaucugucucccugccuccugaauaucgaaugcccccucuuaagaugaggcaacaggauuaacuggguauuggaccagguaccugacuggaauguucuuaucucaucugaggcuuugguggucuugaagucugaagccaagaucccaguuggggaugaguggagcagggguuaagagaacgaaugugauugggcuguggguguggcucaguuuguacugagcuugccugagguccuggguaucucgcacaguccacacuuauacagaaaaagaagaaggauguaggaagugucacuggcuccuuauauugccauaguuagcuuaaagauuuuuuuaaauuuugguccauguugucaaauuauuuuucaaaugguuccaguuaaauuuuucagacagaggaucucagggugaccauuuuaaaguauguuccacacagcacugcgauucacaguuuuaaauggacuaugucacuuuugauuuuucuuaggcuauccucuuuuuuaaaauacucucucucucucucucucucucucucucucucucucucucucucucucccucccucccucccucccuccaugagagaggacagugcuuacugaugaugcucagcacugcucuucagguuuauuggccauuugcauguuuuagaugaucugugcuggguguaugguguguuuggccauugacaaacugcuuauguguaagauacaucugacucgacuuacuauacaacucuaauuugugaggcuuuagcuaccaccccuuugaugauuggaguguccaaauugaggcccaaauaaaagaaagcaaaauauaaaagaacucacuuggguguuuuuuuaaagaugauagccaguguaagauugacagcuuccuuugaacuaggcacugugauacaucauuuaccuucauuuauuuguuccucuaguccuuaaggauccucagaagguugguuauuaccauaccaucucauagaagaguaaagagagauguagggaggcugggugacgguccagggucccacaauuacaggugacauccuguacacacacugauccagggucugacucuccagggaauuuacuucugagaaccuucauaagacugcaguacaccugcucagccuuggaccucagcuugagugucugucucuccucugcuucugggagaaagcagauggggaagauucggguuguuuggggacugaggucacuucacgcuggaaaggcuggugaccuuuccucgcuggcuuccggaggaucccugugcuggcaccaugucagauccggugcuggggcccugggagccugggucccugcuuccaggaacugacacguuuuuauuguuguuuuuagcauccacucagagcagagcucagggucauggcugaagggcgagagcugauccuagaccuggagaagaacgaguaaguggguuucucccuucuuuugucugacacagaacaaugaacucacauuugaugccagucugacccaggugucccaguuggaaaggaagaaguuuaguggugugcccccccacaccacacccccccagccuccaccccgcucccugccccaagcucgacauccuuggucccuuugcagggccucuugccaagagagagcuuuuccuuggucuuuugacugcugggagauuggcgggauacuucacauccugcuuggauuuccuuaggcuguguuuccggugcaucguggaguucacuggggccgaaugugugugugugugugugugugugugugugugugugugugugucuaagggcgggaagggacuggaggcagcugcugcuguccuagcucccgcucaguguauggcaggaaaugaaggcgauuagagggagacgggagaagcagcaggcugggcagggauuuggcaccucugacccugauucuugcaucuacccaagauucugcugagaagugcauugcuugaagccgccuggcuuccucggguucagcuuuucccuaaucucauucaugcugggcgucggccuaguucagaaauaucuccgcauugauucgccuuccggcauaacugucucaauucaugggugcaggguugaauagaugacccugcccagcuguguccauugauugacugcccauucugccgucagccccagucaccuggccucccagagcuccuccuacuuggcuagggacucugaaggcuuuuauaauuuccccaccaauggucccacuuuuuaucguccacauugacauuguagauaaggaugcuugguuuggagaguugcccgucugcucuuggcagccuccaaaacacccuggaagcugaugaguaaugaaagcuucguugccaagaaggggcuagagcaaggccuuccccauccaaaccagugggaauggcugccuggcuuugguggaaugggagaagaaggauuuauuccaaauuugggcucguuggacacuugcagagaaguccccagugcugugagagggcagcuggugcagggacaggguguuuugugccacuacucuauggagauguggacgaacaucuguuugccagugacaggcccaaguaaggaugccaccaaaguccaaauuugugaaccaguaauuuuuauugggauugcuuacaguaauaggggugaaggguuaccuauggguacagaagugacucaaaagauagcagccucaccaaggcccacccagcauggguaacaacucaugaaagcuagaagccugagguucacugcauggcuugcaggcagcucugguggugugagccugguccaaggggcugggcuggguuuggguugacuagacugagccucagggaaggagguaguccuuacugcuuauauauuguugaggagggaggggucuagugauucuggucaucuucaggaacuuccuugaagcccuggguuguuuauuguuuacuuucugaguuuaaugagcuucccagcagaauggaauguuuuaacacauucuggaguaagcacccugugucuuaaaagagcaugggguuuauuauggaggaaauugcuacauaacacagaguucugucccuuucucuucccucugccgcuggcuuucauuucagcacucccaaaaagauagacaucacugccauuuuggcuccccucucccagagcaaaaccagccuuuuauugguuugcugaaugguuucuuuccuucucuuccccggggauagcuacccagugugggaagcgccuccuugcucagggcaucacuuugacugugaugcugugcuccuccaaggcucagggagggcuaguuugcgcuuggcuucucuuagggaucuguuuggugccuuacuggcucuguugaguagcugcuucccugcuccugacugcuguccgugucuguccuauuuaacccucgcucuuccccaaguccacugaauugaugauacguucaggggccgagccuuagcugaaucagcuaaggagggacccuuguccuuuccuucuguguugggacuucuguagaagaucacaggaaguuaggcuaggaagauuucuuuagaacaagagcuuccaaucuguggcucaaaaccucuuucuuggcaaaccugucaccagaaauuuuacauugaggauucauaacaguagcaaaacuacaguuaugaaggagccaugaaaaucaucuaugguuguggggagggagaggagcuguaugaaagggucgcagcacuaggaagguugagaaccacugcacuagggacuccugagugcuguggucucgugcacaaguacagaaacuucaucacagaaagggagagacacuugucuaaagucacccagcaaguguaugaagagggcgaguggaagucaguuguguucuuggcuuggauguggaguuguagcaugugaccuagguagggcaagcugaggaaaucugagaggagaguagugauggcugccucauggggugcuugugagggaugggccgagugggcaaagcguagaaugugagcacguggaguugucaauauagugauuuuuuaaaaaauuucuuuuuaauuugugucuguguguguuguguaugugucucuguguguauuuguaucugugugugugugugugugugugagagagagagagagagagagagagaacagguuugaauauggauaugucugcucagaggucaggggauagccucaacugucacccuucaggaaugcugccuacuuuauuuugaaacaagagcucccugggugugguggcguacgccuuuaaucccagcacucgggaggcagaggcaggcagauuucugaguucgaggccagccuggucuacaaagugagcuccaggacagccagggcuacacagagaaucccugucucgaaaaaaaaaauaaaaaaauaaaaaaacaaaacaaaacaaaaaaaacaaccaaccaaccaaccaaacaaacaaaaaaccaaaagaaagaaagaaagaaaggaaggaaggaaggaaggaaagaaagaaagaaagaaagaaagaaagaaagaaagaaagaaagaaagaaagaaagaaagaaagaaagaaacucucucauuggccuggaguucacucauuuggcuagucuggcuugccaaagagcaccaggaaucugccuguuuccccuuccucaucuuugcgaugacaagcaccugccuggccuuuauuguuauuguuaacauggauucuaggacugaacuccggaaggcaaagcuucacugagcaggcccugucgugagucgugauuuuuuuuucuuuucuuuucuuuucuuuucuuuucuuuucuuuucuuuucuuuucuuuucuuuucuuuucuuuucuuuccuuuccuuuccuuuccuuuccuuuucuuuucuuucuuucuuucuuucuuucuuucuuucuuuuuuguuuuuuuuuuguuuuuuuguuuuuguuuuucgagacaggguuucucuguauaguccuggcuguccuggaacucacucuaaagaccaggcuggccucgaacucagaaauucaccugccucugccucccaagugcugggauuaaaggcgggcgccgccacgcccggcuuguccugaucuuuaacauaccuacugaacugcuagggguuuuucauaggugccacccauugucugcccauggccuccaccaacucccagggaggcccguggagauaugguuccuggccuccuuuagccuaccgcagccuggaguggaaguggcacagccaaacagcaugaucucaccaggugucccuggggaaggacuuccugcuuuucucauccaaauugggcuuuuuguuuuugcacacguguugccgaacugaauucacuccaacugcacugcacuuccugguguggcuauuuuuccccacguccucuccuucacaggccgccaagcccagacucaaaacagcucugggcugaggagaggggauuuuucugaguuuucaaguuacuauguuaacauuucuaccuucuggugguauggaaggaaucuagguccgugcucagaaacuucccaagccuuguucguuucagcucuugguggaugccucugcucucccugucuguuuucacgugaacugugacguucugggcaccaggguaggucccuggacucgaguugagcuguggggaaaagaguucugccagccugcagcucuugcuagagucagaagggauacagggagugaacggauaguguacaggauaucaaauaaugagaauuguauacaggaagcaaaacacugggcucaggaagagcgggggugguggggguggugggggugguggggggugggagggagccgauguugaugaacagcagucagaaaugaucaugggaaaucugagcagagaacuaaaggagugagcuguggagacagcugugggagaguuucaaggagggaacagucaaguucagagguccuguagauuacgaggauuuuagcaucccuaucccacuucucuguucauuggauucucuggucucccgggagccacagacaaggguuucugagacaauggugaggggaaggauauugaaauuuguuuuucaucacucugaggugucuggcuuuuuccccaucgauuuaaaguccucgugcuaaugcacggcccgaaauagcagugagcggguccuuaauggaauucacacauggagaaaucauagccaagaauggugcgggcagaggagcugggguggggguggggugggggaaggaggggucaggagaugggacguggcgggcggagcuuuagcggagucagagccagggccuacuuuuucuccaguuugaagccgcucaggacaagcgggucauagcuccuuuucuguggagcgcuggcaaaacagauauggcccugugagaaaaugagcauguggcuucacguuguggcucgcauuuagaugcugaccuuaccauucagcaccuacauucucucccuuuaagucucagucccuucgcccaggacuauaaucacaguccugcaucucaaagcguggggaggcugagaugcugcguguguauaaaggaccuaacccagugucuaccuuguacugcacacucaguaaagggcaacuauuaucauuucuugcuccacuguuugcaaauugcacaaguggggcauguucaguauagaacacauagcagugccaagcaaagaaagcaguagagcucacugcugucugaugggggauuuucuagaccuuucuugugccuaugagagcguagauccugucaacaugcagucucagggaaucugauacagacgucuaggguagcuggggaagaaaaaaaaagauuaaaaagaaauuuauauuuauuucuugcgcauggguauuuuuccugcauguauauaugaucaccaugugcauaccuggugcucucagugguaucaaauccccuggaacuggaguuacauaugguugugaucuaccaugugggugcuaggaauagaagccagguccucuggaagaacagccaaugcucuuagccuguaaggcauagcuacagccuccagaaaauagguuuuuacccguauaaaccuauucuauucuguuaaauuuauuguauacacaugagugucaugaaaacuauucugcucagucucaggacagcauuauaauguuauuuacuauaauaucuaacauauacaagcuacagaccuuuggacugcugcacaguuguuaggagacagucagucccuugucacccaggcaucccgucugguggacauaguccuaagcucauagaaguaacuuagaguugacgaacacaccagcgcccccuccugagcuucaaacuucucaucuguaaaaugagauuuuuguucaaguugggcuucaagagccuuccuguguuaccuauuuaaaggacgcugucugcguggcaaugcgaaguuccugcuucaggagagccccuccccccaaaagagucuacagcaggaugcaaagaaacggucuccaaccauguccuugaaguuggggugaacuguuagcuuaggucucaccaguugaggcggcagaaagaagagaagggaggauuacaggauggaaauuacaggcuccuagucacagccuguaauuugguggcauacauccauaauauuuuuuccucugugacucgccccccuguucugaggacugccauuaaccuaggggccgugucugacaagccuuaugugcuguucaauuagagacacuuuucuugugcugaagucaucuuaggagacagacuccugggggcuguggacucuaguucucuugccccgcggcaaccuuuucuaagagaaacuccacuaacuuguucaagcugauucuaagacagagcugaaccagggggcaaaaaucacuguauuacaaggucaccuucaacagcaaugaggaccggggauggagcucaguccgaguacuuggcuagcaugcgugagcgaggcccuggauucaauucccucccugcaggauauaacuuagcccugguggugcacgccugcaaucccagcacugagagguggaggagggagggucagcugcucaaggccauccucgaauacacucugagguugagcacaacugggcuauaugagacccugucucaaaaacaaccaggaugucaccaaccaacgaaggaggaacagugucagcacuaucugugcuguggccguguccucgccacuuguccccugagcacaccccgaggcugacucuucucgcuugaggcuacucugcggacuugaguccaaauccuagcgauguuuagaauuggucucgagaagggauguggcaggugguggccgcccauaccauugguguugcaugaggcagaggcaggcccaucucagugaguucagggccagccuggucuacagcgcaaguucuaggaugucacaaagaaacuuugaaaaacuaagaaaaaaaaagggggacuaggggaagaagaaagacagagagagagguccuuugaucuuaagguggaggcuccucaauaacaauggcucucugggcugguuuaugcugucaauacuaaggcagaacucaggcauguggagcuuagggguuuaacuacccauuauaacuuuugauggguuagaguuuuaagagucuuacuauucacuaugacuuuugacaauaagcuuucuuccuagcucagcuauuauagauaggaggaugguuuuauuguccugaaacuuuagagucagcuuagaaaauuaagucauuucugaauuguuuuguuuuugccucucucucucucucucucucucucucucucucucucucucucucuccccucugucccucccucccucccucccucccucccucccuuccuuccuucucuuuguuuucuaaagacugggucuuacucgauagcccaggaugucaccaaacucaugacaagccucugcccucuccuucccaucuaaggagaucacaucuaaugagcugccaccauaucaguccacagccacuuguuaccagccucccuuuccccuuagcccuaguuggaucguuuaaugacagaggggcagaugcauggcgaaucaccaggcagagggugcucuucagcagacaacucaaauuacucacugccucucauucucagguuugucuuucuuccauggaauucucuuagaaacauucagccaguucaaacaggacggcacuccugcccccgcgcuucaucccagcaccuucucagguggggacagauuucaacaucuuaccuagagucaaggacaccucacuuuggcccugucuggucagaaauuucaucuggucagaaauucuauugguuguuggcaaaauucaauuuccugggucaaagagacgcugggaaaggcuuagcuggcgacccagugcccuuaggagaccuugcuuugcugaguugcauuaaaaugagucacaggcauauggauuacauuucacuuaaaauacacauggcccaagaaauuaaaggauagcguacuuuaaccaaguauuuggcagaucucagguauuccaaauguuuuugcaaagccugugugcagcugggcucccgggucccugcaguuaauccugugagacuuggugccaaggaagcagcugaguggcuggguggggagaacagaauuuaaugagagcugccuguggcuaucugaaaauuuccgcagacguauuuuugggugggaaauacggagaacagaaccaggccuacuccauccaaggcgaugaauggaugcaugcguuaauaugaaugcggagugcuguuaggccuugcccuagcgugaccuggaaguucuguuugaguuguaguuucccacugcagcuuggagacagauuuauuacaucuuacaguucccaugugcagaagcccugacaugguagagcaaauggaaugucagugucugauaggaucuccgugcgagucagacuauucucagccacacuugcucaauagcaggcugucugauugccaugggcuggggguuuaugucucuuucaagcccauguacugaaaggggauauguuaggcaugguuuuauaaggugauugggucaugcugucucugcccuucauggcuugaguuaagcggccuucuaagagcccccaggaagcuagaacacacuugcuaugugaaagugcagcuaaaaucaacaucuacuuagcacaguggcucuuggccgauacgagcuauucuagaaucgugagacauucauuucuguugguuauaagccucucugcuugugguauuuuguugcagcagccuggguggacuacaucuuuuccaaaugacuggaaacaauaccuuuuuggggucgauuguucagagcuggucucgguauuaauaauugcgagugcucucuugaagucacgcccugcacagucaaccagggugucagauagccuccaaaauggaaaugaccaaguguguugacacugagccccagaggcucugcuuuuuuuuuuuuuuuuuuuuuuuuuugguuuuucgagacaggguuucucuguguagcccuggcuauccuggaacucucuguagaccaggcuggccucgaacucagaaauucuccugcuucugccucccaagugcuggguuuaaaggcgugcgccacuacucccaggaggcucugcuuuuaaggcagagagggauuugaucgcaggcaggagaggguggugggaccacauacacagagcauaagugacgcaugcaugaaugagcugagaacggugacauccaccgcugcuggcagagguggagacuguugaagccuggaucuuuggcacaguaaugcugauuuuauucuuuuggccuccagggcuggggcgaagaaaagcuucuguggucuuaagccacugaacccaaaacacaaacacgaacguguuuauggcuuagagaugcugggcuguaucccucuagucagugucugucaugugucaaguagguuuucaguauguguuaaauuuauuuuaaaaugacuuuguuacugugcuuuauguguauggguguuuugcaugcaucuaagucugugcaccacguguguacauggugcccguggaggcuagaagaaggugucagaugcccuggagccagaacuauagacaguugcgaagcaccauguggauucugggaaggacagccaguacucuuaacucauggagacauuacuccacucuccuguguuaauuuaauuuuaaaaaauaaagauuuguuucucucucccucucucccucucccuaucccucccccucucccucucucucucucucucucucucucucucucucucucucucucucgugucucugugucugucagucugucucugucuuucucucuauguguauguguauauguauguauguguauguauguguguguauguguguguauguauguguauguauguguguguauguguauguauguguguauguguguguguauauguguauguauguguguguauguauguguguauguguguuauguguguauguguguuauguguguauguguguguguauauguguguguauguguguguguauauguguauguauguguguauauguuuguauguguguguauauguguguauguguguguauauguguguauauguguguguauguguguauguguauguauguguguguauguguguguauguguguguauguguguguguguauauguguguauauguguguguauguguguguguguauauguguguauaugugguaugugugugugugucugugugugugugugugugucuguguguauauguaugugugugugucugugugguuauguguguguguuacugggaacuaaacugagagccucaucugcuagcccagcacucauccacugagcuaugucuuuagcuuucuuuuuuuacuuuucauuuuucagacagguuuuucuacuaaguuguccagaaugcccuugacugacugcuccuacaucagccuuccagguagcuggguuuucaagccuuuaucuaccacuuccuucuagaacaucuuuucugaaaaucuugaugaugcaaggcauuaccacugagaaaaugagaagcacaaaacauauugagaaaccuguguguuuguuaccugucaagucuuucuuaaguucugggaaccgucucuugauaagaguccacucugcuaaagaacuuaggggggaggguaacuagggauggugguuggauguuaauaauggugacagcaguaacacuccucacugcaaauggacguaaccggucuggucugcagccuuuacauagcugguuagugccauuaucacagucacuguaugagauauagggaccuaugcuagucuguuugcaaaaggggucucugaaauauuauguuuucaaguucaccagggugagagguagagauaaaugugagucuggucuguuugaguccaaaguccaaauuggucuaagucagucagucagucagucagucagucagucauucugucuaucugccugcugguuuguuucugucucucugucaguucccucugcccccacccccacacacucucucucucucucucucucuguguauguauuuauguguguauacagauucauauuugugcacauuaaugcaggauguauagaagccacaagccaacuguggguguuguuccucuggagcuaugcaucuuguucuuuugagucaggucuguguuuuggagcucggcaaguaugccagaggugcccaggcauccagauguuucuuccucccuagcacugggguugcaaaccucugcccccaugugugcauguuaaaagcaugguuucugggaaccgaacucaggucuucacguuuguccagcacuuuccugaguaaacuguugcucccaccccaaaguccaagccucuuaaccacugaaccguugugccucucugacuuagugugcuuugaacauuucuugguuaacacugugccuagcaucuucacugugucuuuuccuuucuucgugucucaguuacgguuccccuucugugguaaaacaccguguccaaggcaacuuauuaaaaggaaguauuuaauuggaagcuugcccacagccucagaggguuacuccauacuccuuauguaggggauuugaguuugcagggcgggcaggcgggcaauggcucuggagcaguagcuaagagcucacaucggaacguuaggcugcaggcagagaaaagaaaaccagagccagggaugggcuucuaaaaccucaaagccuaccccagugacacaccuccuccaacaaggccacgccuccuaauccuucccuaacaguucugcuaacugggaacaaaacacucaaaucuaugagccuguggagaccauucucauucaaauuaccaccuucucucuucccaagccuugacuggaacuagaauguccauguaaugugauagggauaauucagacugguauggaccagagccuggcuccucuugucuguagaaggugugaaggcuaguauuaucagcuugacagagucuagagucaccuaaaagacaggacucugaccaugccuauggggaauuaucuugauuguacugggguggaaaggccacccaccauggacggcaccguucgcugugagcuauguuuguagaggagaagcugagcagugauaugcauucauagcccuuagcuuucuuaugauggagacaguuuauuacuugaaugugacgugaccgguggcaucaagucccccugcucuggauuccccaccaugauggacauacccaugcacuguaggcuaaaauaaauucuuaauucucccuuaaguugcuuuuccagggguguauuuuuuuuuuaaucacagcaguaggaugaggaaacaagacaaggcguaggcuuugccaaguucucuaaccucuguuuccuuauccauaccauagcuagucgcagugacuauggauagauuucaaugauguaaugaccuuaaggagcuuucagugccuggcacgcuguaagugcaauaaauagccauuauuauuuguauucugcagggucaggaaaacagugaggaaugauguaagagggaauuccccagagcugauuccccaaaugcaagaagaagaguugaccuuaaaauccacugccccaggaaggaaacucacuucugcucuccagccaugcccagguugaccuaacuguaucacaaacaugaaucguaacagccgucuccugugugggcccaacuguaccucuuucugggccuguggagucaguccccaggacucucauauugaggccugaaccuuccugauaaggcgguggggaugggcuuaccaguucugucccuaucucuucccugggcuugcagccagggcugcccgcacaucaaggaaggauguguaccucgucuuuugucuccagcuuaguucuucuggcugccccuucacugggagccaggguaaaaugaaugggaggaagcugucagcugccccgguggccucagauggacccuugcggagcuaaggggaacuggggacuuggaagacauuggggacuguuauggacugugagcauacuuacucaccaggcuguugaucuguagaucacaacagcccaggggaugagcucuuaccaugagcuucauguuuuacacagacuugcuuaacucuguauguuuacccaaauggaguccuacuggguccuugauuuuaagaccuauuguauuucccuuggaaauauaacaugggcauuaucagaaaccauucaauguuauuuuggggccaaaaacuauauaaauauugaaguuauggguuucuuuuuuuaaugagaucauacuuaauguauaacuuuaaaauuauuuguugugcuagcuuaguuuuuuguuguuguuuuguuuguuuuuuugucuucuugguaaaaacuagagucacuuaggaaaagagaaccuggauugaugacacacuaccaucagauuggccuguggaacauuuuauugauuaauaaucgacaugagaggcccaagcccacuaugggcggugccagcccuagguaggugguccuggguuguaucagaaagcaaguugacaaaucccaaaagagcaagccgguaggcaccauucauuccuccauggucucugcuuccauucuugccuuuagguuccugcuugaaguucauagcagacuaugaacuauaagguggaauaaauccuuuccuucccugguugcuuuuguuuguuaugcaauagguagcaaaguaagacauuugccaucagcauuuuuccacauuaguccaucuguaguggugugugugugugugugugucugucugucucucugucugucuuauugguaugugguauguguguaguaugugcagguaaguguauggguacaugaaccuauguauacaaaugagaagucccacauugggugucaucuucauugucuuacacaugauaggaucuuccgcugaacuggaagcuugcuguuugggcuggcuaguaaacuguugggaucuugucuccaaaccaaaauuugaguuuucaggcaugaauaucuaugccuggaguuuugcacagguguugaggguuugaaauuauauccuuaugcuugcagaauaaguucaauaauccacuagcuacugucccagcccuauuuuuauucuuuauaaauggagacacaggaguccauggugauuaagauggaucagaaguuacuguuuuucuaguaagggagagucgaguuucugaucucucguuacuacaaauaacacugcagugacagguguaagagucuuuaaguguuugucagaucuuucuauaggacugauagaguuauaagaacauauggugguuauauuugaagauuguaccauuucacuuguauaugucugugagaauauauuauggauacauuuccauauguacuuaggaucauuuaaaaauguuuaugugauauuauauugacuacuuauauaagauaacgacacaguuaucuuguauuuuuaaauuuaauuuuaguuuuugaggguuuacuuauuuauuuuucuuuuauguguaugaguguuuaccugaauacaugucuguguacuauguauauguaguucccauagaggccagaagaagucauuaguuucccuuggacuggaguuaacaguguuugugagccaaugugugggugcugggaauugaaccugggaccuuugggaaaguagucgguguuguuaccauuuggccaucuuuccagcccucccugacaaguaacacuucacaauuguuaguucacaauucaaauuucaauuugugagccugaaaagugaucagguuuacaaaacgccgccgccgccgccgccgccgccgauccuuaauaguuguuuuacuaacugcuuugcucacugcugugaugaaauaccugggaagaagcaacauauggagggaggcuuucauggcuuugggucugaggggauuuagucuaacauggcgagaccucaugaaguaagcaugaguuggucacaccugggucuagucaggacagcacuucccugacagauggggaucgggucaagggaacuugccagucacacuugcauuucugggggcagauugccauuggccucucuauaccuuuacacgcuuuuuucccaugaucccauccaugguauccuuugaaacccaagcauuucuacuucuauuucacauagcuuuguugauaccaacugugcaucgacaaccauuuaccuuacucauuuaagacaauuaguuugguauuuuuuucauugggcagcuaccaccauaaucuaaccuagagucauuuccuucauuccaggaagaacccauuagcaguguuacagauugaauugcaucguuaucugccuacaugcuuauguuggagccugacuccugaguaaucuuauuuggaaauugagucacauguauuuuguuaagaugaguaagguggacuccuaaugcagggugacuggauuccguauagaaagggagucaggacacagacaugcaaagaacugaguucuaaugccacaaguucuuuccuucuacccuuugggacagagggauugaacuuggguaaucagguuuggcagcaggugccuuuacuccccuagccauuugcugacaugacaagauuuaaaaaguuaaaaaccuuacaugcuauugcucuugauugucuuaaaauaaaauuagauggggaaaaaagaaggaaccaggcugggaagggcucucucugucucugucucugucucugucucugucucucaugucugcagucaccauaggaacaugacccugcuaaccucagacugugguuauaaacgucuggguuuugagccacuuaauuugggaugcuuuguuaagacaggccuuccccuucuuccccucaucagucuauaagccacagacuucaacuugcuuuuucuagauuuucccagucugggugauucauauaaguucauuaggcaauauacccuuucucuuucucucucuguccccugcuccucuuuccugcucucuauccccccuucuaccuuuuccccuuugcucccucugucuauuccaacccaccccuuugacacaguuucucaugcaguccaggcuggacucacuauguagcuagcccugagcucuggauccuccuagccaugagcuccggauccuccuuggcuccauucccaagugccaaagcaacaagguuauaccaucacaucuggccucugggcucuuuccuaauugggucuuuuacuuaggucuguguuuuugagguuuaugcauggcaucgaaugucuuguuguuguuuuuuaaguugcuguauauauucuauccuauauguacaccagcuuauaaugucccauuuaucuaccaguugauagauuuccccguugacccucagcuaacuuucugcucuuugacgagggggcugcugauuggguaccucuguaucuagcucugugcuuggcacuguguaggaaugggaacaguuauauuugcccucuguaggagagauaauaacaaagcagagcugaauaaagugcugcaaggccagaggagagagggugucucugucuguaaugggguccuaggaggauuccccgacagggcacucacuuggagcucagucuuuggggauaggggcugcuuuggaugacacagaaagaagggaugaauggaagaaucaggaaggaauuaagacugggaagauacuauauaaauauuuggucuacaccaaggaccuaagucuucaucaucuguuaggaauccagcaucccuaaguagccauuguuuguccucuuaaugauguguuaaaguuggggaagagaagguugguuuccccuuccucagcugggcuuccagaagauucaagugacagacagcucaauauuccucucuuucacuuuagcauuugaguuggguucucuuguuuggggccaagcauacagccagagaggcaagcagagcuucuagaaagaugauugaagaauauuugacaacucugcuuugaaugggaagcguuuuuuuucccccuccaucuuuccuagcugaagcgaaauguggauugaaccaugggggugaauaugugucuggggauucuaggcauugcaaggagcugaguacaaggcuaagaugguguccucucagcuugagugggugggaugcauauggauggagggauggauggauggauggauggauggauggauggauggauauacauuugggcagagcacuguuaagucccaccaccuucuccuuucuuuucuccuaucucuaagaccaugacucuucagcuaggcuccuuggacauuugaggauauuuucuuccuuuaaaauuuucugcuugggcaaugaaucaugacuguucugaggggaaaccugugagaggugaaagcagcauuggggacccuggaguaacacugucagggaauugacguuuuauccaggagguauuuugauuuuaaggaaauaagcuuugcauugucuccauuuagggcuuagucacacauauguguauacacacacauacacacaaauguacucacacauucgcucacaugcacucuccugauuacuaaauacuaaaugaauagguucuagguugggggugagauguaguuucugccuaaauccagcuagggaugaguguuagcuuagagacuucugguuuuuuuuaauggaagucacuaggguccuggguugaguuuagacaauucauugagaaucucucucucuaucucucucucucucuccuacccuucuucccuucccuccuuccccucuuuucuccccucaccucaaguugugugugggggaggugggugggugcuaguggaugaccuuggcgguugggucuucaaggaccacucaccuuuuauaauuuuuaauuguuuuugacacaggacaucuuauuguucugaaguucccaaaguauuuggccauugaaccccaggaaucuucccacacccccaguauugagugagauuaaaccugugcgccaccauaccugacuuuuuaaaaguauguaucucuggggauugaacuccggucuuugugcuugccuugcaaacacuucaucugugugcaaacacuucuccccagccuucauuaagaauucuucauuuuguccuucuuuccuucuguccugucauucagcacauacugugagugccaacugugugucugauauucuugggcuaaguaguggcaaggacauucucugacaucgagggauuucgugucgaguggagaagacacagacaauuacaguagagcaaggugagcugcuaggguggagaaaaacagaaggugcucuugggagaacugaucuacugaccuagaucaacgucuuaggaacuucuuagaacaagggggugaagaaggaguguggugcagucugcucaugaugacuaaaugucuguguaccauaguucuuguaagaaaaacaaagacuagguggaagaugcuaagaaauuauacucucugguuaggacauccugagcagaggaaggaagugaagacaggcccagggguaggggguggggguggggaacacauaggcacgauuuccugaagagccuugccagaguuuauuuugagagcaaugggaggugguagaagaggcggauaggacagacagcuccaaauacaccuuaugucugauauggugacaagaugacccauauggagagggaaggauggauugcugguuuauaagauggagucauggagauggggagauagagcaaauauaggaugaagaagaggguagacagacacaaggucuuacugugauuuuccauugaguaacgagugagacaucagugucaagucccaggguuuguccuuaccuucuggugggaccugaaauaggucaaauucuuacucagaucuuguuuucucucguuugaugaaguaaugacugucuucauucugagagucacgaccucugugggaucgaagcaagaucugcuaaggaaauugcuguaaaaacucaaccuguguccccaucacccacacuuaccuccccuaguugcccugucuuaucugaguuuugguguucgaguguguguguguguggguggggggaagugugggauucccaugcucauguagaggacagaaguugguaucuguugucuuucucuaucgcucaucgucuccuugcuuccaaagauaaggucuuaucaaguugggagcucgacaguugucuagccugucuggugaacaaauucccaggcguccuucagucuccgugucuuucagugagugaugggaucugaacucaggcccucaggcucacacagcaagcucguuaccugcuuugccaucuccccagcccucacucuuccaaacuucucaguaccucacuucucaggagcaggccucugcuuauucaacaguagagacuucacuugggagccuugcuggggcuuggaagugucucauauuggcuuuuguggcaaacagcaauaccucugaguggaugaaguuuagcuaggcacuccucagcuucuugacuaagccggguggaagcugggucuuucugauuuaagggaguaaggcucuuuuccggucucuucauggcuuccauguguccccauggauuuccuccccuccccccagguagcguguuuggagaaaacuggcagggaccucauagucuccucuugcaucagccucccuugggagagguccagaugggccaaggggcuauaauggcugcauuauaucaagcauaguuucuuuuuuucaaaaccuuucaggagaagggaguucugggaaaaagaauuccuuuggagagacacugaaucauaaaggaaagagugaucuaagcuuggaagggccaacaggggcccuguuuuucuggaagcucuuuauuucuugccuuaaccagauucuagauuuaggguuuacacaaaggucagacuagauugugagauauguaguauaacaaugugguugggacgaguagagcaagagacucucagcucccagugucuaggccagccuuaccuucagcacacauacacaaacuugacaguacccacacaacuauacacacacacacucacacacaggaauacauauacgcauauaugcacacuucccucauaguuuuauaacuagaggaaacuagaggucggcuuucauaccaguucuaaaaagaaggaagguggguuugaaaugggucugaguuucugggggacuuucugguaaaaccugccuccacguggccugucagcucuuuucagguauuuucguggaucaucuucauccugggagagagguagguccccgcaggguaggagugauaccagccuuugagggcuaaugcucaacaauccucuagcacggugccuggcauauggcuggccuuagucaauauuuguagugugagguggguugcagacguagguccuggagccaagcacuuaaaguaaguguaugacgaaaucaggacacgaggaacccaggcuuuccuacagccucuaauacauacuacgagcgagguuggacaaacgcccuuccucugccaacuccugaccuagcugccaccaggauuucacauauccuuguggacugagacuucuguguuuggaaacagauuagaacuuucaugacaauauguuacuuuuacucuuuucagauuccuuaucuguaaaagggaaagacugagcagagagguuagggcauaaagguuuuuucauuauuaugguagaugccuugcuuuggacuggauccggggauaucggcuggcucuuugggaucugcugcugggcagggccucugauguacuugcagugucacucaccaugaccuucagagcugagaccuuccaguccuggcuugugaccaggucauuuggcuaaguuagagcaagaaccuuggccaauuccuaguauccuagucugcaguguacugagaugggaggauucaccuaaauucaaacuaggccacugucaucuggcuagaacuuggcccaggugcuaggcaggguaggauaguagccuacugugguccaugaggggcccuuucagugguccucacuuguguucugagaugcuaagaaucccagggcagguuuagaauaguucucaaguauuuagccagaggcacccaccuuugagggugcuaaguuuguguuuucagauacccacucugucuuguuucagggucagauauaccugguccccucuucugaguuucuuaaaagaucugguggcuucuuggagauugcuuuccuccgcucccccaggcucagucauaaagucucucuucauaguauggcagucuuguccucccccccccccccccaguacuccuccccaggccgcugugacuucagcuaaucugaugaacagcaaccaugauuauuuaccaaauacugguuacuauacagguugcuaccauggggauauuucuugcucuuuaaaauuugguauuucugagaaaauuuuauuuccccgaaccauucuuaaccaauaaauguucaguucaggacaggcuuuguagggcauccuuaagcaaacccacaaacucuuaucgguaagccauuuccugggccccucaggugucuugccagcuagcuaagcuugccugaucaugagaugucaggcccucuuuguacugauggauauucauguucauacucacaguggggagagagccauggagaggauuaaauagauccugcuggcuaaaggaucugguuauccagacaugcuuugggcauaacauaaaaacugcacucaggaccaggagcuauucagaggggugugaggucucuggaaaccagaaauacaaugggaaguggcugguaaaggggacuguugcuuugaugccuuguguaaagauguccucaauaggcugcuaaagacaacauacccaaaauuuuggcuuuuugagagcugggcuggugggugguaccaucuugcuuagguugguccccgagacaacaggggccuugcucaaaugggaggagggcucagcucuucacuauaggagcaaccuucagccuuccagggcccuucugagcccucacaaaggaaugcuggugcuugugagccccugaaagaucagugccuuauuuggcaauggggcuuuugcaaaucuguuuccauuccuuuagagucagagguagaccaagcaaagugcaggcugauuuggaaaaucugguucuuuuucucuccuuacguuuacccuacuggagaaccaacauaaaagaaaauuauacguaugauuucuuuuuuucuaauucugcccaaaaugugaaguagcacaggccauuucauuagaguaacagucugccuuucagauacacuuccuguccuggggaguucuagguggcacccuuuacguuuaauggaaaccugggguuauuguuuuccaacugaauggaaauauuugcaguuauugagucuuacacuaaagccuuuauuuaccugugaacaccugauguuacaggguugugugagcgguagccuaauucacugugaguaguucccugaagccaggacacuuugauauagagucuugacaaacuuugguaggccuuuucaagucugagucuugacagaguaucuccccucccccacaguccucaugaaccauggucauccuugccgugugccauggcuuggaaggagaggccagugcagcgggcacucaauccaaagccuucaggguauauacgaggugugugcuauuggaagccuucuggccacauagcuaugaauauagcugguucuguauuuguagacaauguccuagugcaguaugaaaaccagggacagcucuggguccuucucugaugggcuagugucaucauuagauccuuuuuuuaacccucacacaaagcaauaccuauuucuagguuguuuugagaguuuguggagaggugacuagaagguuagggagggaacccagaagguuaaaaaguuaaaaugaguggggcaguaguggcccauaccuuuaaucccagcacuugggaggcagaggcagaggcagagaggcagagagagaggcagaggcagagaggcagagagagaggcagaggcaggcggauuucugaguuugaggccggccuggucugcagagugaguuccaggaccccccagggcuauacagagaaacccugucuuaaaaaaacaaaaaaccagcuggacaagguggcgcacacuuuuaaucccagcacucgggaggcagaggcagguggauuucugaguucaaggccugucuggucuacagagugaguuccaggucagccaggcuacacacagaaacccugucucaaaaaacaaacaaacaaaacaaaacaaaaaaacccagaaaccaaaaaauaaaacaaaaagcuagaaagaaccuaacagagcagggugguucccagagcaccccccccccccuuaaaaaaaagcaucaccuggaaaaaacuauuaaagacgcagauuucuuacuauggggcuggaggacuucuggggcuuuguauuuucguucucaaagccuuuccuggugugauugggccagagucuaugaccuuaagagugagaguuaaaaauggaaggcagcuauauaucugucccuguccuggacaggguaaggacccaccccuaaccaccuuccaacccccuaccuaggccccagaucaauagugagagucuggucuucgacuccauguguccagacacuuggauacucucaggacuagacgcacuaggggagggcagcaauaaaaucagcccgggaaggagcagagacacguuuguucaugcccggcacgugggaugagggugguuuucaagguaguuuguaaacugucuuuguaccagguugccuaugugaugcuggggaacagugaccuggaccccuggaccuggaggaacagacaguuaggagccaccaaguggguguugggaacuuaaccugggucuucuauaagcagcaagugauuagaaacauggaaccaucucucuagcccccuccccccuccccgcaagauggagguucuguuuaaggacuuuggggucugggagacuagggguuugccccugauuagggcugcagugugcuuuugccaccaugaggacaaagacaccaugaggacagcagauccucuucugcuacucucggccugcccauggucuccuuagggcagaagagacaggacugaagauaagggaguacagcagaguguuuucucuaucagucagugggggagggggaggggagggugggaaucuuggauaggcuuccccucuuccuggaucuccacacacaaaucauuuccugaaaacccuaaugcaugccagugguaagagacagcuuccugccaccaugcugagccagcccccuaucagagagaugagagaaagauguaguuggagaagggacaucuggccacucaguguccauguauguggucucuucucugggaagacgacaacaacuuuuguccugagcacagugccagaaucccccugccuggacacaugggaagauucagccuucucuuggggacagcggagagccuuuaaaagcagugcuuugucccuguugguaaaguuguacagauggugaugaaacaugaccccuuugcuucuagaaggagggaccuuccuggcucacauccuuagcccauucagggaaaagguuauuuagcuagaacuagcccagaauuucuuacuuuaagcugucuugcuccugcccugugcuuagcuuaccccauggcucuucaauguagacauuaauauccaagugggcauaguugccuugaucaugauagacauucaucauuaucaucaucaucaacaacaacaacaacaaauuaaaacuugaucuccaaguuccgggcaaugguuugguuucauguuuucaucuaagauagagcaacaaagugccuaaagacucugucucacaaacucgaggcugaauggagcuccaacagugucaugcauggucccuuaaagugaccuggcccccugucuacaaaaugggaacggguaggaaucccuaccucucaggugugcuuuuaagguguaaacucguuggcuuucucaggucugcaacaaucaggaugugguggagacaggaagcugagggggcuugggagucagaccauguacauauguuucugaaguuguuucagaaacuugugguuuaggguaucgguuguaggcuuguucucaccucaggauuaccugggggugggagagaagugcuguuaagacagaaugcuaggccccagccucaguuucucuuuugauguuguaggucugagguguggucuccuccuuugcauuuugcuuguggaguuugcuuggguaaccugaggucaacggucgguuguucucuguuggucuccaccauaugcuucgagauaggacuucucacggagucuguagcucaccgaauucuguuagauuggcugggccacacccaaaaauucuagggauccuccugccucugccucccuagcacggagguuagcagacauguuucugcuuucuaugucuggcuuuuuuacuugauugcugggaaucagguccuugcuugagccaccucucccacuccuaacuccugcuccacccccucucucuggucuugugagacaggguuucucuguguaacccuggcugucucggaacucacucuguagaccaggcuggccuugagcucacaggauuuaccugccucugccucccaagugcuggaguuaaaggcgugcauuaccccagcacaguuuagcuuuagauccuaugagcaggugcugcaugcagagaggucauauuuaauccagggugaggacuugagcuacagaggacacguagucagaacuggagugggugguuucaggagcccccgucacugaaaguuucucuuauugaauggcugcuuccugauagguucuuacaauacauaggagguucauuuguucaguaauucaguuauccacuuagucaggcuaaauguuucuugccugcuuuaggagccaggaaggaggaguuugcagcugaggcuccaagagccgcuugcugacgagggcaaguccucagauaagcugcaaaugaguuaucuucugaauacgugugccugaacguguguguguguguguguguguguguguguguguguguguguguguguguguguguguauguauaccucagaggcucaguuuggauuccucucuuuggcccaucccccaucuuccucacuucgguucauuugaaugaugcugcuggguaggauaaggagcuccccccuccuaaaacccugaauaugcuuaaaguguacucaccucaagugcauuuccugugggaaaauuuacaucucuucacuagcacccagggcacaucauuacacucugaccucucagccagccguccauuacucagucugugaaaauagauucuuggaaugagcuaauugcuuuuccucuccucucuuaagugauauaugggugaauuaaucggcgaggagagcuagagagagacucgagugaaauccauucauuuuucuggauucuuucauccuaaaccuuguuaaaagcacuaccaaggagcuagggguguaguucaauugcuaaggaaauacugcccugcacccaugaagccuugaacucgaccuuuagcacccuauaacacugggcauguugcuccacaucugugccugcgaucccagcauucgggagguggggaugggagggucagaaguucaggguccauccuaggcuauauaaugaguucauggccauugugggcuacaugagacccuguuucuaaaaguuaagcaaugaugauaauuauuaauuucuaccuagcuccucucuauuaugauuggaguucagcuugcucucuguauuauuaaauugcuugauucagcgguauauugcccuuacucaugggaagaggaaacugaagagaaaguaaccggcuaguggcuguagagacaauacucugucuuucagaccccagacccugcucuaagccccugguaagcuagagugcucauuaauucccucccuaguuaacuauaucauccauuuaguaaacuugcuggaagacacaagcaggccuaacuguggagccugugcccuugggagacuuccuguugaaguccuaugaauucagucagaccugugaaugacucccucugaaucucuggaugcuaaggcgagguaggcuuggcgacacauucugcaagcuggcagcugacccagagucucuguggcugaguguuccuuugcaucagcuggauuuuguguuuuucuggguuuacauaucccucuugggugguuucuccgcaagacugaauguuaauucuuaaggcaucugcugucugacugcauccggagaugggaagagucuagccuagacuuuggagccaugucccuuccucugggaaauaucucuucuucccaaaucuaguaucucuucugauuccucugacuccguucugucuucagcccguguuuucuucuaaaaaacaguuuugaauuagguuuucuguuuucagaauaaauauuugaucagacccuuucuuuucuuuccuuuucuuuucuuuucuuuucuuuucuuuucuuuucuuuucuuuucuuuucuuuucuuuccuuuucucuuucuuucuuucuuucuuucuuucuuucuuucuuucuuucuuucuuucuuucuuucuuucuuucuuuuauugcagcaauauguaacuugccuuguaaacaucugcccuccccugagguagccaccagugacaguggacuucugccuugccaguuguuuuuaauacuuguaccugggguacacugauuggcuuuucauuaaaauggacuugagaauacauguauuucugaaauguccuguaccuaauuccuuuuuagauuuagaucucgcucucucucucucucucucuccccacacacacauauauacacacacaccauauauauacacacauauacacacacacauauauguguguauauauauauauauauauauauauauauauauauauauauaugcauuucuuucugucagacuugaauuucuaauguuuuguuccauuaaaaucagaaauaacuuugcucccuggccuugccuuucuggagaccaguucugucagcugaaaaauccguuagauucuuuuauuucucauuuuacuuuuggcgagauucuaggaagcucguucuguaucuccuagccuucggggagggauccuuaaccucggcuuuaaaggaucagcagcuccaugaacaaugacugucccugacauuuguucaacucuugcaauacuacucacuccauuggccaugccuaaaacacaggccaaggccagauacgaccccuucauugacagccuaccaaaaauaucuagcagaggcuauucucauaaagaaaaaaugaggugcccaugcuaaaguuuagcauguuccacauuggaaggaccauuugaauuuuacaaucggguccucagucucacagauguugugacuguguuugcaguuuuugggucuuucucaagacccagaaaaacaaaccaacaugauugauuuaggauugucaacuccuggaugaagugaucaaugacagauuuccuccuggcucucuuuuuguuccuuaguccccuaauaaccaccacuuucuucuagucaggguaaccuuucgugguucaguuaaagucacugggcgccauugccaggaagagagaauccaucacuaaagguucaaaugucugcucuucuuuuuuucaggcaccuuuuugcuccagccuacacagaaaccugcuacacugcaaguggcaauccucaaaccagcacgcugaagucugaggugagucauguagacaugugcccaucaguagcugccccggcuaggugggaauaaauauguggccccuucucugaauaccuggcuuccccugaccaagaccucgggcccaaacagaggcgaacucuguugucucauaguugcuccuuguucuuugccagcaaaaaugacaaagcagagagagguagaauguuugaggguaauucgauugaaauucguguaaaucauuacaaaguacucauacuguuaggccuauguuaauuacccauauauuaaaaaucauugaaaggauuaauuuacucaucauccugccaucucauccaaguagauguugauuaaucuuuuuuuuaaauguaggguuugcaguuuuaaucacugugcauacaaauuuauauuagcauacuauaauauauaauauuaacaaaaugauauaacaacaaaauuauaguauaucuuuugaugcaguugggguuuguuguucguuuguuuguuuuguuuuuucaagacauuguugcccuguggaucucuggcuguccuggaauucauucuguaguuggggcuggccuugaacucagagaucugccugccucugccucccaaguucuggaauuaaaggcgugcgcccccacugccuggcuccaucaggcucuguaaaaauaagcuguugucuuaauacuggaccuuaacccuugagaguuguuuuuaguaggaaaguuuugcacaucgucccagagucauccaguuuggauagucauccagucauaguuuuacaucuucauuuauuucaccauauccuacgaguggaccuuuaagauaguaaaucccaccuguugcaugauuagucggcucuucccuuggagauuucuguuagaaugcacaggcuuagagcagaggagcccuggaucagaccgaggcuucggaggcugggcucuugagaggcguaggaaggagaaggacauaggcagcuacauugugacuuggcuccuggugugugacacggagaacaggaaaggcuccucugcucaggauuccacucacaguaacuggaacuagaucuccgugcaacccauuccucacauaccucagccugcgcgugaauauuuaacaagauagccaucgucagucacuaucaggcuagcuuguuuaucagacguccuggaacggggaaaaggaugggucacuuaaguuuggagucaacuaagaaaaugguucucaacuuguggguuacgaccccuuuggcaagcuccuaucuccaaaaggauuuacauuauaauuuauaaccguagcaaaauggcgguuaugagguagcgauguaaauuuuagaguugggucucuacaaccugaggaacugcauuaaagggucgcagcaucaggaaaguugagagccacagcagaguauaugguaccugggaggggaugcucuuuuggguucugggucagaaggucaaugggacuucuucccaagacuuuccugggugggaaugaaguuggaaguguggccagugacagcagcagacagacuggauuggaucagggaaacuguccagcugugacccacaucuccacaaagcuucuugccccacgcuuuucccuucuuagaaagcccagagcccguagccauuacaauuucacagaaccacccuccuccgagcucagccccuccuacuuccauacccacaacucaagaaugggucucagggcacaaguuaacuaugagcucaugcuuccugcugugaaagcccccugggcugacccccucagccugacaagcugcggaaugcaaugacuucauggccgauccugacuuguucuuugugcucuaaacugugcaccaagcagaaaugcguuaagggucuuucagagcagaacucuggaagaggauguccccugaucccacgaaucccccuccuuccugaaggccucacuggcugaagcacauccuuacugaacccugggccaagaucauuguuuucuuccauccaccgcuguuggauucuugcaaaguccccacccaggcccagggggcucccagucagccuucucguuuggaaacuaagaaaucaaggagaagcaggaauggagucacucauagcuguuggccuaaaugcagaggaugggacucugccuccaaacuaggcaggcauucuggaaaucuuaucaagacucaccagcuagaccuguagguuacagaccuaaucuaggucagguuacugggggaacagguuugggaauguguuccaacagcaagacuugcaaggguugggaucugaagccaggcuguggucuuggcucucacuggcuggaugaccuuaaucaacccuuuggaccauacugaguucuuuuuuuaaaaucucaaaaauuagaugagcugaucagugagucagcgcuguggaagguuaagaggagucgcugauuuuuauggggauucauaacuaugauuucuaacuccauaauuuacagaugaggggacugaggagggagcucaucccacugugugcuagaggguagaaaggcuuuggugacgagucagucaggugccaauucggccuugguuggggaugguagaggguggggugcagggccaaguugcugggguucacgucucugcuuaacugagucagucucucaagcucuuuauauccgaucuuaguccagaagcugagguccuuuaaaguagccuuugguuuucuccuuuaaaauugugggaguaauaucuaccucaugaagcugugcucagaauuaaaguaaaaauuagcaacugucgucaaagaguaaagacccgagugacaaauacccuggucacaugugcuagugcccuuuguaaauuaaggagcaugugacaguuguaguacaugccacugcagagagcaugggggguggggggugggggguggggaugcacucugugacggccgucagucagagagccgaagaggucugaggcuucuccauuacuacuucuggaucuaacuucuccauaccgugaaggaacuggcauuuugaaacaguguuugaccuauaguucugaaugcuugcuugacucucagucauuccacugacgacaaacccucgaaggccuggccccuugucccggggagaacucgucuuucucacugucagcacacugugcacugggucuguaaucucccuccugaguucuaaagaccacacucagaacuugguuguugaucugcuucuaguucaccuggucuggggacagauggagaagucacauggcaggcuggccuuugaaaaacagugggacccuuggcuagaaguugguccauacauauguugccugccuuccuagauuugcgggguagcaguggacuuuggcuagaagccaggcuguguguauguugccugccuuccuaggagccgagggaugaccuccuaccacagucggguuuccuuugugcucacaaagcagucaugaaucugacuuugauaccaagaggagacugcugcuaucuccccuccuggcuguguguuagugugaauggguagaugacaggugcugcuuggccaaugggccacucguagaugaaaggguaccugcgauucagagaaggaacccagguugagugugggucaggcuugugcuuccuggcauggcugcauggcucagauaaauaggauggaggacagaaacaguaaagguuguggaucugggucaacccuuuuggugggcuucgguguccucggaggccauguuuuaugccuagugaaagaauuuagugaaaaacauagccacuaguguuggcugucuaucucucugggauaaggagcagucuagcuagcucuuuuguguacaggucucucauggcccucagagguuggagguuaaagagguggaaggccagagaagucauguacacugcuagcauauguggggaccuggauuuaaggcugccuuggcugggccauaaaugcuucaguuuaauuaccagguugucccaggacuagagaugggagagaaguggacgcccccccccccauggguuugccuucuggauccucccccaaggagaccgcacagucuggagaugagauccuuagaucguuaugcagggaaaacuugagcguuugugaucauuccuuagccucagggugcugaggaagcccauuaaagaaacugauuuuacuucuaguuuuuuguuuuuguuuuuguucuugcuuguuuuucgagacagguuucucuguguaguccuggcuguccuggcacucacucuguagaccaggcuggcuucgaacucauagagaucuuccugccucugccuccugagugcugggauuaaaggcauauaccaccaugcccagcuuuucucccaguuuugcccucucuguguucugaccuccuugggaggaguguuuucuccuccaucugaagagagccacaguugacuuagcacccagcacucucagaagcacugugcgugauuccuaauugccacgauuagccuagugaucaaacuuuucuggcaccacaaagcuauuuguagcgcugugccuuugacuucugcauccauugcuuuucguuacugagauaaaacagcaagacuaaaagcaacuuuacaaaaggaagaguuuauuuggguuuaagauuccagaacaauaguccauaaugguaggagagucacugcagcggguggccagagcagcaggcugagagaacgcaucuucgguuccaaucaugaagccuaagagaguaaacuagagaggaggaugaggcucugaaaucuccaguccuguccuccagugaccuucuuccucuaucaaggcugcacugccuaccugagucacaucacugaggacuagcaaguauucgaacaacugagccugggcuggggccagcacuucucauucaaaccaccacagcuuccuaauuauuaaugacuagcuuucacaagggacuggagcuaugugugcauuuucucauugcaucucugaagccuugcucagcgccugcuuaugguagugcuugguugccagcguuuauaaagauuagagggaucuggcuggguuugggggaccacucagacuagagagugcaccaggcuucauggagcuagggacccaggaaggaaggugcagguguggagggauucgggaaaggaagagcaucuugagcugagaucuuuuaucuuuuuauccuaacaaagcacugugaacucugagguuaagagagaagaaauagauucucucuccauuuuggaggcuaaaaguccaaaccaaguuguugaaagagccgcacacacucuguaagcucuccaggggagaguccucccauuucuaauuccucagugcuccuugacugcguuacaucauuccagguuuugccucugucuucaggugacuucuccccuuacauccuuuguguccuuucauccaggaaacauaugggccguuagauuuaugaccugcucuaauccacguggccauaucuuaauuuaauuacauggucaaaacucuauuuacaaaugaaaucauauucuagucucuggguggacauaagaguuuuaggaggacacuguucaacccauuacagggcguucguuacagaggugccaucauugagagaauggcucucucugaagacuauuccugaggcugacauggcagauuuaaaaacccuggguucuccaaccuagcaggaagaucuuuggcaaaucuucuugucccugugagcucaacauuuuuugucugcucaguagagguggugaugucugcccugugcuaggccuuggguuucuauaagaaccaaaaaaguggaaacuuggaagccuuuugcagguaagagcuaugaggucagggguugggaaggaacgaguccgucuccugucaaucaaugagacauuaacauugccgaguuuaucagugccauuugaccgagugcuuccuuucuguuuggcaggaucacugcuuuuaccacgggacugugagggacguggaugaguccagugucacgcucagcaccugccggggaauuagguaagaggcccugaagcugcuggggacagcuggugcccucuccuauacgauaagcaagaccuugcaaacaagaggccacgcuugugagauaccagggaagucucagauaaucuacacguauaccuuuccugacaaauucauuguauuaagguagaaauuguugcuggguggugcuggcucacacuuuuaaucccagaccucaggaagcagaagcaggcugaucucugaguucgagaccagccuagcuuggucuacagagcgaguucuaggacagccugggcuacacacaaagagaaaucuugaaaacaaagauaggaguucuauuauuuaggaauaaggccaacaaaucaagagacaauuaugacacuaagauuagugucaaugaagaguuaucagauguaacuugaaggcuacaagucacaguaaaaagaggugugcaaaucaugagggauguaguaggaaagcacagagugugaagagacaggaaguuggguccgugugggcuagcacaggaaaggagugaaugaguucgaagggcagacugaggaguagcuaguauaaauagcuucaguagucuaggacacagggcccacuaaguugucugguaaccaucacuauggguaaugaauagugguccaagagggugagaaaccaagacgggauccagguggcuggacccugggcuauuuguuggcuuguacuacaaggcauaguagcuaguaaaauguuugccaucucuagggguuggguaaccauggggacgcaguuccuccaggaccauugaauugagcuucuagaaaugaaagcagugagagacagcaaacaggugacaugccauuuguccccaggcugagucgcaacauucuucacucugugguugaaugauguucaggugucuagcagaaauugaggagagagaagcuaauggagagaaagacaaggauaaauuucaagacaaagucaaccggaaaguuccaaccagaugauguuugguaaaaggguggcccuucuguuucuauaccaaaccagcuggguuugagccaggagcaccaggagccugaugggagguggaggaaggcaccagaucccuuagaaguagaguuauaguugguugugggccaccauguggaugcugggaaccaaaccuggguccucugcaagaacaaaguguuccuaacuaccaagccuucucuccagcccccugcugcuacuuuccaugcuuauuggaaauaucugggcucuuauuuacacaaauugccuggguuuugagcaccuccacugcacagcuccugaacucaagguggcgacugacucuaggaauaacaacagcgaaaguccauuugcgaaaguccauuugcgguagccaauaccgcgaaccauaugcugggggcaggacucucaccucugcuaauguuaauuacacauucaguguucucaaaggcagggcugggaaugcaggcccacuguugucucucaggagcuaguaggaagggcuuucuuucccuuuaucaguggcugcuucucucauucaucuugggugcuugcuguaugcccgugcccuacuuugguguaggauaaacaagcaucaucaaacaaguuuggagccuucuguauccucaucuuuuuuuaaaacagauuuauuuauuuguuuuauguauaugaguacacuguagcugugcuguacugaugguugugagucuucaugugguugcugggaauuugaauuuaggaugucuccucgcuguggcccugcucacucugcuccagcuuaaagauuuauuuuauuauuauaucuaaguacacucuguugcugucuucagacacaccagaagagggugugucagaucucauuacagaugguugugagccaccaugugguugcugggauuugaacucaugaccuucagaagagcagucagugcuuacccacugagccauuucuccagcccccuguauucucaucuuaacagaccugccaaugacagauaugguagaggccauaacgaacuaaggaaacacaaaccaugaguucugcagcccuuuaccagcauauaagauuuguucccucuacagcuuagcuagcuuaucccaucccaccuucacccccaucccccaaauaugacugagggcccuucugacugcaggucucaugucuguuuauguguugguucccaucccugaaagguugcguggcgaguggccugagggaauuaggcaggaaaucgguuuuggcugggaggugauuaacaguggccucauauccuucacucaaguggccuccuccagccaagccaacuugcuucucagugguguuuauaggcucagccagggccaccuguggccagcaaguaaacaaugacugucccaggaaggaggaaagggagcaagcaggugugaccuucuccgcccgccccuuccuuuccccccucugggucuggagcacugggaacuuacuuggcuuggccucuuguaaaucauuccagcagucaggcugauggggaagcucaccaagcugcccauguguuucugguuuucauguugcuuccaucugccgaggucuacauguuugucuuucccggcccucucuucccuccacaugcuaaggaacggagguuguagccaggaugacuugaaagcuggagacuugaaugcaccauggcauucccagagcagaagcaggaaugacaguggugcucaaacccaaauaguuucccaagaccccugaauccucauauuuccaaagaaggucuccaugguaaccauucaucucuccugguacugugcuccucugcuuggagaaaauggauaaaauuuaugcuaggcuggcuuuucuggcugaacaugaaagagucaggagagccuccagaccugugguucucagacuuccuaaugcugccgcccuucaauacaguuccuccuguugcuacuucauaacuguaaugcugcuacuauuaugaguccuaauguaaauaucuguguuuuccaaugguccuaggccauccccgugaaaggguuauuuuacaugcuccccugacucccaaggaguuccuaccuacagguugagaaccguugcuguagccauugugagggucucuucucuccagaguacucuauaggucaguuuaucauuacagaaacaguaccuaguagaauaaaucuaaauguuuauaaacauuuaagggcacgaugagaaauacuuucucacccugcuuucccagaucuuaccccguuucuggaugcagccauaaacuaccaguuucuuaugucccccauacucacuccuggcaaaaggaacuucgauacaugauauaauguuuuauaacuuugggcccuaaccaccuugggaauuggguuaaucagugacugcggaucuuaacaaagacacagcaaaccacagccaaaugcuucaugucaacaacuccaacagggaagaucggcuuuggcuugggguuucagaggaccccaagcuucacugcugccucuguccgucuggaauccaugaccaggauggacuaaggcaggacauucuugguagcggagacaguaguccuaacaacugcccuccccccagaucuucuugcuccaggcaggccucccgaagucuccagaaccuacuccaaauagcaucccagcuaggggccaucuucacugagggugucagguguccacacacuccagccuuccccaugcuaaaaauccaucccauaaaugugaccacgacaucuugcuugcacagagacuucuucauaacugaccaacagucuaaauguaaggucugaugaucguuuaugggaaaguaugccaauauugggccgugaugucuuugacuaaaccuguguguguguccccauccauuguuggugagguguuugguugguuuuaauucuuaaugcuuauuggaaauugccauggugcaacucauucaguuucagagauaaacauccaaacacaggaguguaaccuaaaaacaagcuuccacacaaacccauuucucaucuggguaaugguuggaauaugccugauagggauguauugucuauuacguacaagagagaccaucuugcacaucuaggucgguuuugugauguguuuccaacuuagaacuaagccuuagguacacauguaucugucagauuacuuuaauggguccuuaaacucuuccguacugucuggugagcugaauuauaguccuucagugacauacaauccauaucccuuacagauccacuugagggaccagauucugucacugcaguucucucugucaagaucuggaguucucacagcaguucugccuugacaggcaggcaggcuggcuggcuccggacuccgauccuguacuccagagagagaaucugagauuggguacuggagaguauauccaaaugugcacaccauggacuggaauggcuuuagaacugccauuccagggcccugaguuugugucagacucuacacuuccugggggucugacucccggacuucugcucuccauacuuacuuuugccuuuggcuccaucuuggccacacuggcuuccccgugggccucacuguauagacugccaaguacuugacuuuguggauaaugggauuggcgagaugcucauuccagaaucaaugacucuggaaauuagcaaccaagaaucugcugcagguguuauguuaacucacucugugacucuugaccaagcucccuacccacuaaaccuuaaguagacuggaucauaaaaaggauccuuuagcuugggaaauccugaacuacaagaaggagcagaguaggaaaaaggaaccaaggcuggaggugggagauguucccccaaaagccauguccuccuccugcaggccuaaugauaauuccuucugucaguggaauaagcccuuggauggcaggaccuuuacgcugugacaaguuuagauucuagagacagaccauuccugguuuaaaagcugacaacuggggccggggagguaacucaguugguaaaguacuugccacacaggcacaaagaucugaguucaguucccaggauguaccagggcaggauguugcaugcuuuuaaucucacuguuggugagacagaaacaagaggaucuuuggagcuugcaggccagccagucuggcuuuauuagugagcaucaagccauugagaggcuuagucuuaaaaaucaagaugaacaacaacagagaaacagcagccaaggucguccucugccauccacaugcuccccacaugcacacuaaccugccuucuaacacaguucuuuuaaaaagacuuauuauuguguguguguguguguguguguguguguauguauguauguauguguguguguguauguguguacauacauguaaaugauuguggggggggaggccugugugcuauaaggugcauguugaagucagaggauaacuguaugaaguccauucucuccuucuauuuagcauggguucuagggauugaacccaggauuguguaucugaagccuuucccuacuaagccauuuauuucacuggccccagauggugcugauacauuccugaaaucucaguuuucugcccuguaagaugggagcaaugauacugaagucaucagggcucacauuagaggguuagccucaccuccuugacagcacaauguuugguuggaucaccgaaucccugggggcuagaacaggugggaagugcucuguguagauguacugaguggcuccccaacaaaaugguuuguaccccauuuauacaguaugcuuccauggcugcuggcguucuuggagaaucuucccugguugugagugagcacugcguaauuacuuuagagcagugguccccaacauuccuaaugcugcgacucuguaauucugucccucauguugugcccccccauuaaguaauuuuguuacaguuaugaauuauaauguaaauaucuaauaugcaacccuaagggugucaaacucauagguugagaaccacugcuuuagacuguccugugauaaggcugugucaggagacagcagagccaggauuguaauccaggaugucuccuuacugagccuguguucucugccugugcucugucccagcaggaacucagcaucaugugccuuucuucccucugugcugccuuggaaguucccuaugacccguuaguguagguacacuuuggggaagugguggggaggaggaacccagggcugcuacuucuuaggaucucuccuaauguggagaagguggaugcauaacugugugucccaggggcggcuuccuuggggaguggcaucucucucaagucuugaaggauguauuugaccgaguccuucagucauuuauggguuaagcaugaaugaaccucuuguuuccugacuggcuggccugccuggguucuucuauaugaucuuaucugugauuuauuuuucucauucucuuaaugaugaggaauagguuuggagaguagcauccuggcucuuugccuccuagguccucuguccucaccucuaaucucugccucugccagagcuaacauuuagcaaauuggaucaguggaggcccuuaggauaaaugauggagcagggggagauauaagguagcuugagggugguagcaagggagagcccccagagcuucauucuuagaaacuugccaucaauaacgcuggggaccacuguaaugugcuugguugugccaacucuuuucagucuccaaguaaucccaggggaggaucaguggucguuaggccuggggugaguccccaagggcuauagugacgggagaaaggagagaggucgcugaauccuggugcuggaagggauaaccucagugguuaucccaagcuugggucauucagacugccuacuugagaugaugucucaaucaugugccauagagacagucaggagcaugggcuccugaaguuccuggguguggcucggcagagcauuucccauaggacuuaguguguaaggguccaugauuugccgaagaaugauaacccagacucaugcuagacucaaauaguauguaaacacaaagaguguuuuauucuguagaaguccagugugcuggggucucccauuaccagaauagagagauacccaagugagcuugcagaccugauuuaaagcacauuauggaauucuauguuaauuuguuggguccaucucuauagacauuccauuaucagggugugggagcuggaaacuugcugggggaggucuggaaacugcugcugacccauuguccuugccucaggccauugguggggcagcuucugaggccaaggcuugccuggaauggucuguucuuggaaauggagauuaagcccagucuccuuaacugccgauuugaagccugucuuggaaucagcugagccuucucaagugcagacucuugguccagcaagcagauccugagucuacugggauagccuggguacuuucugaagauugcugaauagcuugaaaacucugguccugggcucucugagcacaggcuuaagcuuacuaguggagcuacauagagccuaagggaacagacuauaucuguuaaccagcagccacaggugaaagcuucugauucuaaucucucugaaccucaguuucuucacugauaaagugaggucuguaauuuugccugccuuacaaugugcuggggaaauuuaaagagaguaacaucugccaucuaugcggcacauggucaguuagcugucagcaaacacuagcugacgauaagguugggcggaucccuccucugccaucuaccagggaacuuggauuccacagacaggcuaggugcauccuuguugauguuugaucuuuugcuaugcauuguaauaaucuugcuccuuaauuuaaaacuggugguuaaauaaagaugccaacugucaaaagcugggcagaugagacauguauaggguuugugguucacugggcuuggggucugaggagaaccaugaggggagaagauggagagaagaagaagucaccauggggauaggugaaucaaaaguuuuugccgugagggcuagccaguuggaaguaagagcggcccagauggaacaugacaaauuauaaaaugggauuauugauagagaaauagauucaaauagcauagaggguagauaucugcccaggucuagugcuaacuaaggcuuauuauaauaauuaaauuugugugucuuuaaucaaggaacugaaugaucaaaggcagggcaaaaaccucugauugagauuaaauauuuauacaacaaauuggugcccaaugugggucuugaacccacaacccugagauuaagagucucaugcucuaccaauggaguuaguaaaauuaaaaaauaaugcuuuucuguugcccaaaaccauuuugcucuaggaaacuguccugcugaucacuguggggacccagagauagguuggggcagaguuguuuuguuuuuauccaacaaaaaaacaaagcugugcucaugaaagcuaacaugggguagaauuucaagcugcucugagcagucagccugucuccuuagaauguggggcucccaugggagaacuaauggcagguugugagagcuaacaugaaaaugaaugucauacugcuaugagcaaccagucucuauaaacaugagcuuccaugggagaacugauuacagcucaaccuagcacauuauacaauaagggagagggaauuuaaauucaguugaauaaagagaaggguauuaaauaaauuuacaugaagaaaaagggggauauaaguauauuuaucuacaggaaugcuaauuuccaaagaaaggagagaaaaugagaauuaauauaaauguuugaaggguauauaaauaaauaaauccaggccuuugaucuuaauacuuggaagauaaaggcaaggacagacagguuccuugugaguuugaguuugaggccagucuaaucuacaaaacacguucaaguuguccugggcuauacagagaaacccugucuuaauacauaacaauaauuguuuuuaaaauguuuuaaguuaucaaagauauuaaucucuaaagaagagagaaagauauggaaauugauuucgauguuuucaaggguacauagauaaugaauaaauaaauccaggccuuugaucucaauacuugggagacuaaggcagggacagauaaguaaguuccuuguggguuugagaccagccuaaucuacagagcaaauccaggucagccugaucuacacacacauuaaaaaaaaauccugucucaauaaauaauaauaaucguuuuaaauuguucucauuguuuuaaauuaucaaaaugaaggugguuauaagugcucucucugguugugauggcauuacaaauccucuaugagagaagucaaucuagagcagaccuaaauuuaaaaagaggcugcuaauuggaucagucuauacucuuaaugauuucaaauugccggaccaaaggcaugcuaugauagcucagccguugaggguuaggcucacagccaaacauauaagcguucaguucccaucccuaauuaaugcuguauaauguuugaauaaaguaauuggagugagcuagcuggcugucaggcuuccccgggaggacguaccucucugcuccuuuggaaaaugagggcuuagcaucuuggugagcuucucucuauugcugcaccuacaaccaacaucaaucaacacauccuggccggucucacuugagagagucacugccgccaucacuguagccauaugcauaguccugaugacagaagaugagguaacagagaacugcccacuggacauccuccuaccuucauugucaguagugaagucguggauagugagugcucacugaaugggggugucuuucugaaccauucuccaggucuauuaugaaagaugauaaaaagucagggugaagguuguaggaugaggaaccagauugcugaagcucaccccuguuuuaacucuuuacuacuugugugaauuugggcuggucauggaaaaaauauuuguaagggucagagaaguuaguuagaaguuagcucucaucagcuuggugcccaguucauagaaaagcucaauaaguuauagcuacuaugaugauaauuaccagcccugcugccaaguuccaauugguacuuucacugauuccuauggggaacuuuccauucacuggguguaauauuggugcacacaggaucaccagccagucugugguccacaucauuuaguggccaauauuauagucauuagaggaagcugggguggugggcgaggcucuggucagcugggaugaagagauagcuugggaacaggaugccaauauugcccuggccuccguucuuuccugugcagaguagggaaguugcugugaucccugcucuuugcccuccacccuagcuguuaagggaacaccuuaggugucucaccauaggccagauggcggcugcugugucagccaggaugcagccaggaaguugauagucuucccgguacuggaaugaggucagcgagggaugggaucaggaaaggucuacugcccaccagagucugucccaagagaaucaugagcucuuauuaaaggacaaaaccugggugggcauccugagagggcagugguggcuagagguugaguggcccaagaaagaagcgcugccacucauggugccagaggcugagcugagaaggucuuugguuuggagauaagguccugagugacuuguugccaagguccuggggauucaguccugggcucauuguucccagaaucuggaacccauuucuuggcugucuuguuuaucucucuguguggaagguggcaguuuggagagugggucagaaggacagacuauauuuacucaugacuauaguugaugaugccagcaacacucuucagaaguguggcugacuguugcaggguucccagugggagauaagaugacaaagaaggcauuuggcccccuuccauccucagacacaguuuacggaaagguaauuaaccaugggacgcacaguuggcagacauuacugucuuuucauuccuacaucacaguguuagguuggcacaucauagaucuuaguggauaagaugacagggggcuacccugugagcaucuccccaccucuguugauaauggugaagccagaggcaguaagugcucacugaaccuagagagccacagaggcuucagugguacaguacccuaagcaguugcaucuaauccgugggugucugucaaggcucaggcuaggucaugggucacagugacuacacccauucucagccuguucuucaccaggacaggcagcuuggcuuguucauauuccauccuuagcaacugccaugguuguagauacauagcuagaauggcugccuuccugccaaccgugaauacaguuauucucugugcuccugcauuccaccucuguagaguuaaccaauuauggaucaauuauuuuagaaaaaaaaaguuuugcucauauauguuuuuucuugaccuuagucccuaaauaauauaguauauguaacauaccuuuacauuuaaaaauauuauuuguuuguuuguuuaaugugugugcuccugaguguauguuugugcaccaugugugugcagugccuguagaggcuaagagagaacaucagauucccuggaucuggaguuagaggcaguuugugagcugccuggcaugggugcuaggaccaaacucagauuuagagagagaagcaagugcucuuaauugcugagccaucucuccaggcccaacauuuaccuuuguuuguuuguuuguuuguuuguuuguuuguuugucuagcugguuguuuuuucaagauaggguucucuauguagcccuggcuguccugcaacuuacucuguagaccaggcuggccucacucacagagaucugucugccucugccucccaagugcugagauuaaaggcauacaucaccaccacuccugguucagcauuuacauuuuauuugcuauuauaaguaacauagaggugauguaaaauauacagaaagaaacaaauagguuauacaucaauagcacaccauuuuauauauggcuuggagugucuggcauuuuuuguuuccuuuggagucuggacccaagucucuauagauaccagcaauaagacuauuuguguuugaaugauaucuagaacucagugaaaucucagugagugaaaaaaaaaaaaacaaaaacaaaauaacccagcacauaucuuugaguucaguacugggugaaagauuguucuauaugguuaguugugggugucaccugaccagauagcugcuggcauggggcaguugauggguagggaugcuuggcucccaggcacuaggacacuugucuuucauuuaguuacucaagagccccgugaguuaguacauuaucauuuuuauuuuagggaugaggagauugaagcucggggucaugagauguuucuugagcaugugaccuuugagugccacagcuaaauugagaggcuggcuaucuagcuggcaggccagagugcuuccucugaucacauguuacuuuuucagggccuauacaguuuaaugauugucuauggggucuauggggucuacgauugucaugggucaugcuugauuugguggccuuuaggggucccagucuaaagccugaacuuagggagguaggucuaaagugcucugagauucugugccccacaguguauuucucuacagagggucuaagcuuacaccaggccuucccagagggccucgugacccaguagaacgugaagaagcauggagcauuugaaucugcacaagggacuuuuccggaagcauugaccgaagcuuccauuucucuuauccacagaggacugauuauagugagaaguaaccucagcuacaucaucgagcccgucccuaacagcgacagccaacaccguauuuacagauccgaacaucucacgcugcccccggggaacuguggguucgagcacuccgggcccaccucgaaggacugggcccuucaguuuacacaucagaccaaaaagcaaccucgcagagugaguuuucagguucccaguggagcuggcagacuggagccuguccucucugcacccuuacuuugguuccagggguauuucuagauugagagagaaggguaagaaagagggaaaagcccaccucucucucucucucucucucucucucucucucucccucucucucucucucuuucucuauuguugagugagauaccuuuguaagagaaucacuguuuauauuuaaaauauucuaagauacugguuuaaaacacuguguaagguuaaaaaaaaugucacuuccccucuuggaauagcuaccucaucugauguacaauauuuguuuuguucacacugagaacagaggucuguggucucaaaguuacuugggaacuaagcugucggcauguucccuuguggggugcuggccucaauuuuugccugugcuagccaguuuggcuucuuuguuuuuugagacuagaggauuagaucccauggcucagaaaggccuugaguaauaacccguugcagauggugauggugggcugcagccagaacugucccuaacgccuaaauguaaaagaaguaaaaaggucacagcuuauuaaccaaugugguucucagcugccuuuuggaaugagcuggagccagccauuucuacugcacugaccugcuucugucucuucuuguccagaugaaacgggaagaucuacacucuaugaaguacguggagcuuuaccugguggcugauuaugcagagguaaggggucagcaauggauuucagcaaacagaaaacaaaacaaaaaacaagaaacaaacagacaaaccuucucucuugaaagcaccaacucaucacauucaucuuuuucuaguuuaucauauaaauuugauccuaaaucugaccuuaaaucuagccauuuucuauuuuuggcugugcgccuagccuuuaauggcugagccaucucuccagcccucuucuagccauuuuaaacaguaaggaaaaaaaaaagaaaacagcaaaaagccaaggaaaggcacuccuaggacagccacggaagcacgggcuuugcuuagacuggaucucaugguccuacaguuuggaugcuuucucuuaggacugucuguaauccuucagagaauccuguagacuucuguuuuacaaagguaucaggcgccugccgcaucugaucagauacagucuucucacauguguaucuauuuuuauaaccauguugcugcuuccuaaauguccccagagcagcagcaucuguggcaccugggaacugugaaaaaaugcaaauuuuuuagccucacuccagaucucucgaaccccagaucaucagggugggggucccacaauccaugguuucauaagacaucggauugguuuugaugcauagcggguaagcuugggaaacacuggccuaaaagagcaggauagucccuugacucauuuuccucgaauuggacaggccccaagauuucacagacaccuguccaccuggcccagucauuugucucacuuuuucaggcgacuuccugauuuuuucugugccguuccaacauagugcuuggcaucaggaugcagccgugagccagagcugcucuugaaucugaacuuugcuguagaagcacaaaacccuuguagcucuaggcaugggagccacugaaaugggcccuuggugaugcuuaaaaugcacacagcagaucuggugugguuuagagccuugguagacccucucugaucuggugaugccaaagauggcagguggcguguaaagaaagcuugaauggagacuuauccuggaguccaggaguucuguuuccuccuggaagcccuccaugcacccaccacccauauuuccauuaaccaugcauuaccuucaagucccauaccguguggugacaugaccacagccaaacacucuuuccugugcccuggcugagcacugcaaaacuccaugaaagugggggugggggcucaucacuguaucauggucuccuguccucucuacuuggggcuaccagcuuccccaguggccucuuucuuugcagcuccacagcgugggucggagcaaugccagcgggugagggaguucuagcccagguuugagagcuuauuuucagagcuagaggucggaagagaaggaucuuuagccuucuuucuuaaagacaggaggaguucacugggcagcgaaguggaggugaagggcuuuccugggagggaacauuguguuuacuuucaaaagaguuuagcuuucuuaagcugauguuggcauuguuccccccaccccaccccccagcagucaggaauggguggguucuaggguuuuuguuuucuuucuacagauugauguguagaugggggagcagcaacaaagguuggcuucaaagccagccaaguaacccacuuagccccaccccauagcggcaccuuuggcucucuguauugugaagguuccugggggaaagcaaggucuuuccucccagagaguucuccauuuaagcuuuauaucuuguaucgucugauacaaggucuuucgucauuuuuccuaagauuguucagauaaaauguccugagacuccaauggagugaggcacuuagaaccccccccccccgcuccaguuuaagggaggaguauuauucuuuugcccaguggguccuuggugcaggguuuuacaagccacuuaaccugugagucuccagcaggcauagaagaggaggaguuggggaguggucuguugcuggguagcuagacucccagcaaaccaggcaagaaaaggcucuguuugaaggugugccaccauggcugugggaccacccagaggaucuuacugaugcaggggagugaagcaccccuuaaaaagcaccagucagucacauagacauccucacccccuuagcuacaagucacccccaugacucguaccucuugcugagucagggaucucucaguucucagugucaugaacaucucucagcuguaggcuuugaaugauucaugucaggguuggaucaggccaggcaagauuugcagcccagaaucugcuggcagaaauauauuccuggucguuaaucugagcaugcaggaagaugaaucaagggaaggauguaguauuugugauuuaucccccagugcugagacacagccgcuaucuccgggcucggaacucacagcagccagagggaugcuucgagugggaaagcaagcucugggcagugagguugugcuauuggcaucuagagagagcugucagcaguaagcaagcaagcaagcaagcaagcaagcaagcaguggcucucugccugggccaagaucgaggugggagcuucugggaugauucucagcauguccauucuguaggcaaggaggcgugugagagagcugcuuggguggauccuggcacauucccucauuuauuaagugaaauagaaugcaaugggagcaaagaggggggcuuacguugggggaggggaaagaauggguuuagacauagggcuguaaagaacuuuggugguaccagcaggauguaagauaucugggaaaggcuggccuaccguguuauaugaccgggguugccucagaaaggguaacacugaagcacauauuuuuuaagacuggagguuguaaacuacagcccaugugaaccuaucacauguuccuaugaguauuauucuggagcagggccauaccauuugauuuaugguauccuggaagcuucuaagcaaccaaggagaacuggguagcugugcuccaccaaggcagaacugagcagcuguggucuacgaucauguggucuaccaagccucaucauguuuacucaguagcgcuuuguagaauaagcuuaccaacuccugcuucagagucuucuggaaaacaugacacacuguuucaacuaugguggccucacugggccuuacuguuugaggauaggauuaauauauuuggaagccagaaaucucuucccaaugcaguaauaaauguuuacuaaauaaguggaaagacucuugccacaggacuaguuuagaagucaggaggucuugguaauagaaacuucuagauuaaacaguuugcaaaggucuaugcaacaggguucuagaauuuaccucuguaggagauaaggguagcaaaggaguucuuuucuggugagugucaguuccaaagaagucaaggacuguugcagaauuaauacaagagggaggaagugguguaccagagcugggagucagcccuugccaaaccaauacucuagggcaccucauuuggguauucuggaagagcuggaggaggaaaccuguaacggcuugaauaaggaauacccaccuaacaauaccuucacuagcuauccagauucugggucaaaaugacagcacacagggcaugucuauccuuuagggcagggggagguuacaguucuaaaaucuuuucgucuucccauccugacaauuucccuacuucauuauugaaggugaaagaggucuguccuuuucagacagaagugguaauacaaagccuccuaauggggcuuuaggcagacauucuaaucaaguucagcacacucuucucuccuaugccccauuaucgaugucugauuucacagugaugaugaagucaaagagucuuucucaccaaagaaggcacugccucuuggaaucauguggaaggcaaaaccauguugaugccacauggcccuguuggcagcacccccuaugugacauuugcaugccccccccccacugcaguuaguccguguagguucucagugaguuucuuagcucuuuuuuuuuuuuuuuuugguuugguuuuucgagacaggguuucucuguguagcccugacuguccuggaacucacuuuguagaccaggcuggccucgaacucagaaauccgccugccucugccucccgagugcugggauuaaaggcgugcgccaccacacccggcuucuuagcucuuuuaaauuguguccuucuuucuuaaguagaggauuuguuguuaugguuauuucuggcucucccuccacugugacugaagcucuuguagggugucaucaagaccugacauccauaugccccuuuugugcuaagcaccacagcuuguccauagagcaguuuagcaaccauuagaucagugacaacugaccacauguaggagaaagccuuauaagaugugugaugguggcuuccuauuggguugaugagcaaagcaaagagaccauucccuccucugauugaucagugagcuaaccggaagcauuguaauauaaagucaggaaaauaacuaccugaaggggcuggaagaagauaaucacaucugcucugguugcuuccuugcccugggagauggagguagccaagauagaucucacucagguucuuccugcugagagccaugggaagggcuauuacugaaaaaugacugcacacggaagacccuugggugagagcuguggaggggucugucucaccugguucuguuuguccuguuuaguuucagaagaaucgacaugaccaggaugccaccaaacgcaagcucauggagauugccaacuauguugauaaggugagaccagguguguacuuucugggggagauugcugcaccucagacagucugcagggcaagaagucacacacaccugagcucuuguugcugauuugggacccugagcuaucaaccagaggcaaacaacucagcuucuugggucagguuuuugucuuuuguugguuugugugaguguuugggggccuuuuguuuuucucuguuuuaauuuauaaacuacaagcacuggcuuaagucaguggcuuucaguuauguuuauaguuuucugauggaaaucauguuucaaaaaugacaucuugugccccugcccauguaaaagucacauggaagcagauggcuggaaacagacaugcgccuggcucugacccccugaccuuucucacaaaugaaguggguuuugaggcacacugagcaagggagagcccaguuuaaaaggcaucaaggauguguucccucugggugaaagcccggggauucuuugacuuagauguugaaguggaucgggauguuucuagggagacuacgaauaguuauacuucuucagucggguuguuucaaccaugcacuuaggaaauucacagaaguuugagcugcacucaugggguauucucagaccgugaaguauucuaugcgaaagcaaguucuagcacaaaaggcagagaacaaaacuuugcaauggcagcuccucuccacaagcaaagcuuugacguguuuggucaugugccuccuuuuaaggggcaguccugguggguagaacuaagguugcauguuugccaguggcugacagucccagcccuggggucucuugucucuuugagacucugauaaccacuucaggaccuguagaacuuugaaggcuuucuuggccagcgagagguucacggauccuagaucucaggcuggagagaugguucauccgauaacaaauagaaauuagaaacuuucaaacugggcgguggugauacauaccuuuaaucccagcacuggggaggcagaggcaggucucugagcucaaggccagccugcucuacaaagugaguuuccagaauagccagggcuacacagagaaaccuugucucuaaaaaccauaaacaaacaaacaaacaaauguuaaaaauuaaacuuucagggcuuaaaaggcagaguugauugcuguggaauuacuagaugaaaaguucacagccuuguauuuuuuuuucucugcccucaacagcuguggaaagaggccacugguauguaacaggugaaagccaaacacuagccuuuccuggagggaaggauucuagggacacaguagaguccuguguccagcuccuaacucaccagcaauagcgucucagcgauccuguaaccaaacacccaacaucuggagaaguguguuuucccuggggauacaggaagcugauccuaccgccaccuguguagcaaccauugucccagacccgacucaggggaggugcagggcuuggcuggcuggcucuaggaauuuucuuccugcacugggugauuagagccuaccucuaagcacugaugagaaauggaagugguaugucaguaaacacaucaaacaaauaaacaauaauaacuacagaaaaagcaaagaugcggagggaaaagaggguagccgcacaccccgggugucgguggaaacccugugccuuguggauggucauccaagcccccaacuucccuccggcacgcgugguuuagggugaggcacaugggcuccuccuaagucugcugagccaguuacuuggacugaacauuuuagagcuaaaacuggaagaacucuacacauuugcugaaucaggggcccaauccacgggcccuguuuucucugaggcguaagaaaagccaaguugacuucccuuaaaaaguuccugagugaagcaaauucagaugcuucggguuuuucugugaugauagauguggcaaagacagaggaaccaggagcccaucuagacugcaguuuccugggggcaagagaaggaugcgaaugugugcgugcgcguguguguguguguguguguguguguguguguacuuuauuguuauauacauauuauaugaucccagcucuucagcagcagauggucacaagggcccugggaguauaaucugguucaucuuggcuccagaguguuucugcugagauuuugggcaaugucucaacuccucuaagccucaguacccuuccuucuucaugacaagugcuugaugaacagcgggaccaccaguuauuaauuuuagcugggaaggaacccaccauuuuuagauuggggugaucuaaucccuuuguggcuucuguguuaugugguuuuuuuuuuuuuuuuuuuuuuuuaagucacucaugggcuggggagaugacgcaguauguaaaguaucugcuggguacauaaggaccuaagccccaccacccaucuaaaagccaggcauggugucaugaaccuauagccauguggcuggugggggaggcaggggacagagacaggccauccuuggaccucucaagccaaccaguuaggguuaaucaguuaguuccugauuuagugagagacccugucugaaaaaauaacauggagaauaaacggaggaagguaacaugaaccuugggacuucguguguauaugcacacacagaagacacauguacauguauuaugugcacacacaggucacauguacaugcaacacugacacgguagcauuggucagguccaccaaagaaccccuugaugguuaggguguuguucccucuacuuuuuuuuuuaaccuguuuucuaagccagauacuccaguuugaccaccagaaugcaucccucugaaggucguauuucccgauuucuagagccagagagcaaucucagcaucugugcucugagcuccuaggucggauggugagagaaacuggccuuuuggugucuuuucaguuuuaccgcucccugaacauccgaauugcacuugucggcuuggagguguggacgcauggggauaagugugaaguuucagagaaucccuacucuacccucugguccuuucuuaguuggaggcgcaagcugcuugcucagaagagccaugacaaugcucagcuaaucacguaagcagcccuuuucuggucuugugguaucagcuuugucugcagaaccccugccugccguaaggggugcgaaauucacccuuccuuucacaggggccaauguugguugugcaagaccccacccugcucccugggccacauaaccaggcuuuuucagacucaacacaucuugaaagaauguuaaaaagccuaagaaugauaacaguccucugcagaguuccacgugaggcaauuagccucacccguaaucagcugagcagcugaggcacuugggagugaauauuaggggaaugagcagaugacucuuggucacaguugcuagccugaaacaggcauucuugagcacagucaguugaccucccacugcaggauacaggaaaugggucuucaaguccuucacaccguucucuggggucucagggcugaaguccugggaaggucaaaaugguagacuguaggaccuucgugcucaacaaaggcacagagaugauaaacuccuuuacuuguuuguauuuauuuauuuauuuauuuauaacauaggcgagucaguaauuauuucauccuugauaccuugauuuacccuuucauaauaacugcgauuuccaauauuuaccugucccuaaaaccuagacucuuaguggucacuugaggacaauccacucacugagaaagucuuuguuugcugaaacauuuggccugcacuuuuggauuggacacuuugaaucuguuuaugguaguaaagcuucccagagcuaagugcaagucuccgaaaugccaagcagggcuucauacacucagaucggcauauauugaauuuauuaagcaaacauuuaucaaacauccauuuauucuccucgccuacucuggguggaugagauggagaagggauagguuaaacuggaagaaacuggcuguugacagguuagggccaucauuuuggagcagagauggaaacagcuuagcccugcacccagcugcaguuugugaggcucccaaagggacucagcuacuuucuugguccuugugugauguguggaucacagccucagccccgcagcugcauccagcauccuugcuuuugcccccaagacacaugccacugaugguaagaccugagcugcuggccacuggcggaaauggacaugauucacuugggcaucacagccuggaccacacccuucccugugaccccugugucuggccguuuucuaugaaucagggauggggcacagcuuuucaagcccugccuuuuuccuuuuggagacuuugggcacuuucugagggggaaagugaccuuuuuuugcuacuaugagaggaagugagaggaggugagaggugugguauccugaaagaaauccaguuggcuggguuaacaggcuuguccucuugggacuaaucugggaaggucaggggaucggugcacaucaugguagccauucacuccugccccuggggaacaguucucucagcccccaccugaauuacaugucuuuuuucuuccugcaggggcagguccuuccaaggcaccaccauuggccuggccccccucauggccaugugcuccguguaccagucuggaggaguuagcauggugggucucagacaagacaaugauguugcgcaaggggacaauggcucccaagagaggaagucagcuuugaaaagccgauuugauauuuauagucacagaagaaaaaagcauuaaagagagcaaaugugucagaugaaauucuuagguucaaaggauaguagccagggguaaaauuucauucaucuuuguguucauuuguaagcagugguaaaaauggcccuccagaucgguuguguauuauuccauagcgggcuggaggaggaggcagagcaggagcugagggcaggggagugaacagagauagaaguguuucucaucugggucuugaguccuuagguaccgcauugugaaaugagauccugucucaagagucaaaguuaggaaauugcccucuuuugaaauucugacuuggcaagaguaggguuuuuuuuuuuuuuuuuggcuaugaagcuguugauggccuggaacucauuguauagaccgggcuagccuccggcuugcuaucuagcucaaaaugaccuuaggguucuguucuuccugauuccaucucuugagugcugggacgacaaguguuggcuaacauaccaaguucgauguggugcugggaucaaacccaagucuucacgcaugcuccuccaguacucuacagcuacaucccuagccccuggauuuuggcuugucucuucuaaccuggacgagauauaaaggaagccucgucucucugcucauuuguuauuuuaucccucuacccaucauguauuuuuauugacaagguagcaugaacguuaaaccccagauucuagagucaaauugguuucaaagagcagccaugcgacuuuggaguuaaugugugucuuuaguuguaaagaucauggcuuaugaucuuaggguaagaguaaacauuaagugagauaauaaaaggaauauauauauauauauauauauauauauauauacacauacacuuuuuguuguuuuuuggagacagggucucacuacaaagcacugacuaucucagaacucacccauagaccaggcuagccuuuaacagagauccuccuaucucugccuccugagagcuaguauuaaaggcaugcacaaccaugccugguauaaacauccauuuugcugcuuuuguucuacuguuugguuuuggggaaugggucucacuauguugcccaggguagucucaaacaucugggcucaaaagacccuccugcuucagccucucaguuggcuggggcucuagguuuacaucgcugcaccagcccuauuuguucugcugaugaggaccacacacuguaccaguuuugucugggguggcccuuucugcaggggugcucucagaaagcagccagucaagugucucuguugcucaauucaaggugaugcauccgagagaugcauccacaggucauucguggucugcaucuuuuaagaacacagguagcagucuuuugagcauuugcuuuucaaaugaagacaaguggcuuuagauuuguuauaagcaagguaugaagagccaauaugcucagcguuaggggagaucaauggagcgcugucaggcucagauaagaaaaagucaugcaggccaggugguggugaugcacgccuuuaaucccagcacucaggaggcaggggcagguggaucucugaguuugaggucagccuggucuacagagugaguuccaggauagccagggcuacucagaaauaaagcaaaaaaaaaaaagagagagagagaaagaaagaaagaggaaggaaagaaaagaaaaggacaugcaaagcagaaagaacccccugaccuugaauuugaaauucucugaacaggaccacuccgagaaugccauugguguagccuccacuguggcccaugagauuggccacaacuuuggcaugagccaugauucugcacacugcuguucugccagugcagccgauggcggcugcaucauggccgccgccaccgggugagucaaccugaagggugccgguggggagaagagugagcugagaggugcagggucagauggccuagauggccccagggaaacuuucaagcuguugaugaaggcaguuuaaaugauguuuagaugaaacagaagcgagcagauguguugugggacgcuaaguuccucagagagcagguggucuggauugacgaauaguuuguaauuuucagcucuaaaacuggcuucaacguguuuuguuuguuuuguuuuuguuuuugacaucaccugugagagucuugcucagucaaaucuugaacuugugaauuuaagcaacucucccacgucaacuacuaaagucuuuggggcuuuaaguaugugcuaccacacccauaugcccaguucaaccacaacccuuggucuugccucuucgggagcuuuguaguuuauagaguaaaaggagaaaggggccauccagucacucuuaaggaauuccaugaaacaaagguacugagacuccaacacuuacaaggauugucuaaaccagagcuuuuggaagaggguuaucuuguuccugaaugcauacaucaugccauucuucaggacuugagccacucccuggaaggcaauguaguaggauccuuauuacaccccuucauuccaaaccacuaggguuugcuugugcuucccagagaauggugguucaaugcagccuucucguucauagugcuaguguuugcucgcuacuuccugacuaccgugacuccaaaggauggcagugacaugcgggauaugacaugcggcauaacuuuugaguuugaguucaugguuaagcccaccccuuucucagccaaucccaauagaguguguguagacaaaugggcgacagcuaaauucaugacuacucuagcuguuuuuuaaguuauucacacacugucauagcugaaugguuaguagcaaaguccuuggggaccuacuguaguacugaaagaagcccucaauguuuaaccuuucguuguuuuagagacuuaagggcagggcuuuaccagggucucuuuacagacccauguugugauauagaaguuuucccauauuuacaucuugugagguauuucucugugguuuuccuacauacaucugugaucuaugaugaguuuaauguauaaagcaggcacagucagagguuaaaaacaccaacucauaauaaacuagagcauuugaaauagugaugaugauaauaaaaauauauugguccguuuugaauguuucaacucaauaguuucagaucucuguugacuagggguaaccaaaaccagggcuggcagcuacgaauaaggaaccggcugcacuuuucguuuccauaggugcaggcgacuggagcuuucguacauacuaccgugauaaagcccacacauuuggguguugggcaguagaguuggcuaugaaaacagagaucagccccugagugaauuaaaucuguggucuugggcuuucugguucuguuuuuugucaugagaagauaaauacccaucugauguguucagcuuucaguaugaaaaccugucuuuuuuuuuucauuuuuuaaaauuagacauuuucuuuauuuacauuucaaauguuauccucuuuccccccucccccugcucaccaaccuacccacucccacuucccuguccuggcauuccccuacacuggggcaucaagccuucacagaaccaagggcuucuccucccauugaugucccacaagccauccgcugcuacacaugcagcuggagccauggguccuuccauguguacucuuugguuggugggaaaccugucuuaauguaccucucacccuuuaccuaccucagcuuccucacugaaaagacagaaaugacuguucuguuucucaacugccuuuuucauuuuuaagaaaaacauaacgguguggccuauucaucaucucaugguucagggugaaagaauucuaaguugguguacugaugaauguccuggugaggcagagggcguguguaggguuuucauccaagugaacuaagccucuugaguggcaggcaggacagcaagcugucggugugcuucagcuccgcuaacgccuccuucuucucugucaggcacccuuuccccaaaguguucaguugguguaacaggaaggagcuggacagguaucugcagacaggaggagggaugugucucuccaacaugccggacacuaggacgcuguauggaggccggagguguggcaacggguaccuggaagacggugaagaaugugacuguggagaagaggagguaagugucaggaccuuacuagagagagggacgaaucuguauugucuucagagcuuaaggacauuugaaagcacaaugugacagauaaguuccuaucaaaaggacaaugcgguccuuccuauggaaaggacaaagggacagauuuuucccaguugccagcacuucuuacacaugacuaccgaaggcccucugugugucagaggcagacagugagucugccagguggaccguuucgauggccucugcagcuguggucaggacaguccuauccaggaucaggguggagccccuuugagcagcugcucuagccacagaccaugaucccagggcacguagcucucucuccuccuccccagaggagccccagauggcgucuuuggcccuccagcugcacugaauuuauuucuggaggccacacagcuggaugagcucaugaccaugagccuggugaggagcccuaacccaagcucgugcuguccagcccggagaagagaagauuugaagggaguguuggaaguacugucaggucaggggagaucugccgagaaaggagaagcagaacucuugguggauaguccucuccuccuaucagggcuucagagcgaguguggagagcgcacacccuagcucugucaucuuuauuagaaggauguuuuucugaaaaagaagaagaagaagaagaaggaaagcagaacuauauuguuucgugucuauuuuuugaagaucagaaaguauguuaacccaugcuugacaguuagugaacuguaaguaagcaguguguagcuaugggacugagguagccauauuacucuccaugucgagaugcccucuuguuuuuauuuugcacguauuucauguguguuugugugcguauguucccccucuccaacuucaccaccuggcauucagggaccaaacucgggcugucaggcuuggcaccaagugccuucacccacugagccauguugugaccuucuuuuaaaacucuaacccuguaauuuucagaauaaaagaacuagugaaagaccaaugaacuaaaagugagggucagcccuggccuuucagcauagggagaguccuuugaagggugacgggcaugguggacuuugcaagcucaguaugaccacauaaguaugggauaauaccuacucgaaaucaccacguagucccauuuacauuguggugucuccgaggauggagcacuugugucuuuucucuuacagauacucauuaccuuaguaaagaagugcaagugaugcucuagggaacgggaagcagagcgcgccaggcaggccggggaauggagguggcaagggcgcccccugcugggcucugacucuugcccuucugcugccuuuguaggaauguaagaacccuugcugcaaugccuccaacugcacucugaaggaaggggcagagugugcccaugguuccugcugccaccagugcaagguaagugucuccuuuccucugccucaggcuuugaggugacagccuaguggguggcggcuggguuucagccugcaucaaaaauuucagacacagggccggggagggugguucuuaucacuggccacuugugguaagaauccaugcuuucaugcucagggcucuggauucaaccccaucacugggaggaagagaagggagaaaggguggguguguguuagauauuuggaacugagaaugucccuuuaacuaagccuaccaauuuucuauccugggccucauuaugcucaaaucaccucauauacauauaaauacauauacacauauauauccuauauuaagauaugaauauauaaauaugucacuaauauauauauaaauauauaagcagaaauauaaauaaaaauauacauauguauguacguauaaaaucaaaauaaagauauauacacauauaacuguguauauaucuuuuuauuuaaauaguugauauaucugauauagggcuauauacauacauauauaugugcauuuguagauauauguacauauaucuuuauuuugauuuuauauguauguguauauauauaugcauguguauauauaugugugugugaauauauguauauguauguauauucuuuuauuuugagacaagaccucacuaaauugcucaggguggcuuugaacuugcucuggaguccaggcaagugcugacaucaucucccaggagagaucuaaggcaccaggcccagugagacuucauuuuuccuugaacacaugaaaaagcaaacccugauucugaugaacauaaauggccaucgugguggaugucgggcaccaggaggagaauuuuauaugcuaacugacucagucuuccccacagccccaugggguacacauuacugccucuguuuuaaggugaggaaaaugggucauuaggagauggguggugucaggaccugaacccaaguucucccugacucugaagcaugcauucuuaauaucaaugcggaaaauaaucuauuaccauuaauagucauauagcacugaauuugagaacuucuuuuuuggggggugggguuucgagacaggguuucucuguguagcccuggcuguccugggacucacuuucuagaccaggcuggccucgaacucagaaaucuaccugccucugccucccgagugcugggauuaaaggcaugcgccaccacgccuggcuugagaacuucuuaauccaaaucugacaagucaggaagucccaaaauauauaaauaaaaaaauuaacagauuuggugauaaaaucugaccuaaauggauaucagacuaauuauaguuuuuauaaaaagauuaccuaaaauaacuuuauuucaucauaauauaccauauauuaauauuuuugguuauaaagcuuauccugagccuuguuaaagguuauguaguauauauuuuuauaauuauacacaucuaucauauucauauagauuuguuagaugcacacacuauuaugauauuugaacuuuugaguuauuaaccugaaacucugaguacuagagaaguuugaguauggagcuguggccugucccacccucagcuuggcgagcgcacacagugcucacguguuguucaaguacccuacugagcaugcuugcucuuagcagccagagagagggcugggaucuggaaucaugggcaaacaagaaccaaaggucaaacgcacaguaggacuuggcucaguagaacuuggacaccuucuguuuugacauggaagcccccagggaggcuaugcugaguugaguucuucaagucucagaccaaggcuggagaauaagcacggagugaccuuucacucaacuccaggauuucagacugagccucucaaaggauuccuugacuuaaagcgcuaccugugugaacuuggggaauuuuuaaacugccggagucucagcucugucuacacacccgcaugagcaucagaaaugcugauauaaaguagcuauaucaguuucauggacauugugaggggcagaugagagaaguauuuggauaacagucagccccaugcucugcauaccacugagggugugcuguuuagagccacaagcuggauguagugagacaugucuacaguucugcuauuccagaggcuuagccaggaggauugcccugaguucaaggccagucuguguuaaauaauggguuugaggcuaguuucaagaacaaaccaagaaguuguaaacuuacaugaacaaagcaguaauguuguaaauugaaaaucuacaugaaugccaauuuucuguguguggguauaugcauguaugcauguaggcauguacccuuaucaggaaacuggucugccacauaccacgugacuuugaauauauuaugucuugcuccuuuaguuauauaagacuauaaugcaaacuaauaaagucguagugacacuuaagugaaagaugguuguaauggcagagagaaaacuauagauuguuagagaaacauuauuucucaacugcugugggaaggaauugcguugaguugguccauguggguacaaguuugaaggaacucagucacuguuuaugcgaaggccgacgauggcuugagcucauugaagucgugugauaagugcggugauaacaaggucgucaaaacuguuuuccacagauaggauguucaugagcucuuggcugaaaggguugggggcagggaagaaaugacuacucuucucuucucauuccucuaccuagcugguggcuccuggaacccagugucgggagcagguucggcaaugugaccuccccgaguucugcaccggcaagucuccccacugccccaccaacuauuaucagauggauggcacccccugcgaggguggccaggccuacugcuacaacggcaugugccucacuuaccaggaacagugccagcagcuguggggaccugguaagagcccuccuggauggagagcauggucucuuccgcccaccaccucugagccugucuccccgcuggcccuuuagcuuggccuagaacaccuucaaauaccacaucucaugcucuuagcucaagagugacaguauuucucauauucccuugaagcuuuuaguucuaacacuggacagacaguuaauaguacucccuccccaacacaccaaugaagcagaaauggagaauaaaagaaaaugaaaaagacccuuaagcuacaaaaaauguuuagcuucagucauauugagagaaagcaaauugaaacuaccaucaagugggguuuuuucauggaucagaucucaaagacagcagugauauaguaauaacaacaaccauccuaauauauuagcauggaggguaugucuuagucaggguuuguauuacugcacaaaacaucaugaccaagaagaaaguuggggaggaaaggguuuauucagcuuacacuuccauacugcuguucaucaccaaaggaagucaggacgugaacucacacagggcaggaaccuggaggcaggagcugauacagaggccauggagggauauuucuuacugacuugcuuccccuggcuugcucagccugcuuccuuauagaacccaggaccaccagcccagggauggcaccacccacaaugggcccucccauccuugaucauuacuugagaaaaugucuuacagcuggaucucauggaggcauuuccucaagggaggcuccuuucucugugauaacuccagcaugugguuuugacacacaaaaccagccaguauggaaagaccaauguagaaagcauuuuagagauagcaaaaauuuuaauguauuuaccaguuccauuaauuacauuaggcuuaaauuguuuuccacuuacccuuuuuuuuuuucugagaaguuuuuacauggcauggaacaauuugugaguauauaaaaguagguauauacagcaaacauuuauugauaauaaaucacaaggaaauuuauuuuaaaauaaucuuucauauauaauuuuaccaaagcaaauguauacuuugacaaaucgguguguuuguuugguuuuuuuuuuuuuuuuuuuuuuacauagagaauuaagucuuggcuaaaugguugaaagugcaggacauagagggucugaaacaguuuucagaguuggcugauuuuauaguugucagggaugggaacaccaacccacaucgauaugugguguaaaagugauagaaguauguuuagggccuuaccagaaaugguuggaaauucuaaucugacaccaaaucaugauucguucagugacuuuuaucuuuauuuuuuugagacagggacagggacagggacuuuauuuuuugagacaguguguguggccugcuugccugaaacuuacuacguaauccaggcuggcuugcaacuccuagagaucuaccugccucuuccucucuagugcuaggauuaaaggcaggcaccacacucagcuaguguuuuguuguuguuguuguuguuuuguuuguuuuaauggaacugaagucaggaacgcaaacagcaauuuuauaaaucaaacuuucuaacauaauauuaacauuaaucugaaguuuaucugcugaggaaugacaguagggaaaacauuuuuuguuuucuuuaaugaauccauugcauaagagacaacauacauacaacaaaaauauaaccagucauaauauaaaguagccucaagucugagcuugucucaguagcauucauuuguugugugcaucuguguugaaagccaagcuguaguaaagucacgugacacuuggcaugggugaacucugaauucaugacacauucuguuuucaguuaguuuugggucauugcacauuuagaaucucuuuaguguugccaguuuuuuuuugagcuccauccccauucaggugugggauucuaucugccuccguuuucagaagcugggcaguacacuacuuagaaacaaccucggguuguauuugcuuauggauguaaagaugcuuuguaagauguuguuacacuguugcaaauuguagcggcagcauccuuaagucagacaacugaaugcccugaggcugaauucuguauccgacaaacuaaaaccccaaagggcagagcagaaagagaagagacgaugcuuccguccuucacugcguucuuucaagaagaugccccaagaucaaaucuaagggaugcaaaagguagagaagacauuuucuucucuaaaagacacacugcuaaagauuguugcuuuuccaugauauaagagggaaaacaagguggaugugaaggaaaaacuccaaagaucuauuuuagcucuuuuaauguuuggggcaugaauuacuaaucuuuuacgguccagaaauaggauagcucuucuucauuagcuagcaggcuuagcaugcagcugccauagauacaaaucuucaaugaaggguuaaaaaccaggcuaaaaauauuuucucugaauuggccuugauggaugguggaagugucaugcaugccguugcccaagccuagcuggcucugucacggggagccgcuggcgggcuuaugcacugacaaauguuucuugcauaccuaggagcccggccugcccucgaucuuugcuuugagagggugaaugcugcuggugacaccuauggaaacuguggcaagggcuugaauggccaauacaggaagugcagucccaggugaggaccacagcucugacccggugggaggaagaguggccaaucgaucccugcucugaccucuucauucccaccugacuugguguggauagccuacuauuggcuuuuaaacacaccaguuuaagccucucucuguucucuaccuauugcuuggugaugcacucacuguuugguuggcucuaaggaagugaaaaagaggagugggcagcauugcuuccuaggaagcugaucaaggcugcuuuggagucucuggccuauaagugcaggacaagguaguuggacaugccuuuaucccggcaccggggagucagaggcaggugaucaugcggaucucggucaguuugagaccagccuggucuacaaagcaagugucagaauagccaggacuguuacuuagagaaauccugucuuuuuucuuuuuaaagugaggcaggagaugacugaucugagaugacaauguuccagcaucuaaauguuguggaucccagacggcucuuuuuuggaccauuuuugcagagugcuaaaguuaugccugcuccugagagccaucucugauucauucauuccagccacccacucacuccucugcccacuacuguuucagauucaccacaugcaaggugcugaauugagugucuagagcaaugugguuaacugguguaacaguuaacggccuggagcaucuucccaagguguucucuagcugaguucuagagcagccaucuaaaugaaugggggaggaguugcacuaguguguaaaacaguguuuuaggcugagauauuagagaaaaaggagcaauugacgaacugauagagagcaagcuacaauuugugggaagacaugggcggggguggcaagaaaaaugagccugggcagaggaaagcaggaacuagauccugagagauauaaaggcaucucuggaugaucuggaccccucccauggaugcugcagugagggggcucugugucuuauaggccaggauagaaagggaguaauauauauauauguauauguauauguauauguaauauauauacauacacacacauucauacauacauacauacauacauacacacacacacacacacacacacacacacacacacacacucacacacacgggcuggugagauggcucagcagauaagagcacuaacugcucuuuugaaguuaaaucccagcaaccacaugguggcucacaaccaucuguaaugagaucugaugcccucuucugaugugucuaaagacaguuacaguguacuuacauauaauuauaaauaagucuuuuuaaaaaggggggauaagaauguaagucagggaagcuguguaggagggaagauugacagggauugaaaaugcucaaacuugggaacaaugaagaauggggaggcagagggagaccuagcuccuaguuuggagugccuggggaauggauuugggacaaagaugaccaauuauucaugucauucagguguccuugugguuaggacauccuaaguugagcucuuggcuuaggucugcugagacacaaggaaccugccccuuuucugggucugagucuaccuuuggucucuacugccggguuccagcccacucucugguccuuugcccugcuccaccgaagccuacugacuuggcucagacugaagcucuccaauguccccgcucuuccccagucucugauccugucuucuuuccuggcccagggaugccaagugugggaagauucagugccagagcacccaggcccggccccuggaauccaacgcaguaucuauugacaccaccaucaccuugaacgggaggcggauccacugucggggcacccacgucuaccgggguccugaggaggaggaaggggaaggugacaugcuggacccagggcuggugaugacuggaaccaaguguggccacaaccaugugagucccucccuaaccucacucagaaaccaagaggcagaggcagaggcagagacugagaagugugggcuccggaggagugaugcccagcucucagaauaacagcaucccaccuaugacuauggaccuagucauguaaacgcaggcaucacugucaugcaugucauuuacuauccucauagaaauggucuaaggcugggcgugguggcgcacaccuuuaauccuagcacuugggaggcagaggcaggcgaauuucugaguucgaggccagccuggucuacagagugaguuccaggacagccagggcuacacagagaaacccugucucaaaaaaagaaaaaaaggaagaggagaaggaggaggaggaggaggaggagaagaaagaaagaaagaaagaaagaaagaaagaaagaaagaaagaaagaaagaaagaaagaaagaaagaaaggaaaggucuaagauuucagggagacccaaggaaaauaacgccaccaaccccaugcuuuaaauuguguuaaauuauaaacacagaggaaaccuaugguacgaugcccagcugaaaguaagcuccugccacaaucaugauuuuuaggcaucauccuaaacuuaguccauauucauugcuggauggaauauagucagcaugacgcuagacuauaaacguguccuaguuguugaauguaccauuucaguaauguuugcugcuccuucccuaaucacaaagacaacagcagaguucaguuacccacugaaucuuuuuugaggccuuuugcauuucucacuagauauauagcccccagcuauguuuugggguucccauucauccuaaggacaaaccucccacacccuaagccucccccaugccccugugucccgcugauggcugcccuucuauguugcagauuugcuucgaggggcagugcaggaacaccuccuucuuugagacggaaggcugugggaaaaagugcaauggccacgggguacguguguguaugcagaggucuggguuccuggguguugcccugugggaggucacagcucuccugggugcugaugcgucugcggccccucacucuaggucugcaacaacaacaagaacugucauugcuucccuggcuggucuccaccuuucuguaacaccccgggagaugguggcagcgucgacagugguccuuugcccccuaagaguaaguguucugcuuugugagagaggaggaggagaccguggggauaagggguagguuggcaggagccucuagucuuuugacuuugcaauauggcaucguugucuacaaaccuguugggcugcauucauagcuauucauggggauugugggccauaggcuggguuugcccguugcagaaaguccaagguaagcuggcuucacucuccagauucuacagggagggagccaagauaaagacgcugagugggaggaugccaggucuuccuauggggccugggcuuagucaccuuccuguccuuuuacuagaggagagaggggcagggguagauauuaagggagacugaggccacuggauagucacaauuauuuggagguaguaacuaguaauuaguccuuuuagggacacuugaaauaauuacaaucuuggggugcauuguauugguuauuuuaccuuuuguuaaauaagguuaagaaaugggaaaacaggcaaguuuuacaguucuuagggguggucucggggacuugaccccugugguuuccagauugugucuuugaauaauggcaaaaguacuuuaaaaaaaaaaggcuaaaaacugggugugguaguuccuaccuguaaucccagcauuuaggaggcugaggcaggagaauugcugcugcaacuuugaggccagucugggcuguaacaaaaugaaaacagacaagaaggaagagccugacuaugcaaugaccaugaacagagcaagaggagcuucagugaugcaggcacacugugugcauuuacauuuaugacucgggaacuguugagaugggcuuuggacccaaccgugaggcugagggcccagggugagaguucuaguccuaaaaugucucaaccaguauuuucuggccauugcucuguguccaggaaaaucguggugcuggcugacuuuaugaaaguccaugaacugcuuugggaagaaucucugaggcagcuggacauggggacugucuuuaaaagcccaugggugggccuggcucuuucagcuaguauuaggacaccaauagaguaugaugugcguugcauguauuugugcuuguuuaaacuaagucggcgggaaucaaauaccuggagcggaacaaaggcucugucauuuuacuguagccugaucagccucuaauucucucacuugugcugacuuccggcaggugugggucccgugaucgcugggguguuuucagcucucuucguguuggcaguucuggugcuacugugucacugcuacagacagagccacaaacugggcaaacccucggcucucccuuucaagcugcggcaucaguucaggugggacagggugcugugccuagcccuuguggaaagguuggugguuaugggucuaauucugggaugaugaaggcagggaacaugccacccucaacccuucuguccucucagucaccaugacagacauuaguagauaaugacuguaagugauuucuacugagccuggccauuaacuugaauucuucccaauagaaagcccuuagccgguucaaacugggguaugacauaaaaucuauuuaccguccccuaccugauuaacuuaucuuguuuuuaaagugcaggaagcuggggcgacagagagggaugacaagcucaaucagucacagagauaacuagacauuagcccaagaagacgaaugauuaauucauugagauauugauggagcaugcucucuagaguuuguuaaauguacuugcauggggaucccgcauccuucuguuauccaugccagugggggucgggguacauggugguuagugauauucugucuccuaauugggauggaggggucugcuugugcaaggcagaagcccucccuugggcuucuccacuggccgugugugcgcuuaucuauuauucaggagauggguuuuagaggauuaucccgcuuucuucagaggaggguuagauuuguccgcuggccugggucggauuugcuuaguccacacacaccacugaacacuccuucccccauguccccucuuccuuguuuccaguugucccuucaggguaucucagagugguggaacuggccaugccaacccaacuuucaaguugcagaccccccagggcaagcgaaagguaagggcuuugcaccauugaacuugacugaguucccuugagaucccuguucggcuuucuucgguacuuaugugugcccacgggguugguaaugaaagcuaucuuuggggcuugaaguugguucugaagccuggaauccaaaggucagcaugucugaaagucaccucauugagacacacacuuagggaggauuccuuaucucagcugcucugugucuccuucauauaggugacuaacaccccugaaucccuccggaagccgucccaccccccuccccggcccccuccagacuaccugcgcguugaaucgccaccugcaccauugccggcacaucugaacagggcugcugggagcuccccagaagcuggggcucgaauagaaagaaaggagucagccaggaggccucccccaagccgacccaugcccccugcaccuaacugccuacugucccagguaaguggauucucgccaacccuaggcuggggacaucgcccauagcaggccaucagcaaugagggggcguugaugugaugcacugauuggaucugaucauccuuucuuuguucugguaaauccaaugggcuuccagagguuuagcaauaaaccuucccagccaggugguagcaguacacaccuuuaaucccagcauucaggaguagaggcaggcaaaucucuacauucaaggccagcauauucuacacagcuaguuccaggacagcuaaggcuacacaaagaaacccuaucuugaaaaaccaaaauacuuuuauugcugcugcugcugcugcuacuguucaucaucaccaucaucaucaucaccaccaucaucaccaucaucccuaagccacuaaagugaugcuuuucuccuauuugauuuccacacacuuuguaccccaaauuaacuucuuucgguuccccgagagcugguccucuucaggucaaugcagaugcuguuuuuccccaaacacaccacacacacacacacacacacacacacacaccccugccucugccuggccuguuccuauucaccgucaauugugacuuuagauaacacuccuccugagggguuucucucaccuaguaaggcugaucuuagugcccugugcuucucccaucguauucagccccacaaaguguaucuacuaguuagcuuccacucaccaagggucuuacugaagggugcaccacgaugccucgcuugccugagggagucucugggaggugaugggucuggacuguccccuucuguguagcugguacucacaacuuggagcugugacagaguggccuguucgcuuagcguguguacucugguauagguuccccagugaagacauggacaucucuugggcaguggccucuaaaacugauugugucugcuuugucuugguauggcccaaaggcuuucccagggccgaguuucucugcucacaaccaccccauggucagcuucagacccuagggcgugaggacagugaggguauuggguuggguucugugcugugaagcagccccuucgcaagugccuguguguggggccaggaugagacauacaaauccacgcagagggggagggaucgacugcaucugauauguuccgguacaagcucagcauacccagaucacucccgcuuaaccacuuuaaacccuguuccaugacauugagccaugcaugccccgaaaugggccagcucuuacuaucuuuguaaacgaugaccuuaaacugcgcaugcucagggaagguacaucuaacaaaugugaauguacucacuggauagaguuggccuugcugccuuuggaggggcgugguuuagcagauccucaucauguucuccugaacaugcaggguauaaacucacacauguacauaauuaaaaauaauacgauuagccaaguguggugguacaugcuguugaucccagcacuugggaggccaacacagauggauugcuguaaauucaaggccaaccugaucuacaugaagaguuacaagauagccaaggcuauguagaaaaacccugacucaaaacagcagcaauaauucuuuauacuaaaauauuuaaguaguacagaagugugugucuguucugagaaguuugauuagcucuuuguuuauguuccuaguguugaguuaccuucuuccugagucuuagugcuccccaaagccugcaaugucuccaugaaucagacagaaaaggugccccaccccggcuggaaauaaaagccugguaaauuauuuauguuaauagggauaaaagauaugaugagaaauaaacuaauuaaaaauuaggcuuaggggagccacauguacauacauacacacacaugugcaugcacauggacacaccacacacauacauacacauucucucucucucucucucucuuucacacacacacacgcacacacacgcacacacacacacacacacacacacacacaccacucauuccgucuuccugguucauguccacccacgucuguucaucgccauuggcuauaggcagggaugugguggucugcuuugcauacacgcuccucugucggggccaugucagcuugucucgcagcugacuguccucauuagcccagaugcccuacuuuacucuuuacacacacuguagcccacaucacuggguaaguuauacuuuucucccaccguggcuauuuuggaaguuucugaguucucugguauuauaaaucauguguacauagggacauccuugcaaaccagccuucugcagcucucuaacauggucaaacagaagugggauuuuucacaccaggaaaagacauuuucuucuucuuuuuuuuuuuuuuuuuuuuuuugguuaaauuuugggacaggguuuugaauucacagacccaccugcuucuaccuccugagggcuggaauuaaaagugugccuuaucaugccaugcccauagcucuaauuuuaauagacagccaacuuguuuuccaaaaaggucuuauuuuuuucuuagcaugugacuacauuauaaaguagacccccgcauaggagaguccuuuagaaauggaacaauccgguacguaaguuauuuuggcugugacccagaagauacuaggcauacuuucuuuugaagggagacccucaagucagacuucuugcuuccuccaggacuucuccaggccucgaccaccucagaaggcacucccagccaauccggugccaggccaaaggaccggucccaggucaggaggcaccucccugcuucagcccccuacuucugguccucagccccccaggccuccagcagugccuguuccaaaggugaguccacagaaggacccagaaggaccagagaggaaguguguggcugagaaggcagucccgugccccacgcuagguucuagaacagaagcagaaaugaacacguagccucgcuuggaggucuauuuggcuguaccuuacaugagcaaagggagguuugaauuuccuugagaaugaaagcgucacacagaagccuaagcucugguggcuuugauggcaccugaacagauaggccaccuugaguaaauccuuaucucuugauaagaaggcuuaagauuggccggcaaggugguucaagguaauuuuuaaaaaggccagagaagcagcagggaccagcuccaugacauugcucugaaggccauuaguuuauacaagccugucaacauaugucccuuuccuuaacgcuucucucugccugccauguccucggcuuagucuggggaguugggucagaaggggugaggcaagaaagcugguugccagcccguauccccugaagcacuagggaacuagauguacugaaacuugauggaagaggggaggggcuaaguuuccagcuuuggggguggccacacaauugcucucacuacaagggccaauggcccuggaaugcagccgcggggacagacuucugagcaagaggacacuugcccacagucccacugaccagcacugaggucacaucguuuuuuguuuuuguuuuuuuuuuuuccuuuccagcuacccgaguaccgaucacagaggguuggagcaauaauuagcuccaagaucuagaagugucgagaaguuucuuguuccgauggaagacuccggaugccauggaagguccagaagaaagacgccuucucacccauccugaagcuuuggcagccuucuggaacgucccucauccccagaaucucccuucuuacccgagugccuccugcuuccuccgaggcccagggggacucauauccaauggcuccuaaguguuuguccugugcaauauacagcccagggagggaagggaagcacggcgaggagggugggaaagguucucccucagcccacuagccaagagcuaccagcgaugcucagggaaggcuugagcugggguccuccucugcggagcuuggagaagguacccauccugguccuaugcuggcaggaacacacgcgagugucacugauuggccuccuucugggaucccaggcugcugaggaagcuacugcuacaucccuaccccaaggggcuuggucaaggugccuguuccuggcucucuggcugcaugugauaagccaugcuccccuccccugccuuucuucacauucccacucccauauuuacacgggucacucugacucagacagguacuauuuguaaguagcauagacagcaggggggugggguggucaaccuguguccccucugagccguuaugccaaaggucacuaaggacauuuagaauccccauccauccauccauccauccauccauccauccauucauccauccccaguguuccaugugucaccuucuccuuuuccagcaucccuauccuauggugcuuugguggugaacuauggcaguccugacuugcugaugaccauaugcuggugaccuacaaaucgggauccugccauauggggucgccacuggacuuucugcacuggaucucaagagcguugagccgagugggcguguaugugugugugugugugugugugugugugugugugugugugugugugugugugaaagagacagaggcaaugagagagacagacaugcaggcaggccgacagcucugcauguacuuguguuuuacggccucaagcagaauaagggaccuccuccuuauuucugacucauaucuaaguaagguuccccaggacagccacaguuguacugaggggggcugacauguuuggcauccuggcuauaguauuguauacacagggccaccagccccgcccuaguggucagcucugaggggggacuggugacucugaacagaucgaugucaacagccauggugaaccagaucugggcaggguuccccaaacucuauucaaccagaguuuuaucacgcaccucaucgggucucuccugguugcugccccgaggugaucgucauggaaaaugcugagaaggugggaaugggaugggguggaccuucucuugcuuggugcuccgcuauuuggaacaguucuuacacauuugcugggccuggccucugagaggccaucuuccacccccagaaaggugcuaauggcacugcagagggcucucuaggggccuccccgccccaacagcaagcaguuguuagcucuuggaacccuccagaggaagaggcaagcguuugacuuccccuuuaccaccugaggccuccuuauaucucuucccagaguaagcuuugggauuguagacaugugggagcuaugacagacguggccugggguagaaagaucucaggaaagcaccuuucuccuuuucagggugaccgugcucuucacacucucugaggccucaguccauguccuauaucaguuucucuuuugugugcuuuaccaaguggccggugacuacaggccaccccgauucucaccacaaaguuagaaacccuccacuuucugucccuugaaccauaucagaaaaagacccauuuccuugcucuuugguaaucacuucuguuuuuuucuuuuucauuacuuugcuaccaccuccaucccaugacauuauacugugaaguguaagaggacgggguuuuuuuaaacuugguagaaaugucggcagcugcucuacacacaacuucacucaaggcuuuguuuccagaggccagcuaggcugucacaggcaggaaucccuucccaucugcuuugugaagggucccauacagguguaucuagacuucaaggacaggguuugucucacaggauugucacuuaggagaugaaagaauauuaccacaugaggaggaggggcaguugcaacagaacacuuuggucuuccuacaccaagucugugagggcauccaagacugaaugaaagcgcuuuucuuaugcauacaaugugagcaagaacaagaacuguuuaaggcaccucuguucccagccacugaagagagacgucagaagauguuagaauaggucaaagccaaggcucuggugggcugagggaagguuuguagcugcguuuagugguauacaucuuuagucccagcauaggcaggugaaucucgaguuugaagcuagccuggucuaaaaaggaaguuccaagacugccagggccacacagaggaaaaaaaaaacccucuagaaaaacaaaaaugaagacaggaucucauguaucguagauuggccuuuaagucacuuuaccaaggaugaucuuugaacuccugaguacagacugcgggugugugcuaccaugcuuuauguggcccuggguucaaacacagcccuucauauguauauagccaaacacucuacaacugagcuacauccuccagccuaggcuguaaauguuuuuuggagcuagauuagcugccugccaaccuuagaacugcaaagccauuccugaccuguaaaccucagcucuccaucucuauaagagguauagccugggcuaauaccguccaaguuacaacuccuugcuugcuuucuguuccuucuagccuuggugacuuccaccaggaagagaauacccccucucuaccccugcuccaagacacuguagaugcuagugucggaguguucucuguaacgcgacaguuccuucuguugcaauagccccccugcaacacugcaauaauccuucagugucuccccugggcucaauucacuuccuuauuugacaaaguggaggugagacuuguauucuuaaaauuggaggcuaguuauuuugucaaaugcauguaaugaacagacccgaaggaauccuccacacacaagccagggaacaccaacuggaaagguaccccgucccagggaagccugcuagggagagguucuguagaauccgagccuagcaccccaaagucaugcacccaguauccucuuguaugacuguauaugucuaugucugggauccagggcaaaugugaauuuucuuuugauuugggagauuguucacaggaaguaguccuccccucucauguccuccuauugauuguuuacaauauuuguacaucuaugcaaaauacuugaaugggccauggugccuuguuuuuuguuguuguuguuauuuuuuucuccuuguuuguauuuaauuaaaacaaauugucaugaggaaauguuc

SEQ ID NO: 5952 - RNA, 92848 nt, Mus musculus
gaacauuuccucaugacaauuuguuuuaauuaaauacaaacaaggagaaaaaaauaacaacaacaacaaaaaacaaggcaccauggcccauucaaguauuuugcauagauguacaaauauuguaaacaaucaauaggaggacaugagaggggaggacuacuuccugugaacaaucucccaaaucaaaagaaaauucacauuugcccuggaucccagacauagacauauacagucauacaagaggauacugggugcaugacuuuggggugcuaggcucggauucuacagaaccucucccuagcaggcuucccugggacgggguaccuuuccaguugguguucccuggcuuguguguggaggauuccuucgggucuguucauuacaugcauuugacaaaauaacuagccuccaauuuuaagaauacaagucucaccuccacuuugucaaauaaggaagugaauugagcccaggggagacacugaaggauuauugcaguguugcaggggggcuauugcaacagaaggaacugucgcguuacagagaacacuccgacacuagcaucuacagugucuuggagcagggguagagaggggguauucucuuccugguggaagucaccaaggcuagaaggaacagaaagcaagcaaggaguuguaacuuggacgguauuagcccaggcuauaccucuuauagagauggagagcugagguuuacaggucaggaauggcuuugcaguucuaagguuggcaggcagcuaaucuagcuccaaaaaacauuuacagccuaggcuggaggauguagcucaguuguagaguguuuggcuauauacauaugaagggcuguguuugaacccagggccacauaaagcaugguagcacacacccgcagucuguacucaggaguucaaagaucauccuugguaaagugacuuaaaggccaaucuacgauacaugagauccugucuucauuuuuguuuuucuagaggguuuuuuuuuuccucuguguggcccuggcagucuuggaacuuccuuuuuagaccaggcuagcuucaaacucgagauucaccugccuaugcugggacuaaagauguauaccacuaaacgcagcuacaaaccuucccucagcccaccagagccuuggcuuugaccuauucuaacaucuucugacgucucucuucaguggcugggaacagaggugccuuaaacaguucuuguucuugcucacauuguaugcauaagaaaagcgcuuucauucagucuuggaugcccucacagacuugguguaggaagaccaaaguguucuguugcaacugccccuccuccucaugugguaauauucuuucaucuccuaagugacaauccugugagacaaacccuguccuugaagucuagauacaccuguaugggacccuucacaaagcagaugggaagggauuccugccugugacagccuagcuggccucuggaaacaaagccuugagugaaguuguguguagagcagcugccgacauuucuaccaaguuuaaaaaaaccccguccucuuacacuucacaguauaaugucaugggauggaggugguagcaaaguaaugaaaaagaaaaaaacagaagugauuaccaaagagcaaggaaaugggucuuuuucugauaugguucaagggacagaaaguggaggguuucuaacuuuguggugagaaucgggguggccuguagucaccggccacuugguaaagcacacaaaagagaaacugauauaggacauggacugaggccucagagagugugaagagcacggucacccugaaaaggagaaaggugcuuuccugagaucuuucuaccccaggccacgucugucauagcucccacaugucuacaaucccaaagcuuacucugggaagagauauaaggaggccucaggugguaaaggggaagucaaacgcuugccucuuccucuggaggguuccaagagcuaacaacugcuugcuguuggggcggggaggccccuagagagcccucugcagugccauuagcaccuuucuggggguggaagauggccucucagaggccaggcccagcaaauguguaagaacuguuccaaauagcggagcaccaagcaagagaagguccaccccaucccauucccaccuucucagcauuuuccaugacgaucaccucggggcagcaaccaggagagacccgaugaggugcgugauaaaacucugguugaauagaguuuggggaacccugcccagaucugguucaccauggcuguugacaucgaucuguucagagucaccaguccccccucagagcugaccacuagggcggggcugguggcccuguguauacaauacuauagccaggaugccaaacaugucagccccccucaguacaacuguggcuguccuggggaaccuuacuuagauaugagucagaaauaaggaggaggucccuuauucugcuugaggccguaaaacacaaguacaugcagagcugucggccugccugcaugucugucucucucauugccucugucucuuucacacacacacacacacacacacacacacacacacacacacacacacacacauacacgcccacucggcucaacgcucuugagauccagugcagaaaguccaguggcgaccccauauggcaggaucccgauuuguaggucaccagcauauggucaucagcaagucaggacugccauaguucaccaccaaagcaccauaggauagggaugcuggaaaaggagaaggugacacauggaacacuggggauggaugaauggauggauggauggauggauggauggauggauggggauucuaaauguccuuagugaccuuuggcauaacggcucagaggggacacagguugaccaccccaccccccugcugucuaugcuacuuacaaauaguaccugucugagucagagugacccguguaaauaugggagugggaaugugaagaaaggcaggggaggggagcauggcuuaucacaugcagccagagagccaggaacaggcaccuugaccaagccccuugggguagggauguagcaguagcuuccucagcagccugggaucccagaaggaggccaaucagugacacucgcguguguuccugccagcauaggaccaggauggguaccuucuccaagcuccgcagaggaggaccccagcucaagccuucccugagcaucgcugguagcucuuggcuagugggcugagggagaaccuuucccacccuccucgccgugcuucccuucccucccugggcuguauauugcacaggacaaacacuuaggagccauuggauaugagucccccugggccucggaggaagcaggaggcacucggguaagaagggagauucuggggaugagggacguuccagaaggcugccaaagcuucaggaugggugagaaggcgucuuucuucuggaccuuccauggcauccggagucuuccaucggaacaagaaacuucucgacacuucuagaucuuggagcuaauuauugcuccaacccucugugaucgguacucggguagcuggaaaggaaaaaaaaaaaacaaaaacaaaaaacgaugugaccucagugcuggucagugggacugugggcaaguguccucuugcucagaagucuguccccgcggcugcauuccagggccauuggcccuuguagugagagcaauuguguggccacccccaaagcuggaaacuuagccccuccccucuuccaucaaguuucaguacaucuaguucccuagugcuucaggggauacgggcuggcaaccagcuuucuugccucaccccuucugacccaacuccccagacuaagccgaggacauggcaggcagagagaagcguuaaggaaagggacauauguugacaggcuuguauaaacuaauggccuucagagcaaugucauggagcuggucccugcugcuucucuggccuuuuuaaaaauuaccuugaaccaccuugccggccaaucuuaagccuucuuaucaagagauaaggauuuacucaagguggccuaucuguucaggugccaucaaagccaccagagcuuaggcuucugugugacgcuuucauucucaaggaaauucaaaccucccuuugcucauguaagguacagccaaauagaccuccaagcgaggcuacguguucauuucugcuucuguucuagaaccuagcguggggcacgggacugccuucucagccacacacuuccucucugguccuucuggguccuucuguggacucaccuuuggaacaggcacugcuggaggccuggggggcugaggaccagaaguagggggcugaagcagggaggugccuccugaccugggaccgguccuuuggccuggcaccggauuggcugggagugccuucugagguggucgaggccuggagaaguccuggaggaagcaagaagucugacuugagggucucccuucaaaagaaaguaugccuaguaucuucugggucacagccaaaauaacuuacguaccggauuguuccauuucuaaaggacucuccuaugcgggggucuacuuuauaauguagucacaugcuaagaaaaaaauaagaccuuuuuggaaaacaaguuggcugucuauuaaaauuagagcuaugggcauggcaugauaaggcacacuuuuaauuccagcccucaggagguagaagcaggugggucugugaauucaaaacccugucccaaaauuuaaccaaaaaaaaaaaaaaaaaaaaaaagaagaagaaaaugucuuuuccuggugugaaaaaucccacuucuguuugaccauguuagagagcugcagaaggcugguuugcaaggaugucccuauguacacaugauuuauaauaccagagaacucagaaacuuccaaaauagccacggugggagaaaaguauaacuuacccagugaugugggcuacaguguguguaaagaguaaaguagggcaucugggcuaaugaggacagucagcugcgagacaagcugacauggccccgacagaggagcguguaugcaaagcagaccaccacaucccugccuauagccaauggcgaugaacagacguggguggacaugaaccaggaagacggaaugaguggugugugugugugugugugugugugugugugcgugugugugcgugugugugugugaaagagagagagagagagagagaauguguauguaugugugugguguguccaugugcaugcacauguguguguauguauguacauguggcuccccuaagccuaauuuuuaauuaguuuauuucucaucauaucuuuuaucccuauuaacauaaauaauuuaccaggcuuuuauuuccagccgggguggggcaccuuuucugucugauucauggagacauugcaggcuuuggggagcacuaagacucaggaagaagguaacucaacacuaggaacauaaacaaagagcuaaucaaacuucucagaacagacacacacuucuguacuacuuaaauauuuuaguauaaagaauuauugcugcuguuuugagucaggguuuuucuacauagccuuggcuaucuuguaacucuucauguagaucagguuggccuugaauuuacagcaauccaucuguguuggccucccaagugcugggaucaacagcauguaccaccacacuuggcuaaucguauuauuuuuaauuauguacaugugugaguuuauacccugcauguucaggagaacaugaugaggaucugcuaaaccacgccccuccaaaggcagcaaggccaacucuauccagugaguacauucacauuuguuagauguaccuucccugagcaugcgcaguuuaaggucaucguuuacaaagauaguaagagcuggcccauuucggggcaugcauggcucaaugucauggaacaggguuuaaagugguuaagcgggagugaucuggguaugcugagcuuguaccggaacauaucagaugcagucgaucccucccccucugcguggauuuguaugucucauccuggccccacacacaggcacuugcgaaggggcugcuucacagcacagaacccaacccaauacccucacuguccucacgcccuagggucugaagcugaccauggggugguugugagcagagaaacucggcccugggaaagccuuugggccauaccaagacaaagcagacacaaucaguuuuagaggccacugcccaagagauguccaugucuucacuggggaaccuauaccagaguacacacgcuaagcgaacaggccacucugucacagcuccaaguugugaguaccagcuacacagaaggggacaguccagacccaucaccucccagagacucccucaggcaagcgaggcaucguggugcacccuucaguaagacccuuggugaguggaagcuaacuaguagauacacuuuguggggcugaauacgaugggagaagcacagggcacuaagaucagccuuacuaggugagagaaaccccucaggaggaguguuaucuaaagucacaauugacggugaauaggaacaggccaggcagaggcaggggugugugugugugugugugugugugugugugguguguuuggggaaaaacagcaucugcauugaccugaagaggaccagcucucggggaaccgaaagaaguuaauuugggguacaaaguguguggaaaucaaauaggagaaaagcaucacuuuaguggcuuagggaugauggugaugaugguggugaugaugaugauggugaugaugaacaguagcagcagcagcagcagcaauaaaaguauuuugguuuuucaagauaggguuucuuuguguagccuuagcuguccuggaacuagcuguguagaauaugcuggccuugaauguagagauuugccugccucuacuccugaaugcugggauuaaagguguguacugcuaccaccuggcugggaagguuuauugcuaaaccucuggaagcccauuggauuuaccagaacaaagaaaggaugaucagauccaaucagugcaucacaucaacgcccccucauugcugauggccugcuaugggcgauguccccagccuaggguuggcgagaauccacuuaccugggacaguaggcaguuaggugcagggggcaugggucggcuugggggaggccuccuggcugacuccuuucuuucuauucgagccccagcuucuggggagcucccagcagcccuguucagaugugccggcaauggugcagguggcgauucaacgcgcagguagucuggagggggccggggaggggggugggacggcuuccggagggauucagggguguuagucaccuauaugaaggagacacagagcagcugagauaaggaauccucccuaagugugugucucaaugaggugacuuucagacaugcugaccuuuggauuccaggcuucagaaccaacuucaagccccaaagauagcuuucauuaccaaccccgugggcacacauaaguaccgaagaaagccgaacagggaucucaagggaacucagucaaguucaauggugcaaagcccuuaccuuucgcuugcccuggggggucugcaacuugaaaguuggguuggcauggccaguuccaccacucugagauacccugaagggacaacuggaaacaaggaagaggggacaugggggaaggaguguucagugguguguguggacuaagcaaauccgacccaggccagcggacaaaucuaacccuccucugaagaaagcgggauaauccucuaaaacccaucuccugaauaauagauaagcgcacacacggccaguggagaagcccaagggagggcuucugccuugcacaagcagaccccuccaucccaauuaggagacagaauaucacuaaccaccauguaccccgacccccacuggcauggauaacagaaggaugcgggauccccaugcaaguacauuuaacaaacucuagagagcaugcuccaucaauaucucaaugaauuaaucauucgucuucuugggcuaaugucuaguuaucucugugacugauugagcuugucaucccucucugucgccccagcuuccugcacuuuaaaaacaagauaaguuaaucagguaggggacgguaaauagauuuuaugucauaccccaguuugaaccggcuaagggcuuucuauugggaagaauucaaguuaauggccaggcucaguagaaaucacuuacagucauuaucuacuaaugucugucauggugacugagaggacagaaggguugaggguggcauguucccugccuucaucaucccagaauuagacccauaaccaccaaccuuuccacaagggcuaggcacagcacccugucccaccugaacugaugccgcagcuugaaagggagagccgaggguuugcccaguuuguggcucugucuguagcagugacacaguagcaccagaacugccaacacgaagagagcugaaaacaccccagcgaucacgggacccacaccugccggaagucagcacaagugagagaauuagaggcugaucaggcuacaguaaaaugacagagccuuuguuccgcuccagguauuugauucccgccgacuuaguuuaaacaagcacaaauacaugcaacgcacaucauacucuauugguguccuaauacuagcugaaagagccaggcccacccaugggcuuuuaaagacaguccccauguccagcugccucagagauucuucccaaagcaguucauggacuuucauaaagucagccagcaccacgauuuuccuggacacagagcaauggccagaaaauacugguugagacauuuuaggacuagaacucucacccugggcccucagccucacgguuggguccaaagcccaucucaacaguucccgagucauaaauguaaaugcacacagugugccugcaucacugaagcuccucuugcucuguucauggucauugcauagucaggcucuuccuucuugucuguuuucauuuuguuacagcccagacuggccucaaaguugcagcagcaauucuccugccucagccuccuaaaugcugggauuacagguaggaacuaccacacccaguuuuuagccuuuuuuuuuuaaaguacuuuugccauuauucaaagacacaaucuggaaaccacaggggucaaguccccgagaccaccccuaagaacuguaaaacuugccuguuuucccauuucuuaaccuuauuuaacaaaagguaaaauaaccaauacaaugcaccccaagauuguaauuauuucaagugucccuaaaaggacuaauuacuaguuacuaccuccaaauaauugugacuauccaguggccucagucucccuuaauaucuaccccugccccucucuccucuaguaaaaggacaggaaggugacuaagcccaggccccauaggaagaccuggcauccucccacucagcgucuuuaucuuggcucccucccuguagaaucuggagagugaagccagcuuaccuuggacuuucugcaacgggcaaacccagccuauggcccacaauccccaugaauagcuaugaaugcagcccaacagguuuguagacaacgaugccauauugcaaagucaaaagacuagaggcuccugccaaccuaccccuuauccccacggucuccuccuccucucucacaaagcagaacacuuacucuuagggggcaaaggaccacugucgacgcugccaccaucucccgggguguuacagaaagguggagaccagccagggaagcaaugacaguucuuguuguuguugcagaccuagagugaggggccgcagacgcaucagcacccaggagagcugugaccucccacagggcaacacccaggaacccagaccucugcauacacacacguaccccguggccauugcacuuuuucccacagccuuccgucucaaagaaggagguguuccugcacugccccucgaagcaaaucugcaacauagaagggcagccaucagcgggacacaggggcaugggggaggcuuagggugugggagguuuguccuuaggaugaaugggaaccccaaaacauagcugggggcuauauaucuagugagaaaugcaaaaggccucaaaaaagauucaguggguaacugaacucugcuguugucuuugugauuagggaaggagcagcaaacauuacugaaaugguacauucaacaacuaggacacguuuauagucuagcgucaugcugacuauauuccauccagcaaugaauauggacuaaguuuaggaugaugccuaaaaaucaugauuguggcaggagcuuacuuucagcugggcaucguaccauagguuuccucuguguuuauaauuuaacacaauuuaaagcaugggguugguggcguuauuuuccuugggucucccugaaaucuuagaccuuuccuuucuuucuuucuuucuuucuuucuuucuuucuuucuuucuuucuuucuuucuuucuuucuuucuuucuucuccuccuccuccuccuccuccuucuccucuuccuuuuuuucuuuuuuugagacaggguuucucuguguagcccuggcuguccuggaacucacucuguagaccaggcuggccucgaacucagaaauucgccugccucugccucccaagugcuaggauuaaaggugugcgccaccacgcccagccuuagaccauuucuaugaggauaguaaaugacaugcaugacagugaugccugcguuuacaugacuagguccauagucauaggugggaugcuguuauucugagagcugggcaucacuccuccggagcccacacuucucagucucugccucugccucugccucuugguuucugagugagguuagggagggacucacaugguuguggccacacuugguuccagucaucaccagcccuggguccagcaugucaccuuccccuuccuccuccucaggaccccgguagacgugggugccccgacaguggauccgccucccguucaaggugaugguggugucaauagauacugcguuggauuccaggggccgggccugggugcucuggcacugaaucuucccacacuuggcaucccugggccaggaaagaagacaggaucagagacuggggaagagcggggacauuggagagcuucagucugagccaagucaguaggcuucgguggagcagggcaaaggaccagagagugggcuggaacccggcaguagagaccaaagguagacucagacccagaaaaggggcagguuccuugugucucagcagaccuaagccaagagcucaacuuaggauguccuaaccacaaggacaccugaaugacaugaauaauuggucaucuuugucccaaauccauuccccaggcacuccaaacuaggagcuaggucucccucugccuccccauucuucauuguucccaaguuugagcauuuucaaucccugucaaucuucccuccuacacagcuucccugacuuacauucuuauccccccuuuuuaaaaagacuuauuuauaauuauauguaaguacacuguaacugucuuuagacacaucagaagagggcaucagaucucauuacagaugguugugagccaccaugugguugcugggauuuaacuucaaaagagcaguuagugcucuuaucugcugagccaucucaccagcccgugugugugaguguguguguguguguguguguguguguguguguguguguauguauguauguauguauguaugaauguguguguauguauauauauuacauauacauauacauauacauauauauauauuacucccuuucuauccuggccuauaagacacagagcccccucacugcagcauccaugggagggguccagaucauccagagaugccuuuauaucucucaggaucuaguuccugcuuuccucugcccaggcucauuuuucuugccacccccgcccaugucuucccacaaauuguagcuugcucucuaucaguucgucaauugcuccuuuuucucuaauaucucagccuaaaacacuguuuuacacacuagugcaacuccucccccauucauuuagauggcugcucuagaacucagcuagagaacaccuugggaagaugcuccaggccguuaacuguuacaccaguuaaccacauugcucuagacacucaauucagcaccuugcauguggugaaucugaaacaguagugggcagaggagugaguggguggcuggaaugaaugaaucagagauggcucucaggagcaggcauaacuuuagcacucugcaaaaaugguccaaaaaagagccgucugggauccacaacauuuagaugcuggaacauugucaucucagaucagucaucuccugccucacuuuaaaaagaaaaaagacaggauuucucuaaguaacaguccuggcuauucugacacuugcuuuguagaccaggcuggucucaaacugaccgagauccgcaugaucaccugccucugacuccccggugccgggauaaaggcauguccaacuaccuuguccugcacuuauaggccagagacuccaaagcagccuugaucagcuuccuaggaagcaaugcugcccacuccucuuuuucacuuccuuagagccaaccaaacagugagugcaucaccaagcaauagguagagaacagagagaggcuuaaacugguguguuuaaaagccaauaguaggcuauccacaccaagucaggugggaaugaagaggucagagcagggaucgauuggccacucuuccucccaccgggucagagcugugguccucaccugggacugcacuuccuguauuggccauucaagcccuugccacaguuuccauaggugucaccagcagcauucacccucucaaagcaaagaucgagggcaggccgggcuccuagguaugcaagaaacauuugucagugcauaagcccgccagcggcuccccgugacagagccagcuaggcuugggcaacggcaugcaugacacuuccaccauccaucaaggccaauucagagaaaauauuuuuagccugguuuuuaacccuucauugaagauuuguaucuauggcagcugcaugcuaagccugcuagcuaaugaagaagagcuauccuauuucuggaccguaaaagauuaguaauucaugccccaaacauuaaaagagcuaaaauagaucuuuggaguuuuuccuucacauccaccuuguuuucccucuuauaucauggaaaagcaacaaucuuuagcagugugucuuuuagagaagaaaaugucuucucuaccuuuugcaucccuuagauuugaucuuggggcaucuucuugaaagaacgcagugaaggacggaagcaucgucucuucucuuucugcucugcccuuugggguuuuaguuugucggauacagaauucagccucagggcauucaguugucugacuuaaggaugcugccgcuacaauuugcaacaguguaacaacaucuuacaaagcaucuuuacauccauaagcaaauacaacccgagguuguuucuaaguaguguacugcccagcuucugaaaacggaggcagauagaaucccacaccugaauggggauggagcucaaaaaaaaacuggcaacacuaaagagauucuaaaugugcaaugacccaaaacuaacugaaaacagaaugugucaugaauucagaguucacccaugccaagugucacgugacuuuacuacagcuuggcuuucaacacagaugcacacaacaaaugaaugcuacugagacaagcucagacuugaggcuacuuuauauuaugacugguuauauuuuuguuguauguauguugucucuuaugcaauggauucauuaaagaaaacaaaaaauguuuucccuacugucauuccucagcagauaaacuucagauuaauguuaauauuauguuagaaaguuugauuuauaaaauugcuguuugcguuccugacuucaguuccauuaaaacaaacaaaacaacaacaacaacaacaaaacacuagcugaguguggugccugccuuuaauccuagcacuagagaggaagaggcagguagaucucuaggaguugcaagccagccuggauuacguaguaaguuucaggcaagcaggccacacacacugucucaaaaaauaaagucccugucccugucccugucucaaaaaaauaaagauaaaagucacugaacgaaucaugauuuggugucagauuagaauuuccaaccauuucugguaaggcccuaaacauacuucuaucacuuuuacaccacauaucgauguggguugguguucccaucccugacaacuauaaaaucagccaacucugaaaacuguuucagacccucuauguccugcacuuucaaccauuuagccaagacuuaauucucuauguaaaaaaaaaaaaaaaaaaaaaaccaaacaaacacaccgauuugucaaaguauacauuugcuuugguaaaauuauauaugaaagauuauuuuaaaauaaauuuccuugugauuuauuaucaauaaauguuugcuguauauaccuacuuuuauauacucacaaauuguuccaugccauguaaaaacuucucagaaaaaaaaaaaggguaaguggaaaacaauuuaagccuaauguaauuaauggaacugguaaauacauuaaaauuuuugcuaucucuaaaaugcuuucuacauuggucuuuccauacuggcugguuuugugugucaaaaccacaugcuggaguuaucacagagaaaggagccucccuugaggaaaugccuccaugagauccagcuguaagacauuuucucaaguaaugaucaaggaugggagggcccauuguggguggugccaucccugggcuggugguccuggguucuauaaggaagcaggcugagcaagccaggggaagcaagucaguaagaaauaucccuccauggccucuguaucagcuccugccuccagguuccugcccugugugaguucacguccugacuuccuuuggugaugaacagcaguauggaaguguaagcugaauaaacccuuuccuccccaacuuucuucuuggucaugauguuuugugcaguaauacaaacccugacuaagacauacccuccaugcuaauauauuaggaugguuguuguuauuacuauaucacugcugucuuugagaucugauccaugaaaaaaccccacuugaugguaguuucaauuugcuuucucucaauaugacugaagcuaaacauuuuuuguagcuuaagggucuuuuucauuuucuuuuauucuccauuucugcuucauugguguguuggggagggaguacuauuaacugucuguccaguguuagaacuaaaagcuucaagggaauaugagaaauacugucacucuugagcuaagagcaugagaugugguauuugaagguguucuaggccaagcuaaagggccagcggggagacaggcucagagguggugggcggaagagaccaugcucuccauccaggagggcucuuaccagguccccacagcugcuggcacuguuccugguaagugaggcacaugccguuguagcaguaggccuggccacccucgcagggggugccauccaucugauaauaguugguggggcaguggggagacuugccggugcagaacucggggaggucacauugccgaaccugcucccgacacuggguuccaggagccaccagcuagguagaggaaugagaagagaagaguagucauuucuucccugcccccaacccuuucagccaagagcucaugaacauccuaucuguggaaaacaguuuugacgaccuuguuaucaccgcacuuaucacacgacuucaaugagcucaagccaucgucggccuucgcauaaacagugacugaguuccuucaaacuuguacccacauggaccaacucaacgcaauuccuucccacagcaguugagaaauaauguuucucuaacaaucuauaguuuucucucugccauuacaaccaucuuucacuuaagugucacuacgacuuuauuaguuugcauuauagucuuauauaacuaaaggagcaagacauaauauauucaaagucacgugguauguggcagaccaguuuccugauaaggguacaugccuacaugcauacaugcauauacccacacacagaaaauuggcauucauguagauuuucaauuuacaacauuacugcuuuguucauguaaguuuacaacuucuugguuuguucuugaaacuagccucaaacccauuauuuaacacagacuggccuugaacucagggcaauccuccuggcuaagccucuggaauagcagaacuguagacaugucucacuacauccagcuuguggcucuaaacagcacacccucagugguaugcagagcauggggcugacuguuauccaaauacuucucucaucugccccucacaauguccaugaaacugauauagcuacuuuauaucagcauuucugaugcucaugcggguguguagacagagcugagacuccggcaguuuaaaaauuccccaaguucacacagguagcgcuuuaagucaaggaauccuuugagaggcucagucugaaauccuggaguugagugaaaggucacuccgugcuuauucuccagccuuggucugagacuugaagaacucaacucagcauagccucccugggggcuuccaugucaaaacagaagguguccaaguucuacugagccaaguccuacugugcguuugaccuuugguucuuguuugcccaugauuccagaucccagcccucucucuggcugcuaagagcaagcaugcucaguaggguacuugaacaacacgugagcacugugugcgcucgccaagcugagggugggacaggccacagcuccauacucaaacuucucuaguacucagaguuucagguuaauaacucaaaaguucaaauaucauaauagugugugcaucuaacaaaucuauaugaauaugauagauguguauaauuauaaaaauauauacuacauaaccuuuaacaaggcucaggauaagcuuuauaaccaaaaauauuaauauaugguauauuaugaugaaauaaaguuauuuuagguaaucuuuuuauaaaaacuauaauuagucugauauccauuuaggucagauuuuaucaccaaaucuguuaauuuuuuuauuuauauauuuugggacuuccugacuugucagauuuggauuaagaaguucucaagccaggcgugguggcgcaugccuuuaaucccagcacucgggaggcagaggcagguagauuucugaguucgaggccagccuggucuagaaagugagucccaggacagccagggcuacacagagaaacccugucucgaaaccccaccccccaaaaaagaaguucucaaauucagugcuauaugacuauuaaugguaauagauuauuuuccgcauugauauuaagaaugcaugcuucagagucagggagaacuuggguucagguccugacaccacccaucuccuaaugacccauuuuccucaccuuaaaacagaggcaguaauguguaccccauggggcuguggggaagacugagucaguuagcauauaaaauucuccuccuggugcccgacauccaccacgauggccauuuauguucaucagaaucaggguuugcuuuuucauguguucaaggaaaaaugaagucucacugggccuggugccuuagaucucuccugggagaugaugucagcacuugccuggacuccagagcaaguucaaagccacccugagcaauuuagugaggucuugucucaaaauaaaagaauauacauacauauacauauauucacacacacauauauauacacaugcauauauauauacacauacauauaaaaucaaaauaaagauauauguacauauaucuacaaaugcacauauauauguauguauauagcccuauaucagauauaucaacuauuuaaauaaaaagauauauacacaguuauauguguauauaucuuuauuuugauuuuauacguacauacauauguauauuuuuauuuauauuucugcuuauauauuuauauauauauuagugacauauuuauauauucauaucuuaauauaggauauauauguguauauguauuuauauguauaugaggugauuugagcauaaugaggcccaggauagaaaauugguaggcuuaguuaaagggacauucucaguuccaaauaucuaacacacacccacccuuucucccuucucuuccucccagugaugggguugaauccagagcccugagcaugaaagcauggauucuuaccacaaguggccagugauaagaaccacccuccccggcccugugucugaaauuuuugaugcaggcugaaacccagccgccacccacuaggcugucaccucaaagccugaggcagaggaaaggagacacuuaccuugcacugguggcagcaggaaccaugggcacacucugccccuuccuucagagugcaguuggaggcauugcagcaaggguucuuacauuccuacaaaggcagcagaagggcaagagucagagcccagcagggggcgcccuugccaccuccauuccccggccugccuggcgcgcucugcuucccguucccuagagcaucacuugcacuucuuuacuaagguaaugaguaucuguaagagaaaagacacaagugcuccauccucggagacaccacaauguaaaugggacuacguggugauuucgaguagguauuaucccauacuuauguggucauacugagcuugcaaaguccaccaugcccgucacccuucaaaggacucucccuaugcugaaaggccagggcugacccucacuuuuaguucauuggucuuucacuaguucuuuuauucugaaaauuacaggguuagaguuuuaaaagaaggucacaacauggcucagugggugaaggcacuuggugccaagccugacagcccgaguuuggucccugaaugccagguggugaaguuggagagggggaacauacgcacacaaacacacaugaaauacgugcaaaauaaaaacaagagggcaucucgacauggagaguaauauggcuaccucagucccauagcuacacacugcuuacuuacaguucacuaacugucaagcauggguuaacauacuuucugaucuucaaaaaauagacacgaaacaauauaguucugcuuuccuucuucuucuucuucuucuuuuucagaaaaacauccuucuaauaaagaugacagagcuagggugugcgcucuccacacucgcucugaagcccugauaggaggagaggacuauccaccaagaguucugcuucuccuuucucggcagaucuccccugaccugacaguacuuccaacacucccuucaaaucuucucuucuccgggcuggacagcacgagcuuggguuagggcuccucaccaggcucauggucaugagcucauccagcuguguggccuccagaaauaaauucagugcagcuggagggccaaagacgccaucuggggcuccucuggggaggaggagagagagcuacgugcccugggaucauggucuguggcuagagcagcugcucaaaggggcuccacccugauccuggauaggacuguccugaccacagcugcagaggccaucgaaacgguccaccuggcagacucacugucugccucugacacacagagggccuucgguagucauguguaagaagugcuggcaacugggaaaaaucugucccuuuguccuuuccauaggaaggaccgcauuguccuuuugauaggaacuuaucugucacauugugcuuucaaauguccuuaagcucugaagacaauacagauucgucccucucucuaguaagguccugacacuuaccuccucuucuccacagucacauucuucaccgucuuccagguacccguugccacaccuccggccuccauacagcguccuaguguccggcauguuggagagacacaucccuccuccugucugcagauaccuguccagcuccuuccuguuacaccaacugaacacuuuggggaaagggugccugacagagaagaaggaggcguuagcggagcugaagcacaccgacagcuugcuguccugccugccacucaagaggcuuaguucacuuggaugaaaacccuacacacgcccucugccucaccaggacauucaucaguacaccaacuuagaauucuuucacccugaaccaugagaugaugaauaggccacaccguuauguuuuucuuaaaaaugaaaaaggcaguugagaaacagaacagucauuucugucuuuucagugaggaagcugagguagguaaagggugagagguacauuaagacagguuucccaccaaccaaagaguacacauggaaggacccauggcuccagcugcauguguagcagcggauggcuugugggacaucaaugggaggagaagcccuugguucugugaaggcuugaugccccaguguaggggaaugccaggacagggaagugggaguggguagguuggugagcagggggaggggggaaagaggauaacauuugaaauguaaauaaagaaaaugucuaauuuuaaaaaaugaaaaaaaaaagacagguuuucauacugaaagcugaacacaucagauggguauuuaucuucucaugacaaaaaacagaaccagaaagcccaagaccacagauuuaauucacucaggggcugaucucuguuuucauagccaacucuacugcccaacacccaaaugugugggcuuuaucacgguaguauguacgaaagcuccagucgccugcaccuauggaaacgaaaagugcagccgguuccuuauucguagcugccagcccugguuuugguuaccccuagucaacagagaucugaaacuauugaguugaaacauucaaaacggaccaauauauuuuuauuaucaucaucacuauuucaaaugcucuaguuuauuaugaguugguguuuuuaaccucugacugugccugcuuuauacauuaaacucaucauagaucacagauguauguaggaaaaccacagagaaauaccucacaagauguaaauaugggaaaacuucuauaucacaacaugggucuguaaagagacccugguaaagcccugcccuuaagucucuaaaacaacgaaagguuaaacauugagggcuucuuucaguacuacaguagguccccaaggacuuugcuacuaaccauucagcuaugacagugugugaauaacuuaaaaaacagcuagaguagucaugaauuuagcugucgcccauuugucuacacacacucuauugggauuggcugagaaaggggugggcuuaaccaugaacucaaacucaaaaguuaugccgcaugucauaucccgcaugucacugccauccuuuggagucacgguagucaggaaguagcgagcaaacacuagcacuaugaacgagaaggcugcauugaaccaccauucucugggaagcacaagcaaacccuagugguuuggaaugaagggguguaauaaggauccuacuacauugccuuccagggaguggcucaaguccugaagaauggcaugauguaugcauucaggaacaagauaacccucuuccaaaagcucugguuuagacaauccuuguaaguguuggagucucaguaccuuuguuucauggaauuccuuaagagugacuggauggccccuuucuccuuuuacucuauaaacuacaaagcucccgaagaggcaagaccaaggguugugguugaacugggcauaugggugugguagcacauacuuaaagccccaaagacuuuaguaguugacgugggagaguugcuuaaauucacaaguucaagauuugacugagcaagacucucacaggugaugucaaaaacaaaaacaaaacaaacaaaacacguugaagccaguuuuagagcugaaaauuacaaacuauucgucaauccagaccaccugcucucugaggaacuuagcgucccacaacacaucugcucgcuucuguuucaucuaaacaucauuuaaacugccuucaucaacagcuugaaaguuucccuggggccaucuaggccaucugacccugcaccucucagcucacucuucuccccaccggcacccuucagguugacucacccgguggcggcggccaugaugcagccgccaucggcugcacuggcagaacagcagugugcagaaucauggcucaugccaaaguuguggccaaucucaugggccacaguggaggcuacaccaauggcauucucggagugguccuguucagagaauuucaaauucaaggucaggggguucuuucugcuuugcauguccuuuucuuuucuuuccuuccucuuucuuucuuucucucucucucuuuuuuuuuuuugcuuuauuucugaguagcccuggcuauccuggaacucacucuguagaccaggcugaccucaaacucagagauccaccugccccugccuccugagugcugggauuaaaggcgugcaucaccaccaccuggccugcaugacuuuuucuuaucugagccugacagcgcuccauugaucuccccuaacgcugagcauauuggcucuucauaccuugcuuauaacaaaucuaaagccacuugucuucauuugaaaagcaaaugcucaaaagacugcuaccuguguucuuaaaagaugcagaccacgaaugaccuguggaugcaucucucggaugcaucaccuugaauugagcaacagagacacuugacuggcugcuuucugagagcaccccugcagaaagggccaccccagacaaaacugguacagugugugguccucaucagcagaacaaauagggcuggugcagcgauguaaaccuagagccccagccaacugagaggcugaagcaggagggucuuuugagcccagauguuugagacuacccugggcaacauagugagacccauuccccaaaaccaaacaguagaacaaaagcagcaaaauggauguuuauaccaggcaugguugugcaugccuuuaauacuagcucucaggaggcagagauaggaggaucucuguuaaaggcuagccuggucuaugggugaguucugagauagucagugcuuuguagugagacccugucuccaaaaaacaacaaaaaguguauguguauauauauauauauauauauauauauauauauuccuuuuauuaucucacuuaauguuuacucuuacccuaagaucauaagccaugaucuuuacaacuaaagacacacauuaacuccaaagucgcauggcugcucuuugaaaccaauuugacucuagaaucugggguuuaacguucaugcuaccuugucaauaaaaauacaugauggguagagggauaaaauaacaaaugagcagagagacgaggcuuccuuuauaucucguccagguuagaagagacaagccaaaauccaggggcuagggauguagcuguagaguacuggaggagcaugcgugaagacuuggguuugaucccagcaccacaucgaacuugguauguuagccaacacuugucgucccagcacucaagagauggaaucaggaagaacagaacccuaaggucauuuugagcuagauagcaagccggaggcuagcccggucuauacaaugaguuccaggccaucaacagcuucauagccaaaaaaaaaaaaaaaaacccuacucuugccaagucagaauuucaaaagagggcaauuuccuaacuuugacucuugagacaggaucucauuucacaaugcgguaccuaaggacucaagacccagaugagaaacacuucuaucucuguucacuccccugcccucagcuccugcucugccuccuccuccagcccgcuauggaauaauacacaaccgaucuggagggccauuuuuaccacugcuuacaaaugaacacaaagaugaaugaaauuuuaccccuggcuacuauccuuugaaccuaagaauuucaucugacacauuugcucucuuuaaugcuuuuuucuucugugacuauaaauaucaaaucggcuuuucaaagcugacuuccucucuugggagccauuguccccuugcgcaacaucauugucuugucugagacccaccaugcuaacuccuccagacugguacacggagcacauggccaugaggggggccaggccaaugguggugccuuggaaggaccugccccugcaggaagaaaaaagacauguaauucaggugggggcugagagaacuguuccccaggggcaggagugaauggcuaccaugaugugcaccgauccccugaccuucccagauuagucccaagaggacaagccuguuaacccagccaacuggauuucuuucaggauaccacaccucucaccuccucucacuuccucucauaguagcaaaaaaaggucacuuucccccucagaaagugcccaaagucuccaaaaggaaaaaggcagggcuugaaaagcugugccccaucccugauucauagaaaacggccagacacaggggucacagggaagggugugguccaggcugugaugcccaagugaaucauguccauuuccgccaguggccagcagcucaggucuuaccaucaguggcaugugucuugggggcaaaagcaaggaugcuggaugcagcugcggggcugaggcugugauccacacaucacacaaggaccaagaaaguagcugagucccuuugggagccucacaaacugcagcugggugcagggcuaagcuguuuccaucucugcuccaaaaugauggcccuaaccugucaacagccaguuucuuccaguuuaaccuaucccuucuccaucucauccacccagaguaggcgaggagaauaaauggauguuugauaaauguuugcuuaauaaauucaauauaugccgaucugaguguaugaagcccugcuuggcauuucggagacuugcacuuagcucugggaagcuuuacuaccauaaacagauucaaaguguccaauccaaaagugcaggccaaauguuucagcaaacaaagacuuucucagugaguggauuguccucaagugaccacuaagagucuagguuuuagggacagguaaauauuggaaaucgcaguuauuaugaaaggguaaaucaagguaucaaggaugaaauaauuacugacucgccuauguuauaaauaaauaaauaaauaaauacaaacaaguaaaggaguuuaucaucucugugccuuuguugagcacgaagguccuacagucuaccauuuugaccuucccaggacuucagcccugagaccccagagaacggugugaaggacuugaagacccauuuccuguauccugcagugggaggucaacugacugugcucaagaaugccuguuucaggcuagcaacugugaccaagagucaucugcucauuccccuaauauucacucccaagugccucagcugcucagcugauuacgggugaggcuaauugccucacguggaacucugcagaggacuguuaucauucuuaggcuuuuuaacauucuuucaagauguguugagucugaaaaagccugguuauguggcccagggagcaggguggggucuugcacaaccaacauuggccccugugaaaggaagggugaauuucgcaccccuuacggcaggcagggguucugcagacaaagcugauaccacaagaccagaaaagggcugcuuacgugauuagcugagcauugucauggcucuucugagcaagcagcuugcgccuccaacuaagaaaggaccagaggguagaguagggauucucugaaacuucacacuuauccccaugcguccacaccuccaagccgacaagugcaauucggauguucagggagcgguaaaacugaaaagacaccaaaaggccaguuucucucaccauccgaccuaggagcucagagcacagaugcugagauugcucucuggcucuagaaaucgggaaauacgaccuucagagggaugcauucugguggucaaacuggaguaucuggcuuagaaaacagguuaaaaaaaaaaguagagggaacaacacccuaaccaucaagggguucuuugguggaccugaccaaugcuaccgugucaguguugcauguacaugugaccugugugugcacauaauacauguacaugugucuucugugugugcauauacacacgaagucccaagguucauguuaccuuccuccguuuauucuccauguuauuuuuucagacagggucucucacuaaaucaggaacuaacugauuaacccuaacugguuggcuugagagguccaaggauggccugucucuguccccugccucccccaccagccacauggcuauagguucaugacaccaugccuggcuuuuagaugggugguggggcuuagguccuuauguacccagcagauacuuuacauacugcgucaucuccccagcccaugagugacuuaaaaaaaaaaaaaaaaaaaaaaaaccacauaacacagaagccacaaagggauuagaucaccccaaucuaaaaaugguggguuccuucccagcuaaaauuaauaacugguggucccgcuguucaucaagcacuugucaugaagaaggaaggguacugaggcuuagaggaguugagacauugcccaaaaucucagcagaaacacucuggagccaagaugaaccagauuauacucccagggcccuugugaccaucugcugcugaagagcugggaucauauaauauguauauaacaauaaaguacacacacacacacacacacacacacacacacgcgcacgcacacauucgcauccuucucuugcccccaggaaacugcagucuagaugggcuccugguuccucugucuuugccacaucuaucaucacagaaaaacccgaagcaucugaauuugcuucacucaggaacuuuuuaagggaagucaacuuggcuuuucuuacgccucagagaaaacagggcccguggauugggccccugauucagcaaauguguagaguucuuccaguuuuagcucuaaaauguucaguccaaguaacuggcucagcagacuuaggaggagcccaugugccucacccuaaaccacgcgugccggagggaaguugggggcuuggaugaccauccacaaggcacaggguuuccaccgacacccggggugugcggcuacccucuuuucccuccgcaucuuugcuuuuucuguaguuauuauuguuuauuuguuugauguguuuacugacauaccacuuccauuucucaucagugcuuagagguaggcucuaaucacccagugcaggaagaaaauuccuagagccagccagccaagcccugcaccuccccugagucgggucugggacaaugguugcuacacagguggcgguaggaucagcuuccuguauccccagggaaaacacacuucuccagauguuggguguuugguuacaggaucgcugagacgcuauugcuggugaguuaggagcuggacacaggacucuacugugucccuagaauccuucccuccaggaaaggcuaguguuuggcuuucaccuguuacauaccaguggccucuuuccacagcuguugagggcagagaaaaaaaaauacaaggcugugaacuuuucaucuaguaauuccacagcaaucaacucugccuuuuaagcccugaaaguuuaauuuuuaacauuuguuuguuuguuuguuuaugguuuuuagagacaagguuucucuguguagcccuggcuauucuggaaacucacuuuguagagcaggcuggccuugagcucagagaccugccucugccuccccagugcugggauuaaagguauguaucaccaccgcccaguuugaaaguuucuaauuucuauuuguuaucggaugaaccaucucuccagccugagaucuaggauccgugaaccucucgcuggccaagaaagccuucaaaguucuacagguccugaagugguuaucagagucucaaagagacaagagaccccagggcugggacugucagccacuggcaaacaugcaaccuuaguucuacccaccaggacugccccuuaaaaggaggcacaugaccaaacacgucaaagcuuugcuuguggagaggagcugccauugcaaaguuuuguucucugccuuuugugcuagaacuugcuuucgcauagaauacuucacggucugagaauaccccaugagugcagcucaaacuucugugaauuuccuaagugcaugguugaaacaacccgacugaagaaguauaacuauucguagucucccuagaaacaucccgauccacuucaacaucuaagucaaagaauccccgggcuuucacccagagggaacacauccuugaugccuuuuaaacugggcucucccuugcucagugugccucaaaacccacuucauuugugagaaaggucagggggucagagccaggcgcaugucuguuuccagccaucugcuuccaugugacuuuuacaugggcaggggcacaagaugucauuuuugaaacaugauuuccaucagaaaacuauaaacauaacugaaagccacugacuuaagccagugcuuguaguuuauaaauuaaaacagagaaaaacaaaaggcccccaaacacucacacaaaccaacaaaagacaaaaaccugacccaagaagcugaguuguuugccucugguugauagcucagggucccaaaucagcaacaagagcucaggugugugugacuucuugcccugcagacugucugaggugcagcaaucucccccagaaaguacacaccuggucucaccuuaucaacauaguuggcaaucuccaugagcuugcguuugguggcauccuggucaugucgauucuucugaaacuaaacaggacaaacagaaccaggugagacagaccccuccacagcucucacccaagggucuuccgugugcagucauuuuucaguaauagcccuucccauggcucucagcaggaagaaccugagugagaucuaucuuggcuaccuccaucucccagggcaaggaagcaaccagagcagaugugauuaucuucuuccagccccuucagguaguuauuuuccugacuuuauauuacaaugcuuccgguuagcucacugaucaaucagaggagggaauggucucuuugcuuugcucaucaacccaauaggaagccaccaucacacaucuuauaaggcuuucuccuacauguggucaguugucacugaucuaaugguugcuaaacugcucuauggacaagcuguggugcuuagcacaaaaggggcauauggaugucaggucuugaugacacccuacaagagcuucagucacaguggagggagagccagaaauaaccauaacaacaaauccucuacuuaagaaagaaggacacaauuuaaaagagcuaagaagccgggugugguggcgcacgccuuuaaucccagcacucgggaggcagaggcaggcggauuucugaguucgaggccagccuggucuacaaagugaguuccaggacagucagggcuacacagagaaacccugucucgaaaaaccaaaccaaaaaaaaaaaaaaaaagagcuaagaaacucacugagaaccuacacggacuaacugcaguggggggggggcaugcaaaugucacauagggggugcugccaacagggccauguggcaucaacaugguuuugccuuccacaugauuccaagaggcagugccuucuuuggugagaaagacucuuugacuucaucaucacugugaaaucagacaucgauaauggggcauaggagagaagagugugcugaacuugauuagaaugucugccuaaagccccauuaggaggcuuuguauuaccacuucugucugaaaaggacagaccucuuucaccuucaauaaugaaguagggaaauugucaggaugggaagacgaaaagauuuuagaacuguaaccucccccugcccuaaaggauagacaugcccugugugcugucauuuugacccagaaucuggauagcuagugaagguauuguuagguggguauuccuuauucaagccguuacagguuuccuccuccagcucuuccagaauacccaaaugaggugcccuagaguauugguuuggcaagggcugacucccagcucugguacaccacuuccucccucuuguauuaauucugcaacaguccuugacuucuuuggaacugacacucaccagaaaagaacuccuuugcuacccuuaucuccuacagagguaaauucuagaacccuguugcauagaccuuugcaaacuguuuaaucuagaaguuucuauuaccaagaccuccugacuucuaaacuaguccuguggcaagagucuuuccacuuauuuaguaaacauuuauuacugcauugggaagagauuucuggcuuccaaauauauuaauccuauccucaaacaguaaggcccagugaggccaccauaguugaaacagugugucauguuuuccagaagacucugaagcaggaguugguaagcuuauucuacaaagcgcuacugaguaaacaugaugaggcuugguagaccacaugaucguagaccacagcugcucaguucugccuugguggagcacagcuacccaguucuccuugguugcuuagaagcuuccaggauaccauaaaucaaaugguauggcccugcuccagaauaauacucauaggaacaugugauagguucacaugggcuguaguuuacaaccuccagucuuaaaaaauaugugcuucaguguuacccuuucugaggcaaccccggucauauaacacgguaggccagccuuucccagauaucuuacauccugcugguaccaccaaaguucuuuacagcccuaugucuaaacccauucuuuccccucccccaacguaagccccccucuuugcucccauugcauucuauuucacuuaauaaaugagggaaugugccaggauccacccaagcagcucucucacacgccuccuugccuacagaauggacaugcugagaaucaucccagaagcucccaccucgaucuuggcccaggcagagagccacugcuugcuugcuugcuugcuugcuugcuugcuuacugcugacagcucucucuagaugccaauagcacaaccucacugcccagagcuugcuuucccacucgaagcaucccucuggcugcugugaguuccgagcccggagauagcggcugugucucagcacugggggauaaaucacaaauacuacauccuucccuugauucaucuuccugcaugcucagauuaacgaccaggaauauauuucugccagcagauucugggcugcaaaucuugccuggccugauccaacccugacaugaaucauucaaagccuacagcugagagauguucaugacacugagaacugagagaucccugacucagcaagagguacgagucaugggggugacuuguagcuaagggggugaggaugucuaugugacugacuggugcuuuuuaaggggugcuucacuccccugcaucaguaagauccucuggguggucccacagccaugguggcacaccuucaaacagagccuuuucuugccugguuugcugggagucuagcuacccagcaacagaccacuccccaacuccuccucuucuaugccugcuggagacucacagguuaaguggcuuguaaaacccugcaccaaggacccacugggcaaaagaauaauacuccucccuuaaacuggagcgggggggggggguucuaagugccucacuccauuggagucucaggacauuuuaucugaacaaucuuaggaaaaaugacgaaagaccuuguaucagacgauacaagauauaaagcuuaaauggagaacucucugggaggaaagaccuugcuuucccccaggaaccuucacaauacagagagccaaaggugccgcuaugggguggggcuaaguggguuacuuggcuggcuuugaagccaaccuuuguugcugcucccccaucuacacaucaaucuguagaaagaaaacaaaaacccuagaacccacccauuccugacugcuggggggugggguggggggaacaaugccaacaucagcuuaagaaagcuaaacucuuuugaaaguaaacacaauguucccucccaggaaagcccuucaccuccacuucgcugcccagugaacuccuccugucuuuaagaaagaaggcuaaagauccuucucuuccgaccucuagcucugaaaauaagcucucaaaccugggcuagaacucccucacccgcuggcauugcuccgacccacgcuguggagcugcaaagaaagaggccacuggggaagcugguagccccaaguagagaggacaggagaccaugauacagugaugagcccccacccccacuuucauggaguuuugcagugcucagccagggcacaggaaagaguguuuggcuguggucaugucaccacacgguaugggacuugaagguaaugcaugguuaauggaaauauggguggugggugcauggagggcuuccaggaggaaacagaacuccuggacuccaggauaagucuccauucaagcuuucuuuacacgccaccugccaucuuuggcaucaccagaucagagagggucuaccaaggcucuaaaccacaccagaucugcugugugcauuuuaagcaucaccaagggcccauuucaguggcucccaugccuagagcuacaaggguuuugugcuucuacagcaaaguucagauucaagagcagcucuggcucacggcugcauccugaugccaagcacuauguuggaacggcacagaaaaaaucaggaagucgccugaaaaagugagacaaaugacugggccagguggacaggugucugugaaaucuuggggccuguccaauucgaggaaaaugagucaagggacuauccugcucuuuuaggccaguguuucccaagcuuacccgcuaugcaucaaaaccaauccgaugucuuaugaaaccauggauugugggacccccacccugaugaucugggguucgagagaucuggagugaggcuaaaaaauuugcauuuuuucacaguucccaggugccacagaugcugcugcucuggggacauuuaggaagcagcaacaugguuauaaaaauagauacacaugugagaagacuguaucugaucagaugcggcaggcgccugauaccuuuguaaaacagaagucuacaggauucucugaaggauuacagacaguccuaagagaaagcauccaaacuguaggaccaugagauccagucuaagcaaagcccgugcuuccguggcuguccuaggagugccuuuccuuggcuuuuugcuguuuucuuuuuuuuuuccuuacuguuuaaaauggcuagaagagggcuggagagauggcucagccauuaaaggcuaggcgcacagccaaaaauagaaaauggcuagauuuaaggucagauuuaggaucaaauuuauaugauaaacuagaaaaagaugaaugugaugaguuggugcuuucaagagagaagguuugucuguuuguuucuuguuuuuuguuuuguuuucuguuugcugaaauccauugcugaccccuuaccucugcauaaucagccaccagguaaagcuccacguacuucauagaguguagaucuucccguuucaucuggacaagaagagacagaagcaggucagugcaguagaaauggcuggcuccagcucauuccaaaaggcagcugagaaccacauugguuaauaagcugugaccuuuuuacuucuuuuacauuuaggcguuagggacaguucuggcugcagcccaccaucaccaucugcaacggguuauuacucaaggccuuucugagccaugggaucuaauccucuagucucaaaaaacaaagaagccaaacuggcuagcacaggcaaaaauugaggccagcaccccacaagggaacaugccgacagcuuaguucccaaguaacuuugagaccacagaccucuguucucagugugaacaaaacaaauauuguacaucagaugagguagcuauuccaagaggggaagugacauuuuuuuuaaccuuacacaguguuuuaaaccaguaucuuagaauauuuuaaauauaaacagugauucucuuacaaagguaucucacucaacaauagagaaagagagagagagagagggagagagagagagagagagagagagagagagagaggugggcuuuucccucuuucuuacccuucucucucaaucuagaaauaccccuggaaccaaaguaagggugcagagaggacaggcuccagucugccagcuccacugggaaccugaaaacucacucugcgagguugcuuuuuggucugauguguaaacugaagggcccaguccuucgaggugggcccggagugcucgaacccacaguuccccgggggcagcgugagauguucggaucuguaaauacgguguuggcugucgcuguuagggacgggcucgaugauguagcugagguuacuucucacuauaaucaguccucuguggauaagagaaauggaagcuucggucaaugcuuccggaaaagucccuugugcagauucaaaugcuccaugcuucuucacguucuacugggucacgaggcccucugggaaggccugguguaagcuuagacccucuguagagaaauacacuguggggcacagaaucucagagcacuuuagaccuaccucccuaaguucaggcuuuagacugggaccccuaaaggccaccaaaucaagcaugacccaugacaaucguagaccccauagaccccauagacaaucauuaaacuguauaggcccugaaaaaguaacaugugaucagaggaagcacucuggccugccagcuagauagccagccucucaauuuagcuguggcacucaaaggucacaugcucaagaaacaucucaugaccccgagcuucaaucuccucaucccuaaaauaaaaaugauaauguacuaacucacggggcucuugaguaacuaaaugaaagacaaguguccuagugccugggagccaagcaucccuacccaucaacugccccaugccagcagcuaucuggucaggugacacccacaacuaaccauauagaacaaucuuucacccaguacugaacucaaagauaugugcuggguuauuuuguuuuuguuuuuuuuuuuuucacucacugagauuucacugaguucuagauaucauucaaacacaaauagucuuauugcugguaucuauagagacuuggguccagacuccaaaggaaacaaaaaaugccagacacuccaagccauauauaaaauggugugcuauugauguauaaccuauuuguuucuuucuguauauuuuacaucaccucuauguuacuuauaauagcaaauaaaauguaaaugcugaaccaggagugguggugauguaugccuuuaaucucagcacuugggaggcagaggcagacagaucucugugagugaggccagccuggucuacagaguaaguugcaggacagccagggcuacauagagaacccuaucuugaaaaaacaaccagcuagacaaacaaacaaacaaacaaacaaacaaacaaacaaagguaaauguugggccuggagagauggcucagcaauuaagagcacuugcuucucucucuaaaucugaguuugguccuagcacccaugccaggcagcucacaaacugccucuaacuccagauccagggaaucugauguucucucuuagccucuacaggcacugcacacacauggugcacaaacauacacucaggagcacacacauuaaacaaacaaacaaauaauauuuuuaaauguaaagguauguuacauauacuauauuauuuagggacuaaggucaagaaaaaacauauaugagcaaaacuuuuuuuuucuaaaauaauugauccauaauugguuaacucuacagagguggaaugcaggagcacagagaauaacuguauucacgguuggcaggaaggcagccauucuagcuauguaucuacaaccauggcaguugcuaaggauggaauaugaacaagccaagcugccuguccuggugaagaacaggcugagaauggguguagucacugugacccaugaccuagccugagccuugacagacacccacggauuagaugcaacugcuuaggguacuguaccacugaagccucuguggcucucuagguucagugagcacuuacugccucuggcuucaccauuaucaacagagguggggagaugcucacaggguagcccccugucaucuuauccacuaagaucuaugaugugccaaccuaacacugugauguaggaaugaaaagacaguaaugucugccaacugugcgucccaugguuaauuaccuuuccguaaacugugucugaggauggaagggggccaaaugccuucuuugucaucuuaucucccacugggaacccugcaacagucagccacacuucugaagaguguugcuggcaucaucaacuauagucaugaguaaauauagucuguccuucugacccacucuccaaacugccaccuuccacacagagagauaaacaagacagccaagaaauggguuccagauucugggaacaaugagcccaggacugaauccccaggaccuuggcaacaagucacucaggaccuuaucuccaaaccaaagaccuucucagcucagccucuggcaccaugaguggcagcgcuucuuucuugggccacucaaccucuagccaccacugcccucucaggaugcccacccagguuuuguccuuuaauaagagcucaugauucucuugggacagacucuggugggcaguagaccuuuccugaucccaucccucgcugaccucauuccaguaccgggaagacuaucaacuuccuggcugcauccuggcugacacagcagccgccaucuggccuauggugagacaccuaagguguucccuuaacagcuaggguggagggcaaagagcagggaucacagcaacuucccuacucugcacaggaaagaacggaggccagggcaauauuggcauccuguucccaagcuaucucuucaucccagcugaccagagccucgcccaccaccccagcuuccucuaaugacuauaauauuggccacuaaaugauguggaccacagacuggcuggugauccugugugcaccaauauuacacccagugaauggaaaguuccccauaggaaucagugaaaguaccaauuggaacuuggcagcagggcugguaauuaucaucauaguagcuauaacuuauugagcuuuucuaugaacugggcaccaagcugaugagagcuaacuucuaacuaacuucucugacccuuacaaauauuuuuuccaugaccagcccaaauucacacaaguaguaaagaguuaaaacaggggugagcuucagcaaucugguuccucauccuacaaccuucacccugacuuuuuaucaucuuucauaauagaccuggagaaugguucagaaagacacccccauucagugagcacucacuauccacgacuucacuacugacaaugaagguaggaggauguccagugggcaguucucuguuaccucaucuucugucaucaggacuaugcauauggcuacagugauggcggcagugacucucucaagugagaccggccaggauguguugauugauguugguuguaggugcagcaauagagagaagcucaccaagaugcuaagcccucauuuuccaaaggagcagagagguacguccucccggggaagccugacagccagcuagcucacuccaauuacuuuauucaaacauuauacagcauuaauuagggaugggaacugaacgcuuauauguuuggcugugagccuaacccucaacggcugagcuaucauagcaugccuuugguccggcaauuugaaaucauuaagaguauagacugauccaauuagcagccucuuuuuaaauuuaggucugcucuagauugacuucucucauagaggauuuguaaugccaucacaaccagagagagcacuuauaaccaccuucauuuugauaauuuaaaacaaugagaacaauuuaaaacgauuauuauuauuuauugagacaggauuuuuuuuuaauguguguguagaucaggcugaccuggauuugcucuguagauuaggcuggucucaaacccacaaggaacuuacuuaucugucccugccuuagucucccaaguauugagaucaaaggccuggauuuauuuauucauuaucuauguacccuugaaaacaucgaaaucaauuuccauaucuuucucucuucuuuagagauuaauaucuuugauaacuuaaaacauuuuaaaaacaauuauuguuauguauuaagacaggguuucucuguauagcccaggacaacuugaacguguuuuguagauuagacuggccucaaacucaaacucacaaggaaccugucuguccuugccuuuaucuuccaaguauuaagaucaaaggccuggauuuauuuauuuauauacccuucaaacauuuauauuaauucucauuuucucuccuuucuuuggaaauuagcauuccuguagauaaauauacuuauaucccccuuuuucuucauguaaauuuauuuaauacccuucucuuuauucaacugaauuuaaauucccucucccuuauuguauaaugugcuagguugagcuguaaucaguucucccauggaagcucauguuuauagagacugguugcucauagcaguaugacauucauuuucauguuagcucucacaaccugccauuaguucucccaugggagccccacauucuaaggagacaggcugacugcucagagcagcuugaaauucuaccccauguuagcuuucaugagcacagcuuuguuuuuuuguuggauaaaaacaaaacaacucugccccaaccuaucucuggguccccacagugaucagcaggacaguuuccuagagcaaaaugguuuugggcaacagaaaagcauuauuuuuuaauuuuacuaacuccauugguagagcaugagacucuuaaucucaggguuguggguucaagacccacauugggcaccaauuuguuguauaaauauuuaaucucaaucagagguuuuugcccugccuuugaucauucaguuccuugauuaaagacacacaaauuuaauuauuauaauaagccuuaguuagcacuagaccugggcagauaucuacccucuaugcuauuugaaucuauuucucuaucaauaaucccauuuuauaauuugucauguuccaucugggccgcucuuacuuccaacuggcuagcccucacggcaaaaacuuuugauucaccuauccccauggugacuucuucuucucuccaucuucuccccucaugguucuccucagaccccaagcccagugaaccacaaacccuauacaugucucaucugcccagcuuuugacaguuggcaucuuuauuuaaccaccaguuuuaaauuaaggagcaagauuauuacaaugcauagcaaaagaucaaacaucaacaaggaugcaccuagccugucuguggaauccaaguucccugguagauggcagaggagggauccgcccaaccuuaucgucagcuaguguuugcugacagcuaacugaccaugugccgcauagauggcagauguuacucucuuuaaauuuccccagcacauuguaaggcaggcaaaauuacagaccucacuuuaucagugaagaaacugagguucagagagauuagaaucagaagcuuucaccuguggcugcugguuaacagauauagucuguucccuuaggcucuauguagcuccacuaguaagcuuaagccugugcucagagagcccaggaccagaguuuucaagcuauucagcaaucuucagaaaguacccaggcuaucccaguagacucaggaucugcuugcuggaccaagagucugcacuugagaaggcucagcugauuccaagacaggcuucaaaucggcaguuaaggagacugggcuuaaucuccauuuccaagaacagaccauuccaggcaagccuuggccucagaagcugccccaccaauggccugaggcaaggacaaugggucagcagcaguuuccagaccucccccagcaaguuuccagcucccacacccugauaauggaaugucuauagagauggacccaacaaauuaacauagaauuccauaaugugcuuuaaaucaggucugcaagcucacuuggguaucucucuauucugguaaugggagaccccagcacacuggacuucuacagaauaaaacacucuuuguguuuacauacuauuugagucuagcaugagucuggguuaucauucuucggcaaaucauggacccuuacacacuaaguccuaugggaaaugcucugccgagccacacccaggaacuucaggagcccaugcuccugacugucucuauggcacaugauugagacaucaucucaaguaggcagucugaaugacccaagcuugggauaaccacugagguuaucccuuccagcaccaggauucagcgaccucucuccuuucucccgucacuauagcccuuggggacucaccccaggccuaacgaccacugauccuccccugggauuacuuggagacugaaaagaguuggcacaaccaagcacauuacagugguccccagcguuauugauggcaaguuucuaagaaugaagcucugggggcucucccuugcuaccacccucaagcuaccuuauaucucccccugcuccaucauuuauccuaagggccuccacugauccaauuugcuaaauguuagcucuggcagaggcagagauuagaggugaggacagaggaccuaggaggcaaagagccaggaugcuacucuccaaaccuauuccucaucauuaagagaaugagaaaaauaaaucacagauaagaucauauagaagaacccaggcaggccagccagucaggaaacaagagguucauucaugcuuaacccauaaaugacugaaggacucggucaaauacauccuucaagacuugagagagaugccacuccccaaggaagccgccccugggacacacaguuaugcauccaccuucuccacauuaggagagauccuaagaaguagcagcccuggguuccuccuccccaccacuuccccaaaguguaccuacacuaacgggucauagggaacuuccaaggcagcacagagggaagaaaggcacaugaugcugaguuccugcugggacagagcacaggcagagaacacaggcucaguaaggagacauccuggauuacaauccuggcucugcugucuccugacacagccuuaucacaggacagucuaaagcagugguucucaaccuaugaguuugacacccuuaggguugcauauuagauauuuacauuauaauucauaacuguaacaaaauuacuuaaugggggggcacaacaugagggacagaauuacagagucgcagcauuaggaauguuggggaccacugcucuaaaguaauuacgcagugcucacucacaaccagggaagauucuccaagaacgccagcagccauggaagcauacuguauaaaugggguacaaaccauuuuguuggggagccacucaguacaucuacacagagcacuucccaccuguucuagcccccagggauucggugauccaaccaaacauugugcugucaaggaggugaggcuaacccucuaaugugagcccugaugacuucaguaucauugcucccaucuuacagggcagaaaacugagauuucaggaauguaucagcaccaucuggggccagugaaauaaauggcuuaguagggaaaggcuucagauacacaauccuggguucaaucccuagaacccaugcuaaauagaaggagagaauggacuucauacaguuauccucugacuucaacaugcaccuuauagcacacaggccuccccccccacaaucauuuacauguauguacacacauacacacacacacauacauacauacauacacacacacacacacacacacacacacaauaauaagucuuuuuaaaagaacuguguuagaaggcagguuagugugcauguggggagcauguggauggcagaggacgaccuuggcugcuguuucucuguuguuguucaucuugauuuuuaagacuaagccucucaauggcuugaugcucacuaauaaagccagacuggcuggccugcaagcuccaaagauccucuuguuucugucucaccaacagugagauuaaaagcaugcaacauccugcccugguacauccugggaacugaacucagaucuuugugccuguguggcaaguacuuuaccaacugaguuaccuccccggccccaguugucagcuuuuaaaccaggaauggucugucucuagaaucuaaacuugucacagcguaaagguccugccauccaagggcuuauuccacugacagaaggaauuaucauuaggccugcaggaggaggacauggcuuuugggggaacaucucccaccuccagccuugguuccuuuuuccuacucugcuccuucuuguaguucaggauuucccaagcuaaaggauccuuuuuaugauccagucuacuuaagguuuaguggguagggagcuuggucaagagucacagagugaguuaacauaacaccugcagcagauucuugguugcuaauuuccagagucauugauucuggaaugagcaucucgccaaucccauuauccacaaagucaaguacuuggcagucuauacagugaggcccacggggaagccaguguggccaagauggagccaaaggcaaaaguaaguauggagagcagaaguccgggagucagacccccaggaaguguagagucugacacaaacucagggcccuggaauggcaguucuaaagccauuccaguccauggugugcacauuuggauauacucuccaguacccaaucucagauucucucucuggaguacaggaucggaguccggagccagccagccugccugccugucaaggcagaacugcugugagaacuccagaucuugacagagagaacugcagugacagaaucuggucccucaaguggaucuguaagggauauggauuguaugucacugaaggacuauaauucagcucaccagacaguacggaagaguuuaaggacccauuaaaguaaucugacagauacauguguaccuaaggcuuaguucuaaguuggaaacacaucacaaaaccgaccuagaugugcaagauggucucucuuguacguaauagacaauacaucccuaucaggcauauuccaaccauuacccagaugagaaauggguuuguguggaagcuuguuuuuagguuacacuccuguguuuggauguuuaucucugaaacugaaugaguugcaccauggcaauuuccaauaagcauuaagaauuaaaaccaaccaaacaccucaccaacaauggauggggacacacacacagguuuagucaaagacaucacggcccaauauuggcauacuuucccauaaacgaucaucagaccuuacauuuagacuguuggucaguuaugaagaagucucugugcaagcaagaugucguggucacauuuaugggauggauuuuuagcauggggaaggcuggaguguguggacaccugacacccucagugaagauggccccuagcugggaugcuauuuggaguagguucuggagacuucgggaggccugccuggagcaagaagaucuggggggagggcaguuguuaggacuacugucuccgcuaccaagaauguccugccuuaguccauccuggucauggauuccagacggacagaggcagcagugaagcuugggguccucugaaaccccaagccaaagccgaucuucccuguuggaguuguugacaugaagcauuuggcugugguuugcugugucuuuguuaagauccgcagucacugauuaacccaauucccaaggugguuagggcccaaaguuauaaaacauuauaucauguaucgaaguuccuuuugccaggagugaguaugggggacauaagaaacugguaguuuauggcugcauccagaaacgggguaagaucugggaaagcagggugagaaaguauuucucaucgugcccuuaaauguuuauaaacauuuagauuuauucuacuagguacuguuucuguaaugauaaacugaccuauagaguacucuggagagaagagacccucacaauggcuacagcaacgguucucaaccuguagguaggaacuccuugggagucaggggagcauguaaaauaacccuuucacggggauggccuaggaccauuggaaaacacagauauuuacauuaggacucauaauaguagcagcauuacaguuaugaaguagcaacaggaggaacuguauugaagggcggcagcauuaggaagucugagaaccacaggucuggaggcucuccugacucuuucauguucagccagaaaagccagccuagcauaaauuuuauccauuuucuccaagcagaggagcacaguaccaggagagaugaaugguuaccauggagaccuucuuuggaaauaugaggauucaggggucuugggaaacuauuuggguuugagcaccacugucauuccugcuucugcucugggaaugccauggugcauucaagucuccagcuuucaagucauccuggcuacaaccuccguuccuuagcauguggagggaagagagggccgggaaagacaaacauguagaccucggcagauggaagcaacaugaaaaccagaaacacaugggcagcuuggugagcuuccccaucagccugacugcuggaaugauuuacaagaggccaagccaaguaaguucccagugcuccagacccagaggggggaaaggaaggggcgggcggagaaggucacaccugcuugcucccuuuccuccuuccugggacagucauuguuuacuugcuggccacagguggcccuggcugagccuauaaacaccacugagaagcaaguuggcuuggcuggaggaggccacuugagugaaggauaugaggccacuguuaaucaccucccagccaaaaccgauuuccugccuaauucccucaggccacucgccacgcaaccuuucagggaugggaaccaacacauaaacagacaugagaccugcagucagaagggcccucagucauauuugggggaugggggugaaggugggaugggauaagcuagcuaagcuguagagggaacaaaucuuauaugcugguaaagggcugcagaacucaugguuuguguuuccuuaguucguuauggccucuaccauaucugucauuggcaggucuguuaagaugagaauacagggggcuggagaaauggcucaguggguaagcacugacugcucuucugaaggucaugaguucaaaucccagcaaccacaugguggcucacaaccaucuguaaugagaucugacacacccucuucuggugugucugaagacagcaacagaguguacuuagauauaauaauaaaauaaaucuuuaagcuggagcagagugagcagggccacagcgaggagacauccuaaauucaaauucccagcaaccacaugaagacucacaaccaucaguacagcacagcuacaguguacucauauacauaaaacaaauaaauaaaucuguuuuaaaaaaagaugaggauacagaaggcuccaaacuuguuugaugaugcuuguuuauccuacaccaaaguagggcacgggcauacagcaagcacccaagaugaaugagagaagcagccacugauaaagggaaagaaagcccuuccuacuagcuccugagagacaacagugggccugcauucccagcccugccuuugagaacacugaauguguaauuaacauuagcagaggugagaguccugcccccagcauaugguucgcgguauuggcuaccgcaaauggacuuucgcaaauggacuuucgcuguuguuauuccuagagucagucgccaccuugaguucaggagcugugcaguggaggugcucaaaacccaggcaauuuguguaaauaagagcccagauauuuccaauaagcauggaaaguagcagcagggggcuggagagaaggcuugguaguuaggaacacuuuguucuugcagaggacccagguuugguucccagcauccacaugguggcccacaaccaacuauaacucuacuucuaagggaucuggugccuuccuccaccucccaucaggcuccuggugcuccuggcucaaacccagcugguuugguauagaaacagaagggccacccuuuuaccaaacaucaucugguuggaacuuuccgguugacuuugucuugaaauuuauccuugucuuucucuccauuagcuucucucuccucaauuucugcuagacaccugaacaucauucaaccacagagugaagaauguugcgacucagccuggggacaaauggcaugucaccuguuugcugucucucacugcuuucauuucuagaagcucaauucaaugguccuggaggaacugcguccccaugguuacccaaccccuagagauggcaaacauuuuacuagcuacuaugccuuguaguacaagccaacaaauagcccaggguccagccaccuggaucccgucuugguuucucacccucuuggaccacuauucauuacccauagugaugguuaccagacaacuuagugggcccuguguccuagacuacugaagcuauuuauacuagcuacuccucagucugcccuucgaacucauucacuccuuuccugugcuagcccacacggacccaacuuccugucucuucacacucugugcuuuccuacuacaucccucaugauuugcacaccucuuuuuacugugacuuguagccuucaaguuacaucugauaacucuucauugacacuaaucuuagugucauaauugucucuugauuuguuggccuuauuccuaaauaauagaacuccuaucuuuguuuucaagauuucucuuuguguguagcccaggcuguccuagaacucgcucuguagaccaagcuaggcuggucucgaacucagagaucagccugcuucugcuuccugaggucugggauuaaaagugugagccagcaccacccagcaacaauuucuaccuuaauacaaugaauuugucaggaaagguauacguguagauuaucugagacuucccugguaucucacaagcguggccucuuguuugcaaggucuugcuuaucguauaggagagggcaccagcuguccccagcagcuucagggccucuuaccuaauuccccggcaggugcugagcgugacacuggacucauccacgucccucacagucccgugguaaaagcagugauccugccaaacagaaaggaagcacucggucaaauggcacugauaaacucggcaauguuaaugucucauugauugacaggagacggacucguuccuucccaaccccugaccucauagcucuuaccugcaaaaggcuuccaaguuuccacuuuuuugguucuuauagaaacccaaggccuagcacagggcagacaucaccaccucuacugagcagacaaaaaauguugagcucacagggacaagaagauuugccaaagaucuuccugcuagguuggagaacccaggguuuuuaaaucugccaugucagccucaggaauagucuucagagagagccauucucucaaugauggcaccucuguaacgaacgcccuguaauggguugaacaguguccuccuaaaacucuuauguccacccagagacuagaauaugauuucauuuguaaauagaguuuugaccauguaauuaaauuaagauauggccacguggauuagagcaggucauaaaucuaacggcccauauguuuccuggaugaaaggacacaaaggauguaaggggagaagucaccugaagacagaggcaaaaccuggaaugauguaacgcagucaaggagcacugaggaauuagaaaugggaggacucuccccuggagagcuuacagagugugugcggcucuuucaacaacuugguuuggacuuuuagccuccaaaauggagagagaaucuauuucuucucucuuaaccucagaguucacagugcuuuguuaggauaaaaagauaaaagaucucagcucaagaugcucuuccuuucccgaaucccuccacaccugcaccuuccuuccugggucccuagcuccaugaagccuggugcacucucuagucugaguggucccccaaacccagccagaucccucuaaucuuuauaaacgcuggcaaccaagcacuaccauaagcaggcgcugagcaaggcuucagagaugcaaugagaaaaugcacacauagcuccagucccuugugaaagcuagucauuaauaauuaggaagcuguggugguuugaaugagaagugcuggccccagcccaggcucaguuguucgaauacuugcuaguccucagugaugugacucagguaggcagugcagccuugauagaggaagaaggucacuggaggacaggacuggagauuucagagccucauccuccucucuaguuuacucucuuaggcuucaugauuggaaccgaagaugcguucucucagccugcugcucuggccacccgcugcagugacucuccuaccauuauggacuauuguucuggaaucuuaaacccaaauaaacucuuccuuuuguaaaguugcuuuuagucuugcuguuuuaucucaguaacgaaaagcaauggaugcagaagucaaaggcacagcgcuacaaauagcuuuguggugccagaaaaguuugaucacuaggcuaaucguggcaauuaggaaucacgcacagugcuucugagagugcugggugcuaagucaacuguggcucucuucagauggaggagaaaacacuccucccaaggaggucagaacacagagagggcaaaacugggagaaaagcugggcauggugguauaugccuuuaaucccagcacucaggaggcagaggcaggaagaucucuaugaguucgaagccagccuggucuacagagugagugccaggacagccaggacuacacagagaaaccugucucgaaaaacaagcaagaacaaaaacaaaaacaaaaaacuagaaguaaaaucaguuucuuuaaugggcuuccucagcacccugaggcuaaggaaugaucacaaacgcucaaguuuucccugcauaacgaucuaaggaucucaucuccagacugugcggucuccuugggggaggauccagaaggcaaacccaugggggggggggcguccacuucucucccaucucuaguccugggacaaccugguaauuaaacugaagcauuuauggcccagccaaggcagccuuaaauccagguccccacauaugcuagcaguguacaugacuucucuggccuuccaccucuuuaaccuccaaccucugagggccaugagagaccuguacacaaaagagcuagcuagacugcuccuuaucccagagagauagacagccaacacuaguggcuauguuuuucacuaaauucuuucacuaggcauaaaacauggccuccgaggacaccgaagcccaccaaaaggguugacccagauccacaaccuuuacuguuucuguccuccauccuauuuaucugagccaugcagccaugccaggaagcacaagccugacccacacucaaccuggguuccuucucugaaucgcagguacccuuucaucuacgaguggcccauuggccaagcagcaccugucaucuacccauucacacuaacacacagccaggaggggagauagcagcagucuccucuugguaucaaagucagauucaugacugcuuugugagcacaaaggaaacccgacugugguaggaggucaucccucggcuccuaggaaggcaggcaacauacacacagccuggcuucuagccaaaguccacugcuaccccgcaaaucuaggaaggcaggcaacauauguauggaccaacuucuagccaagggucccacuguuuuucaaaggccagccugccaugugacuucuccaucuguccccagaccaggugaacuagaagcagaucaacaaccaaguucugaguguggucuuuagaacucaggagggagauuacagacccagugcacagugugcugacagugagaaagacgaguucuccccgggacaaggggccaggccuucgaggguuugucgucaguggaaugacugagagucaagcaagcauucagaacuauaggucaaacacuguuucaaaaugccaguuccuucacgguauggagaaguuagauccagaaguaguaauggagaagccucagaccucuucggcucucugacugacggccgucacagagugcauccccaccccccaccccccaccccccaugcucucugcaguggcauguacuacaacugucacaugcuccuuaauuuacaaagggcacuagcacaugugaccaggguauuugucacucgggucuuuacucuuugacgacaguugcuaauuuuuacuuuaauucugagcacagcuucaugagguagauauuacucccacaauuuuaaaggagaaaaccaaaggcuacuuuaaaggaccucagcuucuggacuaagaucggauauaaagagcuugagagacugacucaguuaagcagagacgugaaccccagcaacuuggcccugcaccccacccucuaccauccccaaccaaggccgaauuggcaccugacugacucgucaccaaagccuuucuacccucuagcacacagugggaugagcucccuccucaguccccucaucuguaaauuauggaguuagaaaucauaguuaugaauccccauaaaaaucagcgacuccucuuaaccuuccacagcgcugacucacugaucagcucaucuaauuuuugagauuuuaaaaaaagaacucaguaugguccaaaggguugauuaaggucauccagccagugagagccaagaccacagccuggcuucagaucccaacccuugcaagucuugcuguuggaacacauucccaaaccuguucccccaguaaccugaccuagauuaggucuguaaccuacaggucuagcuggugagucuugauaagauuuccagaaugccugccuaguuuggaggcagagucccauccucugcauuuaggccaacagcuaugagugacuccauuccugcuucuccuugauuucuuaguuuccaaacgagaaggcugacugggagcccccugggccuggguggggacuuugcaagaauccaacagcgguggauggaagaaaacaaugaucuuggcccaggguucaguaaggaugugcuucagccagugaggccuucaggaaggagggggauucgugggaucaggggacauccucuuccagaguucugcucugaaagacccuuaacgcauuucugcuuggugcacaguuuagagcacaaagaacaagucaggaucggccaugaagucauugcauuccgcagcuugucaggcugagggggucagcccagggggcuuucacagcaggaagcaugagcucauaguuaacuugugcccugagacccauucuugaguuguggguauggaaguaggaggggcugagcucggaggagggugguucugugaaauuguaauggcuacgggcucugggcuuucuaagaagggaaaagcguggggcaagaagcuuuguggagaugugggucacagcuggacaguuucccugauccaauccagucugucugcugcugucacuggccacacuuccaacuucauucccacccaggaaagucuugggaagaagucccauugaccuucugacccagaacccaaaagagcauccccucccagguaccauauacucugcuguggcucucaacuuuccugaugcugcgacccuuuaaugcaguuccucagguuguagagacccaacucuaaaauuuacaucgcuaccucauaaccgccauuuugcuacgguuauaaauuauaauguaaauccuuuuggagauaggagcuugccaaaggggucguaacccacaaguugagaaccauuuucuuaguugacuccaaacuuaagugacccauccuuuuccccguuccaggacgucugauaaacaagcuagccugauagugacugacgauggcuaucuuguuaaauauucacgcgcaggcugagguaugugaggaauggguugcacggagaucuaguuccaguuacugugaguggaauccugagcagaggagccuuuccuguucuccgugucacacaccaggagccaagucacaauguagcugccuauguccuucuccuuccuacgccucucaagagcccagccuccgaagccucggucugauccagggcuccucugcucuaagccugugcauucuaacagaaaucuccaagggaagagccgacuaaucaugcaacaggugggauuuacuaucuuaaagguccacucguaggauauggugaaauaaaugaagauguaaaacuaugacuggaugacuauccaaacuggaugacucugggacgaugugcaaaacuuuccuacuaaaaacaacucucaaggguuaagguccaguauuaagacaacagcuuauuuuuacagagccugauggagccaggcagugggggcgcacgccuuuaauuccagaacuugggaggcagaggcaggcagaucucugaguucaaggccagccccaacuacagaaugaauuccaggacagccagagauccacagggcaacaaugucuugaaaaaacaaaacaaacaaacgaacaacaaaccccaacugcaucaaaagauauacuauaauuuuguuguuauaucauuuuguuaauauuauauauuauaguaugcuaauauaaauuuguaugcacagugauuaaaacugcaaacccuacauuuaaaaaaaagauuaaucaacaucuacuuggaugagauggcaggaugaugaguaaauuaauccuuucaaugauuuuuaauauauggguaauuaacauaggccuaacaguaugaguacuuuguaaugauuuacacgaauuucaaucgaauuacccucaaacauucuaccucucucugcuuugucauuuuugcuggcaaagaacaaggagcaacuaugagacaacagaguucgccucuguuugggcccgaggucuuggucaggggaagccagguauucagagaaggggccacauauuuauucccaccuagccggggcagcuacugaugggcacaugucuacaugacucaccucagacuucagcgugcugguuugaggauugccacuugcaguguagcagguuucuguguaggcuggagcaaaaaggugccugaaaaaaagaagagcagacauuugaaccuuuagugauggauucucucuuccuggcaauggcgcccagugacuuuaacugaaccacgaaagguuacccugacuagaagaaaguggugguuauuaggggacuaaggaacaaaaagagagccaggaggaaaucugucauugaucacuucauccaggaguugacaauccuaaaucaaucauguugguuuguuuuucugggucuugagaaagacccaaaaacugcaaacacagucacaacaucugugagacugaggacccgauuguaaaauucaaaugguccuuccaauguggaacaugcuaaacuuuagcaugggcaccucauuuuuucuuuaugagaauagccucugcuagauauuuuugguaggcugucaaugaaggggucguaucuggccuuggccuguguuuuaggcauggccaauggagugaguaguauugcaagaguugaacaaaugucagggacagucauuguucauggagcugcugauccuuuaaagccgagguuaaggaucccuccccgaaggcuaggagauacagaacgagcuuccuagaaucucgccaaaaguaaaaugagaaauaaaagaaucuaacggauuuuucagcugacagaacuggucuccagaaaggcaaggccagggagcaaaguuauuucugauuuuaauggaacaaaacauuagaaauucaagucugacagaaagaaaugcauauauauauauauauauauauauauauauauauauauauauacacacauauauguguguguguauauguguguauauauaugguguguguguauauauguguguguggggagagagagagagagagagagcgagaucuaaaucuaaaaaggaauuagguacaggacauuucagaaauacauguauucucaaguccauuuuaaugaaaagccaaucaguguaccccagguacaaguauuaaaaacaacuggcaaggcagaaguccacugucacugguggcuaccucaggggagggcagauguuuacaaggcaaguuacauauugcugcaauaaaagaaagaaagaaagaaagaaagaaagaaagaaagaaagaaagaaagaaagaaagaaagaaagaaagagaaaaggaaagaaaagaaaagaaaagaaaagaaaagaaaagaaaagaaaagaaaagaaaagaaaaggaaagaaaagaaagggucugaucaaauauuuauucugaaaacagaaaaccuaauucaaaacuguuuuuuagaagaaaacacgggcugaagacagaacggagucagaggaaucagaagagauacuagauuugggaagaagagauauuucccagaggaagggacauggcuccaaagucuaggcuagacucuucccaucuccggaugcagucagacagcagaugccuuaagaauuaacauucagucuugcggagaaaccacccaagagggauauguaaacccagaaaaacacaaaauccagcugaugcaaaggaacacucagccacagagacucugggucagcugccagcuugcagaaugugucgccaagccuaccucgccuuagcauccagagauucagagggagucauucacaggucugacugaauucauaggacuucaacaggaagucucccaagggcacaggcuccacaguuaggccugcuugugucuuccagcaaguuuacuaaauggaugauauaguuaacuagggagggaauuaaugagcacucuagcuuaccaggggcuuagagcagggucuggggucugaaagacagaguauugucucuacagccacuagccgguuacuuucucuucaguuuccucuucccaugaguaagggcaauauaccgcugaaucaagcaauuuaauaauacagagagcaagcugaacuccaaucauaauagagaggagcuagguagaaauuaauaauuaucaucauugcuuaacuuuuagaaacagggucucauguagcccacaauggccaugaacucauuauauagccuaggauggacccugaacuucugacccucccauccccaccucccgaaugcugggaucgcaggcacagauguggagcaacaugcccaguguuauagggugcuaaaggucgaguucaaggcuucaugggugcagggcaguauuuccuuagcaauugaacuacaccccuagcuccuugguagugcuuuuaacaagguuuaggaugaaagaauccagaaaaaugaauggauuucacucgagucucucucuagcucuccucgccgauuaauucacccauauaucacuuaagagaggagaggaaaagcaauuagcucauuccaagaaucuauuuucacagacugaguaauggacggcuggcugagaggucagaguguaaugaugugcccugggugcuagugaagagauguaaauuuucccacaggaaaugcacuugaggugaguacacuuuaagcauauucaggguuuuaggaggggggagcuccuuauccuacccagcagcaucauucaaaugaaccgaagugaggaagaugggggaugggccaaagagaggaauccaaacugagccucugagguauacauacacacacacacacacacacacacacacacacacacacacacacacacacacacacacguucaggcacacguauucagaagauaacucauuugcagcuuaucugaggacuugcccucgucagcaagcggcucuuggagccucagcugcaaacuccuccuuccuggcuccuaaagcaggcaagaaacauuuagccugacuaaguggauaacugaauuacugaacaaaugaaccuccuauguauuguaagaaccuaucaggaagcagccauucaauaagagaaacuuucagugacgggggcuccugaaaccacccacuccaguucugacuacguguccucuguagcucaaguccucacccuggauuaaauaugaccucucugcaugcagcaccugcucauaggaucuaaagcuaaacugugcugggguaaugcacgccuuuaacuccagcacuugggaggcagaggcagguaaauccugugagcucaaggccagccuggucuacagagugaguuccgagacagccaggguuacacagagaaacccugucucacaagaccagagagaggggguggagcaggaguuaggagugggagagguggcucaagcaaggaccugauucccagcaaucaaguaaaaaagccagacauagaaagcagaaacaugucugcuaaccuccgugcuagggaggcagaggcaggaggaucccuagaauuuuuggguguggcccagccaaucuaacagaauucggugagcuacagacuccgugagaaguccuaucucgaagcauaugguggagaccaacagagaacaaccgaccguugaccucagguuacccaagcaaacuccacaagcaaaaugcaaaggaggagaccacaccucagaccuacaacaucaaaagagaaacugaggcuggggccuagcauucugucuuaacagcacuucucucccacccccagguaauccugaggugagaacaagccuacaaccgauacccuaaaccacaaguuucugaaacaacuucagaaacauauguacauggucugacucccaagcccccucagcuuccugucuccaccacauccugauuguugcagaccugagaaagccaacgaguuuacaccuuaaaagcacaccugagagguagggauuccuacccguucccauuuuguagacagggggccaggucacuuuaagggaccaugcaugacacuguuggagcuccauucagccucgaguuugugagacagagucuuuaggcacuuuguugcucuaucuuagaugaaaacaugaaaccaaaccauugcccggaacuuggagaucaaguuuuaauuuguuguuguuguuguugaugaugaugauaaugaugaaugucuaucaugaucaaggcaacuaugcccacuuggauauuaaugucuacauugaagagccaugggguaagcuaagcacagggcaggagcaagacagcuuaaaguaagaaauucugggcuaguucuagcuaaauaaccuuuucccugaaugggcuaaggaugugagccaggaaggucccuccuucuagaagcaaaggggucauguuucaucaccaucuguacaacuuuaccaacagggacaaagcacugcuuuuaaaggcucuccgcuguccccaagagaaggcugaaucuucccauguguccaggcagggggauucuggcacugugcucaggacaaaaguuguugucgucuucccagagaagagaccacauacauggacacugaguggccagaugucccuucuccaacuacaucuuucucucaucucucugauagggggcuggcucagcaugguggcaggaagcugucucuuaccacuggcaugcauuaggguuuucaggaaaugauuuguguguggagauccaggaagaggggaagccuauccaagauucccacccuccccucccccucccccacugacugauagagaaaacacucugcuguacucccuuaucuucaguccugucucuucugcccuaaggagaccaugggcaggccgagaguagcagaagaggaucugcuguccucauggugucuuuguccucaugguggcaaaagcacacugcagcccuaaucaggggcaaaccccuagucucccagaccccaaaguccuuaaacagaaccuccaucuugcggggaggggggagggggcuagagagaugguuccauguuucuaaucacuugcugcuuauagaagacccagguuaaguucccaacacccacuugguggcuccuaacugucuguuccuccagguccagggguccaggucacuguuccccagcaucacauaggcaaccugguacaaagacaguuuacaaacuaccuugaaaaccacccucaucccacgugccgggcaugaacaaacgugucucugcuccuucccgggcugauuuuauugcugcccuccccuagugcgucuaguccugagaguauccaagugucuggacacauggagucgaagaccagacucucacuauugaucuggggccuagguaggggguuggaaggugguuagggguggguccuuacccuguccaggacagggacagauauauagcugccuuccauuuuuaacucucacucuuaaggucauagacucuggcccaaucacaccaggaaaggcuuugagaacgaaaauacaaagccccagaaguccuccagccccauaguaagaaaucugcgucuuuaauaguuuuuuccaggugaugcuuuuuuuuaaggggggggggggugcucugggaaccacccugcucuguuagguucuuucuagcuuuuuguuuuauuuuuugguuucuggguuuuuuuguuuuguuuuguuuguuuguuuuuugagacaggguuucuguguguagccuggcugaccuggaacucacucuguagaccagacaggccuugaacucagaaauccaccugccucugccucccgagugcugggauuaaaagugugcgccaccuuguccagcugguuuuuuguuuuuuuaagacaggguuucucuguauagcccugggggguccuggaacucacucugcagaccaggccggccucaaacucagaaauccgccugccucugccucucucucugccucucugccucugccucucucucugccucucugccucugccucugccucccaagugcugggauuaaagguaugggccacuacugccccacucauuuuaacuuuuuaaccuucuggguucccucccuaaccuucuagucaccucuccacaaacucucaaaacaaccuagaaauagguauugcuuugugugaggguuaaaaaaaggaucuaaugaugacacuagcccaucagagaaggacccagagcugucccugguuuucauacugcacuaggacauugucuacaaauacagaaccagcuauauucauagcuauguggccagaaggcuuccaauagcacacaccucguauauacccugaaggcuuuggauugagugcccgcugcacuggccucuccuuccaagccauggcacacggcaaggaugaccaugguucaugaggacugugggggaggggagauacucugucaagacucagacuugaaaaggccuaccaaaguuugucaagacucuauaucaaaguguccuggcuucagggaacuacucacagugaauuaggcuaccgcucacacaacccuguaacaucagguguucacagguaaauaaaggcuuuaguguaagacucaauaacugcaaauauuuccauucaguuggaaaacaauaaccccagguuuccauuaaacguaaagggugccaccuagaacuccccaggacaggaaguguaucugaaaggcagacuguuacucuaaugaaauggccugugcuacuucacauuuugggcagaauuagaaaaaaagaaaucauacguauaauuuucuuuuauguugguucuccaguaggguaaacguaaggagagaaaaagaaccagauuuuccaaaucagccugcacuuugcuuggucuaccucugacucuaaaggaauggaaacagauuugcaaaagccccauugccaaauaaggcacugaucuuucaggggcucacaagcaccagcauuccuuugugagggcucagaagggcccuggaaggcugaagguugcuccuauagugaagagcugagcccuccucccauuugagcaaggccccuguugucucggggaccaaccuaagcaagaugguaccacccaccagcccagcucucaaaaagccaaaauuuuggguauguugucuuuagcagccuauugaggacaucuuuacacaaggcaucaaagcaacaguccccuuuaccagccacuucccauuguauuucugguuuccagagaccucacaccccucugaauagcuccugguccugagugcaguuuuuauguuaugcccaaagcaugucuggauaaccagauccuuuagccagcaggaucuauuuaauccucuccauggcucucuccccacugugaguaugaacaugaauauccaucaguacaaagagggccugacaucucaugaucaggcaagcuuagcuagcuggcaagacaccugaggggcccaggaaauggcuuaccgauaagaguuuguggguuugcuuaaggaugcccuacaaagccuguccugaacugaacauuuauugguuaagaaugguucggggaaauaaaauuuucucagaaauaccaaauuuuaaagagcaagaaauauccccaugguagcaaccuguauaguaaccaguauuugguaaauaaucaugguugcuguucaucagauuagcugaagucacagcggccuggggaggaguacugggggggggggggggaggacaagacugccauacuaugaagagagacuuuaugacugagccugggggagcggaggaaagcaaucuccaagaagccaccagaucuuuuaagaaacucagaagaggggaccagguauaucugacccugaaacaagacagaguggguaucugaaaacacaaacuuagcacccucaaaggugggugccucuggcuaaauacuugagaacuauucuaaaccugcccugggauucuuagcaucucagaacacaagugaggaccacugaaagggccccucauggaccacaguaggcuacuauccuacccugccuagcaccugggccaaguucuagccagaugacaguggccuaguuugaauuuaggugaauccucccaucucaguacacugcagacuaggauacuaggaauuggccaagguucuugcucuaacuuagccaaaugaccuggucacaagccaggacuggaaggucucagcucugaaggucauggugagugacacugcaaguacaucagaggcccugcccagcagcagaucccaaagagccagccgauauccccggauccaguccaaagcaaggcaucuaccauaauaaugaaaaaaccuuuaugcccuaaccucucugcucagucuuucccuuuuacagauaaggaaucugaaaagaguaaaaguaacauauugucaugaaaguucuaaucuguuuccaaacacagaagucucaguccacaaggauaugugaaauccugguggcagcuaggucaggaguuggcagaggaagggcguuuguccaaccucgcucguaguauguauuagaggcuguaggaaagccuggguuccucguguccugauuucgucauacacuuacuuuaagugcuuggcuccaggaccuacgucugcaacccaccucacacuacaaauauugacuaaggccagccauaugccaggcaccgugcuagaggauuguugagcauuagcccucaaaggcugguaucacuccuacccugcggggaccuaccucucucccaggaugaagaugauccacgaaaauaccugaaaagagcugacaggccacguggaggcagguuuuaccagaaagucccccagaaacucagacccauuucaaacccaccuuccuucuuuuuagaacugguaugaaagccgaccucuaguuuccucuaguuauaaaacuaugagggaagugugcauauaugcguauauguauuccugugugugaguguguguguguauaguuguguggguacugucaaguuuguguaugugugcugaagguaaggcuggccuagacacugggagcugagagucucuugcucuacucgucccaaccacauuguuauacuacauaucucacaaucuagucugaccuuuguguaaacccuaaaucuagaaucugguuaaggcaagaaauaaagagcuuccagaaaaacagggccccuguuggcccuuccaagcuuagaucacucuuuccuuuaugauucagugucucuccaaaggaauucuuuuucccagaacucccuucuccugaaagguuuugaaaaaaagaaacuaugcuugauauaaugcagccauuauagccccuuggcccaucuggaccucucccaagggaggcugaugcaagaggagacuaugaggucccugccaguuuucuccaaacacgcuaccuggggggaggggaggaaauccauggggacacauggaagccaugaagagaccggaaaagagccuuacucccuuaaaucagaaagacccagcuuccacccggcuuagucaagaagcugaggagugccuagcuaaacuucauccacucagagguauugcuguuugccacaaaagccaauaugagacacuuccaagccccagcaaggcucccaagugaagucucuacuguugaauaagcagaggccugcuccugagaagugagguacugagaaguuuggaagagugagggcuggggagauggcaaagcagguaacgagcuugcugugugagccugagggccugaguucagaucccaucacucacugaaagacacggagacugaaggacgccugggaauuuguucaccagacaggcuagacaacugucgagcucccaacuugauaagaccuuaucuuuggaagcaaggagacgaugagcgauagagaaagacaacagauaccaacuucuguccucuacaugagcaugggaaucccacacuuccccccacccacacacacacacacucgaacaccaaaacucagauaagacagggcaacuaggggagguaagugugggugauggggacacagguugaguuuuuacagcaauuuccuuagcagaucuugcuucgaucccacagaggucgugacucucagaaugaagacagucauuacuucaucaaacgagagaaaacaagaucugaguaagaauuugaccuauuucaggucccaccagaagguaaggacaaacccugggacuugacacugaugucucacucguuacucaauggaaaaucacaguaagaccuugugucugucuacccucuucuucauccuauauuugcucuaucuccccaucuccaugacuccaucuuauaaaccagcaauccauccuucccucuccauaugggucaucuugucaccauaucagacauaagguguauuuggagcugucuguccuauccgccucuucuaccaccucccauugcucucaaaauaaacucuggcaaggcucuucaggaaaucgugccuauguguuccccacccccacccccuaccccugggccugucuucacuuccuuccucugcucaggauguccuaaccagagaguauaauuucuuagcaucuuccaccuagucuuuguuuuucuuacaagaacuaugguacacagacauuuagucaucaugagcagacugcaccacacuccuucuucacccccuuguucuaagaaguuccuaagacguugaucuaggucaguagaucaguucucccaagagcaccuucuguuuuucuccacccuagcagcucaccuugcucuacuguaauugucugugucuucuccacucgacacgaaaucccucgaugucagagaauguccuugccacuacuuagcccaagaauaucagacacacaguuggcacucacaguaugugcugaaugacaggacagaaggaaagaaggacaaaaugaagaauucuuaaugaaggcuggggagaaguguuugcacacagaugaaguguuugcaaggcaagcacaaagaccggaguucaauccccagagauacauacuuuuaaaaagucagguaugguggcgcacagguuuaaucucacucaauacugggggugugggaagauuccugggguucaauggccaaauacuuugggaacuucagaacaauaagauguccugugucaaaaacaauuaaaaauuauaaaaggugagugguccuugaagacccaaccgccaaggucauccacuagcacccacccaccucccccacacacaacuugaggugaggggagaaaagaggggaaggagggaagggaagaaggguaggagagagagagagagauagagagagagauucucaaugaauugucuaaacucaacccaggacccuagugacuuccauuaaaaaaaaccagaagucucuaagcuaacacucaucccuagcuggauuuaggcagaaacuacaucucacccccaaccuagaaccuauucauuuaguauuuaguaaucaggagagugcaugugagcgaaugugugaguacauuuguguguauguguguguauacacauaugugugacuaagcccuaaauggagacaaugcaaagcuuauuuccuuaaaaucaaaauaccuccuggauaaaacgucaauucccugacaguguuacuccaggguccccaaugcugcuuucaccucucacagguuuccccucagaacagucaugauucauugcccaagcagaaaauuuuaaaggaagaaaauauccucaaauguccaaggagccuagcugaagagucauggucuuagagauaggagaaaagaaaggagaagguggugggacuuaacagugcucugcccaaauguauauccauccauccauccauccauccauccauccauccaucccuccauccauaugcaucccacccacucaagcugagaggacaccaucuuagccuuguacucagcuccuugcaaugccuagaauccccagacacauauucacccccaugguucaauccacauuucgcuucagcuaggaaagauggagggggaaaaaaaacgcuucccauucaaagcagaguugucaaauauucuucaaucaucuuucuagaagcucugcuugccucucuggcuguaugcuuggccccaaacaagagaacccaacucaaaugcuaaagugaaagagaggaauauugagcugucugucacuugaaucuucuggaagcccagcugaggaaggggaaaccaaccuucucuuccccaacuuuaacacaucauuaagaggacaaacaauggcuacuuagggaugcuggauuccuaacagaugaugaagacuuagguccuugguguagaccaaauauuuauauaguaucuucccagucuuaauuccuuccugauucuuccauucaucccuucuuucugugucauccaaagcagccccuauccccaaagacugagcuccaagugagugcccugucggggaauccuccuaggaccccauuacagacagagacacccucucuccucuggccuugcagcacuuuauucagcucugcuuuguuauuaucucuccuacagagggcaaauauaacuguucccauuccuacacagugccaagcacagagcuagauacagagguacccaaucagcagcccccucgucaaagagcagaaaguuagcugagggucaacggggaaaucuaucaacugguagauaaaugggacauuauaagcugguguacauauaggauagaauauauacagcaacuuaaaaaacaacaacaagacauucgaugccaugcauaaaccucaaaaacacagaccuaaguaaaagacccaauuaggaaagagcccagaggccagaugugaugguauaaccuuguugcuuuggcacuugggaauggagccaaggaggauccggagcucauggcuaggaggauccagagcucagggcuagcuacauagugaguccagccuggacugcaugagaaacugugucaaagggguggguuggaauagacagagggagcaaaggggaaaagguagaaggggggauagagagcaggaaagaggagcaggggacagagagagaaagagaaaggguauauugccuaaugaacuuauaugaaucacccagacugggaaaaucuagaaaaagcaaguugaagucuguggcuuauagacugaugaggggaagaaggggaaggccugucuuaacaaagcaucccaaauuaaguggcucaaaacccagacguuuauaaccacagucugagguuagcagggucauguuccuauggugacugcagacaugagagacagagacagagacagagacagagacagagagagcccuucccagccugguuccuucuuuuuuccccaucuaauuuuauuuuaagacaaucaagagcaauagcauguaagguuuuuaacuuuuuaaaucuugucaugucagcaaauggcuaggggaguaaaggcaccugcugccaaaccugauuacccaaguucaaucccucugucccaaaggguagaaggaaagaacuuguggcauuagaacucaguucuuugcaugucuguguccugacucccuuucuauacggaauccagucacccugcauuaggaguccaccuuacucaucuuaacaaaauacaugugacucaauuuccaaauaagauuacucaggagucaggcuccaacauaagcauguaggcagauaacgaugcaauucaaucuguaacacugcuaauggguucuuccuggaaugaaggaaaugacucuagguuagauuauggugguagcugcccaaugaaaaaaauaccaaacuaauugucuuaaaugaguaagguaaaugguugucgaugcacaguugguaucaacaaagcuaugugaaauagaaguagaaaugcuuggguuucaaaggauaccauggaugggaucaugggaaaaaagcguguaaagguauagagaggccaauggcaaucugcccccagaaaugcaagugugacuggcaaguucccuugacccgauccccaucugucagggaagugcuguccugacuagacccaggugugaccaacucaugcuuacuucaugaggucucgccauguuagacuaaauccccucagacccaaagccaugaaagccucccuccauauguugcuucuucccagguauuucaucacagcagugagcaaagcaguuaguaaaacaacuauuaaggaucggcggcggcggcggcggcggcggcguuuuguaaaccugaucacuuuucaggcucacaaauugaaauuugaauugugaacuaacaauugugaaguguuacuugucagggagggcuggaaagauggccaaaugguaacaacaccgacuacuuucccaaaggucccagguucaauucccagcacccacacauuggcucacaaacacuguuaacuccaguccaagggaaacuaaugacuucuucuggccucuaugggaacuacauauacauaguacacagacauguauucagguaaacacucauacacauaaaagaaaaauaaauaaguaaacccucaaaaacuaaaauuaaauuuaaaaauacaagauaacugugucguuaucuuauauaaguagucaauauaauaucacauaaacauuuuuaaaugauccuaaguacauauggaaauguauccauaauauauucucacagacauauacaagugaaaugguacaaucuucaaauauaaccaccauauguucuuauaacucuaucaguccuauagaaagaucugacaaacacuuaaagacucuuacaccugucacugcaguguuauuuguaguaacgagagaucagaaacucgacucucccuuacuagaaaaacaguaacuucugauccaucuuaaucaccauggacuccugugucuccauuuauaaagaauaaaaauagggcugggacaguagcuaguggauuauugaacuuauucugcaagcauaaggauauaauuucaaacccucaacaccugugcaaaacuccaggcauagauauucaugccugaaaacucaaauuuugguuuggagacaagaucccaacaguuuacuagccagcccaaacagcaagcuuccaguucagcggaagauccuaucauguguaagacaaugaagaugacacccaaugugggacuucucauuuguauacauagguucauguacccauacacuuaccugcacauacuacacacauaccacauaccaauaagacagacagagagacagacagacacacacacacacacacaccacuacagauggacuaauguggaaaaaugcugauggcaaaugucuuacuuugcuaccuauugcauaacaaacaaaagcaaccagggaaggaaaggauuuauuccaccuuauaguucauagucugcuaugaacuucaagcaggaaccuaaaggcaagaauggaagcagagaccauggaggaaugaauggugccuaccggcuugcucuuuugggauuugucaacuugcuuucugauacaacccaggaccaccuaccuagggcuggcaccgcccauagugggcuugggccucucaugucgauuauuaaucaauaaaauguuccacaggccaaucugaugguagugugucaucaauccagguucucuuuuccuaagugacucuaguuuuuaccaagaagacaaaaaaacaaacaaaacaacaacaaaaaacuaagcuagcacaacaaauaauuuuaaaguuauacauuaaguaugaucucauuaaaaaaagaaacccauaacuucaauauuuauauaguuuuuggccccaaaauaacauugaaugguuucugauaaugcccauguuauauuuccaagggaaauacaauaggucuuaaaaucaaggacccaguaggacuccauuuggguaaacauacagaguuaagcaagucuguguaaaacaugaagcucaugguaagagcucauccccugggcuguugugaucuacagaucaacagccuggugaguaaguaugcucacaguccauaacaguccccaaugucuuccaaguccccaguuccccuuagcuccgcaaggguccaucugaggccaccggggcagcugacagcuuccucccauucauuuuacccuggcucccagugaaggggcagccagaagaacuaagcuggagacaaaagacgagguacacauccuuccuugaugugcgggcagcccuggcugcaagcccagggaagagauagggacagaacugguaagcccauccccaccgccuuaucaggaagguucaggccucaauaugagaguccuggggacugacuccacaggcccagaaagagguacaguugggcccacacaggagacggcuguuacgauucauguuugugauacaguuaggucaaccugggcauggcuggagagcagaagugaguuuccuuccuggggcaguggauuuuaaggucaacucuucuucuugcauuuggggaaucagcucuggggaauucccucuuacaucauuccucacuguuuuccugacccugcagaauacaaauaauaauggcuauuuauugcacuuacagcgugccaggcacugaaagcuccuuaaggucauuacaucauugaaaucuauccauagucacugcgacuagcuaugguauggauaaggaaacagagguuagagaacuuggcaaagccuacgccuugucuuguuuccucauccuacugcugugauuaaaaaaaaaauacaccccuggaaaagcaacuuaagggagaauuaagaauuuauuuuagccuacagugcauggguauguccaucaugguggggaauccagagcagggggacuugaugccaccggucacgucacauucaaguaauaaacugucuccaucauaagaaagcuaagggcuaugaaugcauaucacugcucagcuucuccucuacaaacauagcucacagcgaacggugccguccaugguggguggccuuuccaccccaguacaaucaagauaauuccccauaggcauggucagaguccugucuuuuaggugacucuagacucugucaagcugauaauacuagccuucacaccuucuacagacaagaggagccaggcucugguccauaccagucugaauuaucccuaucacauuacauggacauucuaguuccagucaaggcuugggaagagagaaggugguaauuugaaugagaauggucuccacaggcucauagauuugaguguuuuguucccaguuagcagaacuguuagggaaggauuaggaggcguggccuuguuggaggaggugugucacugggguaggcuuugagguuuuagaagcccaucccuggcucugguuuucuuuucucugccugcagccuaacguuccgaugugagcucuuagcuacugcuccagagccauugcccgccugcccgcccugcaaacucaaauccccuacauaaggaguauggaguaacccucugaggcugugggcaagcuuccaauuaaauacuuccuuuuaauaaguugccuuggacacgguguuuuaccacagaaggggaaccguaacugagacacgaagaaaggaaaagacacagugaagaugcuaggcacaguguuaaccaagaaauguucaaagcacacuaagucagagaggcacaacgguucagugguuaagaggcuuggacuuuggggugggagcaacaguuuacucaggaaagugcuggacaaacgugaagaccugaguucgguucccagaaaccaugcuuuuaacaugcacacaugggggcagagguuugcaaccccagugcuagggaggaagaaacaucuggaugccugggcaccucuggcauacuugccgagcuccaaaacacagaccugacucaaaagaacaagaugcauagcuccagaggaacaacacccacaguuggcuuguggcuucuauacauccugcauuaaugugcacaaauaugaaucuguauacacacauaaauacauacacagagagagagagagagagagagugugugggggugggggcagagggaacugacagagagacagaaacaaaccagcaggcagauagacagaaugacugacugacugacugacugacugacugacuuagaccaauuuggacuuuggacucaaacagaccagacucacauuuaucucuaccucucacccuggugaacuugaaaacauaauauuucagagaccccuuuugcaaacagacuagcauaggucccuauaucucauacagugacugugauaauggcacuaaccagcuauguaaaggcugcagaccagaccgguuacguccauuugcagugaggaguguuacugcugucaccauuauuaacauccaaccaccaucccuaguuacccuccccccuaaguucuuuagcagaguggacucuuaucaagagacgguucccagaacuuaagaaagacuugacagguaacaaacacacagguuucucaauauguuuugugcuucucauuuucucagugguaaugccuugcaucaucaagauuuucagaaaagauguucuagaaggaagugguagauaaaggcuugaaaacccagcuaccuggaaggcugauguaggagcagucagucaagggcauucuggacaacuuaguagaaaaaccugucugaaaaaugaaaaguaaaaaaagaaagcuaaagacauagcucaguggaugagugcugggcuagcagaugaggcucucaguuuaguucccaguaacacacacacauaaccacacagacacacacacauacauauacacacagacacacacacacacacacagacacacacacacauaccacauauacacacauauacacacacacacauacacacacauauacacacauauacacacacacacauacacacacauacacacacauacacacacauacauacacauacacacauacacacacauauacacacauauacacacacauacacacauauacacacacauacaaacauauacacacauacauacacauauacacacacacauacacacacauauacacacacacauacacacauaacacacauacacacauaacacacauacacacauacauacacacacauacauacacauauacacacacacauacacacauacauacacauacacacacauacauacacauacauacacacacauacacacacauacauacacauacauacauauacacauacacauagagagaaagacagagacagacugacagacacagagacacgagagagagagagagagagagagagagagagagagagagagagagggagagggggagggauagggagagggagagagggagagagaaacaaaucuuuauuuuuuaaaauuaaauuaacacaggagaguggaguaaugucuccaugaguuaagaguacuggcuguccuucccagaauccacauggugcuucgcaacugucuauaguucuggcuccagggcaucugacaccuucuucuagccuccacgggcaccauguacacacguggugcacagacuuagaugcaugcaaaacacccauacacauaaagcacaguaacaaagucauuuuaaaauaaauuuaacacauacugaaaaccuacuugacacaugacagacacugacuagagggauacagcccagcaucucuaagccauaaacacguucguguuuguguuuuggguucaguggcuuaagaccacagaagcuuuucuucgccccagcccuggaggccaaaagaauaaaaucagcauuacugugccaaagauccaggcuucaacagucuccaccucugccagcagcgguggaugucaccguucucagcucauucaugcaugcgucacuuaugcucuguguauguggucccaccacccucuccugccugcgaucaaaucccucucugccuuaaaagcagagccuccugggaguaguggcgcacgccuuuaaacccagcacuugggaggcagaagcaggagaauuucugaguucgaggccagccuggucuacagagaguuccaggauagccagggcuacacagagaaacccugucucgaaaaaccaaaaaaaaaaaaaaaaaaaaaaaaaagcagagccucuggggcucagugucaacacacuuggucauuuccauuuuggaggcuaucugacacccugguugacugugcagggcgugacuucaagagagcacucgcaauuauuaauaccgagaccagcucugaacaaucgaccccaaaaagguauuguuuccagucauuuggaaaagauguaguccacccaggcugcugcaacaaaauaccacaagcagagaggcuuauaaccaacagaaaugaaugucucacgauucuagaauagcucguaucggccaagagccacugugcuaaguagauguugauuuuagcugcacuuucacauagcaaguguguucuagcuuccugggggcucuuagaaggccgcuuaacucaagccaugaagggcagagacagcaugacccaaucaccuuauaaaaccaugccuaacauauccccuuucaguacaugggcuugaaagagacauaaacccccagcccauggcaaucagacagccugcuauugagcaaguguggcugagaauagucugacucgcacggagauccuaucagacacugacauuccauuugcucuaccaugucagggcuucugcacaugggaacuguaagauguaauaaaucugucuccaagcugcagugggaaacuacaacucaaacagaacuuccaggucacgcuagggcaaggccuaacagcacuccgcauucauauuaacgcaugcauccauucaucgccuuggauggaguaggccugguucuguucuccguauuucccacccaaaaauacgucugcggaaauuuucagauagccacaggcagcucucauuaaauucuguucuccccacccagccacucagcugcuuccuuggcaccaagucucacaggauuaacugcagggacccgggagcccagcugcacacaggcuuugcaaaaacauuuggaauaccugagaucugccaaauacuugguuaaaguacgcuauccuuuaauuucuugggccauguguauuuuaagugaaauguaauccauaugccugugacucauuuuaaugcaacucagcaaagcaaggucuccuaagggcacugggucgccagcuaagccuuucccagcgucucuuugacccaggaaauugaauuuugccaacaaccaauagaauuucugaccagaugaaauuucugaccagacagggccaaagugagguguccuugacucuagguaagauguugaaaucuguccccaccugagaaggugcugggaugaagcgcgggggcaggagugccguccuguuugaacuggcugaauguuucuaagagaauuccauggaagaaagacaaaccugagaaugagaggcagugaguaauuugaguugucugcugaagagcacccucugccuggugauucgccaugcaucugccccucugucauuaaacgauccaacuagggcuaaggggaaagggaggcugguaacaaguggcuguggacugauaugguggcagcucauuagaugugaucuccuuagaugggaaggagagggcagaggcuugucaugaguuuggugacauccugggcuaucgaguaagacccagucuuuagaaaacaaagagaaggaaggaagggagggagggagggagggagggagggagggacagaggggagagagagagagagagagagagagagagagagagagagagagagaggcaaaaacaaaacaauucagaaaugacuuaauuuucuaagcugacucuaaaguuucaggacaauaaaaccauccuccuaucuauaauagcugagcuaggaagaaagcuuauugucaaaagucauagugaauaguaagacucuuaaaacucuaacccaucaaaaguuauaauggguaguuaaaccccuaagcuccacaugccugaguucugccuuaguauugacagcauaaaccagcccagagagccauuguuauugaggagccuccaccuuaagaucaaaggaccucucucucugucuuucuucuuccccuagucccccuuuuuuuuucuuaguuuuucaaaguuucuuugugacauccuagaacuugcgcuguagaccaggcuggcccugaacucacugagaugggccugccucugccucaugcaacaccaaugguaugggcggccaccaccugccacaucccuucucgagaccaauucuaaacaucgcuaggauuuggacucaaguccgcagaguagccucaagcgagaagagucagccucggggugugcucaggggacaaguggcgaggacacggccacagcacagauagugcugacacuguuccuccuucguugguuggugacauccugguuguuuuugagacagggucucauauagcccaguugugcucaaccucagaguguauucgaggauggccuugagcagcugacccucccuccuccaccucucagugcugggauugcaggcgugcaccaccagggcuaaguuauauccugcagggagggaauugaauccagggccucgcucacgcaugcuagccaaguacucggacugagcuccauccccgguccucauugcuguugaaggugaccuuguaauacagugauuuuugcccccugguucagcucugucuuagaaucagcuugaacaaguuaguggaguuucucuuagaaaagguugccgcggggcaagagaacuagaguccacagcccccaggagucugucuccuaagaugacuucagcacaagaaaagugucucuaauugaacagcacauaaggcuugucagacacggccccuagguuaauggcaguccucagaacaggggggcgagucacagaggaaaaaauauuauggauguaugccaccaaauuacaggcugugacuaggagccuguaauuuccauccuguaauccucccuucucuucuuucugccgccucaacuggugagaccuaagcuaacaguucaccccaacuucaaggacaugguuggagaccguuucuuugcauccugcuguagacucuuuuggggggaggggcucuccugaagcaggaacuucgcauugccacgcagacagcguccuuuaaauagguaacacaggaaggcucuugaagcccaacuugaacaaaaaucucauuuuacagaugagaaguuugaagcucaggagggggcgcugguguguucgucaacucuaaguuacuucuaugagcuuaggacuauguccaccagacgggaugccugggugacaagggacugacugucuccuaacaacugugcagcaguccaaaggucuguagcuuguauauguuagauauuauaguaaauaacauuauaaugcuguccugagacugagcagaauaguuuucaugacacucauguguauacaauaaauuuaacagaauagaauagguuuauacggguaaaaaccuauuuucuggaggcuguagcuaugccuuacaggcuaagagcauuggcuguucuuccagaggaccuggcuucuauuccuagcacccacaugguagaucacaaccauauguaacuccaguuccaggggauuugauaccacugagagcaccagguaugcacauggugaucauauauacaugcaggaaaaauacccaugcgcaagaaauaaauauaaauuucuuuuuaaucuuuuuuuuucuuccccagcuacccuagacgucuguaucagauucccugagacugcauguugacaggaucuacgcucucauaggcacaagaaaggucuagaaaaucccccaucagacagcagugagcucuacugcuuucuuugcuuggcacugcuauguguucuauacugaacaugccccacuugugcaauuugcaaacaguggagcaagaaaugauaauaguugcccuuuacugagugugcaguacaagguagacacuggguuagguccuuuauacacacgcagcaucucagccuccccacgcuuugagaugcaggacugugauuauaguccugggcgaagggacugagacuuaaagggagagaauguaggugcugaaugguaaggucagcaucuaaaugcgagccacaacgugaagccacaugcucauuuucucacagggccauaucuguuuugccagcgcuccacagaaaaggagcuaugacccgcuuguccugagcggcuucaaacuggagaaaaaguaggcccuggcucugacuccgcuaaagcuccgcccgccacgucccaucuccugaccccuccuucccccaccccacccccaccccagcuccucugcccgcaccauucuuggcuaugauuucuccaugugugaauuccauuaaggacccgcucacugcuauuucgggccgugcauuagcacgaggacuuuaaaucgauggggaaaaagccagacaccucagagugaugaaaaacaaauuucaauauccuuccccucaccauugucucagaaacccuugucuguggcucccgggagaccagagaauccaaugaacagagaagugggauagggaugcuaaaauccucguaaucuacaggaccucugaacuugacuguucccuccuugaaacucucccacagcugucuccacagcucacuccuuuaguucucugcucagauuucccaugaucauuucugacugcuguucaucaacaucggcucccucccaccccccaccacccccaccacccccaccacccccgcucuuccugagcccaguguuuugcuuccuguauacaauucucauuauuugauauccuguacacuauccguucacucccuguaucccuucugacucuagcaagagcugcaggcuggcagaacucuuuuccccacagcucaacucgaguccagggaccuacccuggugcccagaacgucacaguucacgugaaaacagacagggagagcagaggcauccaccaagagcugaaacgaacaaggcuugggaaguuucugagcacggaccuagauuccuuccauaccaccagaagguagaaauguuaacauaguaacuugaaaacucagaaaaauccccucuccucagcccagagcuguuuugagucugggcuuggcggccugugaaggagaggacguggggaaaaauagccacaccaggaagugcagugcaguuggagugaauucaguucggcaacacgugugcaaaaacaaaaagcccaauuuggaugagaaaagcaggaaguccuuccccagggacaccuggugagaucaugcuguuuggcugugccacuuccacuccaggcugcgguaggcuaaaggaggccaggaaccauaucuccacgggccucccugggaguugguggaggccaugggcagacaauggguggcaccuaugaaaaaccccuagcaguucaguagguauguuaaagaucaggacaagccgggcguggcggcgcccgccuuuaaucccagcacuugggaggcagaggcaggugaauuucugaguucgaggccagccuggucuuuagagugaguuccaggacagccaggacuauacagagaaacccugucucgaaaaacaaaaacaaaaaaacaaaaaaaaaacaaaaaagaaagaaagaaagaaagaaagaaagaaagaaaagaaaaggaaaggaaaggaaaggaaaggaaagaaaagaaaagaaaagaaaagaaaagaaaagaaaagaaaagaaaagaaaagaaaagaaaagaaaagaaaaaaaaaucacgacucacgacagggccugcucagugaagcuuugccuuccggaguucaguccuagaauccauguuaacaauaacaauaaaggccaggcaggugcuugucaucgcaaagaugaggaaggggaaacaggcagauuccuggugcucuuuggcaagccagacuagccaaaugagugaacuccaggccaaugagagaguuucuuucuuucuuucuuucuuucuuucuuucuuucuuucuuucuuucuuucuuucuuucuuucuuucuuuccuuccuuccuuccuuccuuucuuucuuucuuucuuuugguuuuuuguuuguuugguugguugguugguuguuuuuuuuguuuuguuuuguuuuuuuauuuuuuuauuuuuuuuuucgagacagggauucucuguguagcccuggcuguccuggagcucacuuuguagaccaggcuggccucgaacucagaaaucugccugccucugccucccgagugcugggauuaaaggcguacgccaccacacccagggagcucuuguuucaaaauaaaguaggcagcauuccugaagggugacaguugaggcuauccccugaccucugagcagacauauccauauucaaaccuguucucucucucucucucucucucucucacacacacacacacacacacagauacaaauacacacagagacacauacacaacacacacagacacaaauuaaaaagaaauuuuuuaaaaaaucacuauauugacaacuccacgugcucacauucuacgcuuugcccacucggcccaucccucacaagcaccccaugaggcagccaucacuacucuccucucagauuuccucagcuugcccuaccuaggucacaugcuacaacuccacauccaagccaagaacacaacugacuuccacucgcccucuucauacacuugcugggugacuuuagacaagugucucucccuuucugugaugaaguuucuguacuugugcacgagaccacagcacucaggagucccuagugcagugguucucaaccuuccuagugcugcgacccuuucauacagcuccucucccuccccacaaccauagaugauuuucauggcuccuucauaacuguaguuuugcuacuguuaugaauccucaauguaaaauuucuggugacagguuugccaagaaagagguuuugagccacagauuggaagcucuuguucuaaagaaaucuuccuagccuaacuuccugugaucuucuacagaagucccaacacagaaggaaaggacaagggucccuccuuagcugauucagcuaaggcucggccccugaacguaucaucaauucaguggacuuggggaagagcgaggguuaaauaggacagacacggacagcagucaggagcagggaagcagcuacucaacagagccaguaaggcaccaaacagaucccuaagagaagccaagcgcaaacuagcccucccugagccuuggaggagcacagcaucacagucaaagugaugcccugagcaaggaggcgcuucccacacuggguagcuauccccggggaagagaaggaaagaaaccauucagcaaaccaauaaaaggcugguuuugcucugggagaggggagccaaaauggcagugaugucuaucuuuuugggagugcugaaaugaaagccagcggcagagggaagagaaagggacagaacucuguguuauguagcaauuuccuccauaauaaaccccaugcucuuuuaagacacagggugcuuacuccagaauguguuaaaacauuccauucugcugggaagcucauuaaacucagaaaguaaacaauaaacaacccagggcuucaaggaaguuccugaagaugaccagaaucacuagaccccucccuccucaacaauauauaagcaguaaggacuaccuccuucccugaggcucagucuagucaacccaaacccagcccagccccuuggaccaggcucacaccaccagagcugccugcaagccaugcagugaaccucaggcuucuagcuuucaugaguuguuacccaugcugggugggccuuggugaggcugcuaucuuuugagucacuucuguacccauagguaacccuucaccccuauuacuguaagcaaucccaauaaaaauuacugguucacaaauuuggacuuugguggcauccuuacuugggccugucacuggcaaacagauguucguccacaucuccauagaguaguggcacaaaacacccugucccugcaccagcugcccucucacagcacuggggacuucucugcaaguguccaacgagcccaaauuuggaauaaauccuucuucucccauuccaccaaagccaggcagccauucccacugguuuggauggggaaggccuugcucuagccccuucuuggcaacgaagcuuucauuacucaucagcuuccaggguguuuuggaggcugccaagagcagacgggcaacucuccaaaccaagcauccuuaucuacaaugucaauguggacgauaaaaagugggaccauugguggggaaauuauaaaagccuucagagucccuagccaaguaggaggagcucugggaggccaggugacuggggcugacggcagaaugggcagucaaucaauggacacagcugggcagggucaucuauucaacccugcacccaugaauugagacaguuaugccggaaggcgaaucaaugcggagauauuucugaacuaggccgacgcccagcaugaaugagauuagggaaaagcugaacccgaggaagccaggcggcuucaagcaaugcacuucucagcagaaucuuggguagaugcaagaaucagggucagaggugccaaaucccugcccagccugcugcuucucccgucucccucuaaucgccuucauuuccugccauacacugagcgggagcuaggacagcagcagcugccuccagucccuucccgcccuuagacacacacacacacacacacacacacacacacacacacacacauucggccccagugaacuccacgaugcaccggaaacacagccuaaggaaauccaagcaggaugugaaguaucccgccaaucucccagcagucaaaagaccaaggaaaagcucucucuuggcaagaggcccugcaaagggaccaaggaugucgagcuuggggcagggagcgggguggaggcuggggggguguggugugggggggcacaccacuaaacuucuuccuuuccaacugggacaccugggucagacuggcaucaaaugugaguucauuguucugugucagacaaaagaagggagaaacccacuuacucguucuucuccaggucuaggaucagcucucgcccuucagccaugacccugagcucugcucugaguggaugcuaaaaacaacaauaaaaacgugucaguuccuggaagcagggacccaggcucccagggccccagcaccggaucugacauggugccagcacagggauccuccggaagccagcgaggaaaggucaccagccuuuccagcgugaagugaccucaguccccaaacaacccgaaucuuccccaucugcuuucucccagaagcagaggagagacagacacucaagcugagguccaaggcugagcagguguacugcagucuuaugaagguucucagaaguaaauucccuggagagucagacccuggaucaguguguguacaggaugucaccuguaauugugggacccuggaccgucacccagccucccuacaucucucuuuacucuucuaugagaugguaugguaauaaccaaccuucugaggauccuuaaggacuagaggaacaaauaaaugaagguaaaugauguaucacagugccuaguucaaaggaagcugucaaucuuacacuggcuaucaucuuuaaaaaaacacccaagugaguucuuuuauauuuugcuuucuuuuauuugggccucaauuuggacacuccaaucaucaaaggggugguagcuaaagccucacaaauuagaguuguauaguaagucgagucagauguaucuuacacauaagcaguuugucaauggccaaacacaccauacacccagcacagaucaucuaaaacaugcaaauggccaauaaaccugaagagcagugcugagcaucaucaguaagcacuguccucucucauggagggagggagggagggagggagagagagagagagagagagagagagagagagagagagagagagagaguauuuuaaaaaagaggauagccuaagaaaaaucaaaagugacauaguccauuuaaaacugugaaucgcagugcuguguggaacauacuuuaaaauggucacccugagauccucugucugaaaaauuuaacuggaaccauuugaaaaauaauuugacaacauggaccaaaauuuaaaaaaaucuuuaagcuaacuauggcaauauaaggagccagugacacuuccuacauccuucuucuuuuucuguauaaguguggacugugcgagauacccaggaccucaggcaagcucaguacaaacugagccacacccacagcccaaucacauucguucucuuaaccccugcuccacucauccccaacugggaucuuggcuucagacuucaagaccaccaaagccucagaugagauaagaacauuccagucagguaccugguccaauacccaguuaauccuguugccucaucuuaagagggggcauucgauauucaggaggcagggagacagaugggugcccaggcacucccuucccuaauucugaagcacuaauucggcaaguggcugguggcucccacuugugguuuugcccuggggacuuuuggagugagagcccugcccagucacauugagaaucaaggacgcacagccccugugggcauuugagcacaugacuacagaagucaaacaaguccuuacccuggccugaagguggcacccaugugacgggccacacggaaaaaagaaucuuggcacugagcaagugauaccaugugccccccacagagacauuacuugacacaugagagcuaauauuuauuuuuauuuaggugauccaaaaguacuucucucuguuucuggagugugcucagacacagagguuuaaaaucagauguucccuguuucuagggaacagauccagcacaacacaacagugaaacugcauuucucagcucuccggagcuucccuguccagcucgccuacggacagcuucccuccuggaacuccaacagggccugaggaagcacuggaaggugaccccaaugcucacacgucccugagagacccccaaaucccuucuguugagggcaaaauuaaacagcuacacaccaucugggacaagcuuguccuguguauaugcaucauccucaaaaaucucuauuagacuucauauacagucagugucuaagcgaugucuaauaaaucaaugaauuauucagaugcaaauaagaaucagaguaaacuaacacacuccucucccucucucucucucucucucucucccucucucucucucucucucucucucucucucccucucuccauauauuuauagugccaggcacugggcugcugauccuuguagaauacaaugagccacauucugaguagacaauggcugggaacaaugacaggaucugguccuccgcuuuguuucucggauccuuccugaggaugcccaacauccaacaucuggagguaacaaaggaaccucuauaaaaaggaucauauccauucuucggcaauaaugguaguggaugaaauauacaagaccuuacacuuaaaaaaaauaaucugccugagaacggccauccauuaauuugucuagcauuuccuuaaggcuauuuucagccuuuccuacuuuaggaugaaaugaguucaugauuuuuuuuucuuugcuuuucggguaaaauguucccaacuuuuauuguccugcuuuuaaguucucuuacuaagcccaagcggugaacuugggggacaugucugcaugacucuacagucacuuaaggaauucuggguguuucucaucuguuuaucuuuccagauuccagggccacaauugucugaagucuuuccugacacuuccuucccuggcuuuaaucuugcuccuaucuguugcccaauaaaccacaggccauuuggccccuaagagaucauagaaacgaguccuucaaagugggcacagugcuuauccaugcagugcuaggacugggaaggugaagcagcauagucuccacuuagaggccagaguaggacacauaaaaggucccgcugaaaaagaaaguuagcccuucuccacaucucuguuccucuuuauucccacuaaaacuggauuuguaaaugaggaagcucaaguaaaguagaaagucacauaagacguuacugucacgcaacuaccauauuucccuuuugagaacauccucaauaugagucugcuugguggaccauguucugacugucuuggcaacaucuguguauuuugcuacugcucugggccaaggaaucaggaagauauuuugagauauauaaccuaauccuagcucccuaucuugccucuuauuaacaaaaaauaaaaauaaaaaaagaaaagagaaaaagaaaaucgcuggguacccaugacacacagugugaucuuugcauuuucgaaauggaagcagguagauuaagauuuacauacaggucagccuaagcuacacuggagacugccucaaaagagaacugggcucggcacaugaugacacccuagacuaugccuucaagccuagauccaggagauggagacaggauuucagagaaccugucucagaaaacagaaagacagaaaaaccaaaaaaagaaaaaguccaaucaagaucuauggcaaauucacacauuugcacguaaucuguguauuucuaaaagacucuguguguguguguguguguguguguguguguguguguguguguguagggguguguguguguguguguguauguguguguguaggggugugugugugugugugugugugugugugugugugugugcacacaugaguguuuugccuacauauauguaugagcaccauaugcaugcccggugcccucagaggcaucuccuggaacuggaguuacagaugauugugaaccauccucuggaugcuuggaccugaaccccaguucuaucaagaacagcaagugcucuuaacugcuaaaccaucucuccagcccaguucguguguuacugugaauuuucauuuccucaacuacaagggcuugggaaugggucuacgaguucgucauagagugaaggaaaguccccgcuaagauauccuaaguugacacagcuagaggaacugucauuccugcuucuccaaggagcuuggacaucuuaccuuuccucucccagggcuuucugaaguccgccacugagguauuaugaguucaugcuguagcggagggcuaccuucuuggcuuccuccugccaacacaagacaacauaaccauaagaaaacccaaccuccacaucucgggcacucaggagcaggcaugguguucagaagcccaaguggugcuccaaagcacuucugaggcagucauugcuuccuggaaaaugcuccucccaguggucucagaagaccugcugggcgccacugggccuuggugacaaagugauaaaggcuaggcaaacaaggucugugucccccgugaagagucaggaaauaagcaaagauucucaggugcuacuuaacagcccugggggggguggggggggggaauaauaagauugugccacaggauaaagggaagcuggcaggguuccuguuuuaaacaggauggccagugugaugauguuuaagaccugagggaccagaggaagccauuuaugcaaaaaucuggggaagaguaaagagugucaacuguagacgugggcccgggcucgcuaaggcacacgcaggaaggagaaauagccuacaaagucaggggacauugguaaauaugcuaagcaaggguggguaacucagaggauguugguaagaaauauauaugcuaagugagacggcugugguuguaauaacauagaggcaugagcagggucuggguuucauuaccuggaagguuuugaugucuuuagagaaaaaaaaaaagccccacaagagcaguaugaucuguauugguuuuguuuuuguuuugaaaggugacccugccugcugggagaauagggaguaggggacaaggacagaggagaagcagaaaggguggcagcaaagcuagggggcgcaccggagcucuggugagagaagauguggcucuaacuuggauagcauccuggaaggugaugauguggugaggugcugaggagaugcagaagggugugagcucagguuuguuaccaaagagcuuuaauuucccccuuggaagugacacucaccucccugggagggccagagguaaaggugacuucuucgccucccaaccauuaccauucacuugcaaauuguuaaccuuaacuuaaccuuccaaguguugaauucgaaguuauauuucacuuccuuaguuccaaaccuucucaccuccaguuuuuuucuuauccuacacaccuggguucuaucaagaacagcaagugcucuuaacugcuaaaccaucucuccagccucaguuccugucaguguugcugugaauuuucauuuccucaacuaaaagggcuugggaauggguugcugugaauuuucauuuccucaacuaaaagggcuugggaaugggucuaugaguuugucguagagugaaggaaauuccccauuaagauaucccgaguugacauagugggacugauagagguaggcagcaaauuccugagaaaagaagccuaagccacagaagagccauguucaagaauggaagaccucaacacuacuuacaggucaucuuuuuuuaaaaaaauauuuauuuauuuauuuauuuauuuauuauauguaaguacacuguagcugucuucagacacucgagaagagagcaucagauuucguuacagaugguugugagccaccaugugguugcugggauuugaacucaggaccuuuggaagagcagucggcaaucuuaaccgcugagccaucucaccagcccuacaggucaucuuuuaaaagauaagaauuuccugaucccuaagcaaauuacaucucugaaacugaguagaucugaagacucccagagaugucaccaaggaacccuguguucuguuccuucuaacucagccucaucaaccgcaggagggauuaaaagaugacugagcuuuuguggcaaacaucuguaauuccagcaagacaacuagaggucuaaggccaucuuggcuaucuagagaucucugagacagcauccaccuacacagcauccugucccagagaagaauuaaauuaaaaaaaaaaaaaaaagguucugccaggcaugguggcacacgccuuuaaucccagcacuugagaggcagaggcaggcggauuucugaguuugaggccagccuggucuacaaagugaguuccaggacagccagggcuacacagagaaacccugucucgaaaagccccccccccaaaaaaaaaauuuuaaaaaaagguagcuggagccaggcagugguggcgcaggccuucaauuccaguacucaggaggcagagguaggaagaucuccgaguuaaagggagccuggucuacagaccuaguuccuggacagccaaggauacauaaagaaaccuugucucaaacaaacaacauuccaaaacccaaaccccaaaacaaacaaaaaaguguuggauuaccacugauuaaauuccuuuucaaaaauaugauauauuugcaaucaaaauguauccuuaaaaaaagucuuauugguuuuguuuacacugguacaaaucagaagagauagauacauuuacauuauuuacccaaaacauccugaguucuuaacccuaugcuacuacgcuaggugcuuaauguucaugagggaacaagugagacauaguccucuacagagacugauggaucuagacucuuaaacaaaaggagcuguacaggauagaagagaacgacaaaaggucucggauggugaaaagcacugagggcaaucucuuuacacacaguccaguuuaaguacacguaaggcaacguaacuggagaaggguugcucacaacuugaaaauaaggccagagcacgugggaucaagcuuucagugucagaccuggagcgucacuuaacaaaggguaagagaauguuaucucuggcucacuuguuugcuuucggugggauggccuguauucggugaaguuuaacauuaacugcacgccugugacagacaaagaugcaagugacuucaggaauaggagagggagaaccaacaacugcuugauucugucucacccaaaggaauucccuaugccacucccuguaucaccggggauauuguuuauguugauauugauuauguugguauugauuauguugauauugauuauguugaugcuuuugaccagcuuuagcagcugcuuuggccacuucauaaaugaaagaaaaaaaaaucuucgucacauuuguauaagagccaggaguuuaacuuugaggaaauuauauuucuguggucucuugguagaacuuagagccauuaaaaucauaguuuugggagaugucaugauuugggaagcaccuuuuaaaguguaugaaugguacgauuccagauucaucaguauauagucauagaaggacaggaagggggaaaggaaaauauuaauagcaacugcucauuuggggaucaugggucacuuuacaacucguagauuuugcuuucuccccgggucugcagucacucuaccucacugacuguucucaaggccuccagaucccgugaaguuuacuuuccugucuuucuucugugcaaaugguaggcuggaaaaucagacucgaacaggaccuggcucccucuuccccgaggaaccccacaccccaacaaaaggaagagccuucuccuauccaaggcaaaggagcuggagcguugaguggaggaaacccucgggucagguucuugcagggauggggcgggggcugcagccugcccagcccguacacuagggcgucguuagcuugauuuaaaaacgcugacgguugguacagcaagcacccgcgaccgucuggagucagcccagcucuccagcugccucagagcuaaggcuaaauaagcucucccgggucaagaugacagaagccaggcauugccccuccgggaccgucccuuccgcgaaauccuaugagaaccucugagggaugcggcccgggagggagcggugccugggaaaacaguugugagaaauaggcauuauccagcguccaaacuggaagcguggagcccauuccauuuucuucacaugaaaacugaggccaagaggagauaggcauugggugagguggaaagaaagcuccgguuuccaguaucagaucuucaauguggggcguacuuauacacaccuggguuuuuguuagugaacuucagcuuacgaucugcauaaugggugcgcaugguucuuuuauggucuuucagagaugcuaaguguacaggcagagauaaccaguaaaccacccuacccuaaucucucggaaaccuuugauuuucuaucccacugguaugcuuuugacaccaccacccccccgcccccagcaagauccagggagugguucccucgccgauucgggauaggaugcuuggggugcuccucuggggaugcucugggguugcuagagcagcgggcgcaaaauagcgaugagagagaggcagagcggagacgagcaaccucaagaaaaacagcaaagauaggaagagcagcggaaagagaagcccaaaguaagaaaacacggggagaugaagaaaggaaggcaagcaaagagagagagagagagagagagagagagagagagagacuuacugcuuucugauugcagugagcgcacuagcuccacgaccucccguggcucaccacaagagaacaaagccugggcuccuaggcuuggggguggcgauacucacacccggggaguggcggaguccgcagggauagcggucauggagcugccggcaugcaagagcgacucucagacccucagucaucaccaccaccccuagucgccucagaacccaucugcgcgcugccacuuacuugugguccaucccggcucgcacgccgccagcggccaauguagcugcagagcgagagccagcaagcagaaccgggcgacgcccgcgcgcccgggcaugauagcaacggcccucucacuguccgcaaucacacauccccugccauugccugcccccggccuagcggcggcggagguuuucaagcaaacgccggccuaaaagccacccagcccacaucccagacgcuccgccccuagccccucagggcucugccuggaaugggaggaggggaggcgccacgcggaggaggggguuggugguggcuggagggacagcagugggaggagcgagggaagccccccgggagcaucgcugacucaggugaaggacacccaggggaagggaugauccgaauuucugaaguaaucaaccauucuugaggccugggagauuacaggacugggguugaaaguguuaaacacacacacacacacacacacacacacacacacacacacacacacacacuucugccccacuguagcuaguuuacucuaucccgcuuuaugcuaaguacuuugggugaccaagacaacucuuuguagcucuaccuuccaggauugacuacucuuggagucaggcugugaaagaguuaauuccaagggacugaaaugagugcuaaaagaacuuguuuuccuaucgggacuccaaucugggccuuuaguccaggccuucugacacgggaggugggggguggagggggugggguugcagauccagcaucccagaggacagggcuucuguacuccagaaacagaacaccaagcccaagaaacagucuagacaggauuacagagaaggagggaagccuugggcuguauagguuggggacaggagagagcagaauuugggaugguuaggguuuaggaugcaauggaagaugaagcccacaaaugauggcuaucacuaagaaaauuacaguagcagacacuuaggacuuagcuuuuauugacauuccguacgugcuagggccucugauaguugaucuugucaugaguccgcuguggacuggaaaugugucucagcugguggaaugcuugucaugcacucaugaagcccuggguuccauccccaggaccucguaauuccaggaguguggugcaccacugugaucccagcacuuauggggcagaggcuggaggauccaaaguucaagguuaaucucugcuacguggugaauuugaggcuaaucuggacuccauugacacaguguagaauaacagugauaauuaggcgaccaucuggaggggguagguauuggcuucaucucuaucuccccucugggggaggggaaucaaaccagaaaagcauuaaguccccucaccaaaggucacaaagcuaaugucuggguuucacuuagagucuguauauuugcuauuacaaagccuggugcaacaugccuuaguugaugaaugaagaacagaaaaaagagauagccagaaauaaucuguauaggguugguuagcaaaacuccaagggagaggaggcucuggaaggggagucucgcaccuacauuugucaguuccuuuccccaucccccacccccaaaaccaggccaggaacucucaaaaccaaugcaccgugagucugcaaggcucucacagagggaagggaucaaaccauucuuaccauugguguggacaggaacugugugaguucucuccaucugcug

SEQ ID NO: 5953 - RNA, 4344 nt, Mus musculus
cugcaaguccauucaacuuuauuaguucacagcuagcagggaugggguagaacauucuggacagagggagcugggcaggagcugaggugaggggugaguaaugugcugagguggguggguaacuggggacauggggagucuccuuguggccucccaguuucuuccauuucuugguugauuuaucauaacaucaucaggugauucugggauucugggcucuguaaguuccagagcuuuacagacagagcuuaaaggccauuguaggugucuagaacuauuucugagaggaaggucuccucuaccucaugugacuuauuuuguuuccucacaugugcacaucuucauuccaagugauugucgccacuggguccauucuaauuccucgguccuucugcccauucacucaauggcauuucuuauauaccccuuguaggccagacauggguuagguuguccaugcucgguguccaucgggaauggagacaugacguacacccacccacacccucauuuccacaguuguggagggaauaguuuccaacaagucccaccaaggucacaauauguacaauuuaacccuuacaauaggggcucauguagaaggaauaaagaaacaugucucccacuggggaugggggggggggggcgagagacaccagugauuuucuugcuaauggaacaaaacccagccaccuuugaucccauuuuuaaacucagcagagauaagccgagaugacuaugguggagugagagcuuuagaaguguggugaaccccagagaggcucuggcuggggcaccuacuguguaggaggaggaugcuagagaggaugggugucuucuccagagaagucaaacuguuuaagguaauuucucaaaccuagagaggcucaucauccaggggugguagcacucgccuguccuagcacugagggucugaggcagcaggacugcucugaguucaaggacagucuggucuacguggcaaguuccaguuagccaagacuguuaugggagacuguauccccauacacagaagaaaacaaaggaaggaggggagggagggagggaggaguggagaugucuugcagacgucauuucaagaggcuuagagacaugggucacaaacuaaaaaucugguuucccuucccaguucucuuucaaaccuuagcuuacauaaaagaaagacauuuguauugauguuaaugcuagucucauuucuuccaaguacugugccagauucaggucuagcuacuuucacuguccaucacauagccaugguugauuuuaauacugaaacagagucuuccguucuuugcuaggccuccaaauagacaauacugaaacaaugccuuguuugccccugauguaccuugagggucuguguuguccaacuuggggaccguugucaugugacaucuauacagcacugacaugugagaggacagaagugggaggucuauagacaaauuuucacaaauaggaccaacuauggagagcaauuuaagcuuuggaaaacggggcaucuccuuacuguugcucacucccuauagugaggcaguauggccgguugguuaccaaucucucuagcuaaggccaccaccucuaaggcauccuggauggcuucagccucugguucagcuuuggcccuggccccugaguucuuucguggcaguuccuccagggggaaccccugcaggucuucuucccucugaccaagagcuggggucuccucgggccaucuuaccaacccauuggcuuccuccauuuggccggcucuguaagaccaccgagguucgugacagcggaggcaccagaacuggaggcagaugaaggccagcacagcagugaagcaggccagcaggauggccaucagcacccaaagagaaaucuggggguccaccagggagcccccggcagccagcggacucuuauccaggguguggaacaugguacaguagugacuauacgggaaggcagccuucuugcagcugauacagaggaaguagagaguggaaggagcgagguguuccaaugccacagaggugaugguucgaggcaccuucuccucgugauggaaguuauagcgcagguauccggagaagauacuguuccaguugggccuguacauaauaugguaauaguccuccaagcagggcuccgagggugaccaggagaugauggcuccugugugagacacguucccaaccucaauguucaucccgggucuggaaccaaaucacagugaagagugacauccucccuccuacaucagcauuugacaucauccuagccgcugcagacugagcgcaugagauggccacagauacugacaucguuagagagacaaaagaaaauggacguccggagguuaagcuaguaagccagugguggaauacagguaggaaugaggacuggcucaugacaaagcuagcagcccucaggcucaagauguacccacaucaucccggccacagcccauccuggcugagauccaucacugacagugucguucccagcccuuccaaacacaggcaacgugaagagagcucugagggccuaccuuaugcuucucagcucaguccugaccucuugccucugcugugaaugcuguaauguuaccuagaacauucugcccaauggcuuuuuuuuuuuuuuuugacaaguuacuuuucccaugacuaguagagauucccucuggcgccccccaguggcgaucuaccucaaagcuucugcaaguguuuuguuuugucaaagcccaaggugcaagaaauuaguuucucagaucaagguccucagcucccaggauagcuuaacuucuaauugccccauaacuucuaaaaguagcaauaguacuaugacuuuugugacugucuaacccacuaguucccaacuuuccuaaugcuguaacccuuuaauacaguacuucaugugauggugacccuccaaccauaaaauugcuuuuguugcuacuucauaacuguaauuuugcuaccgucaugacuuguaauguaaauguuuguguuuuccaauggucguuuggcccccaaagggguugagaaccacagcaaaucggcaguugcuggauccaggcugugccagguggcuucucccacaauaacagacuccauucccaucuuauuaaugagcggccuggaguaucagcucacaggaagagagagaacuuacccacuuagccacuguauuucaaugcagagccccugaguucaguaauagauuauuauuguugauuauuuauuauuauuauuauuauuauuaaauuauugguaaaugagguacccugguuggcuguauggcagaugagcccuguucagauuguaagccuuucagcuuugguaaaggagaggcaucaagguuuuuggguuuucuuucauucucuccgauugagagaaagcuuuccuucugaauccccccugaucaaaaaucuagacaagcguugccaggcucuauauguuccggucucccucugccuucuucuccauuccccauccccagccagaagugcagaugcugcggaagauugaaauggcaagcgggcacguucagcccaaagugaauauuaagccaaacugauuucuguuucugggcuuguguuguuaggcuaggugagccaggggaaaacguaacagcgugaaguaaguuuucaguccuugguuuccaucucuaaagacagugacaugcuugagaaagcagcuuccuccucuccacguggcugggaauuugcacccaguaaaugggaaauacaaaagaugaggcagggguguacagagccucccagagauggcuuucagaaggaaacggacuuacucucccucgggucucuugauguaugcccaccuccccacccagggaccuacauacccaacaaacacacuuccaaccuccguaagugggcggaauucauacccuguuaauacacaggcgcccuguaaggcccucccaucggggugaucgggcauccuguccuuguacacauaccuccccuucugcuugccuccccccugcugcuggccaucuuauagccuggguucccugcagcagacguuucuaagagcuuccaccgagacugcuucuacagcaucuccagcuuccagggacaaauccaucucuucguauuuauuuuuuuuuuucuccccgucuucuguuuuuaaacucuucccauuuuuagcuauccaguccccacagccuggccccucuccaggcagagugugaaaggaaaagccauuuuuauuuccaagacagccauccaugccucuuaccugaugcucgcagugugucugguauagacgucuccccucugagccggagcggaccggaucccaggug

SEQ ID NO: 5954 - RNA, 1419 nt, Mus musculus
gcauuauucaagcuugccuggcucucuacuaguaugaccaaguagcauaggaacaaugcccaggcucucuaaauaaauacuagcgcauuguuuuuccuagaggugccucugcucgcguuucuacaccacaccaaucuuuccaguuccaugacagaaugugggcccccggcagggcuggggugccguagguguuagcaggcagccugcacuuggucugcacugaccacugccuugccuaugggcaccgcaaggagcuagcaguuaagcuguuaauacacgaguucauaacauuuacuagcuauuucuugacuugagaacugcgcaauguucucuauagcgucugggguacagacuagaagaaaauaagauauggaagugauauucucccuggaaauucaaauguaaaauaaagaccgcaacuuggaaaugugcuuaacgucccuggucuuccgaguggacggcuguucuguuccaagggagagcaucccauagacagacaucuacauacuaagagguaggacggcaguuagcuucagugcaacacugagucaagcuuccuauauuuagggagaaaacuuacagguccguccccccccguggaaacuagauauucuuuacuaguuuauugaauuuaaaaaaauuaagaucccgcauuuuuaagaggcucuuuacauacaguacagcaucuaguugacagauguggaaaucggucagaugagacuuccucauacacugccacgacguagaucugaugcccucucuuaaaagaauccucuaaaagaauccuauaaaaaacugcucccaagccccuccgaagucgcaacagugcagcaaaacccugaguaaguagcaccugcugacccggcacucacacucaaauacagacggaaaaccgauaggcauuuuuuuuucuucugugugcaacuuuuaaaaacaaaucauuaaguugaaauauccagucugcacagugcugucccuucacagaaggcaagaaacugccggaggagcaucuugucggcggcuggccucggugcuguaggcuaugaaagugagccuccuucagggucugguugauguggaaguaagggccuuggcauagugcagacugcucaggcaucggcuggggggcgugugugugggggugcuggggcaggauccggggaugguguggcucaggcugcucucuggcccacuggcccugucugggcuguugaugcugcugcugcugcugcucccacuacugucgcugcuugaagacucugugucccaggaguccuggaagaugggguuccuacugcuccuuuuggucuggggaggagggugguugucaucaucacugccauuucuucuccuuuuucuggggcggaggcgcucgcucauggcagcuggugaaggcgagcgacgcggcgccaccccgcc

SEQ ID NO: 5955 - RNA, 1419 nt, Mus musculus
ggcgggguggcgccgcgucgcucgccuucaccagcugccaugagcgagcgccuccgccccagaaaaaggagaagaaauggcagugaugaugacaaccacccuccuccccagaccaaaaggagcaguaggaaccccaucuuccaggacuccugggacacagagucuucaagcagcgacaguagugggagcagcagcagcagcagcaucaacagcccagacagggccagugggccagagagcagccugagccacaccauccccggauccugccccagcacccccacacacacgccccccagccgaugccugagcagucugcacuaugccaaggcccuuacuuccacaucaaccagacccugaaggaggcucacuuucauagccuacagcaccgaggccagccgccgacaagaugcuccuccggcaguuucuugccuucugugaagggacagcacugugcagacuggauauuucaacuuaaugauuuguuuuuaaaaguugcacacagaagaaaaaaaaaugccuaucgguuuuccgucuguauuugagugugagugccgggucagcaggugcuacuuacucaggguuuugcugcacuguugcgacuucggaggggcuugggagcaguuuuuuauaggauucuuuuagaggauucuuuuaagagagggcaucagaucuacgucguggcaguguaugaggaagucucaucugaccgauuuccacaucugucaacuagaugcuguacuguauguaaagagccucuuaaaaaugcgggaucuuaauuuuuuuaaauucaauaaacuaguaaagaauaucuaguuuccacggggggggacggaccuguaaguuuucucccuaaauauaggaagcuugacucaguguugcacugaagcuaacugccguccuaccucuuaguauguagaugucugucuaugggaugcucucccuuggaacagaacagccguccacucggaagaccagggacguuaagcacauuuccaaguugcggucuuuauuuuacauuugaauuuccagggagaauaucacuuccauaucuuauuuucuucuagucuguaccccagacgcuauagagaacauugcgcaguucucaagucaagaaauagcuaguaaauguuaugaacucguguauuaacagcuuaacugcuagcuccuugcggugcccauaggcaaggcaguggucagugcagaccaagugcaggcugccugcuaacaccuacggcaccccagcccugccgggggcccacauucugucauggaacuggaaagauuggugugguguagaaacgcgagcagaggcaccucuaggaaaaacaaugcgcuaguauuuauuuagagagccugggcauuguuccuaugcuacuuggucauacuaguagagagccaggcaagcuugaauaaugc

SEQ ID NO: 5956 - RNA, 2473 nt, Mus musculus
gaacuugagaauguuucuguguuuuacauaauauauuuguuguaauaucugaagggccagugucuaaaacuaugcucuuaaauggaguuacucccuuugaaauguuguuaccauuuuguuguggguuuuccggaugcaaauucugcuuccucaagagggguuaccccugagguguauccucauauacucaggugaucucaugugaaccuucuccccauuuuaacuggggaggcuagagcuugugacugggcaguguggggaaagguaggacuggagguuagucuuccaauagguagagagagagaagaggaggagaggggaaggagagaggacugaagaaaaagagaaggaagccaugauggagcauaauccgauggccaggaaaaacugcaaguagcaaagggucuuauagcuggggaauaaguuagcauaguauuagaucugcccaauauaggcauauaguuuauaguuauuaaaacuggauuauguguuuauuauaugggcuuauugggguugaaauucuagcaacaccauuuugcuccuuuuuuuaaaaggucuggggagggaaaggggcaucaaagaguugucaguggggaaaauugccuggagcugagucuugucucagcauuuacuguuugugugguuuggaguaaagcccauuugccuuugaccuugaggguaucccuaaguuuggcaccaauuuaaugaucccagcuuauuuccuaauacucaggacaccuuuguuucuaguacggcaugucauguggccucugcuuauuaccaccaaacaccucugauccugcugcugagccaggcagagaacucuuugccccaccuguccacaucuggccuccuuucgugcaaucacuucaaacuguccuccuuuguaaaggaggaggcucucucuuggcucucagggcacauauaacuuaucacuucuauguuuucagagcuuagaauaggagagauacuuugaauguuauccaguccauucccagccucaucccaccacauccuuuuauauguuuagcuacugugaacacaugaccuuguaauaggggcagaaauuagcuuauauuucugauuauugucagguaugaagaggaugguagaauauacaaguuauguagugguacaguuuguauaugaaguguucuugagcuuugggguuuuaaagcucugagguugucaugugcugaguaucaggaaaguacuggaucuugaagacucugccugaauucguacacuaauguacugaacacugauggggggagcuuagauagaggaagcaggucauuguggugcaucccaaaagaacauauccaaucucucuuuauucuucucucuuucuguucccugaugacuguguggugagcagccuuuagucacuguaucaucccaaacucuuaaaaucaauggagccaguggaucuggggcugaggguggggcaaauuuucuccuuuccacuaauguucucacgguuuguuucuuuuugucacggugaugaaaaguucgcucauacacuuaauuaucaucauuuuaaaagauuauacacacuggcagccaaacugaaugcaaucacaucaaacccacaaaucuuacaucagcaauuaccugcucaaaaccaaacagccaaccaaccaaccaaacaaacaaacaacccauuaucuccagguuuacuuugcauggaguuagcaacucuuacaacaaguccaugaaacugccagaacagcaucuuauuuuaguuauaucuuauuauuuauauugcuuguuuuaccuuguucuuaaauaauaauguuucauaauuuugacuucagaggggggaaaaauaacuauaaauggguauuuaugcccaccaaggcuacagguauuagcuuaggucuucuuccuuuuaugggauuaaaccaucuagauaggaacaacuuaagggaccagggguuuauuuugccucgcagcuuaaguguaugucaugucccauugcaccuucagucaggaggcagagaaugaguggcauuugugcuccacuugcuuccuucuuucuaugcaguacaggacccaagcccaguggaaggugguacccucuguuaggaugagauuuccuaccucaguuacccuaaucaggauuucucccaagcaugccuagcagcuaaccuaacugaaauaaccccucacuggugcaacuggacacuugucuccuaggugacucuaagagacaccugucaaucugucaucuugucgaucaacacaaaccaucacaaagcauccaacagaggucuuagguuaggagagacuguuguguguuuagcauguugucucccauucuguauacuuucaacuccauuucaaauccuucucuaaacagcaauugaucuauuugggcugggugagaaaauagucaccugccuccgaugucuuguaucauuccaccauuauuucaaaugcacgucaucuuauuucccagauuuaaagucca

SEQ ID NO: 5957 - RNA, 1817 nt, Mus musculus
ugcuuuuaauuuuucuuucuuuuuaaaauguuuucuucucuaggagucuguaaugccaguagagaugacuucuucccagaagacugaagaguggaaggcccagggcacuuucugaguucaugggacuucuuggaaaagcauagaaauaauuuagaucaauggaggaauuuucauuugcggaagcacacgaauauaugaagauauucucaguggacuggggaugguccuuccaugggaccaggguucaauucccagcaccuacauguggcuaacagccauguauccaucacucuagugucaagggguucuauauccucuucuggucucugagaauaccagguacacaugaggugcacagacacacauguaggcaaagcacucacgcacaaagagaaaauauucaguuuuuaaaaaaauguuuaaaaggaaaacugagcuauguuucagcccugcuuuuguguguucagucagggacccgauaagugguagaggcuguccuugaacucacagcacaguccaggcagaccucgaacuugcagucuuccuaccucaguuucccaagcaacuggaaugacaggccugcaccaucagaaccaccuuguauugugucuuaaacaacauuuuacugaauaagccagaagagaaaaguuuaguucuuuaaaaacuuaagggugggaacacuaaaauuuuccaggaguuuuauuuaugcuguguguguguguguguguguguguguguguguagauuauauuggacuaauauaucuugguacaauguacuucuuacuaaagcacaacucaaggaaggagagaaccccacaaaacugaauaaagcuggaggaaggaugaagagauaaaucuauuagugcauuagccacaaaaugauccuacuucuagugagacuuccuuuuucuuuuuauuuguguguguguguguguguguguguguguguguguguguaugggugugugugugcuuggacacuugugggugucuguguucaagugugcaccuguguaugcaugcaugcauauaugugugugaaugcgcaugugucuguacauuugugugugagcuugugugcacucgcaaaugcgcauguguguguuaugcauaugacagugucuuugagggcaaaagaggccaucauaacuccuggagcuagagauacaggugacugugaucauuuaacauggaugcaagaaaugcaaccucggggcuggagagauggcucagugguuaagagcacaaacucugcucuuccagaaguccugaguucaauucccagcaaccacaugguggcucacaaccaucuguaaugggauccagugcccucuucuggugugucuaaagacagcaacaguguacucauauacauaaaauaaauaaauuaaaaaaaaaaaaaaagaaaugcaaccuagguccucuagaagagcaccaagcauucccagggauacuuaauauuagaguguguuacuguuguuguuguggugguggugguggugguguuuuguuuuguuuguuuuguuuuguuuugagacaagaucucaugcagcucaggcuggccuugaacucacuuuauagaaaacaauuaacuuaaguguuugaucuucccaccuccacuucccaagcuuugagagcauaaggcuaugccacccacacccaguuucaugggugcuaguuaugaagccgggggcuuuauccauguuaggcaagcacucuaccaaccgagcaacaugagcucaauuugaaaaacuuucaauaacacugaacgaaacagaauuggaucuuucuacacauauuauaauagcaaugcuu

SEQ ID NO: 5958 - RNA, 4738 nt, Mus musculus
uuuuuuuuuuuuuuuuuuuuuuuuuuuuuuaaggagcacacacaggucaggaagguaagcaaccacuaaugucuaugugaacuaaaggauacauuuaauuauuuauuuuagugcuauggguugaacucccacaugcuaggaagagugccuuacagaguuaaauccacccaacucccagccuuguuuaguuuuuguucguuuuuuuguuuguuuuuuguuuuucgagacaggguuucucuguguaguccuggcuguccugaaacucacucuguagaccaggcuggccucgaugauggaauucaucaccacauucaaccuuguuucguuuugauucaggaugugcauagcucaaauuggccuuaaauuuaugaucucccuuccucagccugccaaguaacuaagauuauagcccuaaaacaccaagcccuagguauaaguauuuguuuuucuuucuuuuuuuuucuuuuuuuugguuuuguuuuguuuuggagacaguguuucucuuuguaucccuggcucucuguagaccaugcuggcuuguuuuuuucuauucguaaauugcauggaauuuaacuucuccuccuccucuucuuauguguuuuguuuuuccagacaauguguagccuuagcugcucuggaacuugcccucuagaccaggauggcccugaaguccgaguucaccugccucugucucccaagcgcugggacuaaagacaugcaccaccaucauccagcugaguuuaguuucuuaucugugauaagagauugaaauuaguacuuauaaaauaugguagugcggagaauaaaggaauauaggagacuaagcauggugucagagguuugggauccgaguguucaggaggcagaaguaggaagaucacugaugucacggcugaccuagucuauuuaguaaauuccaggcaagccagcuuaggucacagauaagaaccgaaggaagaaagaagccggauggccauuuuguuuuguuuguaguuuacgucuuaucauggugggguaagacagugagguuaaguuuggagggaagccauaggcagaugugaaagcacaauaucuuguggguaucuggggaauaguuccauugcaaaggcuuuuggcugggauccguaggccgagcagugagaguugccagaguuugcugggauuaggggaccuuagcaaggugcacuggaaggcauuuggaaaggaagguauauguuaggugaauguugugugaaguugcagcccccugugguugcucagagauguaaaaaccagggucucucaauuaagaccacuugcucugccggccuguugcagacucacccguuguagucucgguggaauaugcaggguacuacccuggauguguucuuucacaaccagagggaugccuucuuagcaccccaagguuuuacaucaucugucucuuugguagacccaacuggcugucuuucauuuuuccaagccuuaagccauucuuguguuucucuggugguucuggaagucaccuguccuuucuuacccuaaagcuaguuugcugcucuaacuaaaauuaagugggucacgcuagcacuuggcuaucucuguacuacgcuaugcuacauagagaggugagccacuacacccacauaccagcuuccuuagugaaaacugacuuuccauuugaaaaaaagaugccauucuuuuuucuuccggucugggggauugaaucuaggguuucuaucuugcuagauaagcucgcugccagggagcuacauccuaagacgccuuucuuccuuucuuucuugcucccccccccaccaaccccccaccccuguuuuccuuaccucccucuuuugcuuuauuucuucccugagacaggguuucacugugcagcucccuggcugaccuuuaccuuccuaguauuuagauuaucgccaugcuccaccaagcccugcuaucugcuauuuuucguaaucucugccucgggugucccaaggaaacagcacauuucugagauagcaccagaagucugaguuuaaaaugaacccuucccagaccuccugggaugccugagaugggacugcuguagauccuucucccagguguagguugauggcggugugugugugugugugugugugugugugugugugugugugugugugugugguggggggcgguggcaggcagccuggcccacauagacccuguuuuccacagagucccugcuuaugacuuagguuauucugccucuucccgcucaggagccacccuccuuccuaggccugcaagacggggcugaaguuugagacugaagcugccuucaucuuuccauaaucuuccagcucccgucccuugcuuucagaugugauucuggcagcaucucauuccagggggcccuacagggagagucuggggguuguuuuggaacccauauuggccaagauggugaugccaacuaugggacauggagaaaaggggugugagaaaaagugggugaccagauucuuagucuuccuucaguuccuucacagaaacuaaagaauauaugugcaggccauuauggccgcuggaggacaacggagccuagugggucgaucguuuuguaauguugcugacuucuugaggugaagcuugccucaaaaaacgaaaccucucaaaaagaaaccugucucaaaacaaaucaaaacaaaaagcccacaaaaaaccaaaaccaaacaaaccaagauaauggcccaaaccuuccuccuggcuaugcagauuccuggcgacugguuucauuuggucccuauguggucacacccaucauuuucuuccacacaggcuuuuuacagaucauuuuucugccuagaaagcccucuauauccuaccauccucauagacaaaccuaaauuuccuuggcucucaccugagguugccggaagugcuuggugaccuacagaucaaggucagguuccuuaggcccucuaauggccaugcgugaagucacaggucccaagcccaaagcacacuuacuggacucuuaagggcuuccuucaucaauguccuggggaugggcaugcucuguuucugcccacauuuuguauucucaguaccauguugagggcuuggccuguagaggauucuaaucuucauggucgcccucacagacuuaacuacuaaauggcaaaauaauaauaauaauaauaauaauaauaauucccagauagaguggucagcauggugcagagucuuggcuuugagaacuuugagacagagaagcccuagauaggcaaggaucacuagugaggaaaguguggcuaaagagucagacugaauuuuguccugaagccucagcugauucuagagagaggcuugggaucuuuugauucuuuauaaaaucuaaacaaugaaacucuuggccuauaguagcuaacccucuucucuuuuuuuucuuccuccuccucccucuuccuccuccucccucucccuccuccucccucuuccuccuccucuucuucccuccuccuccuuccucuuucuccuccuuccucuuccuccuccuccuccuccucccccucuucuugccuuuccugagugcugggauuaaagucauggcugccacugcccagcagcaggugccuuucauuacuuauguuuucuagaccuugauuuuguaucugcuuugccugucacgguccuuauuuucucagcuggacaugauauaacagcucuaacguuuaaaaaaauauugaggggauccugcugccuccauucugagaucuggaggagagggugucauauccauuaauccacagaugcugugggcaccauuaguaaggcucuggcuagaccuuccacugagagcauuugaaugccaaugccauguucuggcuauggggucucagucuauacuaagucuacagggcuugaauuuacacuagugguucucaauuggauauuuaaacaauaaaaaaaaaguguauggagguuuugcuggcauuugugucuguguaccauaugugcagugcccaaauagaccagagaagagggcacgggauccccggaacugauguuacaagggguugcgagcgugggugcugagaauaggagcuggguuuuugggaagagcugccaguccuucagccuuauggugauguuguuuggauaucuccacaggugacacuuuguacugucuggagacguuugaugcugucacaacuggcggaggggaccagcguuacugcuguuaacuggaaugugacaacacaaagaacagccucucaaccccacagaauuaccuuguucaaagcaucacuucugagcuucagaagcuuuagucgaagcguggaccaggucuucacggcuguggguccgggcucagucccauaagauggaaggcuagcaaguggcagagaagucagaaggaaacaauacagagucagugggcucugggacacugcacgguagcgucuuuaaauauugcagaagccuuagagcuaagucaaugcugcaaauagaguugagaauuuuagauguuaggaaaucggugugaaggcggggcccauggugcagcugaaaggcuccgcgaggagccccucauucaggccucaggacaauagcggacacccaagaacucacaacagaccgagcuuguugcaaaccacaugaggcuuuauucggggaaagccagagcucuggggacgacucauaucccacgcagggguagaggaguuguccucgaggggaaagaguucccaguuuuuauaggcccuca

SEQ ID NO: 5959 - RNA, 10990 nt, Mus musculus
agcaaauaaacacuuuuuuuuauuuuugcaacacaacccaccuuuccccaagaacaugaguugaccucagccaccaaagcagaggacaaaagcuguuuagugucagaaggcaagggguuacuagaaaaauagauuauacccaguggucucccgaggauccagaccccugucucaagcucccuaacagggcuuaccaaguggaaauaaaaggcauggagaggccagaaacuucugaauaagagccugacagagaagaagacuuaggcuccuacauaagaugcagagagaaaauaauuuauuggguaauguauguggugucaugcugaccaucucagaucucacugaagcuaaauucuggccagucuauggagguagaaauugggggguggaaggaaagcuuuaguguuccuacuuccccaagaaaaaguagacuuacacagcucuacccuuuugcccagccugauugccuagacagcuccuaaagcucuuagcugaagcuugcaccaaaacauggaggggggugaaaaaggaaaguugaggaauuaucuccacacauccccagagcugagcuaggcgggaggggaggucaucaggcagcuguugguuaucagggacccaugcagaccugucagacaaaguaggugaggaaggacugagcuggaggagucuaggaggucuuuuugacuccuagagggagaagcagccuggguucaagagggagcaggaagcaacucaguaacaaacagugggaggaauccaggcucccaaaacagugggcaaccauccaccaccacccgcccccccaguggugaccagaggggccccugcggguggcaggcugaucaagggcagagcuugauucggguacccuuggaaaguacccggaaaaaagggaaaacacgcucgccaaggaaggcagcugagaaggugugcacaugggcuaagguauccgcauuguagaagccuaggcgcccagccucauaguccagguauacgccaaagcgccgugguuucucacaugggcugagcagugucugcucuguugagcucugugccugguaucguuugccgugggugcccacacaccacacuucgcgcuggaguaggagcugcugaggcagauggagccggcggcggcgaugaugauggcgugaggagcuggcauccccacugcuaacagaggaccccccagagcccacuuuuucuuuaugauggguugauucacgggcagcacccacugcccagccucgccucccacccaccucuaccucccaguagugccggccagagcggaagcccugggccccuaguacacagcagucagcugagaagcgcuuggaauguucaggaaccuccugccgacguucugccaagcggacuccacggcgaucaggggacagcagcagagcugggugagcugugucaggguccagugucagguccacuuggaaagagacauacaaaaagaguuaaaacagcuucccaucacaccauccuaccccaucuucuuaguucccacccuauguuagaagucaaguucaagaacuauggguucuaaccuucacccuaauucuaacaccugcuggccugucccugacuuuccaucucauccaaaacuuagcugggcuaucauggaagcaacuuuuggcuugaaccucagaguagcuuccaguagucuacaccaucccaguaagccaaaaggaaaggcaaaaaccucccuaccucuugcagccugacaaaacaugcggcucauuuuccucacgauggcgucugucaggaagucguggcuaugggguuggcaugggucaggggaccaaaucucugggggcugcaacuguaucucuucacaccuggaggagggggaccagguagggggugggagcaugauauucccagagugaagaaugauagcuaaggggaaggagcagagggucugagaagcagaaacuuagguucuggggagagagggugggaggggaggggaaaaggaaaggaagucucagagaagcagaaauggggaaccagacacuacuagguuacaaaggguagagugggaacacaccuauugaaagucuccuugauguccugggaauaacagagacaaaaagagggaaagggaaaaagagaaagaaagugucagcuacacaggggucacugcucucuucagcagagaaaggucugaaugugaacaggaagggagaaagcagcaccuuccaggcucacaauaaacaagaauauuucucaacuaccauaacuaccacaaagacuuaaucauccuaccagaaacuaucagaaugcuauuacuaguuuuuuuuuuuuuguuuuuugagacaggguuuaucuguguagcccuggcuggccucgaacucagaaauccaccugccucugccucccaagugcugggacuaaaggcgugugccaccacaccgggcuuucuuucaacuccuaacccccuaauuuaaacaaccgaauuugcauucuuuagguagguaugauugccacacacauacucaauacugucaccagcuuuuuaaaaaaaaagucuuguucgagguacaggcaguucugcaguagcuggagagaaacugccuaauggaacagagaggaagcaggagaguggaucagggcaaaggggaacaacgcucacuugcaguagccgcaggccccccuguuggcuccguucuugggcuucagcaagcaagcggcucagcugggcagccugcucuucaaggcgguuggcugcugcucccgcacguccuaacugagcuucgugcaucucccggaggcgccucucuaauccugccugcucuucagccagaaaccuuguuagccgcccaaacucugaggccacagcugccagcucugacuucaucuggcucugaaaagaugcaaaggcagacaugaagacacaguucugugauccagaggaacccaguaugauucccagcacccacauggcagcucauaaccaucuguaaccccaguuccuggagaucugaugcucucuuuuggccucuagggcaaaugaacauauuugcauacauauacauacaugcaagcaaaacauccauacacuaagauuuaaaaaaggagaguugcaaugggaauagaggcuaccaccugaaugaauacacaaaaagguaaacuugaccuuuucugucuguugccucucaaucucaggcaaaggagucucacgcucccuaacuccaacguguccugggaacgggaagagaagucuccucccccgucucagucuuauugacccugagauaggccaacuccugcauccugcuucacauucaccaacugcuuucuggaauacuuagcucuucccugucuaccuaacuugcuuuucagauggaaacuuucauguuccaaaggacaugaaaaaucucuccucuccagauuucuguacuaccaacucuguauuucugacuauaucuccauaguguaugguauuggaaaugcuauguuagaauacagacaggaguggggacacauguaaagaucagaggacaacuugcaagaguggguucucgaagggcagugguggcgcacgccuuuaaucccaacacuugggaggcaaaggcaggcggacuucugaguucaaggccagccuggucuacagagugaguuccaggacagccagggcuacacagacaaacccugucucgaaaaacaaaacaaagaguggguucucuccuuccaccaacuugguccuagggaucaaauucagguuagcaagcuuggugacagauaccuuuaccaacaaagccaucuugccagucaaguuuuguuuuugagacagaguccugcucuguagcccuggcugacuuaaaacucacaaucuuccugucucuaccuccucugcuaguuuaauuuaaagauaagccacccgcccagcuuugugguguccuuuaaguuucucuucuacuaugccacauauucccacagauaggaccggcauaauccuuuaccacagugucaucagaggcuggcacagugccaaccacagguagguacuugguaagaaauuuuugaaauuaccaaaugagagaacucaggaagcaauauaugaagugaacuuagacauaagggcucaugcauauaaugccaaaacucuucaagacugaagcaagucaauuauuccacaucugaggccagcuugggcuacaauauaaaacccuuucucaaaacacaaaaggaagaugccacacaguuaaguccugacucucaguagucacagucaccagaagagagcagucacucaaguucucuagacuaggagucagcaaacuccuguaaaguugcaaacaguaaauguuauacacuuagggcaacagguaaaacauuuuauagguauagcugcuccuagauauucaaguggguuuguuuccaggagacccaaaucagcagauaugcaaauaaucccuuuuucucccauauauuuuaaaugucucauaacacccaauacaauggaaauacuaccaaauagcuaagcuuguggugauuugaaucagaagcccccauaggcuugguccauacuugauccccuguugguggaaauguuugggaggauuaggaucuguagccuuguuggagguugugucaccuggaugggcauuaagauuucaaaagcccccacacaccauucucuguucaccuacuccuacccugaaccaugaggcccaaaaaacauuuuauaaguugccuucaucaucaugucucuucacagcaauagaaaaaguaacuaagacaauacuguauaaagaauaaacacuuucugggggagggaucuuacuauauagcuguggcuguccuggaagucacuacguagacuaggcuggccucaaacucauagacaucugucuguaucugcccccaaaucugggagaaguaaagacuauaaaaaccaaaccaaucaaacaaacaagugguggugcgugacucuagucccagcacuugggagguagaggcaggcagaucuaucuuuuugaguuugaggccagccuggucuacagagcaaauuccaagaaaggcaagagguacacagagaaaacccaucucaaaaacaaagggcccacauguuggccugaguaaggaggaggaacuaacaagcagguaaggugguaguugucaaaucugguuucacucucugccucaaagacacauaucccaauauacauuuucuaaaacucagaagacccucacaguauuagcuugggaagcugccagauagcacauugugauugacauuucacagcagugacucccuaacguacagauggcacuacuaugaguucuagaagcggcaaggcccagacugaccaggaaggaaggaaaggguauucccaucugaugauggcugaagcuuagcuuagccacaguacuaguuccaguccagcaaggccugcgaggcuucugagaacagacaggaaauugaaggagguaagcuaacguaaaugggcugagaacaccagcaaagaggacaggaggucucugcaaugcugaugauuacuaauucuaucuuuuccuaacagucugcccuucauccaggacccagcaagccugucagaccacagcccuuaauguucagagaagcucugccugccaucuguguuuauccugcaacuugguacuccucuggcagcuguuguacauauuugcucacuugcuuucuaugcuauccagagucaagggcuggguauccucuguagcuuuagauaggacaaccagccucaauaggucaugccuccauuuucacauuuuacaaacuagaaagaaacaugucuccugacucugaaggcugcauccccacagaucucuaagaaucugacagucucaucuuccuuauccucacaacagcaucagccaguccacucacacacaucacccaccuucagcucugucacccgccucuccuccuuggccuucaucuucugcacagccucuagaugcuuccuaagugguuccacaugcccuuguagcuuggccugagggaucaggaaagggaagguuagucagggaaaugaugagaagcaccuguccuacagauucucuauccagucuucccuacaauggagauucagugcuucauauuaccacugucaagugucaaauaugcccuuccuucccacauuccuucucucagaugaucagaaaugccccaucucuccccugcacucaugauggauaggcccugggugugccgucuucagaggcuggaucuucauggcugcagaacucuauuuccgacagcugguguacaccugcccuaagcuccugaccacaugaaguccauccucaggaauauuucugccauuggucacuuccauuugauaagccaucuuccucaacaccuacaaaucuaaacacuuucuagagauggugugccugugcuagaagaauuaaagggagucaggcauggcggcgcacgccuuuaaucccagcacuugggaggcagaggcagguggauuucugaguucgaggccagccuggucuacagagugaguuccaggacagccagggcuacacagagaaauccugucucaaaaaaacaaacaaaaaaaagugauucuacauucaaauauaaaccguacacuuuuuuuuuuuuuuugggacggguauaggauuagaagcuguggccuuguuggagguugugucaccugggugggcauuaagauuucagaagcccacacacaccauucucugugugaaugagacaacgcuggcaacccuacacuucuauuguccccuccuacauacccccauccacgcccuugaguugugauucucugcuauuuccuuggucugggauuacccuacuccacuaguccaagguauucuuccuuuacagcccagcucccaagcauuauucugacucuauguacccaacuuccucugugagccuaaggaacuuaaagagaucuacuucuucccagagcaugcacaguuuacaaaugugccuugcagacauuacagggccuuucauuuccugaggcagggucugucucacagcccucgagagucuggaauguagcuguagcuaaggaggagcuugaacuucucaacuccuacuucccucccuagugcugggauugccacuuuccuucguuucuaugcucuggcuggcugcuguguuucccauucaauuacccacuacgugaaaacaaaaagcgcugucuucuuguaguuacaguucuaacagccgucagauacgugagcuuccuaucccaggcauuuagagccaugccuuucuccugcagacaacaaaugcugccuuuuacucuaucuuuuuaaugucuuuuacauuugacuuguuccuuccuuuucauuaggggaagaugcaggaugagccuugagccucgcuccaagcagaaccaaaacugcaucucaguaauuugaggcaagccaugcuucauuuccucuuuuaaaaugggaauaaugucaaccucacagauagcaaacuuagcaaaauuucuaacauguggcaaaagaucaguaaaugcuauccagcauuugcuaacuacauuguaagcugccagugacauccugauaaugacccaugaacuaaaaagauaacugacccugaguacaaaaggcaauuguuacacaacugguuguggaaaguauuacuggaguaauaaaucagucauuccauaaaacaauauauacaaaauuaugccuuuugauauuauugcuauuucuccacuaguagaaucagucauuucuacuccaucaauucagaauuuacaaagcuuaaauuuaccacuuaauauuugucuaaguugacaggaaauuacaaacaugaaucuaaauagauuauuacagggucuugcuguauuuuaggcaggauuucacuaugcagccacgcugacauagaauuugcuguuuagcucaggcugaccucaaacucagaaaccugccagcuucugccuccagaguucuaugauuaaagcccaugcuaucacuccugcccucccuuucccccuuuuuuccuuuaguacaaguucucugagcugggaagauaguucagcucugaagauaagcuccaucguucaacccacaacguggaaggaagaaucaauucccaaaguugucuguuaaccuuugcaugggguuuacacucacaccugcaaaggcuuugaguuugagacuugcuuggucuacauaggguguuuugggacagcaagggcuagagagagaccaugucucaaagacuauaaacaggcaaauaacuuuuuuuuuuuuuugagugagucucguguaauucaggaacugagucuggccucuaucuugcuauguagucaaggaugcccuugaacugauauuccugcuuccacuuucccaagcguucaguugaggggcuugcuguaccaugcccaucuuagguuuucuacagauccucucacugauucuggacuucugcaauaaggcccacuguaguuuuaaaaaccuacucuaguaacggacaaugagcugugaagccuuagucucuaagcugaggugaugaugaucaccuaaaugaagucacugacugaaucacaaacaacaaagaucugggccagcaaacagaggcuccacucuccuccuaguuccugacucaaaucugaagauaguucuaucugugcuggcuguuucauagauaaacguccuucacauauguccaaagaaucagggaaauaaagagccagacaguuaaccaaacgaaauuacauuccaagaacagucaggucagaaaggucaaacuaaaauauccaaguaggauguaggccccaagaggaggauggucacaucaaagucuaucucuaaagcugcacaacauauaaaccuccaaguucagaacauaaaccugcuucccaaucaauaaaaugagaauagcaaacaucaaacucacagugacucugaauuauaaacgauaaucuauaaaagguggccauaugccugugguaaugaaaguucaaagacacucugaaacuugagcaagacgucuugcccuaagagccucucucuuuucugguaaauacaugagacugggugcagagagaaagcaacgaagcucauagccuaggauaagugugggacccgcugagagacaaguguuuggaaccugacacuaguuauuucuaugcuccgguuucagacccuucauuuguucuuuuaggucuccauuccuucccaucugaaguagcucugucauggauaagacuuaagauucacccagaagaaaauaggacuggagugaagcacugccugucucuaagccacagagccaguuagaggauccuucucauuuacccaccuugaagucagugcuuggacggggagaaccauuuuuccaauggcaagguccugcugggagaaccggcaucacguccauccccaguccccguucucuccuccccauccugacuccacucugccgccccuguguuacucaccuuguacuccugcacuaccuccuccaauggcaccacacuaugcuguuuguggcuccuggauucgcggcacaccacacagauggcuucuucauccaccucacagaacagcuucagggcuucuugaugucucggacagaugccuuguucauucacacggcucccucgcccaggaguugggugcaucugacggaucaccuggaccauguuggccaacugcagguuggggcggaagcuccgccgaggaaaacuuuuucgacacuggggacaagugaagcaucuccgaggggcuggagguggcggcaguugggugaucgggucuagcuccucuuccucgucuuccuccagcacuuccuccuccucguccucaucuuccccucucagguccgccacaucccccaaguaauaguccaguucuuccuccuccuccuccuccuccuccucccacacauaguccauguugucccaguuagacccaccuauaccacuacuccagaacacuuccucuuccuccucggccuccuccuccaugucacccucauaaucuucuucccgcauaggggugucccagcccccgccagccccgacagccuccacuucuuccuccucuccgaccuccuccuccuccuccucccgauccaacucaucucugucuuccucauccuccccgccccacaacuggguuacacacacucggcagaaguugugcccgcagccgauggacaccggguccgugaaguaaucgaggcagauggcacacaccgccuccuccugaagggucugcacaggguugggugucauggcaacggcagccaucuuaguguccagucagccaggguagaagugcgguggggggagcgggggguggggcgggggggucucccuuucccgaagccccguccccaccccgagcccaaccucuccgcaccuugccugcggcaaggccaaaggaauguccuccgaccagcccaccccgccacgcacaguccccuacccccagacgaccaccgugucucacagaggggaggggacagaggggagccccaccgacaagccgcucagguggaccugagugcaaaucugccccaacgcuccccuggccugcucauaaacccccgccccuccucacuuccuggccccgccccccggcuuccggccucccucccaacgcuuccggcgucuccgcacuaccugaacucacgaguucccggcgaggcaccgcccccuucucccacgccccgccccaggcugcagagcgaccggaaacgagaaggagacgcucuagcugacacucgggaacaggacgggagggcuaggacggcggaggcccacgucucggugaugacuggccgcgaagaacgcguacggagcggaaggcgcccccaugcccugccagcgggaacggacagcggaggguggcgaggacguugagcagcgcccuguucuccgugcuccaaccgcagcggccuagcgccauccuaccgaccaggcacggacgauugcagaagggacucccaggaccagugccggaagcugaggggcgggcccgcuca

SEQ ID NO: 5960 - RNA, 1317 nt, Mus musculus
ucuuucuuuuuuuuuuuuuaaugaaaauaagcuuuauuacaucaaguaauaaauacaaagaugcaacaguuucagucgcuuucuuccagauguugugaugggcucacaguaaacacagaacugagaucuacagccucaggauggacauuugcagggugcuugggagguuggguagauggcucuuucuucugcauguguaaccugugcauuuuaaagauugacuuccaagcacucagucaugcaaacgcuuaggcagagaagcuccaugaagcagggucuacacuguacacaggcgggccagcuacugagcaaaggcgcugugguuugcacucaacuccucggaggcaggugagcucagggaaaggaagucagcuggggugaugcguauccaaaggcagguuagaggggacacugguauuuggggacaaacaauagcuugcugugaaguggcuucacaaacaucuuucaaauguuuggaaagaaaaaaagagcugggucauuccuaacuacuuaaaaugcacaucgucaguuacugcaaaauguccucccaaucuuuugaguguggguucagagcuuaaugacugugguagaaaaaugacugccauuuugcacaaagccucucaucuccacgggguagugagaugggccuucagaccagccaggggcuaggaccuggcauuccguuccguuucagccaagcacucccgaaccaggcuccgggcaugaaugaugccucguuuuagccucuccauggcgcucuugcucccugcauacgucggucugaucucuuuccccaacucuucaaugauggccagcagcucugcauauuuacucugaggcaccuggcuauuuccaguucccuggguguagccuagcgauggaggcccauagucacucagcagcuggcgauauugggaggaggucgccaugcuaguagagggugaguggacacuuccggcguugagggcggcggcgggcaugugcgcggucaaguucggcuuguacgacauccccgcgggcggcgggcgcgccgggcagagccgggccaggccgcgagcgcgccggcgaggccgaggccgaggcccgggccgggcggccccacguccccgcagccguccgagcgcccgccgggagcccgcgcacuuuuuguugucgccggcucgggccgcgccggcaacuauggccgucccucacccugccgccgccgccgccgccgccgccgccgccgcaguagaucacccauacaucgggcgcgcggcgcaggggcggccgcaaacuuugagcccagccggucggugcugggccggggccggaccg

SEQ ID NO: 5961 - RNA, 59741 nt, Mus musculus
ggaauugcaauaaaaguccaagacaacuagaacccccuuccucuccgggcagaccagccgggauuaggaggccagcagagcacccacaaacugcgggucacgugcgcgaucagagcccgaccaucgagucaguccuccagcuucccagagcggccucggaagugccccugcggcucgggucuuuccggccaggcaguccgcgcuuuugucccgccggcggccgggcucccgcggugccgccacagccaguacgugagucccgggcugccgacgcucccgccucuccccggcccgccacgcccuucccuucucugcccuccggucccgggcggguccuagugggggagggagagcgugacuuuccacacgcccuggggagcguccucuaggagugaaggggaaggaagagcccugguucgggcccggcgcgcgggcaggcugccaucggagcaggcccugggccgaggaagggccagaguccgccccgguguuccuugacugucauggccguuucgggcuuagaaagaggagaaucccgauuauuagcgccuaaaaauuugcccugauugcgguuaaguuuguuucugagacuuggagaugaccugauucggucaccucuucccgucauuuuggugggggagagguguugagagacacuugcggcucuggaagcagaccguucuccacuuccuggcccucuccuaggagaaacucaucuguagagcagugggugcaaccggaggccgccaucugcccuaccccacccccaccccaccgcaaacugagaaaguguuggccuagggaaaagccagcgaaggcacuugaacccaagugaucgcuuggggaaguccuggggcagcggugugaaagaaagaaaggucagguggagagagccgcggcuaguguguuaucuuaagaugguuagucuagauggccaagaccguuuguguacgccugaagcuuuugucugucuggggugugugugugugugugugugugugugugcgcuuuugucugggguguguguguguguguguguguguguguguguuugaauacguaaugcucacguguccaaggcauuaaaauacaaagauuuuuaaaaaacaaaaauuuaaugcaaaauaugaaaacaagauuuucuuuuacuguucucaaagguuguucugggcccuaccuuaaaagguaaacacuuuuguuaagauguugaguagacuuuaaggacuucuucauuuaaauacuagcaaauauauaagucguuccucuuuuauucagacaggugguagcauaauaaguccugcuucucuguuucuuuuacugaaucuguuuuacagaacucauacggaaacggguggguuguuuguuuuacaaacauguagcagauuggccauuuuaaaggaugcuuuagauaaaucucuagacugcaguugauaaucuuugaguuguuucuaguguuuuuugccaaaugguauuauguggaaugauucuguauuaggauaaggauuuugaaauuaagagggacugagguuaauaagguauuuuuuguuguuuugcauucaguuaaaugggcuacacuaauugcuucaagcuaaucucugagugggcccuuagcuucagaaaaaucucuccacugcccuucaugcucucuugcuucccuuauugcuggaguaucuaaaaguaucucuuucacuacuaugagaauauuucauuauaaaaaucccuccuguccuuauuccuaauuuuuaaauaauagaaacaaaucuuguuaaccauuugcauaugcuucucauaaauuaaaugcaaaaaaugaccaaagcacauaucguccucuuuucagcauaucacuuagacuccauccuccauccgcacguucuuccacugagugcucuugaguugccucuuucauccucucgucaccaaauauggcaccuaagagcuuaaguuacagaagcccuguaccacacuugacauauaggauacucccuuaugggaaacaguugaaaucuggaaauucaaaguagcugcagguauaucacaccuguuucuucuugcagccccacuguaggcgucacuucccacuaaaccaagagugcucucuugugaguugacucagcuuuugagaacuaacuccucgcuguccagaacagguaguaaagugaagguucuugauaucugcuugcacuuuuguagaaccuagcaguagaaugugaaaaaguacagaaauugccagaaaugugagucuuaaguaauuuaugagggauagagacuuucucaugguuggcuuuuucacugauguuaccacagauguuuucacagaugguuaaggucauucugucuaucagaaacuggcucaagagauuucccaucuaguuuugagaaauuaaaaccuuuuuguucuguguuaugggggacaacacaugauggccaccacauccauuuuauugauuguacuauaacuucaucuugcaacucuaguucuugguucucuuaucccuucuuagucuguucuccaacugauuaguaguggugguggcagcagugcugucuuuagucccaggagguagaggcagguggagcucugugagucaaggccagccagugcuauauagugacguuucauucauauauauauauauauauaugaauaauauauauauauauuaagcaaaguagagguaguacagugaauuguaugcccagaguuucaggauucugauauauuuauuuauucuugguugaagcauuuuaaagcaaauuucugacaccguuuguuuuacucuauuuuaguugucauuaaaaguauauauacuccuaacaucuauaguaccauuacauaacagccuauuuuagcuuugauuuuuuuuuuuuuuuuuugauauuaucuagcagcaaguaggcagacuacugggucauuugucuacaauaagcuaagaaggacuuauagcuuauacccuuuguuuuauuuuguuuuuuguuuuucgagacaggguuucucuguguagcccuggcuguccuggaacucacuuuguagaccaagcuggccuggaacucagaaauccgccugccucugccucccacguguugggauuaaagaugugugccaccacugcccaucagcuuauacccuuuuaaugguauguucaugagaauggcaguauaucuuauuacacauucucaguugccuuauaugcuaagcuaacagcauuuaugcuacugaugcccguguuuuugauugagugaacuauuggaagagccaaauagccuguacuuaaacaaggaguuaaggaaacuuuggcuucugacuagauugugaaggcaaauaaaguguuugugguucaugcaguugaggccaguuacuagccaaucauacauuccccaaggaaaugaagugacuaaggauaaugaaaauaauucagucugucaaguaauugauggugaguuugaauacauggcuuuuugucaaaaggaucagaguucagauucccaugugaaaaguuuagaguuguaacaccauauaccugaaauccuagcagucgggaggagagaaauccugcaaacuggguaauuuacaacaaacaaaaaccguacugcucauaguucuggagccugagaugucccagguuaaagugcuggcauguccucagaccuucuugcuuuguuuuuguuuucacgugguagaaggcagcauacaacagaaaagcagagagaaccuuaguaagacuucuuuaugaggagcccaggcccacaauaauggcaucaauacacuguaacauaaagacagugccuccauggccuuguuaucuccugccaggaacaguaucacacuuuuguaaucccagauaauugacaggcuaaaccugguaucucugagucugggacuucaaguucaaggccaaccccaguaacauugugagacuugucucaaagacaaaacaaaaauauuuuaagaaaacaccugcuuuauauuauauuggcaauuaauuaagcaugaauuuuguuuuaauaagguguuaaacuauaugagaaaaugaucaaguaugcauuuuauucuuaacagcucuuagaggaagaauuggauggggauaagaaugaaggcagaaagauucuagagggcaggagucaaggccuagaaguugauguuuauacuauaaaaucagccuuaaaggaugcuuugcaugcaaaugagagaagaagacagaacaaugggguggauaauaggaucuaucuguauuuggauaaaagguuuugaaccaaagauacauuucuaacagacagcuucuaggagugauagaggucauauauagacagagcugucuguccagaggggaguaguucugcagagucaagaggaaagauuaaaugaggggagcaggcacaucugaacaccagcagcucugggaaggaagcaccuuaucuagaaaaagugaguacagugugcucugagguaaagaaauccacuugaguagaugaggcuuaaagggagaugagccacuaaacaaacaggauggugaagguaauacacaagggaagcggaguggauggaguucuaaaugguuuuucuuucuuuuuuuuuugauauuuuaaaagcuuuauauuugaaaauaauaaauguacagaaaaauucuaagaauaacaacagcaaaagaagggggauagagagauggcucaccuguuaagagcacugguucuucagaggaccaggauucaguucccagcaccugaaagguggcucacaguagucuuuaucuuccuuucuaagguauccaacuccuggcuucuucagucaccagccacacauacauauaagcaaacauucauauacauuaaaauaaauuuuaaaaauagugaaagaaacuuuuauucauauucacccguucuuaauauuuuauuuaauuuuguccucuugcguucauaagcauuuccccccaaguugaggauaacuuaauacaucauaguccaucaaccauagauauauuguuguauguuuuuaaauuuaaaaauuaaauuucaauuauuuauuuguauguauguacacauuugugcacagcacaccugugggagucaguagacaaauugugggaauuuguuucuuccaccagguugguccugacagacccaaaggccugcugagccaucucaggauauuuuuugaaggauagguauuuuuuuuaccuaacuacaguacaguugucaauuucaguaaacuuaaaguuaauauuucuuuuauuuuccaacuuugucagcuggcacuuuuugguuguuguuguuuggguuuguuuguuuguuuguugagacagguucuuacuguguagcuguggcuauccuagaucccacuauguagagcuggcuuugcccucacagagaucugccugccucugacucccaaguguugggauuaaagguuugcuaccacacccagcucuggcauugaaaaaaaaaaaagaaagaaaaaauguuuggcuucuuuagccuguaacauuucuagaacuuuucuuugucuuuugaagguuugaaaaauagaacuccuccuccccccacagcccuuuuaauagaauagucuucauuuugaauuaaucuguuuucuuaugguucaguucauguaauaaauucuucuagguucugucccucucaggaugucauuacaggaagcauaugauguaacucuguucucacuagaaauauuauuguagaacaucugucaaagcuugccuaauuucaugcauaauuacuguuuucucucuaaugaacauucugagaaggaauauuuaaauucagaaaauagccuguucuuugucggaauuucuccccagacuuagaauucauuggucacuuuuguuaucuacuuuucacucugauaguuauaggaugcuaauuuauucuguuguaaucaagaggucgccccuuuuuccuggcuuuugucuguggggacuuguguaguccugauuuaguagcuugucauuacugugcuuacuuguuccuaaacuggauggucaggcuggcuuuuguagucuuacagagcgcuccacucagcguuucuguucuuuccuuacucgcugguaaacaccacacacagcucauccuacagcucuguuccuugccacuucuuugaagacuuucuucugaauaagggauacuagaagaaaccaaaacuugaagcgcuuauaccacugugaugauaguuuuccuuuuggcuugcuggcaaccagugcuaagggauauuaucuauguagaaguaaaacucuuauguuuccuagcaucuguacuuuuccacuuucugaugauauaauacuguacauccuggaaaugacuaccuugucgaugagacguuguacuucucuaguacuccucuguguguauuucauagcuuagguaaguaaucuucugugcuugcagauuuaggucauuucccagaucuucacuuaacacugugucguaauaauucuguuaucucuacccauguucuuaugagugcacacgugcauacacacacacacacacacacacacacacacacacacacaauuuguuguauuagaagcaugucuuuagaauuguuacuuguggauugaaggggaaauguguauauuaacacaaauuucccaucacaagcaguauguaaguuuuuaauagauuccaagcaaucuguuagaauauuuguuuucuucaguguuuuaucaacaggguauauggucaagcucugaacaaugguucaguguaacaugugagaaacacuauuuuauugaaauucugauguaauucucuuauuagugaaaauaaauguauuuuugcauguuuaauaacugacuugcuuuuuauuuuuaaaggaaaaacccuguuggcaugguuaguuauugugugaagcacccuguauauucacugaacaaaauaauuauuguagacuacuauaaaaaagcccagaguaagaagagaacaucuaaggggcagucaaaagauuaagggagcagacagcaacagacuagcuugaaaacauuguaacauacuuucaccauagaaauagucuacuuuucaaauaauaguguuugccauagaagucuaugcaccaagaagcaguuucuagugaagguaaauuaaauauuaauuuuuaaagaaaaaaacugaaccauauuagcauuaacaacuuauuucuguuacaaaauaccacuugauguuuuuuucuucccuaguuuaaaauuagaaaggaaaggaacuaaguucucagaguauaccaugauuauauugucaugucacagucacugaacucaaggaugugugauggccugcagaaaagcugcuugacucuaguagucuguucuuucacaucugagaggaguuugcuaugaucagcagucucuaccaacuuuaggcugccuccaggcuaagagauugcaaauaauaggaggcuaaccaaucuaggaaguuaccuucuuuuagacagugaauuaagaaauguuucuagacuuucuuucaaaauagucacuguuaacugagguuucuuuccuccuuuucugguaauccccagaugaacaauguuaaaagguacaacaggaaguggccauagggcucuuaaaauuuuccuugccagcuuuauuuccaguaguaggcauuucuuuggggcuggcgacauagcagcuauuacauguuggagacccugguuuuccagaaacaucuuguugcugauucuuagaggucacuucuaggcccuuuccccagauauuacuguggaaccugcaaagucuggcagaaagaaauuugagcauucuccaaagucuguuuugggugagccaguccugggcagggugcuguauauaaugaacaugauggccagagccaguuugcuuccaagaagccauucauuaaaaagaacagcuauggugcuagauuuugauauacucuagccccuggaauauaauuuauuuucucuaggggcugaucuuugauaaacuagcaggggcuaucaggugcuugggaaucagagugaucuugagggauucaaauguaauggccuggagaagaacaaugaugucagcuuuaaagaucaggauaguaagaucuuugggcuuaagggccaaacugccuggucuuuccagacacacagaaacuugauuugcuagauuucuauuugaguauauuccaguuaaugacaaauguuuugucucaguaaccauuagagcugcugauccugcuacuggagugucuccuuaagcugagagaugagagcuaccuguacauguaguuauaccuccaguuuucagaggcauuaucaggguguaugcaacagaauccacuuucuccaauugcauaucauauguacuuuguucauccuguaguacuccaccaauagcaaguuccaacacauugucauaccuugaaagcaguuuucuguuauugaaguaggcacucuguccagggagauuuugugccgccuacugcuuagcuuggaauaccaauaucucuuggugagccaucaagcuuuggacagacccagacaccuugucauacaaccuuagggccuguaugaagguagaugaccuguggcuuuggucaucauguucauuauauacccaaccugcucaguauugacucaccccaaaauagacuuuggggaaugcucaaguuucuuucugccagacuuugcagguuccacaguaaaaucuggggaaagggccuagaaaaaugacuucuaagagucagcaacaagaguucuuggaaaaccagggucuccaacauguaauagcugcuaugucgcuagcccuuucucuacuguggcugaaagcugcacgauggagaauugcuugagagaguacagccuuucucccucacccucaucacagcucugacaguauuugugccauuuucuuuugggaguggggguagaaauuuuugcuaucuuuauuguaaaaguacuuguauguaguuaaacaucagucuuggauugcaucuugguuaugguuaggaagcuuucucuauacccaggucauagagucauuaauucauauuuucuucuaguuauucuugugucuguuaaauuauuuagagcuucuuuauauuuagagcucuguuccauuugguguuuauccuuuugugugauauaaaagaucuaauuuuaucuuuuuuauuccccagauggcuuuauauuuguuacacuauuuuuaaaaacugucuuuucccaguaauaccauccucaucaucaauuucuguguguaguuggaaucauuucuggauguaucuauuuauaugccaguaacacauuuaaauuauaaaagcacauuuuuaauuauagcauauguuaauagucacuauggcuaguaguugcucacagcucuuuuucuucccuagcaacuuuuuauuuuaggaaguuguuuuuuauggcuguaggaaccuuaacauuuuuuuuuucuucuaaggaaguugaaauggaaggucuaaaauugaaaaguaaauggauggaaaaucugauauauguggacauggcagaguauagauaagguauguugcugcuaaaguuucugggcccacacuagcccacuuaucaguuccauguuuuguguuguggguugcucuacccagaguaauacagagagcuggagaacuagucuggccuaccauucuucaguaaccucauccuugggacuuaauuuuauauacuauuuccucagaugaaccaacuuuugcuuuaguggcugcugggugauucuucaccuucuaaauggucuccuaaauuucuagcauuuucuauuccuuauaggaggucauuauugcuaugaaaaaaaguuggauaguuugauucuuuacaucuguucacucuaaagcauguauuuuacuuuuauugaccauuuuuuccucacauaguugcauacauagcuuuccaaguaagacucaaagaauuucacaauaauguccugaaauguuauacagggcaggagggaaagauugcauuuuauaugguuguaaaugcuucauuuucuuggaauaaguuuaacaguaucuccuuagaagucaguaaaucagaaaaggaguauugauaggguaugggucauguaaagcacccucaggagaacagaaacccuuacuuggguauuaaaguuugcuuugggaaguuuauuuauuuugaaucaugugcuuuuuuuucaaaaccuguacauuugaacccugaucaauagcuuaacuuuuaauacaauaauaaaugauauaauaaauaguaauaacauuugcccugaccaagggacaaguauuguucuuacugguuuuagauggcuaucauccaauaaucauaguaacacuauuacuuuaauuuuacaggugaagaaacugcuguacaaagaaguuaaauagcuaucccaaaggucauauaaguagguauuugaaccuaguugguauucuagucauuuucuggucugugugagagauuggguuuaauauuucacagauagcagaguccacuacagagguuggaguuccuuauuuaaaacaacaguauuuacauaugaccuuuacacaucauccuguguacuugaaauuauuuucaaauuacuugcagugccuaaaagcagugugaaucuuuauuucguuguauuauuuagagaauaaugauaaacauuaaaagcuguauauguucagcacaaauguaacuuuguuuuucugguauuuuggguccaugguuggcugaaucuguaaaugcagaaccugccgcugugaagggccaacuacucuccucaguggcuugagguguugcugucuuguuuuagcauccgugagacaaagaucuuaugccauaguucaggcuggccuggaacaugcaguaaccuuccugccucagccuccaaagugcaagaauaauaagauugagccauuacacuuugcuauuuguaagcuuugacauucuauaugacuaauugauucauaaauaggaaugaaaacuuuauuccuuggcaggcuggagcauguuucuaccauguaaguucuuccaugauuagccacuuuccaaagaguguuuuccuuacacagaaaagucaagaaggccaaauuacgguauaguagcuuuagguuucuuuguuucucauuucuuggucacuguccucaucaucuuauaacugcaacucccugccugauuccucuucuacgguccugacuuaucuuccuuuucaguuuuuccugcucucuccugauuauguguaacuuuucaaagaaaaaauuaacaucuuuguuguucuaacuuuuuucugucauguuuuucagagacuucuuuuuucuuguuuuucuaugaggugacauugaaacugauugguauuggcugugguuuugugcaucaguugaacccauuuuuaugguaccuucuggacucuuguuuuaacaguaguucuaaagguauugaaaucuuauuaaugucccccaucauaauuccaguaauuaaaaugguacuggaagggcuggagagaugacuuagcaguuaagagcauuugaugcucuugcagaggaccuggguccaguucccaacacccuaugaucacacccaaccauccaugcuaacuccaguuccagagggaucugacuaccucuucugaacucaaugggcaccagacaugugcauggugcacauuccuccaagaaagcaaaaacacucaaaaaaauuuaaagauuauuuuuuaaaugguaccugccacauauuaaaaagcaaauaucugacaaauggauaaguuaauuuuguuauuugcuguuguuacucauucaggguuuuuuccuaaauaaacaugucauuuucauucuuuuggucuagugucauauuugaagacaaccauggaggaugaggagucgucuaaaaagaaugaaaaugauucaaaugcagacucucagugcccaagugugggauuuuuucauaaggaucauaugcagaaaucuaagaccggugacacuugugacuuguuuccuaaauggaaaauacugaaggaaggcaaaaguaguaucagagaaaugauugacacacauacaaacgcagcaaauauaaaacuagagcaggaugaugagacaucugagaaaaguuucuacccaaguacaaauacaaugcaccagacuauccccacagaaccaaauuguacuaaacaaggugagcacacagagaacauuaauggaaacguacacccugcucauauugcugauaagaaauuacauaagugugaugaguguggaaaauccuucaaauacaauucucgucuuguucaacauaaaauuaugcacacuggagaaaagcgcuacgagugugaugacuguagggggacuuuucggaguagcuccagucuucgaguccacaagcgcauccauacuggggaaaagcccuauaagugugaugaguguggcaaagccuacauguccuacucuagccuuauaaaccacaaaagcacucauucuggggagaagaacugcaaaugugacgaauguggaaaauccuucaauuauaguucuguucuggaccagcauaaaaggauccacaccggagagaagcccuaugaauguggugaguguggaaaggccuucagaaacaguucugguuugagaguccacaaaaggauccacacaggggagaagcccuaugaaugugauaccugugggaaaaccuucaguaauaguucuggccugaggguccacaaaaggauccauacaggugagaaacccuaugaaugugaugaaugugggaaggcauucauuacuugcagaacacuucuaaaucauaaaagcauccacuuuggugauaaaccuuauaaaugugaugagugugaaaaaucuuuuaauuacagcucucuccucauucagcauaaagucauccacacuggugagaaaccuuaugaaugugaugaaugugggaaggccuucaggaacagcucaggccuuauagugcauaaaaggauccacacaggagagaaaccuuacaagugugauaucuguggcaaagcauucagcuauaguucaggccuugcaguccauaaaagcauucauccuggaaagaaagcccaugaauguaaagacuguggcaaguccuuuaguuauaacucacuucuucuucagcauaagaccauucauacuggagaaagaccuuauguaugugauguguguggcaaaacguucaggaacaauucaggucucaaaguucaucggagacuccauacuggggaaaaaccauauaagugugauguaugugggaaggccuauaucucacgcucaagccuuaaaaaucacaaaggaauccacaugggggagaagcccuauaaaugcagcuauugugagaaaucuuucaacuacaguucugcccuugaacaacauaaaaggauucauacaagggagaagcccuuugggugugaugaguguggaaaagccuucagaaacaauucaggccuuaaaguacauaagcgaauucacacaggggagagaccuuacaaaugugaagaauguggaaaagccuacaucucacucucaagccuuauaaaucauaaaaguguacacccuggggaaaagcccuuuaagugugaugagugugagaaagccuucaucacauacagaacacuucuaaaccacaaaaaaauucaucuuggagaaaagcccuauaaaugcgaugugugugagaaaucuuuuaacuacaccucacuccuuucucaacacaaaagaguucauacuagagagaaacccuuugaaugugacaggugugagaaggucuucagaaacaacucaagccuuaaagugcauaaaagaauacacacuggggagaagcccuaugagugugacauauguggaaaagccuacaucucacacucaagccuuauuaaccauaaaaguacacacccuggcaagacguccuauacaugugaugaaugcggaaaagcauuuuucucaagcagaacucuuauaagccauaagagaguccaucuuggggaaaagcccuucaaguguguugagugugggaagucguucagcuacagcucacuucuuucccaacacaagaggauccacacaggggagaaaccuuauguaugugauuggugugggaaggcauucaggaacagcucaggccucacaguacauaaaaggauccacacaggagagaaacccuaugggugugaugaaugugaaaaggcauacauuucacacucaagucuuauuaaucauaaaaguguccaccguggaaagcagcccuauaauugugagugugggaaaucuuucaauuacagaucuguccuugaccaacauaaaagaauccacacuggaaaaaagccauaucgauguaaugauugugggaaggcauuuaauaucaggucaaaccuuaccaagcacaaaagaauccauacaggagaggaaucuuuaaauauggcaaauauggaaagucauaguggcacauuccagaagaugaucuacuaugagggagggaauucucuggaugggaccagaaugcagaugccugugugggaggcagagcaugccaagucucaaagaaaucaaauagaagaaaaacuuuaugaauauaacaauuucugagguccuuagucaugguuuauaauuuucauaguaugagugaaagaaagaauucuaagugcucaugaacaauucuaugugauucaguuauagcaagaacaguuuuagugucaaaauagucgaacacuuuaggacuauaaaauaccacuggauuuaaagccuuuaaaaguggcggaacauuuaaaaaauauaaucuggacauaaaacauaaagauaagggucuuuaguuagaaaucauucacuacaaagauccuauuuggauaaauaagugaauaagaauguauaaaguugguauaauuuugagcucuauacuucagucaguggaaaaaagauccaagaagggccuccaacaggcaaauucagggagaggaugguuucagggaauaucaguuuauuagugggucaugaauuauagacuuaacaguaaugguuugugguaggaagaucacaacuucugaaacacuuuggauguccuaggaaaagaaaaggcauaaucugugacauaaucacuucaaaugcauauuaguugaaauauacuauuaauugaacugguaagacuaaaguuucaaaugaacucccuuaauagauaauauauaugguaaaugaaaaccuggaaggugacauucacauauacugaaagaauggaaaggauuuuaguaucuucaguuaaguaauggaacacaucuucaacaugaauuugcaccuuacagaaaacuuucagggaauccuaugaauaaaaaaaaaauguuucaaaggauggcuuuuuauuacaagagcuaaauaaguaccaguaauuaagaagaaauucauguuuuaaaaacaauacuuuguuucagaaagcauuguaaaaauguuauguacgacauacauguguauauugucuguaguaaaauaugaauauguucaaaacucacuuggccauaaaggccaaauaguuauggcaagauaagggguaaaaacaauaaaugccucaaauguaaauaggcugugacuuguuuuagauggacaaauaguagagagucauuuguguguuauaucuuuccuuguaaaugauacagaaucuugacuaagaggagcuucugucuuaucugugaagacuuauccacuaaacuaguaucuuaggagucaccagaaguuauaucauacuuaucucagguggaaauagaugaauuuugaagagaccaugaguaagcaaucugaucaugauaugagucuggauuauaauuuguuagaguguguaggcuaugugagugagucaccauauaauucauuaggaacagaacuuuauacaaaguguuaguaacuguagcaguaaagacuagguauuucaauaguaaaaguagauucuucugaguugagcuccauaauaauuggacagguuaucagaaccaggugaacaaacccucaguuuguucucugacuucaggacuuaccaucauuaaagacaaucucuagccaucucuaauuuaaaaauucccaggucucccucugggaauacuagagaguacuuuguuucugucuccagcuaccaguagguuuugacaugucagguggagaaagggaaaauauauuuuugcugcucaauucuguaguagauguccacacuguacuguucuacugcaugagacacuggucaauuugacccuaucuguagaucuaguuuacucagcaaauauuuguggagaaucugcuagguacaaaccacuguccugggcccuagguagggaaaggugggaacaagaguuaagacuucgagcagagucauccuaauccauacacacaucuaaguguucggagaaacuuaaccauagccaggaaaagagcuguggauaguggguuuuucugaggaguaggaaaggacauccugaauaaagacagcagaacaguucaggaauuguccagaauggcuguuuuaaggugagcagaaagacuauagacuguccauucccagcagccauugaggaaagggguugcauuugcuaaagaccacuucuagcuucuuagacaauccaguuaccugagguuucuaugugccuuauagccaaagcagcuaguggcuugagucccauuccuuccacacuccuguuuccccauguaagcuccaacuggaucuauggcacuacuuaguuuuaggaauaacacagguaaaaauguugagccuggccgccuugcagaaaaguuugugaguucugugguacuguggaucaaaauuaauuuauguauacuaugcaaauucuaucaguaagguacaucucuggcucuguguggcucuguggucacuuaaaaauauauauauauguguguguguguguguguguguacacacauguauguauauauacacauauguauguauauaauguguaggcugugugcuugugaauuugugucugaggaagcuggaagcaucagcuguagcuagaguucuaguuguaagcuaccugauacagaugcugagggcugaauuugcauuugauagcaguauauauuucuuuagccucuuuuuagauuggucucuugauuaccccaguguacugagugcuggggacaacuacuuuuggcuuggccuugaguauuauauauugagggugagauaaauuauauucagcuuaacucagauguguauggguuucuaguugucccauaauggauaccaugcugcagauucaaugaguuuauuguggcuaagucugcuuggaccagucuauggaugugagaucagugaucauugccuuuucuaguaagugauacacaagaagaaaacacaaagcaaaaaccuuaacuuguaagggaaucaaaauacauuuuuaagguuugcaagauaagggagaauuggcauggugaaaaguaaacucgaaucuggaagaucugcgaacuaaaacgcuuuuaucuagguaggaacagggucaugauguuuauaaagucauauaugcauggaagauggcauagacaaauguuaauaggauaaaguuuaaaaucugagaugaaaaaccucaauauaagaaaccuaacauucugguuuugguaaaggugggcuauaauauuugggucaauuucccauugaaaaugaaaauguauuuuuuaaaggcauauagcauccugauuuaguucauuuggcagcuauaacaaauuguaaagugaauaauuucaaaaauaacuauuuuucaauucuggagggugacaaguuaaucauggggcacccugaguuuguaaaucuguuuagaauccuuuuuuuggggggggggucauagaaaggaccuuacugugcuguguauagaucaaggggucuuuguugagccuccuuuauaggagcaccaauaccauacaugaguauuccaccuucuugauuuaaucucagcacccacuagggagguucacaaccuuccauaacuccaguuucaaggguuuucagaggguuugccucuggcuuuaauuaaguucucucucacacucucugaaaaauauaauacaaaucuuuuaaaaaugagauaaaaugcagacuguucuguggacugcugaugcucucuggguaagaaauucagagccagucccaccauagugaugaauaggagaccuuugaaaaguuaaaguuggguucuuaaauugcuuacagcaaaauaaaucagagcuaaccccuucccuauguguagagagacaauggccuuguuaauaggcagagugguacaagaaaaagugagaugaucccugguuuuacuccggucuaaauaacagcagccuaagacaugauagacacaaacaugagagcuagcgccauuuaguagcaaguaacaccuaacucacuacauccuuucuguuuuccuuuuguagcaaaguugcuuuaucccagguuagccucacugccucugccuuccaaaguucugagguuaaagauguguaccucuguguccugcucccauaaauaauuuuuaugggcaguaaucugcaagcaaagauaagcagauauauugggaaaaagacaauguaaguaaaauccaacaaaaagaaacauacccaauaggcuugccauacuggauguaauguauuuauaaaaauacuuaaagaugauuauaaugaagaagcacuuggcaucagaacacaugagaagacaauuacucaacugaaagauaugugaagaaguugccuaggauguagcuucaaaaugggaaaauguggguguaugggaagcuucacugagauuuguuuuucagugaauggaaguauuuuuaacauucagucgucguucagaaagagaaccaugggagaaagaguaaggggaacugagcuggguauuuucuagaauuagugaaaucuacagauaugaaaucccaaagaauguaaguaaguuaaauuuauaaaaaucucaucuagcugcacuacugagauggaagcagguggaucggagucccgucucagaaaaggcaggcagacacgcuggaucucaugggagcuugcuugggacuauacuuggggguagggauucuggaaaggagaagcaccuagaaagugaacccaucuucuuggagguguuugguucccuaaccaggacccugccacugccccaacuagauuaaucauuaaaauaagggcaugucuaaagauucccuucuuuacaugccuguugaggcauuucccauuuagauucaacauuuagccaugggguaguguuuguugugcuuagauagcagugaaacccaugcaaagaggcaacaaaaaugggguggcuggaaggauuucuccuaccaggaaaccuggauuggaagaagucuugccugagugguggaggcauacaccuuuuaucccagcauggggaggcagaggcaggcagaucucuugaguguuugaggucagcacaaucuacaaacugagguucaagacagccagggcuacacagagaaacccugucucaaaacaaaacaaaaaucaauaauaaguaagugacuuugcuuauucacagauggucuuguugauauacaaucaggcaaaucucuguaaugcauacauacacacauacauuacuuugcuuauucucauaaggccuuguugauguaucuucaccugucucuucucaggauaauagcucauagguuguaacgaaauuagaaaagucaguauaauugcagaucaagaaagagugccugaaguggaguaguguaaaugaggaaggcuggccaaguagugguuguuuucuuuuuaauuacuuuuuuacacuccauauuuauccuuccuccaucuacccuccgacucuucugcaucccauacuuccuccccacccacccuaccugaccuuuaaacucccugggcccuccagucucuugaggauuaggugcaucaucucugaaugaacacagacucugcagcccucuacuguaugcauguugggggccucauaucagcuguuguaugcugccuguuuggugguccaguguuuaagagaucuuggggauccagauuaauugagacugcugguccuccuucaggauugcccuucuaagguucuuucaaccuucccuaauucaacaacgggucagcugcuucuguccauugguugggugcaaauaucugcaucugauucuuucagcuguuuguugggucuuucagagggcagucaugcuaggucccuucuuaugagcgcuccauagccucaguaauagugucaggcuuugggaccucuuauucaagcauuuuggaacuuuaacaugcugaagcaauagaagacaauucuuaacugaaagucgagaacgauaccccaugguccaugccauauacagauaaaaugagaaaagagguaaggaauccaagcuuuggaucuguuuuuuuuccccccagugguaaucuugcuuuaagcaaucuauuguccugagcaagcaugcuuugucuuugagagagggguucagcuuggagaaagcccccagcuugaggcagccuuaagcaaucuagacagucaugccaugcacauuuugcuucccaugcgccacccuuccuccuuuauggcuuuuauuguaguuaauuguggugauuauuuuuuuuaacuuugcuauuugcagauaugcuagagauuauacaaaaagaauuggugaaugccaaggucucaccaucuuaacuauggcuguuuuuuauuguguccauuaaagucuaaaaagagaagggagauccugugguugucagggacucugagaagggcagaccaaguuccucuggucucagauacaaacuuaggggccaguauuccaaucagugcaaugguuaugaguuuguuuccuguccugccugcaauuuucucaucuguaaaauggggguugcgaacgaauaauacaguucuuuaaggaauagugaaaagaggcagcaaaagugcucaucgagcacgggggcuuguugccaagucuaacaaccugacuacgaccaauugucuuuuggcuuccacaugugccccaccagccacacacauguggauguccugggaauuggacuuggggcaucaggcuugacagcaagcacauuuacacacugagccaucuccauccuuauuuuguuuguguugcuuugaaauagcucucacuauguaugcuaggcagguuuggaacuuucucuguagaugaggcuggccucuaacuugcaauccugccucugcuuccuaagugcugaggggggggggugguuuagguauguacuaccacucccaaggaagccugcauuuucuguuaaaaaugccacccagacagcugcuuccagagcuucuguugugcagcacugcaugugagcucuaacacaaaaaguggaaccuuuccuuuuccaucuuccuuuuucucacacuggucaaaagcccaagcauauugcacugauguuguggucuuucccccaaagcgcccccacuucugccaugcagcuagcugccuugugacaucuauugcuaaacuugccugcuuucuugggcacuaacucaauaaccauggcuagcuugcuuacucucuuccacuccuuaccagcugcuaagacuuccagcucaccuuuccuguuguuuuucuuucaaauucuaaggauacugccuuggacuucaaaaauuacuauagaaacguuacuguuaaauugacucaugcucucuuauuuucaaaagcugaaugcuaugaaaaggagaguaaacuuuaaugacaaagaacaacacaauagagaucagcaaagucaaggcuggcacucaaguauaggaaaauugauaaacuuuuggggugauugaacaaaaacccagaaaaauacaaauaaucuaaguuugagaugagaaauuauagcagacaucccauaagggguuaggaguuauuuuuagacacacaaacauggguguccuagguauagcuuuguuaguucauuguguuuagaaaacagucuguauuugcaguccuuauaauugugcagagacuugcuuuaggucuagcaugcauugcuuuaaugaagcuuacaucauuggaaaaggacauaaguucugcagacgcugggugugguccccuaaugaagucauuagauuaacuuguaauguagcacgcacaucacuguuacuaaugaguguuacugauuuguucaguuaguccuuuacugaggauuucaguuuucugaggccauacagacuggcucauugaaacuuuauggaggaaaaccugauucuagugaugccuuuugcuuauuuagucucuucucugacauuaguagacucgcuucuuucugaucuuugguucauggcuuaucucuuuccauccuuuuacuuucaguguuucuguguuuucuaaucugcugcaugugccacuuggaaauggcauauaguauuguuuaauacagucuaauaauucauuuuaacaggaguguuuuucaugcacaguugcuuauuauuuuagauuaaaugaagaaaauaccuaauuaaaauaaaauaaaaaaauaaaaauaaaaaacccagaaguauuauaaaaaaaaacuuucuauuuuuaauuucacuuggugucaguuauuuccugucuucaaauuauaucagaauuauucuauuaaaauucuauuauaauuauucuauuuccccucuaguuugauaaucauauuaucuuagucugaauuaaaaucuauuuuuagagcuuguaccuuacuacauagaugagccuauaacuugcuaccuuccugccucagucuuucagcuguugggauuacaggcauuugcuuaacuuaaaagauauuuuguuacuaauacauuuccuggauaggucucauauuccuuugucacaacaaaucaccuggccauguauuuaacauauuuuaaaaauuauuauuucuuccuuucuuuuucuuuauacuccacauuuuauuccccuuccgguccacccucugacuguuccacaucccauacugcccccccucccccccccuccccgucuucacaaggauaugaggaaguccccccugcccaccagaccucuaaauucccuggggccuccagucucuugacgguuaagugcaucuucucugacugaacccagaccuggcaguccucugcuauauauguuuugggggccucauaucagcugguguaugcuaccugguuagugguccagugucugagagaucucagggguccagguuaauugagauuguuguucuucccacggggucgcccuccuccucagccucuucuagcuuucacaggagucaguagcuucuguucauugauugggugcaaauaucugcaucugacucuuuaagcugcuuguugggucuuuuggagggcaguuaugcuaggucccuuuuugugagugcuccauugccucaguaauagugucaggccuuggggccuccccuugagcugggucccacuuugggccugucucuggaccuucuuuuccucaggcucuucuccauuuccaucccugcaguucuuucagacaggaacaauuaugagucagaguuuugacugugggauagcaaccccaucccucaucugaugcccugucuuucugcuggagguggacucuacaaguucccucucuccacugcagggcauuucaucuaagaucccucucuuugaguccugagagucucucaccucccaggucucugguacauucuggagguuccccccaccuccuacauccagagguuuccuguuuccauucuuucugcuggcccucagagcuucgucccuuuugucccuuuucccccacccaauaccagaucauauucccaucucccccgaaauccccgcccccauccccuuucucuuccaagucucucccuccuucccccucccuccccacuuauugcuuucuucccucucgcaaaugggacugaaguguccucacuugggcccuucaaauuguugaccuuuuugaguucugugaacuguauuuuggguauucuguacuuuuuuucuuucuuucuuuuucuuuuuuucuuuuuuuggcuaauaaaggcuugagguuuguuucucugucuuugauuuacccgaguuuaauuacaacauauuuaguguggacaaauguuuaucuuaguuuccuuaugcuccugccguuguggcuuuaagucucaguaaucuagugcuugaggcauuagaucuauacccuucucuuccucccuuccuuccuuccuuccuuccuuccuuccuuccuuccuuccuuccuuccuuccuuccuuccuuccuuccuagugcuugaggcauuagaucuauacccuucucuuccuuccuuccuuccuuccuuccuuccuuccuuccuuccuuccuuccuuccuggugcuugaggcauuagaucuauacucuuccuuccuuccuuccuuccuuccuuccuuccuuccuuccuuccuuccuuccuagugcuugaggcauuagaucuauacccuucucuuccuuccuuccuuccuuccuuccuuccuuccuuccuuccuuccuuccuagugcuugaggcauuagaucuauacccuucucuuccuuccuuccuucuuagugcuugaggcauuagaucuauacccuucucuuccuuccuuccuuccuuccuuccuuccuagugcuugaggcauuagaucuauacccuucucuuccuuccuuccuuccuuccuuccuuccuuccuuccuuccuagugcuugaggcauuagaucuauacccuucccuucccuuccuuccuuccuuccuuccuuccuuccuuccuuccuuccuuccuuccuuccuagugcuugaggcauuagaucuauacccuucucuuccuuccuucccuccuagugcuugaggcauuagaucuauacccuucucuuccuuccuuccuuccuuccuuccuuccuuccuuccuuccuuccuagugcuugaggcauuagaucuauacucuuccuuccuuccuuccuuccuuccuuccuuccuuccuuccuuccuuccuuccuagugcuugaggcauuagaaccauacucuuccuuccuuccuuccuuccuuccuuccuuccuuccuuccuuccuuccuuccuagugcucgagguauuagaucuauacucuuccuuccuuccuuccuuccucccuuccuuccuuccuuccuuccuuccuuccuuccuuccuuccuuccuuccuuccuuccuuccuagugcuugaggcauuagaucuauacccuucucuuccuuccuuccuuccuuccuuccuuccuuccuuccuuccuuccuuccuuccuagugcuugaggcauuagaucuauacccuucucuuccuuccuuccuuccuuccuuccuuccuuccuuccuuccuuccuuccuagugcuugaggcauuagaucuauacucuuccuuccuuccuuccuuccuuccuuccuagugcuugaggcauuagaucuauacucuuccuuccuuccuuccuuccuuccuuccuuccuuccuuccuuccuuccuagugcuugaggcauuagaucuauacucuuccuuccuuccuuccuuccuuccuuccuuccuuccuuccuuccuuccuagugcuugaggcauuagaaccauacucuuccuuccuuccuuccuuccuuccuuccuuccuuccuuccuuccuuccuagugcucgagguauuagaucuauacucuuccuuccuuccuuccuuccucccuuccuuccuuccuuccuuccuuccuuccuuccuuccuuccuuccuuccuuccuagugcuugaggcauuagaucuauacccuucucuuccuuccuuccuuccuuccuuccuuccuuccuuccuuccuuccuuccuuccuuccuagugcuugaggcauuagaucuauacccuucucuuccuuccuuccuagugcuugaggcauuagaucuauacucuuccuuccuuccuuccuuccuuccuuccuagugcuugaggcauuagaucuauacucuuccuuccuuccuuccuuccuuccuuccuuccuuccuuccuuccuagugcuugaggcauuagaucuauacucuuccuucuuuccuuccuuccuuccuuccuuccuuccuuccuuccuuccuuccuuccuuccuucccaggauuuacguaaagguauauuugaccaucuugaugcaucuccugugucucuuggccuuccuaucuaucaguggaacaagguggaaaccuuguuccaaguuucauucuggaucaaauuugucuuccagucuauuggcuucucuuagccacuuaaucugccacuuaauaugcauacugaauauucaguuaccagcuuuuauguuucuguugcagacuuuuaauuugcuuccuuuuuauaguaaacagaagucucaaacuuaguuuuaguuuucuugaaaauaguaugcuuuuuuccuuuugcuguuguuuguuuugggaagauggagaucuuggcuaucauuuuuaaaugcuguccaucuucuauugagacaagaucucuugcuagcuugaaacacaccacgcaaguuagacuaguuggucagcaaguacuagugccugcauagcacugggacuauaagcacauaguaccauuccuagccuuuuuuuuuuuuuuuuaauguggguucuggagaacaaacucagguucucaugcuugcaaggcaagcaguuuacugacugaucccucgucccagccauaacauuuguuacuuucuuuucucugaugcugauuucuggguaguuacuaaaguauauuauuagauugccucugcccaaguacuuaagaguagcuuuuccccuccuuauuggaaucugauugguaacauguccaagccagcucagucagucaacagggucucaagcaagggagugaggauugaaaaagaaaaacaguuagagaaaauaauaacgugacucagccagugcugaggcugaagcagcucuaugucucuccagccugcuguuauaucauucuaggugcauccaaaaaccauggucaguucuuaaaucaaagacaaagaaaucaagugaaguagugaaaaaggagaucacacaaaaaaacaaucaagcagaguaguaagcaaaaggaucacacagauaauaagugucuuagucaggguuucuauuccugcacaaacaucaugaccaagaagcaaguuggggaggaaagggauuauucugcuuacacuuccauacugcuguucaucaccaaggaugucaggacuggaacucaagcaagucaggaagcaggagcugaugcagaggccauggagggauguucuuuacuggcuggcuuccccuggcuugcucagccugcucucuuauagaacccaagacuaucaguccagagauggcaccacccacaaggggccuuucccccuugaucacuaauugagaaaaugccuuacaguuguaucucauggaggcauuuccccaacugaagcuccuuucucugugaugacuccagccugugucaaguugacacaaacucagccaguacaauaaguaaguaaaguagcaagcaaagggaacaccucagguagugacucagcaaagcaguaagcaaagccgauggucgcuguuucugacauccuucucugagccuccauccuugucugagcccagugacaaaugccaaauuccuagaaguggcaccaaaagcucucaacaguuacacucuggaaguuuguaacuuuaaccuuccuacagaauucguugacagcucauagaccuucuggauagcuuacaacuuuugaggaauaaggaacuugguucaagaccuaaguaaguuuuguuccaagauucuaaagugaauuuaacuggacaaaagcuauucuucucaaagucuguuggccuuaauaaaguuggguuuucaguggugggggucacagccauccuccccauuuuguuucuguuugucucauacagagaaauuuuaccuuuuacaaauaauaugugagguagaggagguuaacuuugcauuaauaguuaugacaucuugaagucaucuaaauucaugaucuuagccagguaugguagcacaucacaugccuuuaauuccagcacucaggaaggagaagcagguggauuucuaugacuuuaaggccagccuggucuacauuaucagcucuaagaucgacagggcuucauaguaagaccucauaucaagaaaaggaccagugucuuuaauuucuguuuucucuaaauuacucaaauaacuuacugaggaguuuuuuccuaggcccuguucucugacuaugccauuaaaacauacauacaacccuaaggcauggaagguccuauguuccuguuuuauuaucaggaugcuucuuuuaaaucaaagaugaagccaacucugcuauuauaacagaaauacauuaauaguaacacugacuaauuuuuucuuucuuccuguaauuuuaccauuucccuccuacuaacaagaacuuugaaaacuacuuuuaugggaaaauuugcaucauuacugagcuccacgcacaccuccuccuacaccuagaacccuggaaacuaucuacuuuguuuuuuuuccccccugggaacuagcuguuacagcuuggaaauaacuugagaccccccccccccccccgccgaauguguguguguguguguguguguguguguguguguguguguaugaguguguuccagaaccucauccccaguguaguggugguaaggugggugggaacugaagagacagucuaggagaacgugguuacguuguaauggccaucaccccuggaaagggccuaacacuggucuccugaagccagggaagcucuuaaaacauuaggguguuagaaagccagugcuaaccucacccucccaaagcacuuuauuccuucuacacauggcugauccccuuucagguucucugccgugcugugaugcagccaaguaauacucaguagaacuauggcacgaugcugauuagaacgauucagcugcuaaaauuaugggccaaauaaacugcauuauaauguacaaagcauuaaguacccuguuguagcaccagaaaauagacuaguacacuagcuaacaguggagaacuuucgaaagggcauguucugagucuuucuugcccucacaaaucuucaacuuaacuugaaguugacugucccaucauggcuuaugcaguuaggagcaaucaggaugugcccuggaguucaucccagucucuguuaugucucaucagucaagucagucgggagcacaggacagaggacaaauguccugucucaacuucuuuauagagcaaggucuccaugacgaaggagcuccaugcccuuuacuaugggcugacauggggacccuuagcucuccucucaccuucuagacaguauucuuucagccaguuccacgacuacaauguuguagguaggcuagggauggagagaaggaacuacaugcugauuguaagguuacaccaaguucuucauugauuagccaaggacugaaagguuuaacgaaaguaagaugguggcuauggcggagaagaaacagauucagaacaccauagugaagcucugcgcaguugccugagauccuuagggagguaggaaccaucaggagcuagaacauuuccucucuuucuuguuagaauacaaccacuuuaaacucaaguauuauguaauuuuuggaaagagcuaaauuaauaaucugcccauuuauacuucuaggaauuuguucaaacaagaaucucucuuaguuccugaaacagccauagcgucacuagggcaacaugugggggagucaaagcagcagcguggcacuguucuuaacugcuacucagcaccaggccuccaaaugggcacuuuccucugcaaacauaugguuuugauuuucuaacaaaaggaaucuuagcauacaugacauuaccacauuugcauuuauauagugacucacuuucuugugaaaauacacauaucuuuuugcauucuuucuaacggcuuccuaguaacucaauuguuaguuauagucacaaugugguugauuuaaccagccuucucauuggggccuucaauacuguguaggaaaucaauaguuucacuagccccuacucacuacuucuggaaauaacagucagcauguuuacaucucaugcuuacuuuacuauccugucucaguggguuugugucacaacacuuaagucuuuccaagguagucuggcccuuagcucaguuuauauucucauggauagaaacaggucuguucacauagacuuugauuacuaauucuaguuggugguugcaauaaauugccacacagucugugacuuaaaacaucauaauuuaguaucguagaguucuggagaucauaaguuacaagcaagucucacugaauuguggaugccaaagacugcugaggaaaaaccaacacuggugcccagauaaccuccugaggcacuucagcuguugcucuggaccaccuaccuggucaccugugaacugugaccugaaggagaacaugaugaaagcuuguccuguugaagccagcagauugguccguaaaaucaugcccccuuuugguuuucguuuccaguuuugaacaauaagaaagguuauaauccaaaugagucaacuagacagaaggggaauacaaucaccuuagaaucuuuugcaugagcaagaaauaaacauuuggguacauugaaguugccaagguuuggauuauuuguuaccaacacguguauuaucuuaccucggcuuacaaaacagccacugaccucuguacuagucagaagaggcuggguaguuauaacaaagaacuacgcacuguauuaaagguagaguggccaacauaauucauuacacaaguuguuucaaugugauaauuuucgaaugucuuugacuggaugauaaauuauauggauguuuauuuaaagagaaaaguacuuuauauuacucuugcuucaugguucaggcuaaguauucuuuuuuguuuuguuuuguuuuguuuuguuguuuguuuuuuguuuuucaagacaggguuucucuguguagcccuggcuguccuggaacucacuuuguagaccaggcuggccucaaacucagaaauccgccugcuucugccucccgagucugggauuaaaggugugcaccaccaugacuggcucaggcuaaguauucuugccuggcauuuuuucugcuuaauuuauguuuuuucugcuuauuuauguuaauaaccacuugcaaugugauggcacuguugucauuuacauggcugagguuggguuguuaccaguucaaauucucaucaaugaccuuuuagauuuuuuuaaucuuauaacuuaauuucauaagcaugaagccaagggccugaguuuuuguuuuagcuugagcuuacauauauuuacauguagguagaugugagacuacagaggucccauggaccucucaccuauuucucugcagcaacaucuugugaaaucauaguacacugucauacauagcaaguuggaauuguuacagcccaaagaucuuauacauuguguguccaguuuuucuugcauuacuauagauuuaguucuauacaacuuauucaugucaagauuugucauuuaagauagaaaacggccaaguaaaguuuuacucauugucauuucuccauggcuaagcaugauccaugacacaaagaccccuagugaauaguugcuuaaugaauuauaaauuaaugaugguucuaaggcacuguaauggaaaugcaaaauuucauggagcaugaauaagauacuuguaacaggucaguaggguuggcaggauagcacgcuauaaguaucuguaguucuaccaugucucuagcuagcaugcaggagaaaaacaggucuuagaccaccaagggcaagaggcaguauaucauaucuuccuacauucucugauccagaacuuaauuguaaguaaacaccaagcucaaaggaagcuaagguuuauuugccuacaguucuuucucuccuugcucucugcaagauucaccaagauggagaauauuugcccaccucacugauguugggcucuggcccauggaaugugagcagaagugauagcaugucaguuuugagcuaagaccuugaugugauccaaggauuuuguuucugcuugccaauggcacuccugccauccuucaugaguagacucucaguuggguagcuauugguggagacaaucagagguaaaugagacaacucuauagcccgaggcagugcugcuucugcugacaugggacuacugggugucuuuuuuuuuuuuuuuuaauaagccacuaaagauuuggaggcugcuugcugugagcucagacuuugauuacaggguuauguuuauuauacaugggaagaaugaacauuugugaaugaaagcacuuaacagccaugagagaagcugcucccaagacaaacagaaacaacucuacuuggagaagguccuuuuggaguucauagcauagguagccagauugguuucauaacuguaagcaugcuuuccauguguaauagggaaagaauccagauuggucagucaaaugaucagugacaaagcaggaguauauuugccuggaggaaucuuggggauugaggccagguaaauaauagaaaacuaggucaaaauaaaaaaaaauuaacaaaccagguuggggaagcuuucacauugaguaaaacuauagugcuaacaucagaagccugaaauaagugcauuuaagaacauuacuuaauccaugucugucacuaagaggcuacacuagcaauugaaaucucucucuaaagaauaauuccucuaaagagcuucacugccuccaacuucugcaaagugaacgcagcuuuuuccgagaaguaacucucugaacuacuugcugauuguucugccaacaaggauuuguaugcagaaaugacacugauuuucccccuucccuggucaacugccagagauaggaaagggaaaagaaucuugagaggauagcaauuuggguuugaauguccucuuuacaguacauaaauuagccucugaccacguauuggcugcuaauaugaaacuggcugaaguaaagaagaugauuaacacauuucuucaaacaggggaauauccucauuuugacccacuuuucuccugauauuugucuucuuucuuuuaacuaugaaaaguuauaagcacuuaggugucaagagacuggaacuauaaaugccuucagcuuauauucaauaaugccaauacuuuacaaaaugugaauucccuuuuuuucuuccacaaacacacagauauaaauauuguuugagaauauauaguagauacagcacaaugauugcucacccuucaguaugaaccaccuaauaaagauaaucuuuugcagaauuauauacuacuaucacaucaaagcaacuuagcaauuauucuaucaguaaccacaaccaauauacaagucacuaaaaacuacauuuaucugugugugugcaugacacuugugccauagugcaugugaggaugacaacccgaggaagucagguuuuucccacuguguagguuucagaaauucagcuuagguucuccggcaugguggcaagcuccccuaccuucugagccaccuuaccagucuuucuaagucauuuuaaaaauuucacaaugaucuucuaaagauuuuaauggaauguucaucuauaaugcagccaagucccgaggauucuauuuggaggcuaaacuggaagucucccccacaauuccuucuauauguuuuugacauauagcauggacuugaagaaucugggggcuuaaagaagacagcauauucuugacuuaucuguugcuuuccaguguuaugcuuaaagaguaucauccuucaaaugaagucuaaaggguugauuagauuuggguuuaacaguuuuuccaagaacauuucauaggcaccaugccaggaagccaauaauuuggaaucuuucccaagggauguguaauaaugguuugguugggaaaguaaccgcuauuuuuccaugggaaagugccuuugccuagaaucagagacuugaacagauaguuuauaugcuaauacauugugaguuguacagucuuaugaaagcaagugaaggggaaaaaguugaggcaggaaauaaaaaggaaguaaacuacaauggaguucccugccaggcucuccugggcuucacagacucaccauggagucuuuccaugaaacaaagguuacauguuaaugcacggagacuucuaaacuaucuuaccacuccaggcaaaccgcugggaaaguaaggacaacuaugcuuccuguacuacugaucuucuacugcagaucccauccuggcagguguaauggcaaucguaccaaaggccuaucauucaagagauaagaugaaggcugguaaugaccgucauguuuauccaggaaccaggaccuuucuuuucuuccagcccucccuccuggaccauuucccugcacuuuguaucauaauucuccuccugccacucuaacuguucuaguuugcuuuuacugcugugauaaacaccaugaccaaaagaaacuuggaaaggguuuguuucaguuuacagugguaaucuaucaugaaagggaacuccuggcaggaacugaaacagaaggcaaggacaaacacuacuuacggacuugcucaguuugcuuuucaauacaacccagaaaccacugcucagggaugguaccacuccaguguacuggguccuccuacaucagucacuaauaaaggaaaugccuacaggcuugucuacagucacauacagaaccuuggagcagagucugagcaaguucuaacuaugcagcucugauaaguugcagaaauuaucuguuuccucaucugucaaucacagaguuguuuuguccuggauuuauuuuuagauuuaguauuuucucuaacugaccauuucuuuuagaauuaacauguucuuugccugagcuuucauuucuaacuucucauuuucuuuuagaguuaacuuuuucuuuaacuaagcuuccauuucuucuaacuucuugucaaggucugaaauuuucucucccaugucuucuaguuuguuguugaggcuuaccucugagguuuuuguuuggcauuuugaguuuuucauuuucaguucuacuucaguuuggauuuucugcagugauucuauuucucucuuaaguucuacuuuucugucuggagauuuguauuuucaucauuucacucauuuuuuuauguucuuacagccuucauuaaaacauuuaaguagauucucuuuaugguccuuaacauacuuauaguaacuauuuuugaaguccugugcuucagcuaaacuguuuuuccucagagccuacugcaauagagcugcuagccucaugagaaggcauacugucuugaccauucauaguuguacuauuauuauuaauuacuauuaugugcuauagucuaggcaucuggaguugaaguguuucuuggcuuagcuaucuggucucaucuuuauuggguugguguucuguucuucuugcugcugcccacucuggauccuaguuaagugugauggccaggggguucccuaguagagguuuuucugugagucagucuggugucacaaaugaauggagcuaaacuagaaggcuuaaaggcgcggcaagaaagaacuaggaggacccugggguugcaccaagagucauagucuccagagaauggagguaaagugggagggggugccugcuaagaccaagacuaggaagacugaaauagaggccgggaaggauaauaaaggccacuuucuuuugaguugcagucuacuguggccauggggugucccugguagagcagcucugcagguggucagguguugcaaaagaauggaugggcuagaagaacacucccaagaguuguaggaauccagugaauuaggaauuacuguguguaaagccuaugagcauuuccugaaaggcugagaauuauagauuacuuacgucauacaagucuaaguuagaaggccacucaaagaacuaggcaugagugugaagaaaguuguccccagggaagaaaugguaaaauuauaaaagaaguauuaaaaugauacuagggaggcagaaaagcaauagucccuuacacucuggagcagguuagaagguaguguuauucuuuuggauauggaacacagggacaaaggagguuuugguagggauuuuuuuuuuuuuuuuuuuuuuuuuuuuuuuuuuuagugugguguacuggagacaguagcuaaaagaccuuccagugagucuggauuucaguagagacaucugggcuggagauacauaugugagguauuccacauaaaugugauaauugaaguucugaacacauaaucucacuaaaaugaaguguacagagcagccaugucaauggacacaaauaguggcuguuugcuugggccgaccaucaaaggaauggcaaguuacugcuuagugggcaccauuuuuaguuuuagaggaugaaaggaguucuggagauugguuacaugaaaguaugaauguacuuggcacuguuuaauuguauuuuuuuuugguuaugauguuaaaauuuacguguauuuaucaagauaaaagugcuuuuugccaggggcagccccagagauucuucuuucugguucucuugaagguaguagaguggugaagaguguuggcgagggcgagacuugcucuuaugagacauuuaggguuucuguuuaauaauaaaacauuuaccuaucuuaagccuaagucacuuugcuucuguagcugaccugccugucugaguucaucugaggccagaagcugcagucacugauguuuagcaacugauagcaaaacagaggaaggcuaaguagucuuugucccuccucugcagaaacuucucagcucugacucccagcuugcuaaugaaagucacaggaagaaaaagggacaccuugaaaagugauuuuaaucuuuauuucuaaguucuccacaaaguucucucucuaaaaguucucuuaacaaguucuuucuuuaaaauucuccaaagaaguucuucuuugaucucuuccucuaaucuugcucucuccugcucuguaacaguaacgcccuugcuccugaugcuaggcaaugcgaucuuucugagacuucuguaccuuuuguaggaaaacagaucaagugguuauuccuaguauucccacccccccccccuuuuuuuuuuuuuuuacaaaaguucacuagaaguucaaacauaaauucaagucaaaaauugaaugagaaguucacaacagagaauguuuacaugcuuaucuauuaagaguaauuauuugguuaaacauuaucugucaccagcucuacagguucauggagcguuaaagacuauaacuaaguuaucacugaaguuuugcauagauaaacccugucuuuccaccuacaaaaaauuauuaguuucccuuucaugaccuuggguuaauuuguuuuacaaccucuugggauguucucuaaguuauagaugucugcuuucuaucucaaaagcaauuaacuugugacacuugaagacucacagaguucucuuugcaguuuugacaucagaaaggacuuaauagcaguucuauuauaaaagaacauaaugauuacuaauauaauuuuaggacauuuuauagaaucaccauuaaaaauuaagaagucaucuauuugucuauauaguaucacuauaagacaguaugauuuuuguucugcaaaaaucuguucaaaagggugggcuaauaccuugugauuaauauauauuuuuaauaaaacaggaaaagcauauuaauagcuggaauccuuucuaaauguaaucuccuagaucuugccuaaaaaagagauuacgucuuaacuuuacaguccacgguggaaccaucucaggaagaucaccugguagucuuuagcgccuccuagauggcuccuggcagcuuuugaaguuguggggaacuauuuaugaaugugaaaccaagcaaguaggauuuuagaagguagccacccucaaugcccaaugcagcacuuuggaacacagaaugaucaauaauauugcucucuuacuaaaacugaaucucauccuagguggccacaggaagcucgggaguuaugaugcccugaaauuagcacucuuuagcuuggauuaacauuaugagauggauuuggguccuagaaauacagcuucaacaagcaauguauuuaacaugaagcaacauaauguccauaggggacagugugauuuaccucauacgaaaaugugauuauagccgggcaugguggugcacaccuuuaaccccagcacuugggagguagaggcagguggauuucugaguucaaggccagccuggucuacagagugaguuccaggacagccaggacuacacagagaaacccugucucgaaaaaccaaaaaaaaaaaaaaaaagaaauacuuggcuuucucuaucuuaucagucauauuuuaagaacuccaagaauagaagccagguuauggaccacaggaagcagauggucaagucucuguuugcaaacaggaaaagcccugcaagugcuuccccuaaaccucacuguacacagcaccuuggcuucugaugacugccugugcacucacaaguacuacagauauuuaucagcuccaguuuuaaaagugucugcacacucaugucccaucaguucuguaugagaacuucuggccagauaaaugcuagguuucuguauccuagcuucguaaagggaaaccuaaucucuggagcccacaaagaaagaugacagcaccugagccugccaguaaaauauuaauuaaauugaacaaagauaaggauaaggguuuucagguacacaggaugucuacucuuaagaaguccauaauuuaacuaggaaggaacauccaaaguagaauaaauuaaaaucacaauucaaggauuaaauaagucagaguaagacacaaaagaguaaauacaccuuucuuggugacacgaggcaagagggcuuccacuuucuaagugcacuuacauagcccagccucaguccuauccaaggggugaaauucccaccauguggcuuaauaugcugauuccacucagauuugucauagcaucugugaagcuuuacaccuuagcuuuuguggugucuagguuuguuccauccucuguuguucuacaucugaagugggaacacuagcuaaauuaacaaaaaagaauuuuuuaaagcuacaaagaacaugaaaaaagaauagggggaauuuagucuucuagaagauucuauccuuaccaccuggaauugcugaagugaaugauuuuagaaaauggugcaaugacuaaugaguuacacauucagaggagauaaguaaaagauauucuaaaaacagucagauuacuacacagaggccaggcaugacggugcacaccugugaucccaggagaggauggaucuccuugaguuugaggacagccugguuuacccagugagcuucaggacagcaaaacuauacagagaagaacaaaacauagacauauuugugaauaaauuauaagaaugguuacagauauuaugagcccuaaguacacagacugggaaguucuaagcacuuaugcauuaaaucaguggucacacuaacugagcaaggugagggacuuucauuauuccaagcguaguuaugagaaaauugagguacagaaaguuuuagcaacuuuuccaaguauaacagcugguugcuggcagaacugaauaaaauaaaaacuagaauccuuagauguaaaggguauuguuucuaggaaaaucaacaguguaauuuggucuucuaaguccagugcuucugaguguaguuuuuguuuuuuguuuuuuuucgagacaggguuucucuguauagcucuggcugucuuggaacucauucuguagaacaggcuggccucgaacucagaaauccaccugccucugccucccaagugcugggauuaaaggugugcgccaccacugcuuggcccugagugugguuuuugauagauuuuuuaaauuuuaugugagugaauguuuugucugaaugcauagaagugcauugcaugcuugccugguggaccaaaggcagaagaggguaugagauccuacuggagucacagaugauuuuaaauagccaugauggugcagagagcugaauccuguaagaauagcaaguauucuuagcugcggaucccuuucuccagucuuaagauuagguucuuuuaagucagcugguauuaguuagaggcaugaccaugugaccaaguguuacagaucuggccaauuaccccaucagcucuaacauaucgcaaccuccguuaaaccucugcugcucuaguagaucguaucugggguucugaccgguggauaaucauauacuaguuauuaagagcucagcacaaguucauguucgguaaacaguaaccgagugcucuucauccuuuuagaaagguccuaccucauccagcgaggcaguggaaaauagugaugaaugaaauaaaacuuuuuccggcacugcuacucaggcagcucagcucaguaacagguuuguuagaacaggcuuuggcuugcuagcauaaagagugccuaaaaggguccgugacccuagaagcuacuuccaccaggcaguugcuaggcgaccuccuggcaucaggacagaggcagggcagccacgcaggucccgccuccacuuuccgcccuaguuccugccaccucuggcagccagagcgucaacgcgagcgaccggcuggaggaccggcggcgcaagcgcgcugcuucucgcgccgcacugagugacgcacgcucccgcucuaggccucagccuacgccccgcccccugguggacugcucccgccccgagccccccgcuacaucuucccaggggccuucugcaacgcccgcccuccaccucgugaacacugcacaacuggcccaagcgugcagacacaccucccgcguugaugauggagggggggggggaaaguggggagccagcgguugcccaggaccuacuuccggaggacaggcggaaguggcugcggugucuggugggaggggagaaggagcgcgagggggagggccgggccgcagggggucgaggggguggggccugcgggcggcagggaccuggccccggccuggaucuggagccgggagggcggaggcucccagcccggaccgaugggcggggcccagguaagcagcccgugcagggagggacugaguccuaggcgcagcggaagggaggguucugaguauagggagggucucagugucacugugccgugagaacgccgagcgcugagcgcgggguuuggaagggaagggugggaggaguuaaguucuugggggguggggggugucaugugucggccacgccccuacaggaagagggguucauguguguguguguguguguguguguguguguguguguguguguguacugccaggggauggggcaauaggaagggcucccaaacugagaaauuggggcuguugcaaaccggacacaggccucaaauauuccaggagagugcucucgggaguggcccugugaaggaguuugaaagaaauugggaauugcauccuuggcauaguuuuggaaacagugggggaggugagguugcagggaaugccugugaaaggcgccagaggcuagugcuggguaggacugacaggagguaggagauuaaaacacugaacuccgagagaaccuugagagagaggauuaguaagugguguuuuagagaacaguagacccuauuccuguauuuuuuuagaagacagucuucccauaccgacaguacuuuugguaacauuucugcucugagaauaggcaugacacaaacacacauaaacacauaugcucaaaaugauggggauacaguaugugcaugaaggauguacuuuuuauacaaauuguguggcguacucaagagaguuuguugacugaacacgguaaaggaguguggugaauauggaagucuuagaaauccacuggggcauguauuagauuagagugucauacuguuuaaauguuccacagguucccacagagaucagccucccgggccauguugguguuaaagccuguuucuucuccugagccccggcagaacacaaguggaccaguggaugacuucucuugucugagcaagagauggccuaaucccugcaaucucucuaccacuggccucugagcuguaaaagccagcuggaugaagggauguaacacgcgccugggagggacacugaagucaggaguggggggggaggggcccggacacaccccuuccccccccagacuccuccccaucagggugcacguggccauggacuuuggaccuggauaaguggagagaagcuguacuuugggggaucugauucucaguuuuggaaaugaaguauuagguugggggagggggcgggguugaugaucuucagggaagcgacagagagaagaaaagaaagguaagguuucgguuacuuuauuacuuaguaccuuguuguuguacagggagcgugaaugggaaaggucugggaaugcagccaugucggaagucacagcacccguguccugauaagaacccuuauccugauggucaccucugcuucacucuuucaagggggcggaguuguuucuuucccguuccucacugacaguacagugaauagcugguaaaggacugugaguuuagguaggugagguuaggucaaggagagcccucaaggaaaucaggcuucaggcgggcuguuggauuaguuaccuuuaaaagccuuucuuccagugagauaauaggauuucaaaucagccugggcuaaggcugaaguggauuacucuggccgaugcaggcugcucuguuuuggaaaucuguugacagaguaagacuucaagggagguggggaagggagcuggaggguaagaaaugguuagauagcuuacugaaccaucucucugccuccuuccuuccgcaguaaggaagcuuaggucaugaaauguccuggaaagaacacaaacagagcuugaguuuggggaacaguaaaucuguggucgagcucagacuuuccuggucaaugugcaacucgagauaugauaaucaccucuguccccuucuccucacacuagaagauauuucagucagguugcuacuaggaacaaacggaauaauuuuuacauuuugaaaguacccuaggccuuguacauauaaaacggcaacauuaacuauacuggauuucuuguuuauuguaacacauggaaaagcucugaauggaaguugguucuuuuauugaaugaacaugcuggcuagagccacagcagacauauugauugaaggccugcagggcaaugguuucaucauguuauauaaagguggacaguuuuaggaaaacuuaaauugagggauccugcagcuuuggggauggaaguuuuaagaagagcuagagagaagacagaacuguauuucucggaaugggugcugggccuuuucucuugagucauaucccaucuguucucaggugacaacugccuccaaacuggcaucucuugggcuuuuaguucucuuucgguuguuuaucacccaagcaaguuuguucuuaguugucuugguaccugccugcacuuugcuuggacuuuuuuuuuuuuuuggaagcucaguuuacuuauaccaaggugccugcuuuucuuagugaugaugucaacagcaaaaagcaagagauucgguggaugaauuugaggcagcauaugcuggccagggcuagcgagacucauugagccuguaagucaauuacagagggacaucgcagucacugaagacaacgacuguucuucuugucauaggagucccugucuuuccucaguggccugaagccugagaagucugcccugaauaggucuucuggcucugagcuguuuaucuugucugaagcuugucuggacuccugaagagaccagacuuuugugugugaaucaugguuggaugcgucaccuucccuccagccacucaauaaaugcaugguugccggucuuugcucauguauggggaucaugauuucuuauggcagugccuccugagugaccuauagggcaugauauguucuagaagacuuccuaguccuacggaggagucccuccuggcccgugaguaccuaaagcacccagaguacugaggagguguguugcauugauugauggcuuucaaagugucaggucuguugucugcuuucccucaguguggggauugcuuuucuaguuugaggaggagcuauggaggcccugagcaguaagagcucacugaagggguguggcauaugcugauuguacuugugcaguugccuuuagcaucagccugccagggagagaaacugagugcccugacagccucucugguaaguccucuccucuguaacaugagcuagauagaggcuuucagcugccagaacccagcucucccaucuccugugacucuuuggucagacauuucuuuccagccuucucaugggaucagcagauugcuaggguaccacacucaagugugucaggcuguuuagccaggacuggugguaaauuuaaucacacguuguguggggauuuuuaaguggauuuauuuagaccuuacuuuauucuaaaggaagcgcagguagcuaaugaaggauuucagaggcauugcucagugucuacauuguuaguaagcuugauuuucuuucucuaucacuuugugguuugggacagacauguuaggaagaaugagaaaggaaacuuaaacaccaguuuaacacuuugguuuuguuuccucuaacggcuuuaagccaagguuucuucagaaauucagagcaugaguccuuuccaaacugcaaacacuuucagguagccaggcuggaguuugugagcagcaauuuccuggaaguuuuuacuuuuuuuuuucuuaaguuccuuuuuggugguagcagaguaagcaggcaagcauauuaccucuuaauucucuguuauccugugacuagaucuaccuguuuuuuccauuugcacauaaucugaucccaggcucauccccagagucuagacaggcagcucccauuucuuacuuucuucccuaguguaagcucuguagagcccaaggccucaguacugauacgugcuuguugcuuagaccaaauacuauuacccuuguuuaaaauuuacccaauccaaauucuauguuguagccuauuuuuuuucggaggcaggguagccuuuuugcuggggaucauucugugagccuuggaauuuaaacaaagggcugaagagauggaugugguggggaguuucuguguucugaccugcuuccugucuaagugccuuggcaggaaagucacucugacauggccugggcugccucgucuucaccaucuucaggaccuacuauguauggauuuuauccaggauggugauuugugcuccuuauauuuuggauaucuucagaccaguuucccaacuuuuuacacauccagggaacuuggucauuuuuuucucacacuuuggcacugagugugaaggcuauaagucccuaauuccuuuuuaugggaaguagaaagaggccuaaaguauauaaacauuggcauucucuuggcacaugcaugggcuugacuuuccugucacagucugugcagucagcuaaacuggaaauagugggcauacacacaccacacccacacacaguccuccucccucccucaugcgucagcccuuuccucuacgugagggcagaauuccagcugcuacugugaagcuucuccgcugccccacuguguccugucacaugggcacaaagccaucucagcaguccuucucaagggcucaccaggguaccagguuuggaagcugaaaugccuaaaucuaaaaucuggcuaugacuucugacuuaacagcuuccauacacccaaagccucagacuucucucugcugagcucugcagagaugcgggagaguguacagagaggccaagaaaacaggcuuggacggaagggcagcuuccuagugucuccugacaacuuuguuuuacuuccucaccugcccacaagggcccuuaagguacucccacuuucugcauaauuccuggugucugguacgaacaaguuagugaguaacacucaguaagcacagaccuaaaagucccgguuaccuuggggacucuggaacaguagugaugaagucuguagguaggagggucugucugagguugaguauaucuaguaaucaacuggcagugccucugcuccccucaugggugaaagauccaagggugguuggagccaaggcuuaugcagagggccaggcacagcaggaugugggagccagugggggcugugguaccauggugaguggacaguagggauucccagacaucucugauuccaaaaugguccugucagugagauguggcuuacugugaguugcuaauaaugcacggcucagaucucagaaauaguuugugcuccggggccacugcugacaucuaaaucagacccugaaacuccugguugucaucuuuccucccccacucaggcugcuugaggcucugauugagguacuuaccaaguacucuguucaguuggguccugaugagucucccugccccucccauguuucuuuugcuuuaaaaaaauaccaaggaauacagauccagggguuuccuucccccucccauucauuuuuaggguuacuccaaaagccugugauugauucuuuccuuccucaggacuuagguucaguguacaggccugacuuugguuuccccgcccauaaaggggcacacacacacacacacacacacacacacacacacacacaagacagaacugaaacggcggcaggcuggcucuuacccaccuugggcagcagguguuuccucccuaucuucccuuuugaaaccgaauacuuguugcuugcacacccucaccccucucuugcuguuuuuuuuuuucaacuaauagucugcaacuucccucgcauagaggaaugguucccagguucuuagaauugagguuggugaacgcucuucuugcugaggaaacgcuucuaacaccaccaagugcugcaccccucaaagucggugaaucucuagauucacugggcuggacaagggacacucuugggaaaagucuuuacuggacaaggcucagggugugagugggguuggcaucuacacaggagcugcaacugagagggaaagggccucaaacaaacaucucugcuaccacugccuuucgaaguugggggacuugggaagacccguuguuuagaucuugaccggugaucaggaagucagcaguagaggaaggcccuggaaggaggggccagcgcggacucgcccguggcagggcggggaccaacagaggggccuaggggcuggggagcgccgccccgcccucccggggaaggaccacauugccggcuagcaggaaggccaaccagaccggacgaggccgcuccagcgcuggguguugccgguccggggcgagccugguuccaggcggggugaguugagaggauccggugagcugggccgggggacgccagcguccucaguccuggggcuugucccaggaggacaaggaccccggaggagagaggccgcgcagccaggggagucgggucugagucccgagugugcuccaaagccagggcggugagaguggcgggcccgcccggggccgcgcagcgcgcagucucccccacgcggggaagugggaacuuaacgcacagcuacaggauuccuggccuucagcugcuagagggaggguggcuucuccaggaggagcuguugugaaacucggcaggagggcaccuugggugcggggcagggcagggcagggcaggggagagauggggucgcccugaagaagugggagacuggaguggaaaguggacuuuaugcaagccucaccccagcguccaggcuucauaaguuacuagggcuggcuuuugcucagccacaaggaaaauuugacucaauguugaaauaugugauuuggcaagaaaacuuuuuuuccuagccuccuuucuaguauguuuggaacagggggcucccaagaggugcagagcccccccauuguucaaaaugugguucagagggacuguggcccacccauucgagucuccauggaagaguggccuucuggugaagcuucuuuuucuuuaaccuuggcuacuguaaggcucucgugcuugagaauauugcuggccagcuugauugccugucauuaguacuauuuagacuagagcguccuugauucuggggucuucccguuuccagucacuaguccuugacuuuuuagcauggagaucaccaguaauggcaacauuacaucccacuucuguuucucagaaggcuguauuacaguguguucaaacuccaugucauugcaacagguuaaacucacuuucugcuucggacgucaagguauugccauucuaauccagacaucaagggcgguggagaagacaaaagucgguugucuguuuacagaagaggaacugaggcagugguucuucagguaacggcuucagggcugucugucuggugccaggcuauagcagcauuguguuucccuuugaccuguucccaggugaauagccuguaucccuccuaggucuuacccucuauacucuugaauuauuuagcauaucuacucggacuucuuuucaguucuucuuccccucugaaauuauggagccugguacaucauacagagucuaacaagaaaguaauucacuuagagagccguuaucugugauggacacuaugugcucuguacuuguuuaagcugugcuugcuaucauacuggcaaagcagaaacaggagggacaguucaucaacgguucuuccauuucgagacuuaguuguaaggcuagaguaaugguugcucuacugcuccuggcuggaaguugacuauuugcuguuugcuuguugccuaagaaacagccucugacagagaggggcaagcauggaauccagaguguuagaagcuagaugugcuagugcacgcuuguaauaucagaacucugcaggcugaggcaggaggagcaucagguguaguaggcaagcuugcacuaugugcaccgucuuagaaaggagccugcucuuaugcgcuccuucagauuagaaugugagaaggccccagagggacuggcaagacuugccagagccaccuggcagcuggcagaaccuucaguaugccgagacucaggucucaccccaccauggugcaaauguuguugugcguggugguguggguucaccugcuaguuuccucaaaggaguccuaaaaacacuggaaccaugaaagcaaguuuuaaacugagugugcauauuacaggcaaaucucauaacugauauauuaaaaacucaguucaggguugauggauauuuuauuuuguuauuuguuugcuugcucuuguuguauguuauguuuuguuuugguguauguauguauguauguauguauguauauauguauguauuugagacaggguuuuucuauguaaccuuggcuguccuggaguuugcucuguagaccaggcuggccuuaaacucaacagagaucugccugccucugucucuggaguaugugaucaaacgcauguaccaccaugccccgccuaggguauucuauuuuuaaaaggaaaauauggcaaaagaguuuucaagaggcuuuguucauaagugcuguugcaguuuaacuuuguccucuucucacacacugguaggguuuuccauuuucauuucucuuuuuaaaaaauauuugugcauauacauguuuugccugcauguauguuugugcagcacuugcaugccuguuuuuuucaaaggccuaaagaggcccuuugaauuggaguuacugagaguucagagcugccaucuaggucugggaguggaaccuggguccuauagaagagcagccagugcuuuuaacagcugagccggcucuccaccucauugcucucucauaggaaugguaggaacuagcagucuccuuaggaacugaagaaagcaaaagugagccaaggcugccuaaagaaaaagcuucaacuggccaugccguugacgucuuggagcacuuccuucucuuuggaacccagccacugaguucacuggaagccugggccacaugaaggagcacaugauggugacuccggccagugucccagucaacaucaacauuagauuacacauguguuauggaccaugcaucuauaggaggcuagccuuagcuuuugagucuuccaacccgaggucccaacguaaaacagacagguccuucccucugugccccacuuucuaaauucuucagcuauugcuauuggaugaggaaauaggugauuguuacagucuuaagccaaagaauuuugaagcaauuuguuauuugcccccaaauaaaaauacugguaagaaauguaaguacaguugucuuuaagacugaggcuggggaccugaagggagcagguccagagagcucucacccugcuucucgggaauucugguccauuuucucgugauugcaaggacugaaugacugcuguaaugaguuaucccaaacuuccaaacuuugugggcugugggcuuucaugucgcaguccaauggggcugguucccuuucauacucugugguugauucuggcgggcggucagcuggacccucaauguccuaccuugaucuguagccuggauucggcucaaccuucccgagugucuccugccucauuacaggugugcuccaucacacucaggugccuugucuuuuagggaugacuuguaggagucacagggucucagaaucagaacgagggaauguggugcucccuccucccccaaggaaagacguccaucauccugaaugagaagcuuacaggaggggagguguggcagcaucugugcaaagugcaguucuucacuuuggcugcuguuucuaucgucauucucccuucuuuaguuaauacuacagaugguccuucaugcacccucucaucacacuguacacauggaccaagcaccguagcggguguagaggacacagccucuuuucuuaaggagugagguaagagcuaaggaaauacagucuuggauucuguuacaacauggagagagugcagugaagagucgucaugggaggcucgcuuguaucugggaugucguaagccuaaaggaugucaauguucuuaggugggguauggguuacauuucaggaacaaagacacaacagugugcaacaguaguuacuggagaaauaaguagccuucugcggcuauuguauuggauccacgucguuugugguuggaaaugagauugcaucgggauuaaagucugcuguugugaagcccauuucugucaaacuaagaaguuuucaucuuuuuccugugggcaguggcagcuucugaaggcuuuuaauauuaauguguuuaagauucuguugcuaccagaagguauuuagagagaagccacagguagacuagauuagcuggggagcuaacaucagagguuccagcuuaaaacaauauucauaauaaacaguccaggugagagggugugaacugaggacuggcaguggacgguaacuuucaacccuggcauaacucugaggcuucuagggcugcucacauuucuagaguuagaagggguucgugaggcccaaccccugacaggagcuguggacagcugcuggcuucagugggagaaaagcaugaguuugguuuuuuuuuaaggcguggcucccgcagcacaggaagaccuccagagccagccagccuggacccacagggcucacggagacugaagcaccaacugaagagcaugcaggaacuggaccuaggcuccugcacauauguagcagauguacaauguggucuucaugugggucccauaacaauugaaguggguacuucucugacucagagucucuugccugccuuuggaucccuuucccuagcugccuugucuguccucaggggaagaggaugcacuuaguacugaugcaauuuggaugugccaggguggguugguuccccggggauggggucggggugccccuucucugaggagaagaggaggagggacgagaggaagcgggugguaggguggaaaugggaggagaggagagaggggagcugugauagugaucuaaagugaaugaauaaauuaaugaaaaaggaaauguugcuccugguagguccaccaugguccagggaauggcucgacacucaugaguauaugggcagcacaaauuggaguggaaacagggaaguuguggguggguuuagucucccucucugucugucucuguaucucugccucucucucuaucucucugugugugaaugugaucaaaaguuauacaguauaugaaauucucaaaaaaaugaucugguguacguacucuguuauaagaucagaacacugcaccgugauccaccaugcuuauuucuguagcgaacugcgaauagacaccgaggugcaauggagaagauuguuagccucacauuaaauuagaucggaugcugccggaugaggugcaaugagauguuauuaucaaauggguuuugaaaacuuuuuugggugcauuuuggauuggaauggcaguggagagauugcaugaauguggcauucauacugaagacgcuguguaggcugcaggugcaucuguguaggcugcaggugcaucaucuaaauguugaaguucguggcuuggcagugcguggcgcuggucccaccuuguguugucuuuugcugguuccacugguguggaugguaauggggagguguacucuuaugaucugaaggcaucaagaaagaauaucuuggcauuuauuuuguuauguagcugguacuguucuaaauaugcuauggaauaucucauccaauccuuaaagcaacuugcugaaguauucaguuaugcuuuccaucuuagaggugagaaaacugagucuuacagauauagaaaaacacaggcugauggcaagccuugcuucuuggguaucuggcuuugauuauuauuauuauuauuaauaauuauuuuaaaaucuguaccaaagugcauaugguaccagaggggacugagcagugcucccuggaggagcuuccaccccaucagccaaggcucauaccucuagacauggcaccugcuguagauguagauguagauguagaugcugcaucauucccagccaguguaaguucauacacuacuaacauccagacguggaugaacgcccugcccugaagaguauguaggaacaugacacagggaaucuugaugagucuguguggagaggcagcuagggcuucagcaggggaacugugcauucuuguggcaaaagaaucaaguauuguuggaggguucauagagaagggcugaggagggggguaggaagagacuaagagccaaagagagagagguuuuucuaugagcuauccagccacucuaaauggcuguagacuugcuaaaaauccugcugacaggcaauccaggcuugcuuugaucugcacucuagugaaugcauugcaccuaguucaacaucuagagaaaacaagucauuugaaaguaaaaucacuugaaggguaaguagggauuucuugaggauuugccgccauucugagaacuugcagauagaacugaagugacaaaucaaggccacuguccuaucccagucauuuaagguaauuccuuucgcuguuugucucccauccuuuuguuuuaaagacuuuccccuacuuggucaccuauuuagaaagcaggaaguggggggaaauccugaaauccuggccauuggaauucuugcaaaguuucaacauugaucacauucuguaggggacugaaggagaccuggcaacuggugcaucucucaucucucaagaaaguaguguaaugacacagcugagaggaaguggcucaagguuucugcuacauggcauucuggauugugugggugcuugguuuuaggaggaaaucuaauggccaggagcuuggaaagacaggacccagaucagagggcugcagagcugggauucaaaguuuuagaaaggauagagaauaggguaaguacagagcaaggcugauucuuguguccuggcccuuccaagagccuagcaggagcaggcauaugauugagggguuccagguaaaucugcucaucucugcuucccuuacugcauguccccaccuggggcaauacuaauggaugaagucacucggaaauggacuccauguugccuuauuuuauugcuuaugaaacuuuauuuggaaaaaaaaaguuuaaggaauaaaaauggcccuucagagugacauacagguauuauucauuguuauuaaugucuugcuccauucacucuguguagcuaugauaauuucuguucugaacuacuugagggcaucuuucauagaccuuugccccaaagauuucauuguguauuuauucccugagaauugccauguccucucuuagauaccucaguggcuaucagccacuacacauacuuuaaccuacugucugcauccaguuuuacuugaugauuauauuaaagauaaagugucuuacuuuuuuuagauuuuuuucuauguuauauguaugaguguuuugccuacuuguauguaugcauucuugaugccuucaaaggucagaaggagacaaauccccuggaacuggagcugucuguagauggcuaugagcugccuugugaguucugggaucugaacucuggucuucuucaagagcaacaagugcuuuuaaccacugagucaucucuccggucccuuagugucuuuucuauaagaagagguuuauuggaguguaauugacacuugcauuuaaaagguacaguuuguuuugauauauauacacacacacacacacacacacacacacacacauccauuaaacuaucacuguaauaaagacaauaaauauauauaaauaaauguuuauauauauauauauauauauauauauauguguguguguguguguguguguguguauauauauauauauauuaaacuaucacuguaauaaagacaauaaauauauccacucacucgaaaguucaacugauuuccuccagccccaaauugagaacuuagguuccucagcagucacuaagagacuuagucagguuuuaauuauuauuauuuuuuuuuugccaguuucaugaguaacaucaucucaagauaguuuuaauuugcauuuugcuuaugcuugaaguugaacauuuuuugauaugguuaaggacuguagguauguauuucuuacaaguuaccauuauuggcucauuuucuauauauauauauauauauuaaacuucuuuuuuauuugaacuuuccccccgagugugguauuguguaucuguggcugaugcuacagaagcacccaguuggcucuuuggcuuccuugugcaguuucuaucuacacagcagucuuucaaguaagaaggauaccagcauucuuuuguuacaccaagauuuugagucauaauuagaaagccuuucugugcaacuggauuuccucccauccuuuacauuuguuucuuuguuuuauuuuguuuuuaauguuuuaaaauuguggugcacuugguaauuauucuugaauauugauacaauuuuacauuuccccaaaugccuguauauuccagcccuguucuaguccauugguuagucugcuuauucauaacugucuaguugcuggccuuuaguggauacugcuuugauagcucauuaagaggucccuccuuaccacucauuguuaguguuugccugguguucugaugugugugcugcuucuugagagcucuauugacuuuuuuuuguagcuccauacaacagcuuuguugcuuuuguuuguuuguuuauuuguuuuuggguuuuuuuuuuuuuuucaaggcaggauuucccugucugcauagccccggcuguauugaaacucacucuguagacaaggcugaccuugaacucacagagaucugccugccucugcaaaagcauuuucauugagguguuugaugguuccaguaugguuuaaugaaggagagagauguugaaguguuuuucagaaauuguaauuuuguuucauacaaguuuuugaaugcuuaaguuuauuuuuaaauauuuuguuuucauggauuuuuccauagaauuuuuuaauguccauuacuucuucuaguuauuauuguggauaugaguauauuuguauguuaguuguuuuuaccauugauugcaguauaacuguuucuagaaacccucacauaucagcaaacagauaguucuacuucggccuucaguuguuucauuuagucuacuuguauuggcuaauuaauaaccauugagauugugggcgucauggcuuuuaaaguuaauauauuacuaccacacagaugcaucuaucuugcuuugguuguacccacucucucucuuuccccuucucauuccuucuggacugcaggcuccuuucccuuuccuaauaaucuauaucuuuucuacuacccuccuucuuuuguuuuucaggacacagucucucuguguagcccuggcuguucuagaacuugcucuguagaccaggcuggccuuagacucagagaccugcuuacugcagccaccaccuccucuuccucuucuucuuccuucuccccccaaguacuggaauuaaagggguucaucaccacaccuggccuccccucuacuuugaaguuguuauuuguuaccacagugagagaaaauguacauauuuggcuuuugcuuaacacaguucuuuugacaggauuaugcucuuucuggcugauacugcuccauuguguuucuaaaccacauuuguguaucuguuacucugucaccgacaccagggcugauuacauaacuugcauauugugagaagugccucuauaaacaugagugguguaggcugccuagccuugcuucugacaucauuguaucaaacaaagugaccuggacacagagagacaaguguuggcuugcauuguauuccucacuaagucaguuagaacauuugauuaaaaaaaaaaaucaguaauuuuagugcaguuugacaugaggaauggggguuaaauggucuuaccucucacuccugaucugaccuagacuagaucaaaggcaggagaugaagucugugugguagggaaccaggaguuggagucuuuccauuuuguuuuauuauuuuucggcucucuuccacaagcaccauucucugccuccuuguccaagucacauugcuuuccugaggacucauuagcucguuuugaagugguagagggaacaugucagcuuaauccugcagucagccacccucucuccuccuuccucagucucucaccugugcccagccucuccccacugcuguguggaauuauacaaacuugagguaacaauugguuuucucucucccccucuuuagguacauggcuucuuccuacucucagccuagaagaauaaacccuuaguguggggaccugagccaggcaagccaaaggcagccuugagcccucccuccccugcccuccccugcgggggccaggaugcugaagaagcagacugcagggcuugugcuuuggggugcuaucaucuuugugggcuggaaugcccugcugcuucucuucuucuggacacgcccagcaccuggcaggcugcccucagacagcgcccuuggugaugacccugccagccucacccgugaggucauccaccuggccgaggacgcugaggcggaguuggagcggcagaggggacuguugcagcaaaucaaggagcauuaugcuuuguggaggcagagguggagaguucccacuguggccccuccagccuggccccgugugccugugacccccucaccagugcagauccccauccuggucauugccugugaccgcagcacuguccggcgcugcuuggauaaguuguugcacuaucggcccucagcugagcguuuccccauuauugucagucaggacugugggcaugaagagacagcacaggucauugcuuccuauggcacugcagucacacacauccggcagccggaccugaguaacauugccgugcagccagaccaccgcaaguuccaggguuacuacaagauugccaggcacuaccgcugggcacuaggccagaucuucaacaaguucaaguucccggccgcugugguaguggaggaugaucuggaaguggcaccagacuucuuugaguacuuccaggccaccuacccacugcugagaacagaccccucccuuuggugugugucugcuuggaaugacaauggcaaggagcagaugguagacucaagcaaaccugagcugcucuaucgaacagacuuuuuuccuggccuuggauggcugcuguuggcugaucugugggcagagcuggagcccaaguggcccaaggccuuuugggacgacuggaugcgccgaccugagcagcggaaaggacgggcuuguauucguccagaaauuucaagaacuaugaccuuuggucgcaagggugugagccacgggcaguucuuugaccagcaucuuaaguucaucaagcugaaccagcaguucguccccuucacccaguuggaccugucguaccugcagcaggaggccuaugaccgggacuuccucgcccaggucuauggugccccccagcuacagguggagaaaguaaggaccaaugaucagaaggagcugggggaggugcggguacaguacacuagcagagacagcuucaaggccuuugcuaaggcccugggugucauggaugaccucaagucugguguccccagggcuggcuaccguggcauugucacuuuccaguuucggggccggcgugugcaccuggcacccccacagacauggacuggcuaugauccuagcuggaauuagcagcaccugccuuucccuccugggucuccuugccgcgugcugagccgaggcaggccugcagggccugggcuacaccauccugccagugucucccucucagugucucccucuuggaucuguagaucuucccuuuguguccuggccagcccccaaauggcauucuagugcacaaaucauaggaugagaguuauacuccuguugucaagggaguauugugugguauguucggggcauauugaacaagaaaccacugugugguauggggaggguugggccuguuggggccagguuuguaaugucuccaagggcaucugcagagagcuuggcagcuccagcucuccucagcaggccucuccacccugaucuggccccuguuagcccaugagcccucuuuauguacccauccucccuuucugaaccuucccucaggguggggcuggauuauggaggaaggaauggaucuuuggucagaugagacuaacagagggacucacugucagaguuagcguggauugcugcugccggggcacuaccuccuggcuucucucccugcugacguggcucuuguccuggagcagagcagugcguuguugggagauggaaagucuaugcguggguacccugucuucuugccuguggccccccuccuuucugaaaguuaguucucuccgcauucuuuaggaggauucaggggcggccuaguggaagacagugggcuccaugccucuuuccccugggguuugcuucaggggcuccuccccgagggcuugcuccugguggcagcagcugagaucaggacaucuguggcccugagccggcucugguccucggccuuucccagccuucccacaucuucccaggccaagaugcagggggcaggcugaagagaaauuuguguguccuuguuuguugccugaucuuaguuucauggaagaaaauggaaucuacagaauuauuuucaaaaauaaaguaaaggcugaauugcugaaaaauaag

SEQ ID NO: 5962 - RNA, 1028 nt, Mus musculus
cuuguuuuucccacucauggaacuacucagaauaugaaauguuuuuacugaucagcauuucccuccuacccuguggcugcagcucuuccuaguaccuuccacagagcccccuucauaucuuuguuucucaggguauagaucagaggguugaacaugggggugaugauaguauaaaaaagggccacaaacuuccccuugcucucagaauagcugucuuuggguuguaaguauguguagguggcugagccauagaacagagaaaccaccaggaggugggagccacaagucccagcagccuuucugcgugcagccacugacuugaccuucagcaccgcccuagcaaucugugcauaggagccuagaaugagcauggcaggcacugcaacaaucacugcucuggccacaaacaucuuggccucuguuccuccuguguccuggcaggccaacuugaggaagacaggcaucucacagaagaagugauucagucgauguccacagaguggcauggccaucaugaggccuguuugaaucagagaguucaagaagccuccuacccaggaagcaauagccaaugccuggcagagaacggggugcaugauguucauguagugcaguggacgacacacagcagcauagcggucaaaagccaucaccaccaggagcacacucucuguggaucccagagcaagaguuaugaagagcugagacacacacccuccauagcugaugguccugucuuguccauggagguugaugaggagcuggggcacggugcugguggugaagcagagguccaggaaggagagguggcagaggaaguaguacaugggggugugcaguugaagguccauucgggagagagcgaugauggcaguguucccaaagagaguuagggaguagaaaaucaaaauauaaauaaaaaagaugaguucuagugcaggccagucugagaagcccaccaaaaugaagccuuuacccaaacugauguugaagcuuuccauagccaaagacaauuuaaugcaucugau

SEQ ID NO: 5963 - RNA, 938 nt, Mus musculus
uaugggaaguuucaauacgaguuuuagacaggguuucuucuugguggguuucucugauuucccucaacuggaacuccuucucucuguccucauuuccauuuucuacucccuaacucucuuuggcaacuccacuaucauuauucuuucacaacuggaugcucggcuucaaaugcccauguacuucuuccucugccaccuguccuuccuggaccugugcuauaccaccagcauugugccccagcuucugauuaaccuccagggauaugacagaaccauaagcuauggaggguguguggcccagcucuuccuuuuccuugcuuuagccaccacagagagugugcuccugguugugauggccuuugaccgcuauguugcugugugccgcccacugcacuacacgaccaucaugcaccccguucucugccucucacuagcuauuguuucguggguaggaggauucaugaacucucuaauucagacgagccucaugauggcggugccucuuuguggacaucgacugaaccacuucuucugugagauaccuagucuccugaaguuggccugugaggacacagaaggaacaggagccaaaauguuugugguccgaguuguauucuugauuuuucccauaacacuaauucuaagcuccuaugcaaacauugcucaggcagugcugaagaccaagucaauggcagggugcaaaaaggcucuggggacuugugggucccaccuuguggugguuucuauguuuuauggugcagccauguacacauacuuacaacccaagggcaccuauucugagagcaaggggaaguuuguggcccuuuuuuauauuauugucacccccaugcucaacccucugaucuauacccuaaggaacaaggaugucaagggggcucuguggaaggugcuagggagagcuacugacuugggauaga

SEQ ID NO: 5964 - RNA, 938 nt, Mus musculus
ccuacccagagucugugccucucccuagcaacuuccacagagcccccuucacauccuuguuccucagcguauagaucaaaggauugaacauggggguaacaauaguauaaaaaagggcaacaaacuuucccuugcuuucagaauaucuauggacugguugaagauauguauaaauaccugagccauaaaagagagaaaccaccaugaggugggacccacaagucccaaaagccuuucugcguccagccauugacuugacuuucaguacagccuuagcaaugugaacauaggagccuaguaucaguacugcagggcacaccaagacaauuguucgagccacaaacaucuuagcuucuguuccuucuguguccucacaggccaacuucaagaauaugggcauuucacagaagaagugauugauuugauggccacagagucgcauggccaucacaagcccuguuuggaucagagaguucacaaggccucccacccaggaggagauggccagugcccugcagaggaugggguucauaaugcugguauaguggaguggaugacacacagcagcauagcggucaaaggccauugccaccaaaaucaaacauucuguggaggccagagcaaggaaaaugaagagcugggccacacacccuccauagcugaugguccugucaaguccucggagguugaugaggagcuggggcacggugcuggugguguagcagagguccaggaaggagaggugggagaggaagaaguacauagguuugugcagucgaaggucuagucuugcaagaacaaugauggugguauugccaaagauaguuaaagaguagaaaaucaagauaaugacaaaaaggaaggcuugcaguugaggccaaucugagaaacccaccaaaaugaaacucucuuguguacugguguugaaauuucccaua

SEQ ID NO: 5965 - RNA, 1526 nt, Mus musculus
agcuguucuagcuggguuuauuaagguacagaggaaggagaaaggugugagcagcaggguuuccagcucuuguuaaagaaaaauaucucgucaggcaucucgucaggcagaauuuucccagguuccccucaaccgaacauugucaggacccccuggaaaagagaagccaagcuugagagugcccuucacugcuaccgaggauugcugaggagaggaccuggguacccgagcuuacucaagacaggaaggcauaguagcugguucuggggagggucucuguaaagcccauagggagagagccuuaggacaaacgucauggcuggcuggcagccacuugcgaaagguaaacccugaacaacucuuuggagucuucccaguuuuguuaggauauggcuugcuggagcagaucaggaagcaaggcucucucucucucucucuuucugauguggaaggugucuggggagggguaaccacccaggaggaaguaaccacgaaaggaagaugcccauguuaccagcagugacuucacagcuccuacagccucagggcccagcucggugacacacuuccuggaucccucuaugagaggauccaaugggaugcccaugcuggccaggaugaaccucaggauggccaaguggcuuaaugguaggcuaggcacagccccugccacagccucugcagcuggagcaagggcggccacggguucuaccgcaggcuuggccaaugaguccaugaagaaagcaacaccugccaauacaaacagagaaccuagggccuucucaaagauucugaagaccuaacuccuccagggagggcacccaagggagaagucauagccacccuccuacuucuugauugauggcugcccugugucaagggagaugccaacagaaguuaggaaagguggccauauauugggcccaggaaggagauggcuacagagagagagccauaggagauggguaagguuuuuagaguuggggacauucauacugugccuugcugauuguggggacauuaaccagguugagagcagaugggauggguggcaucaauccagggcuggcccuugaagaugucaucagacuagugggugagcugaaggugaguagguggauaugugagugagaggcagcucggaggcucaggugggacucagguugcgcugacagcagaaagcuuuaaaggaucauaggaaaaauagaggaaacccuggaagggauaagcagaggagcaucuggguuccccuguagacaacucugcuagaauagcucccaucaacaucugcacaagagugaaggcuauaugguaaaaaccagcuggagcagucaguggccaggaaaaagcagguaacaauggcagauccuccauaggagauacuaagcccccaagggaacucaccagagucacugagcagagccacacagagcacuagaaagguggugguaagcuucaugguagaaugagucucagaagaugcucccaggaccuauaagacaaucuuccugaagccuggcuccgau

SEQ ID NO: 5966 - RNA, 3708 nt, Mus musculus
agucauaaccuaaugcaguaaaugccacgugcauauacuaaggagcaacacaggucaagaggugacauuguggcuauguuuucaaggacuaagaacuucuuuucuagaggaaugaaagaauuguauuaaaagccuuuauggacugucuaugacuuuggguggauuuggcacaugaugugguccaagcucauggagugcacuuggacuacaugggaaguuugaacuuuguuuuaugugugguguagagauccacacgaagguuugacugggaaguaguggaccaccauaccuaccuggacuuaagcuuuucucuaauucucuuuaacaagauggaagcuuaguugggucaccacuuccuuaauuccauuuaauaucuucagucugguuauuuccuugaacacaggauuuagcugcauuccacuuccuggugccccuuuaauccuugaaccauacuuaaaaaaaaucugcaagcauuacuguaagcagcacuauggaggagagaugaaguagugagacuagugaccagcugcuagcuucaguaugguucaguugaaagauggugagcaauaaauguccauggugcauguguacacagagaaagaaaacauacagaguaauccuuugucaaucaaagcaguccaagaaucuuaaaugaguuucuucuuugaggaauuagcucugugccuuagccacccacggcuuuuaaugacuugaagccuggcucuguaacagagcaccaugaaauagcuuuuguuguuuaugaagcuugacuuuuacaaaagauuucuuuuauaaagacuugauuuuuauauauauaugacuacgcuguaaaugucuucagacaccagaagagggcaucggaucccauuacagauggcugugagccaccaugugguugcugggaauugaacucaggaccucugaaagagcagucagugcucuuaaccacugagccaucuugcagcccuacuugucacuuuucaccugucuguaauuccaguuccagggagaccaaagcuuuccaaggacauucacgcucaugguguacauacugccuaacucacacuuuguuuugucuuuagaauaauuucuggguuuaauuuuuuuuuuuuuaauuuggcuggggcaagagcucacugaguacagcacuugcugcagaagcguggggaccggcgcuaagauccacagcgcccacaguaauguaugccaucuacaggaccuaucuuaggaauacgauagaguagauagacaagaagcagaugaaaagugucacauaaacacaauuaguugucagugguuaugccaaucagaaaacacaagcuuaaauccuuacuagaaacuaagaguuugccugugaugaucacaucgcaccacagcgcuccaaacugguggacuaaagucaacaaugaggaauugguucacagagcaguccuagugggaacucucaagugcugggcugcugauggccagcaccacagcauaggaagaagacugucacugcagaagaccuggauucuguuuccaacaccaacuugguagcucacagcugguuguaacuccaguucuagcaggagguccaacacuuguccccucaaggcaccaggcaccacagaugugguuuggucagcacuuauaaaucaaaagaaaaacauacugauacauuucaaaaacaaaaguuauaggguuucagcuucugcuagauguaguguccuuuuuuuuguauuaauagccauugauaacaauccuacaacuaacuaggcaugguagaacagcccuuuaaucccugcauuugggaagcaaggcaggugaguucaaagccagcaugauuuaaauaaugaguuccaggccagcuaaggcuacauagugagguccugccucaaauccuucaucuagcuuuuguuuaaaacaaacuaaacaaaccccccuaaccugugguauuccuuugcuucauguuuugugaaaacaucccucaucagcaguuacccuguguuggaucagaaagacaaggcacauucuugauuauuucuuucauccauuuucagaacaauaaguuaguuucccuacauucuuugaugaaagguuaucuaauaagcuauuuauugcucaagaccaagaagaacauggauuuauauacacacuggacaagguuuguuuguuucagcuauuacuauuaacauucaaaaauaaccugaucucuauggcccguguaucuuugagaugguccugguagucacuggcaauuuccuaucugguaugaaagguuguuaccucuuguauuuccuauaugagggcaguacuuaaccauucauucaaagacuucugcuucuuagagugggaaguugcacguggagaccaaaacuguauaaugcaggaaggaaugcuuuuagccacugucauaccugaguucugggucauuucagaggacagaacggaaaauuuccccucaaagauaaaauauguccaugguguuuugaaaggaaaauguuuccuauugucuuggaauuugaaugcuugguccccuguuuguagagcuguuugggaaggcuuagaaggcaugaccuugugggaggaggugugucauugggaaccagcuuugacguuucgaagacccaugguauuccuacuucacagucucucugcuugugcugcccuucaaauugugagcucacagcuucuccaguggucauguuggcugcuugcuaccccacugcuccgacacuuaagcccccagaacuguagauaaauaaguaaaccguucucuagcuugucuuggucgugguguuuuaccacagcgauggaaagaguagcuaauaaguguugauaguucuaauuccguuuucguuugaaccauaagguuuguacuuaaaaugaaugguccuaagucagggccucccuuuaacuuggccagaacaacuuggguuuugaugacacuaaacugacuuuuuuaagaaauaaagaucccuucauccccaguacugggagugagcuccugagucuugugcaugcugggucagaccucuaccacugagcuauauucccagcucauaauuacucauccaacuuagacuguaccauggacagccucaggauagcaaugccaucgcuaggaaaagugaacugacacuuaggcgguucuuguccucaggguacagccucuugacugacaucuuuuucuuuacuauagauugcuucuguuguggcuauccucagaaacaaaauuagauuuacuucuuacugucaaguuuuagaggauugucuuucuaagaauacauuuauuuggcuuugguaguagucucaaugguuacagugggaaauuaacaaaauaagauuuauuuaaggaaauaaagcuuuuuaguccuuucucccugccauugauuaaaaaaaaaaaaaagaaaagaaaaagaaaagagagagaaucaccuuucuuaacaaauagaaccugucucguggugcguucucagagacacauguuuaugugcagggauucuguuggaaaagauagagagaugguguguggccuuuaaaagaugaaaacuggaagcuggagagggagaugguuuagagugcuugcuguucuuccagaagaccugaguucaguucucaggaucaaguccggcagcucauaaucacgaguaacuccagauguaagaauuagacacuuccuuaggcacucacgcaugugcaugcacacacacacacacauacaua

SEQ ID NO: 5967 - RNA, 11641 nt, Mus musculus
uaggaugucuucuuuauaugagaaauguggucaugggauuuaucaggucaggguaacggggugggggguuguaagauugauuuguuaaagggauugguggugguuaugcagaaagcaggguuugcugagcauccugccaagcugaaugagcgcuuucucugcuuacuuucaggacuccacuggccuguuuggaacagagcagcaaggcaccagcccugcccucaguacugcgaaccacaccagagagcucgguuuuccuagguggaaacuaccaaguccuguuacacaaguuaaugccccaucuucuaaaugggcacgguuucuccuggcaccuggaaauaguccucaaguggaugagaaaccaaguccucugcaggaggccaccaugcuagcugaccuggcacaagggacuguugagaacaagacuccaguggaaggccacuucagcagagccccugccauuaggccuccucaagccauucacacuaccaccccacaacuggacagaccugacaggaagacccgagagcagccaagggacauggggacuccucgagcagaugguaggccuuuggcucaagggacccagaaggcuccacccuugcaacugcacaaccucuuuacaaccggagaggacuuugaugaugaccuguagccuucacuguucugugucccucaaugccaguccuccuugucacagacuggggugcucuggaacaaauaacccaacaauaaacgugccugucaacagaguccucuugcugcuacacucguacggaucacagggcugguuaaagugcauaugccauuuuauuacagguuacuuacaaaccaagucagaggaagcuacauggggguccugugcuuuaagcauuaacauuagacacaaacacuaaagaguggccauuagaaagggggacaguauaagauaagauccuucauucggcuucacaugaauucuccauucccuaggagcuguaggccccugccugccaccuuucacucacuauggacaguccccucuuaacauaauggcuuuauuuguugaaaauaacuagcaguuguacuaaucacuuuuaauaaaggaaacacggguugucaggcaggaauucuggacugcuggugcaaugcuggcggcaagagcaggugggagugcagugugugcugcaguucccugcagaggccaggccuagggaaagcagaggaagcucagcucagccacggguaccugggucuguucucaggcgucagcauaugcacauucaaaacucuccucaugcacuuuccuauugccugaaaaggcaucacacauucccaccugaagauucuacaagaaugccaagacacugggccuaucuauagaagcccugcugcucuacgugaugcaacuacaagacaaaggggguggggcuuggccacagcacuaucacaaugguggagggugcuucgaauacuggaucguguccagagcagccccgaugucguaauucuuggucuguaggagccuggugagccagccgccuucauccgagaaacccauggacagcaucugggagagggacucaaucagccggggaucagccucugccaaaacaagacaggaaaguaagguauccugcugcauucccagcagagcagcuccugccugccaggaagaccccaccccucugcuuagccuuauagggacccucaaaggcuaaaggaucagacagcuugcuuggcagacucuccaguccuggucacaacuguucaguucugccacugaaguacaaaacagccagaagguauguagacaaauaagugcagcuguuuuccuauaaaguuuuauugacagaugugauagcucaagccuguaaucccaacacucaagagcuggaagcaggaacaucgugggcaacagugagacgccaucucaaaaccaaccaaccaaaauccuuuauagauuaaaaaaaaaaaaucucuaacugccguguguacucguguucccacgugggugaacauguauguguaaagguguggaagcccagagcugaaguaaggcuuuuccucuauggcucuccacuugauugaguuagggucucugugagccaauagcuuaccaaucccacugagccacuuguacaggaagucugucugccuccuaaggccugggacuauagacagcugccagaacugcucagccuuuuggcuuucuggaaacucaaaauucugggccucauuugcaguguaaguaccuuauccgaugagccaguucuacagcuuccauaaccugccuuuuguuuuuuguuuuguuuuguuuuaaauccaggcugugacuccaucccagagccuugcacauuugagcuaaacagucugucaccaaaguacaaaggucuauggagccagggugcccuugaacucaugacagagcaccuccccuagacacucacccaugcagcaguucgcugccccuuugcucuuugcagagaaaauacccuuugaaguccaaacagcagaucuggcccagacauaagccacccaccugaacccuguugcucuggggaagcugggccgcuuccucugcagguauacacuugggacugcccaucccuauccagcacuuuacacacacugcugccuggcuggggccuuggcuguggcaccugccaguaagguuuacaacccccuggggaaaugguguguagagugugaaucuacuucauggugcacggcugcccaaagccaguguugccuucccugucccaucugccuucucagaaucccuggguacugagaucuaggaauuccuaaaaaugagaugacauuacuauugcuugauguagacagaagugugaaccauguucuaguuuucucuaaugucagcuaacagugacagccgucacugcaggcaagccaccuggaguacacaaaguaguaagguacuaccuuaaaaaaaaaaucccaggccaggcaacccuuuuuguguugccaagacuagacaggacaggauccucugaaagcaaagaaggaaaaugaaacuucuggugaccacaugccuggugggagauguggguauagggcagcuuccuucagcccuguggguccuuccugugaggggucuagagagcuuggcccuuccgauucuggcaucuguagagacuggaguucaccuguagauggguccacuucuuuugaagacaaauguguccagucaucgucuccuccugagcaguuucccgacuccaucuguuccuggaauacaaccugcugugagcaucaggccuaagcaaugacaagucuaaccccacuaucuguucccagccagggacugaaccuggggccucaugggcgccagcuguaugaugaguuacagcuccagagcuaaguaaauuuucucuacagaguucuaucaggaggcucaggguaacaguagaaggacaggauuccucaggcugaagcuaguagaccuaccucuggcugucccaccgacuccaaggcuaucuuuuucauuugcucugucagagacugagcagggcccuccccagccccgucagguuugcugacuuccgaagagcagcugcuuggcugaguguuacucuugucuucugugccugugcuggaacuuucugggguagugggugucaggcggcuucucuucccuccauguuccacaucaaugucaaccucaaugccuagagaggagaaagaauugugggcacugugggcugagaaagugcuuucagacucaguugccaacagagcauacagauuaggacacggccggccagcauaaggauguaguagcuggggcuggcgagauggcucagugguuaagagcgccgacugcucuuccgaaggucccgaauucaaaucccagcaaccacaugguggcucacaaccauccguaacaaaaccugaugcccucuuuuggaguaucugaggacagcuacaguguacuuacauauaauaaauaaaucuuuaaaaaaaaaaaggauguagcggcuggccucaaccccagaaccacauagcucuaggugaccagauaacuaugugacaugacagaccaugugacaacccccacaggccagaaacaaacagcugagcucuuucucccaaccccagcccugguaacccacccauuaccacaaaguccgucgucccccgcccaggagaaaccuuguuuuucccaacccaauaggaaacuagacugcagaggccaggccaguacuauacacgggcagaaugucuagccaugacugcuggaggccaugacacacaaggucucaugaugugacaacuauacaucugaacuccaagguucagcugaguguguggcccugaggcuggagagcacccaaccaguguagcggccugcccguguuuguaguaggagcuuagggacccagcagguucacucgugaaaggacagcacccacagcuuccacagucccuucccaaccacacaccaacugaccccgagucccacuguggccuuucaaccccccagcucugggccccugguucaaguucucaucuguuuacuuccuaccuugucaauauuuaccaccucccuuccccuguccuuuuuuuuuuuuuuuuuuuuuuuugguuuuuucgagacaggguuucucuguguagcccuggcuguccuggaacucacucuguagaccaggcugaccucgaacucagaaauccgccugccucugccucccaagugcugggauuaaaggcgugcaccaccacgcccagcuccccuauccuuuuaagagaccaccuuuggcugaaaaaauccaaccaagcaaaaaaguauuuacacuacuaacacuguguaaauguuguuugcacugggcuuguaggucuucucgcuacugucaagaguacaucuccccuuuuguauuauaaccuccugauucuuuccagagucuuuuucauuuucugugguucauggcuaucaggcacccaucagguuuggcuuuuccuuggaaagcacacucaguagucaggcccuccacaacgcauaugggauuuggcccccagaugacccuuugagauagucauauauggcuucugauccuaaagacacuagcaagacacucuguuggcaugaccaggaccgcugucaguuucacauauauagagcauccagaggcaggcaccaagaaaacccagcugccaggagcugguguucuguuaggcauuuggccuucccucagcaaggauucuucagcuguugucaggccagugaggcugaaaugcugggccgccuauuccuuugcucauuucugaugcccacuuccaggugccuuagcuuauguagcaaaagggucaggugcuucaagugcccgagaugaaagccaucagcuggcugugucucucaagagccucuuccuccagugcuaaggccauggucuaacugaacugcccugucugugcuugguguuggugcugggaauugaacgcacagucuuaacacucuaacacagagcuccagcacggcucauccucagcugcucaacuuaacugccaggccaggaugucccuacugccucagagcugccccuggggcagcaugagcagagauggccuugccugcagcgagcgguggucacaccugguacaagaugaaguggagacugguggggcuuggacacgcuucaucagcauuccuuuggauacugacacagccuuuguacagguuccuguggccaacuacuaacacugccaacaggguaaccagaugugggcaagcaccuucuaaaccacaccaguguguccaacagccggugccuagcaucacaguauagagaugacaccggccaccaccucagcagaccgccacuguccuuugcauggagccuggcagaacccaaagcacuugucccuacucuagcaccuucuccgucucagagaggcuugugagaaaacaaaucccagcacuugguagaccaagggagaauuacacaaguucaaggucagccugggcuacagugaagccuugucuaaagaaaagaagaacaaaucaccggccugcuuucaagucuaaacaaauacaacccacuuggcucagaaaaagcaggcugcuguuacccaaagcugugaucagcuggcccaucugccaaucuaucuccccuacuaguuccuucugcuuugugaagaaggcucaaagucagccaggagcucaaccuucaggcgcccauccauuccaguccgcagcaaaggcuaauuuuacacaacaaaaccuugcuggagucgagcacacauaucugcccuggccccugcaccaugccaggaaaggcugccaaagacuauuugcacuuugagccacugugguagucugaauaaaauuggucccauagacccauagggaguagcacuaucaggaggcauggcuuuguuggaggaagugagucacuagggugggcuuugagggcucagaaucucaaaccagauguggaacucucagcucccucucuccagcaccaugucugccuugugcugcuaugcuuccugucauaacaauaauggauuaaaccucucaaacuguaagccagccccagugaaaugcugucuuuauaagaguugcugaggucauggugucucuucacagcaauagaaacccaaacuaagacagucaccaagccacuaggguaucucacaggauggcaagaaagcucacucaccuagagggcugagggcagcugccacacucucccccacauucuucaggaaauugacauugggaucuucugguggagcagaagcuguuuuacaagaagaaagaugaccucaaauucugugacugccaccuaccacagucccagcacauggguuccaagguuccuaucaucgagguaauuccuggcuugggauugccugaccauacuugguacuuccuccuguccccuccccucugcaagcuugguccccuagugggucacauguugggccucucuggcucaguacagcccauguauaaauacugacccuguccuagaugugcuguuuacucaaaauccacagagcccggcuggcugggcuggcacaugucuauaaacuaagccucaagaggcugaggcaggagaaucucaaguuuaaggccaucuugggcuacacagugaguucuaggcuccccagggccauagagagacucaagagggaaaaaaaaaaucaaaaggcagaaaccccaaaucuagagugugggcccacccacuugugaguucuuugcuuucaggauuuugagacaggaucuuauaccacaguuggcucugacuuucugguccucuagccucuacaugccgaggccugagauuacaguguacgugcugccacgccuggcuuugggaccauggguuuuuuuguuuaaagauuugagcaccuauggcccugauauucccaaguuaacccaaaacaaaagaaaauacauucuagaaauccagccaccuacccaugccucccaagggcggccuggcaggggacggugggccauuuagggaaauuagugggcucaggcguucagccaccuguuuacccacuuguaaaagagaaaugcuuugucucuucgggguuaagaggguuugauaccauggauaaggauagaguguagcacaaaaaaggaaccccuaugugucauguguaagacccuagguucaaccuccauucccccaaaagacaaaaaaaaaaagguaaagggauguguaaugugcaacucaguguggguacuucuggacuuuaggcuauggggauggcuuggccaagggccuaccugaacuagcuggcuacuuaagacacccaaaagcuaguucaaauaccagucuuaccugacucagcuguagggcaagggcggccauccccugcacgaggaggacgugggcuccaguuccccggugggcccaucucccagccaggccagccaaaguguccauguuucagcuuccgaagccagcggcuaugagagaagcucuggguaggaggaagcaagacaggaggagagugaggggucaggguuuccagcucccaccacccuguaugccccccacgccccaggacggcagagccccggcucacaucagagagguggccaaagggguugggaaagaugagcuugcuguguucccugugcaggcccuuccccucgcacacgcugcacaggucguagucugggcacacacugcacuuauagcgaguucccaccacaggcccguugcaaccaucacagaucacauuggggugcaccauguuucggggugccuccugagcacauggugggcgauguucccgccggcacuccuucuucucugcagggagagucaaagaguccauccagaacuuaguugcuaaggacaaccgcuuaggaggccaggaccucugugccucugacaacucccagccccgcuacacccaccccaaggcaucacaacuccgacuccugacccuucgaggaaagccccacaggaaggaagccccggauucagccuuuaccuuuaauguagaugcggaagaugucaucuuucacauaggacauagccauugucagcuccucaucacuggaaaaggcaaccaaguccccauccucaucuagauuguucaagaaaugacacaucagagccagggacacagcucggcgggagcaugcaaaggccuuagguuccauucccagaacuagaggcuaaaaugcagcagaggcacccagcaucugcugcaguguacagagcccagugguaaagggacaucuacuaaggcucuacacucaaccuggcugcugagccaagcagcaagauggccguucauuccgauacggcaugaauauguacuccaaccuagguccuagauuaguuacaugcagaaggcagaacauaugucauguguauauguguauaaggguccagcuuccugccacuaaccacugggccaccugugcccucaggccacgccuaaccagguguggguccaucaccugggagaucccacccuaguccugauggcccagcccuucaaaggccucaggcuucagaaguaaaggacguaaguccaucuguccccucccuucaacuagacagcuagaaaccacuacauucaggcuccaucuaaguuguucuuggguuuuuugguguuuuuuuguuuuguuuuuugagacaggguuucucuguauagcccuggcuguccuggaacucacuuuguagaccaggcuggccucgaacucagaaaucugccugccucugccucccaagugcugggauuaaaggcgugcagccaccaugccuggcaucuaaguuguucugagguuguuguuuguucuguuuuugucaauucuauguuuucugcuuucaggggcaggaucuuaguauguagcccuaccuggccugacacuacuuagagcaggacagccuacaaccuguggaugagccgccuucgugcugggauuacaaacaugcaaccaggcuuccagguuuuguuuuguuuuuuuaauauuguauguacacaucacacacacacacacuuaaguguaugugugugccacaaaggccagaagagguguugggucuccaggaccugcagcugugaugagugcuagggacagaacuuggguccucuagaagagcagccaaggcuuuaaccauugagcgauuucucaaacccaucuggcuucauuuuguuagcucacaauaacugggaucacagccauaugcuucuaugucaguacaaauagucuguauaaaaccugauacaguacaaaaaccuuauacaggccaaaaccacacaccugcaggcuggacugagccucugagcaaccauuuagcaacagcuaccauaagggagaugagagagauugccucaaaagaaacaguguccauaaacuacagaccagauaaauuaaacaugacauauucaaagaagacuauucuucauacacaaaaagaaauuaaauacugcccauguacagaaauagagcccuugacuagcauaugcaaagcccuagguucaauucccaguacuggaggggggaagauguacuagugagagcuguaauacaaaugggccuuagacauauuaauaagugaaugaacaaagauucacugugccagccuggucuacagaccagccaaagcuaccuagagaaacccugucuugaaaaagcaaccaaaaaaaaaaaaaaaagccauuuuaauguguucuaauuccuaauaguaaaaugaauacuaaaguagaccagccauugccuggaacuggaaaggauacaagaugacaaacaggaaaaaaauuauauaauaaaauaauaauuauuacaauaauuguuauauaauuuuuauguaauauauaaauaaaauuuauaaaacaaugaagagauucuaagccgaaugugaaaauaguuauacaacucauuuuuuuuuuuuaaaugcaaggagcuggggagguagcucaguugcucgagggccuaacaugcaugaagcccuggacuggaugccuagcacaaagaugacucagaaggacaauuuagagauacaggccaucccggccauauaguaagaccugucucugcuaauacgaaagaauaaucguuauacacuuuuacugggugaauugcacagguccuagguuauaacgcaguuacacugaaaauuuucuguccaguagucccugugauuccugcacuagaaaauugagacaagaggauuggagugauugaggacggccuaaaccacucgugaauuccaggccaaucaggcuacguggcuuuauuucagaaaagagagagacugaccaaccaaccuggccuacccacaguccuccauagagaucgcaaaaccauucccucccacagggagggucuuguccacucgucucuugucaacaaccucuagcuccaccccaugcagccaccagccacuccaacgcaagagacugagcuaguuccgggguccccuaccucccuucccacgggcugccccaccccgcccccgcugcuuauuuauccgcgucacuccucuccaccccuccuccacgucugccuggucccaggucuuccggggcuuuaacugaacccaccaccgggcguuacggggagcaagcgaaccgcuggauguuagauguaaccugagcggccgccugaccacccuguccccgcggggagccagaggacacgccgccucguccucgcccagaccuacuacucccuggcgggggagguuggcuuccccgccccaggcccucaccgcgguagugcgccuggaagccgccaggccucagcguggggaacagcacagccacucggcucagcagccucucgcagggccccgggccggccgcggcuugggcuuccgccuccggcuccgggcugaagcagaagcugaagcggcggaucucgcgggucgccuccuccuugcccagaagauaggccuucaccgugaacgacgccauaaccgcggucuagguacggacgaaacagcugggcagcggcggcgccgagagcccagcuuuuauagaaaacgggggagccccgccucgugggggcggagccucuaugagccccgccccuccccuaggcuggggcggccgcuggagcccccuugaugggacccuugaaagguacggggucgagacgaccccacugccuacucuuuucuuucccaccgaauacaugggugaccacaagagaccagccuca

SEQ ID NO: 5968 - RNA, 915 nt, Mus musculus
ccgaccccacccccgcacgcgcucacggucauuccaagcagggucuuucaggacaucauacguggauggcacugucgugccauagacaccaugcagagaucggagaaccaauugcagcagucauuucacuccuuccacccuguggauucugagggauggaacucaggcuuaguagccgucaccacucugcucuuagguaguagcuccauuuuacaaaguagcuucugguuccauuuugaauggugaugagacucaagaagggaaguagauuuggcgcuuccaaaaugcaugccccgaggcugccuuggcucagugaguccuuucauuguguguccaguuccugguuccgcagaggcauggagggaagucuguaauaagaugcaagaagagacagcaauaaagucuuaggcgccgcuguacaaauaggaaccagaggcgccccgcccccgcccccggucacccugcggacccgugauccucuaaacuacagguugagccugacucccgcccacagcaugccuggcaccgggaagcuagucggcugggcuccggagggugcucuccaccuacaaacaacggcucuguuacuccugagagcggcccauuguccuuguucgauagaguaggagcgccucccccgguccgcagcacacucuccgaggcacaucagagaaugcccugagaagggaguacuggugggcgcaagagagagcagcuggcacuuucuggcuagccugcuagcuagagauaaccucagcucggcuacagcgggccccucccaugccagauccucucugucgggaggagggcuugaaggucuagguguagggacuugcucaugggaucuucugaaaggagacuugggggaacaggcaucuccgccgucugucccugcugcacaauagcugacccuca

SEQ ID NO: 5969 - RNA, 2158 nt, Mus musculus
ucuaccuucccagccuggccaggcucccugccuuuguggauacagucauauccccaccccuccccgccucuacugcaaagggguggagagcgccgaggcucuuccucuccugggccagcgucugaguagcacacugggcgauaagaagaacaccaaagcuaauucugccuguggcuggcaacaugaaggacgaaguggcucuucuggcuaccgucacccucgugggaguucuguugcaaggugggcuggcuccugucugggagguggguggaucuuacauccuguagucugcucucuucaggcuccugggguagggaauuggggugcuggcaggcccaggcucaggagaaggacaggaggcuucuaggcuagccuccugguaccaagguccaagcaauucaagaacuguuggagggccaaaguuccagcugagaaguccccacuucccuggagcagguauagacacucucuaaggagugucuacaggggaggaccaggugaaggauggccacccugcugaggggccacuugaggugccugccuuguggugggagcugguaucuguuugggagugcaauacagugacuaguggaauagcuaugggcuuagguugggagagucccaacuccacgcaucuggagcacaguaucugccagauuuaaggcuggguccaugaugucuaaacagaaacugagacaagaauuuaugcuauuguguggugguacugagacccaagcuagacugacucuggcuuguggcagagucccuucuggcugauucuguagaggggaaaccagggucccuuagccacagaacgugugcuuccuuguuccuuaaagaauacagccaauuuugcccugguccauugccuacgcaggggguccagaccugcagaacgggagguaggcauuugccugugcuuugcaagucaaaucguucaggaguaaagucuucuaagguuccucccaccggcagguguuucagccgcgcaucacccuagucaaucaacccucaggccuacagggccucuccauugaacaccacugauggggcaggugggagaagggcauuagaagagagucgcucagugagaggcaaggagaggggaacuaagggacggaucccgcuccagaucugcggagcaccacaccugacucccacacccccacggccgcagccuacuucucccuacaggugaucucugcacgaagggcuuuccacgugucgccgccgcucaccucuggcccucccgaguucgagcgcgucuuccgagcccagugagcgcggcggguccgggcggguucgggugucagccaaggugaaccacgcgcucacccagccuaccccucgcaggguaaacugcagcgaguacuuuccgcuguuccucgccacacucugggucgccggcaucuucuuccacgaaggugcggggcagcgugggggcacacuucgggggugggggugaucccggauggcgggagcucgugcucaccgcgucgccuugcaucgacucucgcaggagccgcagcccugugcggacuguucuaccuguucgcgcgccuccgcuauuuccagggauacgcgcgcucagcgcaacucagguaacucuggccggacuuccgggaaagcacugcaggggagggucgcuccccaacgccgcucaaagggugggaggcggcgaucggccacaggggacccauggaaagagaucuggggacagcgggugggcggaccuagcccuagcgagccgguguagcccggagugggaggggcuugagccugcggggcaggccuagucuggagggggagggccuaggccugggggcaguccuagcauggagggggcggggccuuguguggaggcggggggggcuuggcuccgcucccgcugagcgccacccgcaggcugacuccccuauacgcgagcgcgcgcgcacucuggcugcugguggcgauggcugcacugggcuugcuaguccacuuccuccccggcacgcuacggacugcgcucuucagauggcuccagaugcuccugccgauggccugaggcgaaggcccuccgaaucagcagaacuggagaucuucgaacaaaacgcuggggugcccgcccccgaaucccaguuuuuaauuaaaguucccacgacgguuccgucugcau

SEQ ID NO: 5970 - RNA, 1905 nt, Mus musculus
uguauaaaaacacuuggcuguuagcuuuuuuucuuugugauuuuaaaaauaaaacuuuaaugaacucuaguaagagguuaaagggugacauguuugaguggcucgugaggucuucuauugcaaagccucccagcaucuccuauggcaguuugggugucaguaaccauccagaacauuuuuugguccuuuccuggcuuuuuaccuucgcucacuugcuugcuaguggcaucacuggaacccagugcuuuggauuggauuuugagugacucaauuuuauauaucagucgguuuuuaaguguaugccccuguagaucuaaauaacuccaguccccaguauugaggcucuuucccacccucaccccuccaaguaaugagcuauugcucacaguaccagucagugauaacuaucucuacuaggucgcucaagcucaaaacaauucugaucaauuacguggcuguauguaaagaaugaggucggaaauggcugaccucgaaauaguguggguggacuaaaaagauagacagcuuuggacaucugggucuuaaggcuuccaccucacucagacuuaacccgcguuccucacgaacccggaagggacugcuuucagggggcgguguucagaaaacguggcucuucuuggauagguucccgucagucacaguucacucucccgcacugagcccgccucgggcuucccuccucgccagaguguucaguuuaaauacccgaaaauuccugacgugcuugucccccacgcccucgggcagcggguuuccuuugauuggcuagagcuucgguccaucagcagugacgcagaguucgccggcccaggccccgcccucuuccgaaagccccgaaaacaauuuuaagauggcggcggcagcggcgcggaaaacaauggggcagggguauagcggacaggccgaagccugaggcgggcgguguuccccggccuggaaucgggccgagcggggccggaggaagacccgccgccgcgcccgagcccgcuccacagcccggccggacauggcgcgggcgugaggcggauccgggccgucagaagcggaggaacccgaaguggcagccggcgccgggaggcccgggcccggccagugccgcccgcggcccauggugcuacccaccugccccauggcggaguucgcgcugccgcggcacagcgcggucauggagcgccuccgccggcgcaucgaacugugccggcgccaccacagcaccugugaggcccgcuacgaggcugugucucccgagcgccuggagcucgagcgccagcacaccuuugcccugcaccagcgcugcauccaggccaaggccaagcgcgccggcaagcaccggcagccgccggccgccgccacggccccgguugccgcuccggcccccgccucggccccggcggccgcgcgccuggacgcagcggacggcccggagcacggccgcccggucgcggugaguaaggcuggcgccugccacagcaauacucacucccgaaaacgccucuuccggcgcggaucgggccuuggggaaacuuucccgagcgcccccauuucuuagucuggguccugggagguggcuaacauggcagggcgcuugucaucuuccagaaguggcacugcgguguacuuugggaaaacguccccuugaggacuugagugaaaucggggcuggaaaagcaggagguuaguugcugguaggcuuuucuccuaaacuuaauuuccaauugaugagaacuucgucuuggagcagacccgcguuggaguugccuaggauguagggcguucuugcaccguaggccuggccucgcuuagucugcagauguugauuggaucuuugcuucguggagguuaguuagggcuuuaauauggaaauaagucucccuucaguugaca

SEQ ID NO: 5971 - RNA, 32329 nt, Mus musculus
uauccuaaagaauaguaucuaggaggacaggguguagcucagugguagagcacugguucaaaugccagcaaugaaaaaguuuuugggcugagguccauuuuacacaaugguaaugacuaaaccaucacuuaaauacaaaacuaaauuaaggucuccuaugagaaaagacuaaauuaaccauuauucaaacaguaaaaacauucaguguuaugauacagauauuuaacacgggcuuuaauauaaugucauuuagcagugugacaaucugaaaaguggacaauagaagaguacuacuggcauggacauuuuacaacaaggaguccagcauagaaaaucagaauauaagggccuuuaucuaucuuaauucagugccaggaaucagacccacggaaccuugcacacgcuuagcaguucuaccuacucagcuacaauaccugcccucuacgcuuuuuuuaagagcugaagacugcugaucauuuacuaacgagucagguauuuaaggaggcuggagcuucaauggaaccuugagggaggaagagggacccaaaaaggcaaugaccaccaccagugacauaaauaaaccugucauuguacagccugggugaauauaaaguaggcacaaaacaaugucaauguagaaugaugaaacagauaaaccgauuucuagaaaagcaaucauccccauguuugcuucaaggagaaaccugcagacauguauucauuucuugcuaguaacuguuuauuucacucuauacauuuggaaacguccgcuacauagcuauggucacugugaccacaaacaacagauggugauaaagcacugaacaggaagaaaaaugcauuccacccucaaaagaaaugaaccaguguuuauaaagacaacagauacagccuucauccuuaacaaauauauuucuuucccaguauuuccccaauauaaacacugaagaguguuuauauauauucagugcaaggaauaguaucauugguacaacuggaccaccucuggagaaagaaugaaauugaaacaucuguuucugaauacauuucagugugguguaauaauauuacacuauagugaugugggagaggcuccucuagcacccaucugcauuccacaugaaaaacaaaacaaaaaaacaaacaaaaaacaaaaagcccuaaauacacuuuuaaaaaauucuacaagccacaaaaaaaaaauuuuuuuuuugaacaggacugcuuuauuaugugaauuuuaagacacaacuguuacaugaacugcaaaugaagauuuuaaauauccuacaaaagucaaauaacucaugcugugugucaauccucccauaaauacuuuuagcagguguucaauuauagucaauucugaauuggcccaucucuggauugauuagacuuucuaaagucuacacagaguaaaagaaauagacacuaauggaaagucuguaaucuauccuguaguuggacccuagaaaggugugggccagcuaaaaaagaagaaacaugucaucacaguaaagccaacacuaugcagagcuuauaauuuucagcaacggaccgcaagcugcgcugugaagaaaaugcauagcagagaaagcuaggaauggaggagauccaugaggaaaacagugucaacacaguggaacaagugauguaauuaucuacccaggcaccaccagcauuccuuaaaaagccuugugcuccagaggacccgagcugucagaccuccuaugugggaaguacaguaugaacugcuacaugaagccagcuccuucccucuucaaaggugcuugugaauggagcagucucuagggcaacagaacacugcacuuuaugaucugaugugaaaugaccaagucaaagucuccuuuuaguucuuuuugggucuauucaauacaauguaaagggaacuuugauauaaauuugggcuuccauccaaucgcucuugugucuuuaagaggaauuaacuaauggaagcacacaaaacaagauuuauaaccacaaauaacugcacuugaacgugauuacaauuuuaggacagacacaugaaugcuuuaauaccaaacuuaaaaaaguuauuauaaaaacggcaauucauucucccuagcauuccuaauguugguguuauuucugcaugaacaaaugaauauauuaaauuaagccaagauuuuaaacuggcaaaaauucuaucauuguaucuaaaaaaaaaaaaaaaaggaaaaggaaaaaaaaaaagacaaaccuggaaaauuuuaaaaacaacaaaacacuaguuaguugcuucauguuacauuucacaaccauuauguuaaauguuuuccuuucuacagaaacaggguccuuuacauuacaacugcaauuauuuacugcuagauguuuaaaauuacaggcuaguauucacuggaaccuguugauggugacaucuugagguuuugagcucccaccuaagguacaccaggcccucuccuaggaccacauuugcaggggaaggggagggagaggaaaucacagaucaaguucuuaaagauuguuucacucucuucguggcuuucuguuucuuggcgaucuguucaaaauuucauccuccuauuaguugaaaagagaagucauaaaaguuaguguauuuaaaaaaacaaauguugccaaauuccacaaccauuuaaacuaagucauucaauugguggaaagguacuggaauuauagguauucgauuuuagucuuucuuuucagaaaacauguacuuucccuaaaccuauuaacuuuuuaaaaacugugguggaggauuuuacuuuuauuuaauuugcauuugccuggaucuguaucucuacccugugcaugccugaugagcucagagccagaagagggcaucagaaccccagggauuggaauuacagauagcugugggccaucauauguguacugagaauugaauccaggugcucuugggagcacccacagcaccacauaaaauaggguagagcacauaccuguaugagcacauacuaggaauggaggcagaaagauuacaggaucaauaaauauuacccuugacuacacagaaugaaaggauaguguagacuacaugaaagccugucucaaaaaguuugggaggcaaaggcaugcagaccucugaguuccaggccacgaugggcuacacagagaagcccugucuugaaaaaccaaaaauaguuuaaaaugcagugguauucaagaaauaccuuugaggggacagugaggagauauaagugucacaggacuguuuacgcugucagcuuuguugccugaaguauuuauuaucccucccuuaccucugcuuuaggcuugcuaucuuccucaucuugacugccaguaacaccaucuucuucagcaucacucuucuguuucucuucuaagacagaaaauaaaucuacugaacagaucuucacauaaaaguucugacaauaauuauaucaucauuuaagaacaaucuacuauagcuuguuuuguuagucaggguuuaugacagguuucuagacuccgcucaccaagcuucuccucuucuuccucuucaucccucuuguucuucucuucuuccuucccuucuucauccuucacaucuggcuggggagcauccgucuucuuguacuccauagcauuggacuguuucugaaauauugccaaguguaggagccaugauuauguuguaacaaauauauuaccccucaauuccugaauguuuacaggcaaaauucuauccaagguuguguagagggcaguuaugcagacaugugaaagacauuguucuaacucuacacauuugccccaugggagggagauugagagggaaguuaagggggagggguaucaugaaaaccagaacaagcacuaggacuuggucaggaggcacaggcuaagcuugacaagcugacucauagacuccaacagugaguagugaggguaaagcuagaaagacaacuuuggaucugacaaaguguaaauaauuuaaauagaauccuaaguuaguggagacagcaugaaacaaggucugaauaagaaaaacacugaggcuguagaaccuaaaagcacaguuugaggauguuuuguuugagagaguguaggcagggaaggagucauagauaaauaagaauagaaauaaugaggaaaacuaguuugugccuagauggguaaucuuauagccauuguucuuuuuccccuagacaggcucacuccauauaaaggagaagaauagagugaaaugacaauuaagggacucuaaauccugucaucauuuggguacaaagagccccuguaaaacacggcccaguauuuacagaacuaccacuaaagaaaaucucaguggauacaauuauuuaguuagacauuccuaccuuuccagaacagcagaagaggaucacaaggaacacuggcaaagcuacagucaaaauguagaccacccaaagccauggacgcucuucagcugccuccagcaucugcagcacuacaccuggcugaaauaccaaacaacaguaauucagagaacugguuuaugacaccaaauacagacucgacugauugcuucauauucauacaacuaacuccuuuauuuccaaaggagucaaacuaugcacauuaagaaauuaggaaaagccgagcaguggugggugacgcacaccuuuaaacccagcacuuaggagacaggcggauuucugaguucaaggccagccuggucuacagagugaauuccaggacagcuagggagacacagaggaaccuugucucgaaaaaccaaguuaaaagaaaacaaaacaaaaaauagaaauuagggggaaaaaaaaaucccccgcuuuacugcuuuuaucaucaugaaguuucaccugcauaggugcaaacuguggcuuguaauaacugcaaaaaguuccuuacucaggaaacagaagaauuaucuuucugccaguuuucuggccauccaaaucgcaacucaacaacaccauuaguuauuugaaaauuccacacaauuccaaccaagauucagcauuuucagugcauuaaaacauacuuaagccaggugcaauaacacauaacuuuaauugaaacacuggaggcagaggcagguaggucccugugaguuugagcccucccagucuacagagcaaguucuaagacagcuagggcuacacagaaaaacugucuugaagacaaaauaaaauaaaauaaaaugauaaacagauacaaauauacacauacauauaacaggauuggaaagccagaauaggagucuaacaauuauauauuuugacacugaauaaguaaaaagauaaacacuaaaaaucugcuuuuuauaaaguaaucagucucccccaaaaguggauauaaauccacaauuaaugaacaaucacuaaccucagcagccccaucagcagcuuucuucaggccccacccaucauuggcccaaucaucaacuacucuucggucaccacuaaugauaaaguugucaaaaaagaugucggaugucauggaccagagcuccaaaccaauagcacugaaaggagucaucuuaaaagguucuaggucuucaaagaaaucuggauuugguauuuuccuugguuuccagauucccuaguuugugauuuggagaggggaguagguugggggugaggcagagacaaaagaaguuucaaaacaucauuucagauaauaacaaaaaaagaaaaucuauguaagacucauuuuauaugaucaaagaagauaaacauuaacugccaaauuuaaacaagcacagaacaauaaaugcuaguaauguuuuuauacugaauucuugacuucuaccaaauucagucuccaaucugcaggaucuuauucugaaccaacaccugguccugcguagcucacuccacccucaacaagugaugguggaauguagucaguaaagccauuucccauuccccagaagugauuuuaaaaaaugggcuagggauguaggccagaaacacagcacuuacaccuaauaugcaugagacacuggauucagucucaauacuaauccucaacaaaacacaauuggugguggccaaccgaauagcuaaauguuugguuugguuuggcuugguucaacagggauucauacacccaggauagccuuaaccuaucccugaucuucuuaguuauagcugaaguugacauuucaacuccugguccucaugcagauaaccaagugcuagaaugacaagcauguaacaaagacauauucagauagucaaauggcaagcuaaaguauaauuuuuguuugaucaguuaucuaaauggacaacuaaaaacauuuuacaacagaaaagcaaacaaaauauauacauauagauagaugcaccauacaucuaaaaguguaagcgaaaauuuaugacuauaguuuuuugguuuagaaacugaagccaggaaggaucuacauugguaccuucccagaacacaaguggagcuucauagcuucacuauacauauuacuaccgcuucauauguaccuaccuaucuuuggcagaaaacugaugagaccaagcaauuagcugacuuggcaagauccaauucccaucacaguucccuuauagccaaucuaugcacucaacaauaggguauccacacccuaaguucuucuacccuacuuuuauuuuuagauauagcucacuaugaugguuugaagagaaaugggcuccauagacucauguguuucaaugcuuggaccauggggagucacacuauuagguguggccuuauuggaggaaguaugucacuguuggggcaggcuuugaguucuuguaugcucaaacucugcccaauauggcagaguccccuucugcugccugcaggcugccaugcuucccaauauaaugacaauggaaucaaccucuaaaacuguaagccagccuuaauuacuuuccuuucuaagaguugucuuagucaugguguuucucuucauagcaauggaaacccaaacuaagauagucacauagcaaguucgaacacuccucuuuccuguuuuuuagguuuuauguuuagcccaauauucaccugucucuuaaguuuacuuucucuuuuugauuugcuggccuuacuauugaucaagcuuuugcccagacacgaacaaauuaauaaaaacacuuaaaccaucaggagacacaaaccugguaguuaggguugucaaucauuggaggcuuccauuugcccuuauaauugggguugucaaucauaggucgcugccagacaccacacccaggggcugacucacacuugggguuggcaaucugaggagccucccauucuccguccauauccucaucccuguggagguauaaacaaacaacuagucuuaugcucucaacauguuucuggagcuauaccagcagcauaugacagaacgauaucucauuucucauuuccacuaucaaugcacucucauaaacuaccuacuuuguuuuuacccaaugaaauuuaguaaaguuuguaagguuuuucacucaaacuugggcaguuggcuuuuuauuuuucccuuuagguuuucagacaggguuucucugguagcccuggcuguccuagaacucagugauccacccgccucugagugcugagaugaaggcauguacuacuauacccagcuuuuuuuuuuccccuuuugcuucuuuuuuguuguuguuguuguugggggagaggggcacauagcuauugcuuugauugauugauugauugauugauugauugauugauuuugguuugcccaagacagaauuucucuguguaacagcuuuggcugucccagaacucacuuuguagaccagguuggccucaaucucagagaucugccugccucugcugggauuaaaugcuugauuuuaauuggggcaguuuagcaguuaagaacacuggcuucucuuccaaauccaagugaguugacacauagacaaacauuaaggcaaaacaccaaagcacauaaaaauaaauuuuuaaaacaaaaaccagguaaugacaaaagcaaccucaaacucaccaauccucuggcuucucugcaucagggucuggaauauacucagguucgucgucuagccagccuucaggcuugguggccucuucaucugggaucuuagaaggggcgucuucaucccuuaaacagaaaacaccagggauggcaacacaggccagagaaucagucaagguagucucuucuacaaacccagauuaauucauucuagaaaacauuuauaaaucauuaucuaggcuacucuccccaccaccacauauaccaaaaaaagagagagagagagagaaagaaaagaaaagaacuuaacuaagaacagcagcuaaagaucaacuaaacauuuuucuaauggaacuacgggaaucaucaagaguuauaagggaagaugcuuaacuucacuggucaucagagaaacuaaaaccaugguaauauuccacuaucacacauccacauagaaaggcuauuacaauaagaaauucugagggaaaaaagugcuggugaaaaaaagcaggggcaauuccucaaaauuggaaguuacuguaugacaauuucauuccuaaguuuguaucugagaaaaacaaaaacacacacaaaaaccaguacaucuaaaaggcaacaaccuacacaucuaucaauuacauaaugguuaaguggauaagcauaguauaucauucacugauaugaugaaguauuucucagucauaaaaagaaaugaagugcuuauccauguuucaauaugguuggauguugaaaaaauuuauguugauaagaagaagucauaugccaaaggccacauauuauaauucaaugucauuuccauaaaauuuuccaaauggacaaauccagaaauaaaaaacaggccgguuagugguugccagaauuuggggacaagggacugacaguaggguacauuauauauaaaaaaaaaauccuacaauuagauaguaguguauauauagcacugcagauacauauacauuaaccaucucuguuuuauacaccaaaaaaaaguacucucaagaugguuaugguagagcugggcggugguggcuacacgccuuuaaucccaacacagaggcagaggcaggcggauuucugaguucgaggccagccugaucuacacagugaguuccaagacagccagggccacacagagaaacccugucucaaagagacaaaaaaaaaaaaaaaaaaaaagauggucauugugguauacaguaaauucagcacuguuaaggcugagacagaauccugaauuugagaauaaccuggauggcauagaaaaagucuuuuaaaaagacacacauacacacaaagaaaaucucaucuaaaauaagacucaagggagcuagaaagauggcaagguggguaagagcacuugcugcucuuucagaugaccacaguuccagugucuacuagcauggcagguuacaaccaucuauauagcucaaguuucuuccgcuggccuccucaagaaccaggaacaaacaguacagggacaagauugucaugcagacacugucaaaguacuacuucagcugguaaucaaaaaucucccuguaggccgggcgugguggcgcacgccuuuaaucccagcacucgggaggcagaggcaggcgaauuucugaguucgaggccagccuggucuacaaagugaguuccaggauagccagggcuauacagagaaacccugucucgcaaaaaaccaaaaaaaaaaaaaaaaaaucucccugugcucaaguuuaauguuuaguuuugccuuggcacugaacucaaggccucauguccacuaccacugagaaaugccucccucaacagagacuguuuuguaacuaucuuaguuuuaaauuaacucugggaugaccucaaaguuuuauguaacuuuugcccgaucuuuuaaagcuuaaaacucucuucauccuauuuuuaaaaaggugauuagcugggcauggugguacaugcuuuuaaucccaacccucaggaggcagaagcagauagaucugugaguucaaggccagccuaguucaaagacagucaaagcuacacagagaaacugucucaaaacaccaaaaauuucagaacuuuaauagcuuuaaauauggauaggaggaguauuuagcaauacagcacauguuuaguaugcaggaggacuuggguuaaacccuuagcacuguaacccaauuuaacuuguaauaaugaagcacuagaauggcuguacaaaaagauugucagcagacaaacuacaaaagcuuuagcauccuauaguuuauaacauagugagggauaauauauuuuacuacuauuggguuuuuuuuuuuuccagaguaauuggaacuuaagucccccuuuuuuuuuucuugcaagcaagcauagggucuuacuauguaagcccacacuggccucacacuccaucuuucugccuuggccucuugagugcuagaauuauaggcauguuccaacgugccuaggcauguaucacagaguauuuacauaaucagaucucaaucaacauuuguuguuuaagcuauguagaauauauaaauguaagcuaauacucaaagauggaucuccaagauuuaccagucaucuggcuugacagcaucuggaucugcuauuuugggccuuucaucccaaucuucaggcuuccggucuucugggucuucaauuucacgugaaggguuuacaggaggagucaugucauuuagcagauuuccacuguucacaacagacuggucaacuaauauuucaaaacuauugucuggauucaagacugaaaagaaagaaaaugcaauuaaaauacugacuaaaccacucauuccaacauucccaucaaucuaacacaacagaucaugccuucuagaggaagacccaguguauagucaugaaaaagagaucaagguacuggaauuagacugucauagucaacaaagccuaguucuuuaagagccuggggccucaaugccauuuccuugaguuccuagaaauuagaaaugaguaauuucuuucuuucuuucuuucuuucuuucuuuucuugguuuuauccagacaggguuucuuuucugucuugccccagcugucuugaagcuuucuuuauacaucaggcuagccuugaacucacagagaucuaccugcuguacaaauugaaaugauaaauuuuaguaagcuauuauuuucuccaaucuggagaucaaaccuagggucuuguacacacuguacaagcacuuuuaccauggaccaucuuuaugaaaauauuuaaaggagcugaauuaauggcucaguggucaagaguucuaacugcucuuccagaguaugaagguuuaauuccaggaucuaaauggcuacucacaaucuucaauaacuuuaguugcaaaggauuugacaacuuuuucuggcaaguaugggcaccaagcacacauauggauguggauggaggaaaaauacccuacauaauaauuaaaaauaaauaaggggcaugagagauugcucaucgguuaagaacacugguugcucuuccaauagacccaggcucaauuccuaccacccacaugguggcucacaaccaccucuaauuucaguuccaggagaguaaaugcgcucuucuggcaaaugcagacauacacaugauacacacacacacacacacacacacacauacacaggcaaaauauaguagcccauaccucuaauaccagcacuuacuaggcaauacuaguuugaggucauguacaacaagaccccaucucaaaacaacaauaaaaaccuucaggguagccggggagugauggcgcacgccuuuaaucccagcacuugggaggcagaggcaggcggauuucugaguuuaaggccggccuggucugcagagugaguuccaggacagccagggcuacacaaaaaaacugucucaaaaaaccuuaaaaaaaaaacaaaaacaaaaaaaaaaaaacaaccuucaggguauggugacacacuccugugaucucagcacuacagugauaggagggucaucaauuuuacucucagcuauacaggaguuuaaggcaagaguacgggguaugcagaaaaaaaaaagcauucuguguaauggcacaugcguuuaaucucagcacuugggcagcagaggcaggcagaucuaagcuugagaacagucugacugcauacaaaguuccaggacagacaggccuacauaaugagaccccccucucaaaauauuaauuuuaaaugcuaauuggugaaacaccacagcagcagauaaagguaucugccacacaaucccaauguucugaguuagagcccaagacauuaggguaggagagaaacaucuucaaaguuguccucugacuuccauacaauugcccacaaaccacauugauaggaucuagagaagcggcucaguaguuaagaacagcagcgauucuuccacaagacccagcucaauucccagcaccuacauuaacauucuaccuccaggggaccaauauacucuucuggcaucucagcaccaggcauccaaguagcacacagacauauacacacacacacacacacacacacacacacacacacacacacacacacacacacacacgccuuugauccagcacucaggaggcagaggcaggaagaucucugaauuugagccuggucuacagagcaaguuccaggacagccauggcuacguaaaaagccaugucucaaaaacaaaaaccuucauauuaugaaaacguuauuaaucuguuuauauagugaacaaauuuccacuccuauugcuauguaaagggacagaagauagucugcucugcaauuuugaacuucaaaugguuacuggccacaagcuauauauauauauauaaagaaaaaaaaaaaaaacacuaccugacccacagguauuaaguauugaaaaaaguauauuaaacccacuaucccaucccccccucccccugucuuuaugagggugcuccccuacccaccaauccacuccuaucuucccacccuggcauuccccuacacuggggcaucgaaucauaauuuuuuuuauuuaacaaucuacgaaguucucagucauuagaaguccuagugcaauuuuaggugcaagugaaauuuuccauucuaagagguagaccuauuaauauauggccuuguaguguuaacacucccacagucuggauaaaaccuaugaagggaucucucuaaaacugaucuguuuccuucucagcauacuaagucugggcucuuaauauggucuuuaauguuccuggcauuagugcauguucucuuucuguaguaagccuguggccacggaagaaauuuuuuuuuuuuugguuuuuugagacaggguuucucuguauagcccuggcuguuccuggaaggcuggccucgaacucagaaaucugccugccucugcccugccucccaagugcugggauuaaaggcgugcaccuccaccacccggcuaggaagauguuaauuuacacacaggguauggggcuguuucaguuaucauaaguuuucuccucuucaucaaauucugcuuugauccauaggcaguuuaguaguuuccuagagaagcuggagcauagucuguuacccacauucauuggaagacaguacauggggucuuuuuaaaaagauucuucauaaagaacggcuuuuaaguauacaaucuuaacaugaacuagaugcuaacuauguaauguuuuaaacccccaaacagcggguuuuucuuacuuaauguauaaagaugcguuuucuugucagugaaauaggucuucagaucugcaucuggccucuuagcauguuuuucuucauauacaccugucuugggauuuuugugucgaaagaugaaaugcaguuuguaguccucuccacacuuaucuggaccaaacauaauaguauagggagucuugucguggaauugauccuucagagacaaagguggagugcuuuaaguaacucuagucaaagaauucaaagagcaaacuuugaaaaacacauacuuccucucauaaaacugcaugcaaauuauucuauuagcuuuaaagaaaaccuuaugauuuuauagugcuucuucagauaccaaucaaaaauaacuggcaaccaccagaaauacuaaaaugcuuuuuuaaagagaaguuauguacauacaaacuucuuucaaaaacaagaaauaaacuugagaaaacuaaaaauuguuagcacacaggugaggccucccuggucuacacagcaaacuccaugcagcaagggauacccacccaaugauauccuguguaaaaauacaaaacaaaacaauaaaaaaccuaaaaauuccacaguuaagaaagcagcaaugaaauacagcuaaggcuucuacaguccccuguuaaaguuaaaaggccauuagugccaagucuccaugguucaccagcagcagcauuucuuuucauaggucuugcaaacuuuucucucuuuaaaugauggggacuaaacccagggcccugugaauggcagccauguacucuaccacugaacugcauaccccccaagcucaagaucauaaagcacauguuacacaaagagagagccuaccaggcugagcucugccgucuuggaaagcagcuucacauaggcaccaccacauucuauuccauucugaaaauuaaccucauaccuaguuucagagagaaaagaaaaaguccuauggcauuuugaaagaucauauuuccuauauuuccuaauugauuucucccagcuuggucauguuuuaucagaugucauacccacacaaaagguuccauugucuacugcuuuuauguggccacucggccacacaaaaaucaaaaaaacaaaauaaaaguaauccuuaaugcaaaagccagacauuuguuugcuucuaagaagguaaacaaccagacuguuuuacaagaagauaaaaacaaaaccacucaacauauuccaauucacacaaaauuccuacuauaaacaugauuuuuuagaauguucaacuuucauacugucaccugagauuacccuuucuagaaaauuaucaagauggcacugaacuuacugaacaaugagaggcuugguaucaaacaggaagggcuuauucaguuuagcagagauggcaugaugcuuggcccgagacaucaguacaaguccuuuauccccuggaagcuuuguuuccuucaucucaucuacuucccacuuuccuacaaaagaauacaaaauggcucuugacuguuagccacaugauuuaaagucuuuuaaaugguaacgaacuaaauucugaguuguguaagugucaaaauaaucgauguuuaccauuacauuuacauaugagcugaguuaauauaucuuuuauaugguaagacauggcuugaaaauaacaguggccuauuuguuauaccuaaagaaaaacuuucauuuccaacauggauauuaagaguucuuauucuaucacacuuuaaaaagccccauauacaaagaugauauaauuuccaagaaaaaaaucucaaaauaucuuuuuagaauacuuauuuuucagcaagguauggcggcacaagccuuuaaucccagcacuccagaggcaaaggcaggaagaucucugaguuugaggauagcacacagaacaagagcucuacaguguuccaauacaaccaggauuagaaagaaacccuaucucuaaaaacaagcaacagauuaccuaucucucagaugugcacaacugcacaagccuuuacuugcaguauugugaggcaaaguccagauaugccuggucuacauagcaaguuuuaggccagccaaggacacagugagacccugucucaugaagucucaucaacauggcagccuaaacaagaccacaacaaggaagacaccaacagacaagcuaauuugaaagagggaaucucauaggggcucaacuucagacaaaguacuacaagcaauuaaggaaugcugagaguagaagaaagccuucccaaggaaaagcccccaaauugguucucaaguggucagcccugaaaucauauacaugaaaauaaugcuauauaaggagcagauuguauuuauauucuuagggaaaauauaguaauaaggagagauaaugaauuugaaagagagcaauggaguacaugggaaggauuggagggaggaaagaaaacaauauaauuauauuuuaauuuuaaaaauaaagauauuuuuaaaauaaauagguuuuuuaaaaaaaaugugugucugcccauggaggccaaaagaaagugucuaaagucuacagcuugaguuacagguaguugugaagcacugauauggguacugggaaacaaauuuggcucuggaagagcaauacauucuccugauuaaacaucuucuugaccuaauccaaaagagaugucauggauuuaguggauauccccaguaugagcacauggacaacacaaaucacaaucaguggccucuaaguuaggaggggugaacaaaguuagauaugggaagaguuagguuaggaguaggggaaagaugauagugaucaauguaucauaugaauguaugaaauucucaaaaauaaacauauuguauucuaaaaagagagauacaauggagacaagaugccacuuugauauacuguaucuagaacaaauggaacucucaccaucauauuuggcaauuucaucaucagugucaucuuuuuuggcuuuagauaaaauccaccuguaauuaagaaggccccagaguuaaaauacauucacucuccuguucuaucuacccuauguaacaagacucaagagaaaagaaauccccaaagaauaaaaucuaggguagaagagaaaaacggaaauaaaagcaacaagaggccaaguuccaagauacauccauguaugaggagauguacaguuagacacacuaucccaggggcccacuauuuaaggcuauaucuagcagcagagcacuugccuccccuccaugacacuauguucagccccaauacugcuuaaaaaggguccagugcuuuuccacuacuuuuauuuacaagacauucaccucucaaaccuuuacucccagggaaacacuuacccugacagagacccucugucaaaggagucagcaaaauaaaccuccccuguuggaacuggagcuuuguaggugaccuguguuaaacauaaaauuaauuaagcagcaauauuuuaaccaagcacaguggcacaagccugcaaucccaaggaaaucaaaucccaaggcauccagagcuacagaagacccuuguuguauuggcaggaaugggucauuuaguaacauucucuagaauuuacucucaggauuugguuucaauugucacaaagcuuucauagcugcccuuaaauucaauccacauguaccaaagacuugucagaaagcuuagcaaguauuuuuuuuuaaaagcugcuuugccuuuaaaaacaauccccuuuuuggggugggguggaggagugccuaagaaauaggcaaguaacuauauauccccagccucuggcuuaauuuuucuuuuuuuaaaccaaaagauaaaaggaucuacuuuaagcugagaaugguuacauacaccuuuaaucccccacucagaagguauaagcagguagaucuuuuuuuuuuuuuagauuuauuuauuuauuuuauguauaugaguacacuauagcuguacagaugguugugagccaucaugugguugcugggaauugaacccaggaccucuggaagagcagucaguacucuuacccgcugagucaccucucuagcccagcagguagaucuuugaguuccaagauagccuggucuacauagugaguucaaagacagccaagauacccugucucauaaaagcaaaaagaaaaggacugaucugcuucaaaccuuuggagauggaggagugcuggcaucugauuuagauuuugaaucuucuaccucuucaauaacaucaucaagaucaucuucaauaucaaucgcgucaucaucauguccaucaugagccucaacagcugcaguuccaaggaccagcagcaaacacaguaaccacuucccuuccaugaucuaucugcaaaaagaauggaaugugaagccgggcagugcuggcgcaugccuguaaucccagcauuuggaaggcacaggauuucugaguucgaggccagccuggucuacagagugaguuccaggagagccaggacugcacagagaaacccugucucaaaaaaccaaaaaaagaaaaagaaaaauaaagaauggaaugugaaauguacuguuucccauuuuaaauuccauaaaaccacuaaccuuagucuguuccuuguuaaucaggguuucaaaucacagaacaacaacaacaaaugcauuuucaaccuauacaaaagggaaagugaacccugggagaugaaaagauuuuccuagauucagucacuuaaaagcaacauucaaaagcauaucuaaguauaccauguaaaccgaguauucuggugcauaccuguacuaguuaguacuugggugacugagacaggaaaacccugaauuaaaggccugucugaacugugaagugcuaucaaaaaauaauaaaauaaguuacaccauaaacccccucaggaagcacagguaggagaucaaaaguucaguguugucuuuggcuagagaguaaaucucuaaaccauaggaaacacuguuuacuucucucacacacaguaucaaacaauacauagaccaaggguauuuaauuaauuaguuccaucacaccuauuuauuaugugugaccucuuccuacgagcugugaaaagacaauuuuaaggagucuuuccuucuacugcuugagucucugacuuaaguuaucagguugguggcaagcaccuuuacgcaccagccauaucuccuuaaccccaacuguuacauaauguccaaaaguucuuucacgucuaauuuacagugacuacuaauuaaaaaauuaaaaugaaauaacaaauauaacaguucacuucacauuaaagacucacuauggacacuacugauacuguucaguucucaggcauacacacauuuuuaaauuaguauucuaagauuccacaacaaaaacauuaagcagaguacuagcuacuuuaaaucgcuaguacuuuaaaacuucuaagcacuuaauucucuuguguauaaaacuagcccaucaugagugacagguagggccucuuucuaaggaucacagcucuacugaaauaaaagccaagcuauauaagacacacaaagugagcugggaguaggugaggcuugagaaagcagaaccaagagacugagaaagaacaaguagaugaccuacuacaaguauaaacaugucuucagcaaggcacaaucuucucuuucuuacacagucacccagucaacccugaucuuugauucuguuaccaccauaaggacacuuauugacauucuguccucucugaagucacccuacacgcagaugagauucuuuacacuucaacacugucauaaaagcuuguaugugcagcaccuguaccuccucuggccagcaaucagaccuuucccucaggcugcucugcagcguauucuccccaaaauccucauucacuucagugacuuucugccucuuuauacacauucauguucauuauucauuuccucuuccuauucuaacacacuacuaaaaagacuuccgaaaauggagaaauccugagaaguccauacccagucuuaguugugucuuacucuuccccuaauucuauguuaauauguuuuucuuuucaauaaacuacaaaugcagagagagagaaagagagagagagagagaaaaugcucgaaagagccuggcaugguagcauaaccuuuaauaccugggaaacagaaacaagcaacaccuaccugguauauaagucugggcucauaaaagcaaaaaaaaaaaaaaaaaaaaagugagauccuaacuuaaacaaaauaaaaaacaccaaaauauacccaaaugccaaguguuuuccugugagucuuucuuggcgacucccacuguggcuaucacucaccuuucacucuggccacacuauuacuuucaccuacuugcuuucuuuucuugaacacuucucaccuucucaaagcaauauaagcccacaauuucuaccaaaacucaucaugauauuguuauaaacacagcaagaagccgggcggugguggugcaugucuuuaaucccagcacuugggaggcagaggcagguggauuucugaagccagccuggucuacagagugaguuccaggacagccagggcuacacagagaaacccugucucggaaaaaccaaaaaacacagcaagauacaaaagcuuaugaaacuuuuaauaaaaauauaauccagauacaauacacaauaguaaauguucccuuguacaaccugaguggaauuauaaaaugaccuaaaugcuauggaaaagcagcuaccauacagcuaauccaacaacuucacucugguugcacaaccaaaauaaccaaaagccgguuuggagagguaccugcacaugcauguucaucacuguaacaauagcuuaguaaacaagccuauuacugauacuacauacauuaaggcaaugguucucaaccugugggucacaaccacuuccagggcucacauaagagaaauucugccuaucaguuacuuacauuacgacuccuaacagcagcacaacuacagcuaugaaguagcaaggaaaguaauuuuaugguuggggaucaccacaugagaaacuguauucaaggauugcagcauuagaaagguugagaacauuuuuuuuuuuuuuuuuuuuuugagacaggguuucucugugcagcccuggcuguccuggaacucacucuagaccaggcuggccucgaacucagaaauccaccugccucggccucccaagugcugggaucaaaggcgugcgccaccacgccuagcuaagaacauuuuuuuuuacauguuacaggcaaguccaaaauagaaaaugaaaagggcucaacuuacuauauugaacaauguaaaccaguuuguucuaaugcugaacuacaaaugccuuauaaauucuguaauacacauagacagacagauagacugacagacuuaucuuugaagagauacagagaugguucagcaguuaaaagugcuuccugcucuuccaggacccaaguucaguucccagcacccaugucaagaagcuuauacccaucuauaacuucuaagucuggccuuugcggacacaugcacuuaugcacauaaccuccuacaagcacauauacgcauaauuaaaaguaaaaauaaaucuaaagaaacuuggugugugcuuuagaaaacaaaacaaaaaacaaaaacaaauaacacuacuucuguucuauuaauaacauaagauauugagggcggagaguuggcucagcaguuaagagcacagcaaccaggaucuauaguggaaucuguuucccacuucuggugugcauuaaaacagggcacucauauacauaaauaaaucuuuaaaaaaagaaaaggauguuaaaauaaugaaggacaaucauaaacuaggagaaaauauuuacaaaacacacauguaaugggcuugcuuuauacauacaaaaaaauaaacuucaacauaagagaacccaacuagaaacuaagcaaaaccugggauuacaguucaucaguaaaguccauggcccagcacuuugaaaggcucugagcuuagccaaagaucuguacccaaaauucuaaauacuuccaacaggugaaaggaaaauaaacuuguucauccauacacuaaaaucuuguucaaucauugaaagaagugcucaagcacaaauacaugaaucuaaaaguauguugcuagcuaaacaaaagaggucagacugcagaaucccaauuacuaauauucugaaaggggaagaacuugagacuucauacaaucaauuguguauauacauugcauuugucagaacccauaaaauuacaacacaaagaaaucuacuuuuaaaauuguaaaucaaaacaaagacaauauguacaauuagacaaaacaaucuacagauuuauuauugacuguuuagcuuaauacaaagucacuuaaaaaauguuuccacuccaggcgugguggcaccuaagucuccuaagcagacagcacaccuuauguuguuccccauaguuucuaaaaauugucagaaaguaaucuauaacaaguagcuuaagaacaaagaaaaguggcagugcacaucccagaacucagaaagcagaagcagacugaguuggaggccagcuugaccuacaaaguuccaagacagaaaggguuagagacacugucuccaaaaaaagaaacaaagaaaggaaggaaaggggaaaagagagaagagcaagcaugcaaucgguuuugucuguaauauuuauuguggguggggcucagaagagaacaacuuucaaauuacuagagucuguucucuuucccucuucccaccaugugggacuugugaaaugaacacaggcuuggcaguaaccauuuuuacacagugaacuaccuccccaccuaugcaauaaaguguuuaaaaaaaaaaaaaaugggggcuggugagauggcucagugggaaagagcacccgacugcucuuccaaagguccggaguucaaaucccagcaaccacauggugacucacaaccauccguaacgagaucugacucccucuucuggagugucuaaagacagcuacaguguacuuacauauaaccaauaaauaaaucuuuuaaaaaacaaaacaaaacaaacaaacaaacaaaaaaaaaacaacggggucuggagagauggcucagcgguuaagagcacugacugcucuucugaaggaccugaguucaaauccauuaccauccguaaugagaucugaugcuucuucuguggugucugaagucagcuacaguguauuuacauauauauauaauaaacaaaucuuaaaaaaaaaaaaucaagcagcagggaaucuagauuugcaaggcucaaggggaaaucaauacagaaauuaucuuacuucuauauagaaacacauuucuuacgacucuuuacuauuucaaaggcaaggaaucuggcaauccuauauaccauuucuucugcuucugacauaauuuucugcuuacaagauauaucauuuguggauuucuugaagcucguuauuuacuguuuuuuccuauuuggcuugaacuguguggcuuguacaugcuagucacauaaucuaccgaugagcuaaauccucaguccugucuauucuuuaggaucaccuacacaggauuuugucauuacguuuguugccacagaccccuuggagcuaggaugcaaaugcaaggcuacaugguuaucaguuacaaauacaaacacaacuguugucaguauauaaccacuuucucacuuuuucuuuuccuuuuuaccaaaauaaaaaguuuuggugaacagcaaaaccagacccuguguguuaugcaccucaaaucuuuugucuuaugaaauuacaaauuacuguagcaauuagaaaucaaagccacguaacauagaaaucuuaagaucugagccuacuacaaagacaauuucuuccaaaaauggcuuaaguauaucacuaaccugaauuucacauggcuuugccuuuaaugcaaacaauaaagccgacaguggaggggacgaguagcauacauacuauaugacacaaguacugauuuaugauccagcucuuuaaaaaaaagcuggucaaucccaagacucuuuccuagcagucacauaaucagacacuacacaaauucuguguuacagaggagccaaagggaaaauguaucuggugccuagcagugagccugauuacacucaaaugguuugcaaugguaggcaccugugaucacagcacuccagagacuaagcagaaagaucaggaguaacagaaugaacaaggccaaccuaggccaccuaaggcccucucucgaagaaauaaaacaaggccuggcaagauagcugggcaaguaaagaugcuuugccaccaagcccaaguuugauccccagaacuuaugugauugagagaacuggcuccugcaaguugcccucauucucaccacacauguacuaugacauguacaugugccauccccucccuaaguuaaaaaaaaaaaagugccaaggccaaaaagggaaaaauuccaaaaauaaauuauaaauuauuauuagaacuaaacuucacacacaaaaauggguguggucugaauauacuuugaagaguagacccauguaaaaggccugguuugggucuuacaguuaccucacuaagggaacucagcagucacugauuacaacagacuacccuguauuacuuuugccacuuuuuaagugguagggccaucuacaugauagccuagcauucagcauucuauugcugaacuuccucccuagcccuuguuuuagagacagaaucuucauuuuguaauccaagguagacucagacuuaaagauaccccaccuccaucuccagggacuaaauaaauucauguacugcuauaucaugcuaucacuggaaagagaggcccauuggacaugcaaacuguauaugcuccaguacaggggaacgccagggccaaaaaaaugggaauggguggguagggaagugggggggaggguaugggggacuuuugggauagcauuggaaauguaauugaggaaaauauguaauaaaaauauuaaaaaaaaaaaaaagcauuuucgggcuggcaagauggcucaguggguaagagcacccaacugcucuuccgaagguccaaaguucaaaucccagcaaccacaugguggcucacaaccacccguaaugagaucugaugcccucuucuggugugcuugaagucagcuacaguguacuuacauauaauaaauaaauaaauaaauaaauaaauaaaucuuaaaaaaaaaaaaaacaugaaagcuuaaaaaaaaaaaaaagagcauuuuccaguucuguuauacauauaacuacuucaaaacuuaagguuuuuugguuuuguuuuuaauguauuacugaaucaugagcucaaggccagcaaguuccaagucauccagggauucacaguaaaacuggcuaaaagaaaaaaagauagccugguaagaaagcucucaguggacaaauaaagacacucacugcuaagacugacaucugaguucauucccuggagcccacauaauagaaagaacuccugcauccacccauaccauacacaccuauacacacaauaguaaaacccuaaucuaauuuuuuuaugaauaucugcaugcauguuucugcacauugggcauacccagaaccugugaaaaguaaggcgaugucagauucccuggaacugcugcuacaauccacuauaugggugcuggguacagaacacagguccucucuagccccaguauauuaaauuuaagaugaaauuuaagcuuaaugaaguuuagucuuucucaaucuagaaggguuugaaggacugggaaagacacgacguauuccaggaaauuacuaaccacuuaguagcaaaccugaggccaaugccagacccuuaacuuuuuuuuuuuuaauauuuauuuauuuuauguauauggguacacuguagcugacuggaugguugugagccuucauguggucguugggaauugaauuuuuagaaacucugcucacucuggucaauucugcuugcucagucccugcuugcucuggcccaaagauuuauuuauuauaauacauaaguacacuguagcugucuucagacaugccagaagagggcguaagaucucauuacgggcauauuuuuauuagccacuauguggcugcugggauuugaacuguaacuucggaagagcagucagugcucuuacccacugagccaucucaccagcacuagacccuuaucuuaaacaagguggaugcuaccugaggucauccucuggccucaaugcacacuccugggcagccaaucauaugaauguguacacacccauauacauacccuaaacuugauguggguauguaucaaugguguaaucuuugucuagcacgugaaagcccuagauuugcucuccaauaaucaaaugaucauccgccugcaaucaaacauaaagcauagacaaauacaaagccaacaaaauacauucuuugcaugaagacuuuggcaugcuucccaacuuaccaaagacaaugaggccuacuuuucaggcccaaagguaucuucaugaccaccuaccuaaugcacucauacuucagugcaauccacccagcuuuuagaagggcgaauuaucuuaaauccuggaaguggaaaguugagauuuuauuauuucacagugcugugaucaaaaccagagccuccugaaggugaacagagcccugccucugaguugcauccucaguguucagcugcagguuuucuauuuggaaaccucaauuccuuauuaucaagacagcucaguggugaacaguaaccugcccugucagggagaacuguuguaguuucuccagcuucugggggaccccggccagaucaucuacauccaguucucccuccuccagucuacagaccuguauaauacaacuacugcccaaugcuuguacuuuuuuaaaaaauaaauuauuuuuuaaauuucuuaugcaugaguguucauuugccugcaugugggccuaccuaccauguaugugcauagugccacaagacuagaagaggggaucaaauucucuggcucuagaguuacagaugguuuugagucaccauguuggugcuaggaacuagacagguccucuugaagaccaccuaguacuguuaaccacuuagucaugccuccccccaccccgccaucgaagacuuuacuucuuagaauuuaaaaaacaaauucaagcagaauuugguuuugcagacauguaacccaauacuaauagaggcagaagcagaauuaucacaaguuugaggccaguucuacacuaugaauuccagaucagccaaggcuacguaguauaauccuguuucaaaacucaaacaagggggaggggaaaaaaaaaacucaaacaaaaagaaaccucaacucuaauuucuuucauuuaugaaaaucacagggauaguaagaugaucuaauauucuuaguuauucuaauauaaauacuaaguaauuuuugaaauagcauggaaacuuuaaaaugugauuucuauguaagcuauacauuccuuccauucauuucagcauacuauuggugugagucuaugugaaggcuuguguguacaaaggacagaccugaugucuuccuccaucucccuucaccuuauucuuugacacagggucugagagaaccuaaagccuaugagcuuuagcaucccauugucuccaguccccagcgcugaaugcugacaauauaaacucaggucuuaaugcuugcacaagaggguaggcacaucaccaucuaagccaucuccucugcccucauuugacauagucuauuaaaaauuuuuggucuuaaaaaaaaauuaggucuuggcagguaauacuuuagguggccuaaaagaccccauauaaacucuaagaguuucuaucacuauuuauauauucugcccaagagcauagacagaaauauguuuauaaacacauauucaaaucacgauuucuggucagcuacuuaauaaugugggucaauugcuaaucucugggccugaguuuucuucucuaaaccaacacuaacuucugcucuagaacugcugacuagguuaaacauacaugaacugcguaugagaccuguuuuacagcaugcgcucaaugugacugucuacaguuacuagauaucgauacuauuucuacuuguugauuuuuuuuuuuuucgguuuuucgagacaggguuucucuguguagcccuggcuguccuggagcucacuuuguagaccaggcuggcauugaacucagaaauccaccugccucugccucccaagugcugggaucaaagguguguaccaccacuaccuggcuacuuguugauuuuuaaugaauuuuaagguaaauacucuaaacuuuauuuugggagaaauauaagcacuuaguuguauuuauuauuuuguggauguacacauguggaagucagagggugacguccaggagucagugcuuuccuuccaacaagugacacccagcaauagaacucuagcuuggcagcaagugcccugacucucuuaucaucuuuccacuauuuuuguguguaugugcgcgcgccuucagauuuuacuacuaccuugucaaacauuuaaaacaugggcuagagagauggcucagaaauuaaaagugcuuacuguucuugcagaggaccugauacccacauuaaguggcuuacaauccuuuaccagugccuuuaacucuagcucugggggauucuguacucauguguacauacacauagaaaugcaugauuagaggccagagagaaggcauagaggguaaaggcacuugucaagaagccuaacagguugaguccaaucccuaauacccauacugaaaaaaaaaauuccagaaauaucacaccaacuuccauacaaguucaaaugccauggcacaugcaugcacaaacaaaagauaaaguaucuucugagaauuacauuuaauggggaaaaauacaacuuuauaugcucaucuauuaaaaaauaauuuuuaaaaaguaugcaugauuacauaccccugcagucccaguuacuugggaggcugaauuuggaugacuaagugaacucagaaauucaagaucaccuuacagugaggagauaguuaaguagugguguuuuccuaauugcuaaguucaaggcucuagaguccauccucaguauuugggggaugagguaggauaacaaagacagaacaacauccugagaaacagugugaccugcucuauaaaugagaccuauaccuuacucacaugucauauuuggggguuucugcuucauguguugggaauggaacccugggccuaggccaagaauuauauaccaccuucuuggauuuguuuucauuaacagaaacauaggaguaauuugguggugguggguuuuuuguuuuuguuucguuuuguuuuguuugauacaggguuucucuguuguagcccuggcuguccuggaacucacucuguagaccaggguggucuugaagucagggauaaaucugccucugcuucccucaugcugggaucaaaggugagccaccaccacaccacccagcuaauaagugauuuuuuuuaaaagaaacuuuuuccuauuaauucacuuuaagaugugaauacgcaggauggagagauggcucagugauuaagaguugaauucccaguugggcagcuuacaacuguuuguaauuccaacucuagagaauauaaugcccuuuacuggcccccaugaauaauauauugcauauauauucacaccaacauacacauauuuuuaaauauauauauauauguacauaguacacacacacauauuaaagauuuauuucauguauaugaguacacuguccucagacacaccggaagagggcaucggcucucauuagagaugacugugagccaccaugugguuccugggaauugaacucaggaccucuggaagaacagccagugcccccaaccgaugagauaucucuccagcccuaaauaaaucuuaaaaugauuuuuuuuaaagacaagaauacaauauaaaaauugucuagauuccuuaaaaaaaaaaaaaaagaaaaaagaaaaauuucagggcugaagacauaguugcugcucuuccagaggacccagguuugauucccagcaccaauaugaugggucucacacacaugguacacagacauacaugcaggcaaaacacacauacacagaaaauuaaauaagccuaaaaauucuuuccuagcauuuguagcaauaacaaagcauuuaacaagcauuuuccuaaugaguuuuacaguaagcuauacagacuacaacuaucuuuggcacuuuaauuacuucuuaggacuuuuuaugagcugccaauacuauuuguccauuuccuuacacuuucccaaacaguuucuuaguaucugcccucucaaaggcaaagcaaguagcacacucauccccauuucuuucuuucuuucuuucuuucauucccauuuuuaaaggauaggaauuaaaguuaucaugcuggacagucuucugcaguuauucuuagcaacugccacucuacucccucaaaguucucuuacugggcaagugaccucugcaggacaaggaugcaagguguguugucaagaugcacaugccuuguggcucuugaaagauuaaggaguuaauugcacuguugaguuaagauagcaaggaggugacacccauucacagacaguucgguaaacuccuauugugaauggcucacuacuauauacaguucuucagggccuggcucaccuguaguguaccccugccuggccuguaagcuuaauuacaguauaaguacaacaugagaauugauucuguucaugcccuuucaaagguuacuggaaaauauacaaagauuuuuaagguaacccaacuugucccccuuuaaaggggugggagggcaaauuauuuuuaaaaaacaggcagauucuuccauuucugaaggguaaagagacuguagcucaacuuugccaagcuuuuaguauucaguuugguuuaacuucacacaacuagcaaugcaaucacuagugucaugaccagcaguuaauacacaaagugucaucaauguguccucaggucuuggcacacaggccuucaauauaaacauuaguguaucaguguaaugaccaaggcauucggauuucaagaagccaguucgauuccuacccacugaaccuuuacuacacauccaauuucucauucccauucccucggaauucaauacaaggcccaucagucauucugucuacuccuggggacugagcccuaaaguagaaaaaaaaaaucucccaaauucccacucccccgauuaauugcaguuaggugcuugaaccaggacuuuuaacccaaacggucuagugcucaguuacaaucccaacuggaugacuagaacuaccuguaugaccuugggccagucauuucaaacuucuaggccucaguuuccuccccucacuaacugaacuuucgcuuguaucuccugcucuuaagguccugugaacacccacacuggauuacuaucuauccaccaccgaauaggcaggugcuuuaauaguuaagccuuaaguuucucaagcgguacacguucuaguacauucuacucccucaucaggaugcuaugguccagucuucccuuugggcaaguuauuuucuaaucuguaacgcuuaucucuggauuuacuucaccuuucccugcuauuugggcuaccuacuaggccgaauucuaauaccacaccuguaccggauuacucagcccaccucugggugggccuggccagggccuaagaaagcucuagaagcaaagccguaggaaguuguuagcuuucucagaggucaagggaaaccccaggacaccugccacgccucccgaccccggcggcgcugcccaggcuagccucucuaacccggccgcucuccucacugcccugcgcguccgcccaggccugcgccauucgaaagcccgcccgaccccucagucgucgagccuacagccacgcccgacccccuccgccacggcgccgcucgcccagucccccaaggcucgucccgggccugagauccccgcacacgcuucccgucucaccucgagccucccggggaccacuggcggcucccucaccuucucccacccgcacacccggccccgugcugcaguggagacagcggcagaggcggcccgaccgucacgugccgcagaacuaagaggccucggcuacggccgccgcgcgagcgagccccaccgcacgaagcccaaccccgcguccgccccucguuccugaguggcuaaaacgaacgucagaucccgccccuuugcgcaagaucuaagaauuuauugguagauacagccaucgcucgaagcgccuucccauacgcccccuagggcuauucuucguggagcguggugauuggucaauagcgaggcaggaagugguugcugauuggguaugaaggaggaaggcgggccgucaccaaacgggcgggcgcgcgccgcggagggcggacggaucuggcacgcguucucgcgugggucgcccuagucccucagggcggguguguuggacauccagaagacggcuuuccgacccauugaguuaggaacucugucccaaccccgccugggaccuauggccuucaucacaaauggugagaggucgggcggugugcuugcg

SEQ ID NO: 5972 - RNA, 32329 nt, Mus musculus
cgcaagcacaccgcccgaccucucaccauuugugaugaaggccauaggucccaggcgggguugggacagaguuccuaacucaaugggucggaaagccgucuucuggauguccaacacacccgcccugagggacuagggcgacccacgcgagaacgcgugccagauccguccgcccuccgcggcgcgcgcccgcccguuuggugacggcccgccuuccuccuucauacccaaucagcaaccacuuccugccucgcuauugaccaaucaccacgcuccacgaagaauagcccuagggggcguaugggaaggcgcuucgagcgauggcuguaucuaccaauaaauucuuagaucuugcgcaaaggggcgggaucugacguucguuuuagccacucaggaacgaggggcggacgcgggguugggcuucgugcgguggggcucgcucgcgcggcggccguagccgaggccucuuaguucugcggcacgugacggucgggccgccucugccgcugucuccacugcagcacggggccgggugugcgggugggagaaggugagggagccgccagugguccccgggaggcucgaggugagacgggaagcgugugcggggaucucaggcccgggacgagccuugggggacugggcgagcggcgccguggcggagggggucgggcguggcuguaggcucgacgacugaggggucgggcgggcuuucgaauggcgcaggccugggcggacgcgcagggcagugaggagagcggccggguuagagaggcuagccugggcagcgccgccggggucgggaggcguggcagguguccugggguuucccuugaccucugagaaagcuaacaacuuccuacggcuuugcuucuagagcuuucuuaggcccuggccaggcccacccagaggugggcugaguaauccgguacaggugugguauuagaauucggccuaguagguagcccaaauagcagggaaaggugaaguaaauccagagauaagcguuacagauuagaaaauaacuugcccaaagggaagacuggaccauagcauccugaugagggaguagaauguacuagaacguguaccgcuugagaaacuuaaggcuuaacuauuaaagcaccugccuauucggugguggauagauaguaauccaguguggguguucacaggaccuuaagagcaggagauacaagcgaaaguucaguuagugaggggaggaaacugaggccuagaaguuugaaaugacuggcccaaggucauacagguaguucuagucauccaguugggauuguaacugagcacuagaccguuuggguuaaaaguccugguucaagcaccuaacugcaauuaaucgggggagugggaauuugggagauuuuuuuuuucuacuuuagggcucaguccccaggaguagacagaaugacugaugggccuuguauugaauuccgagggaaugggaaugagaaauuggauguguaguaaagguucaguggguaggaaucgaacuggcuucuugaaauccgaaugccuuggucauuacacugauacacuaauguuuauauugaaggccugugugccaagaccugaggacacauugaugacacuuuguguauuaacugcuggucaugacacuagugauugcauugcuaguugugugaaguuaaaccaaacugaauacuaaaagcuuggcaaaguugagcuacagucucuuuacccuucagaaauggaagaaucugccuguuuuuuaaaaauaauuugcccucccaccccuuuaaagggggacaaguuggguuaccuuaaaaaucuuuguauauuuuccaguaaccuuugaaagggcaugaacagaaucaauucucauguuguacuuauacuguaauuaagcuuacaggccaggcagggguacacuacaggugagccaggcccugaagaacuguauauaguagugagccauucacaauaggaguuuaccgaacugucugugaaugggugucaccuccuugcuaucuuaacucaacagugcaauuaacuccuuaaucuuucaagagccacaaggcaugugcaucuugacaacacaccuugcauccuuguccugcagaggucacuugcccaguaagagaacuuugagggaguagaguggcaguugcuaagaauaacugcagaagacuguccagcaugauaacuuuaauuccuauccuuuaaaaaugggaaugaaagaaagaaagaaagaaagaaauggggaugagugugcuacuugcuuugccuuugagagggcagauacuaagaaacuguuugggaaaguguaaggaaauggacaaauaguauuggcagcucauaaaaaguccuaagaaguaauuaaagugccaaagauaguuguagucuguauagcuuacuguaaaacucauuaggaaaaugcuuguuaaaugcuuuguuauugcuacaaaugcuaggaaagaauuuuuaggcuuauuuaauuuucuguguauguguguuuugccugcauguaugucuguguaccaugugugugagacccaucauauuggugcugggaaucaaaccuggguccucuggaagagcagcaacuaugucuucagcccugaaauuuuucuuuuuucuuuuuuuuuuuuuuuaaggaaucuagacaauuuuuauauuguauucuugucuuuaaaaaaaaucauuuuaagauuuauuuagggcuggagagauaucucaucgguugggggcacuggcuguucuuccagagguccugaguucaauucccaggaaccacaugguggcucacagucaucucuaaugagagccgaugcccucuuccggugugucugaggacaguguacucauauacaugaaauaaaucuuuaauauguguguguguacuauguacauauauauauauauuuaaaaauauguguauguuggugugaauauauaugcaauauauuauucaugggggccaguaaagggcauuauauucucuagaguuggaauuacaaacaguuguaagcugcccaacugggaauucaacucuuaaucacugagccaucucuccauccugcguauucacaucuuaaagugaauuaauaggaaaaaguuucuuuuaaaaaaaaucacuuauuagcugggugguguggugguggcucaccuuugaucccagcaugagggaagcagaggcagauuuaucccugacuucaagaccacccuggucuacagagugaguuccaggacagccagggcuacaacagagaaacccuguaucaaacaaaacaaaacgaaacaaaaacaaaaaacccaccaccaccaaauuacuccuauguuucuguuaaugaaaacaaauccaagaaggugguauauaauucuuggccuaggcccaggguuccauucccaacacaugaagcagaaacccccaaauaugacaugugaguaagguauaggucucauuuauagagcaggucacacuguuucucaggauguuguucugucuuuguuauccuaccucaucccccaaauacugaggauggacucuagagccuugaacuuagcaauuaggaaaacaccacuacuuaacuaucuccucacuguaaggugaucuugaauuucugaguucacuuagucauccaaauucagccucccaaguaacugggacugcagggguauguaaucaugcauacuuuuuaaaaauuauuuuuuaauagaugagcauauaaaguuguauuuuuccccauuaaauguaauucucagaagauacuuuaucuuuuguuugugcaugcaugugccauggcauuugaacuuguauggaaguuggugugauauuucuggaauuuuuuuuuucaguauggguauuagggauuggacucaaccuguuaggcuucuugacaagugccuuuacccucuaugccuucucucuggccucuaaucaugcauuucuauguguauguacacaugaguacagaaucccccagagcuagaguuaaaggcacugguaaaggauuguaagccacuuaauguggguaucagguccucugcaagaacaguaagcacuuuuaauuucugagccaucucucuagcccauguuuuaaauguuugacaagguaguaguaaaaucugaaggcgcgcgcacauacacacaaaaauaguggaaagaugauaagagagucagggcacuugcugccaagcuagaguucuauugcugggugucacuuguuggaaggaaagcacugacuccuggacgucacccucugacuuccacauguguacauccacaaaauaauaaauacaacuaagugcuuauauuucucccaaaauaaaguuuagaguauuuaccuuaaaauucauuaaaaaucaacaaguagccagguaguggugguacacaccuuugaucccagcacuugggaggcagaggcagguggauuucugaguucaaugccagccuggucuacaaagugagcuccaggacagccagggcuacacagagaaacccugucucgaaaaaccgaaaaaaaaaaaaaucaacaaguagaaauaguaucgauaucuaguaacuguagacagucacauugagcgcaugcuguaaaacaggucucauacgcaguucauguauguuuaaccuagucagcaguucuagagcagaaguuaguguugguuuagagaagaaaacucaggcccagagauuagcaauugacccacauuauuaaguagcugaccagaaaucgugauuugaauauguguuuauaaacauauuucugucuaugcucuugggcagaauauauaaauagugauagaaacucuuagaguuuauauggggucuuuuaggccaccuaaaguauuaccugccaagaccuaauuuuuuuuuaagaccaaaaauuuuuaauagacuaugucaaaugagggcagaggagauggcuuagauggugaugugccuacccucuugugcaagcauuaagaccugaguuuauauugucagcauucagcgcuggggacuggagacaaugggaugcuaaagcucauaggcuuuagguucucucagacccugugucaaagaauaaggugaagggagauggaggaagacaucaggucuguccuuuguacacacaagccuucacauagacucacaccaauaguaugcugaaaugaauggaaggaauguauagcuuacauagaaaucacauuuuaaaguuuccaugcuauuucaaaaauuacuuaguauuuauauuagaauaacuaagaauauuagaucaucuuacuaucccugugauuuucauaaaugaaagaaauuagaguugagguuucuuuuuguuugaguuuuuuuuuuccccucccccuuguuugaguuuugaaacaggauuauacuacguagccuuggcugaucuggaauucauaguguagaacuggccucaaacuugugauaauucugcuucugccucuauuaguauuggguuacaugucugcaaaaccaaauucugcuugaauuuguuuuuuaaauucuaagaaguaaagucuucgauggcgggguggggggaggcaugacuaagugguuaacaguacuagguggucuucaagaggaccugucuaguuccuagcaccaacauggugacucaaaaccaucuguaacucuagagccagagaauuugauccccucuucuagucuuguggcacuaugcacauacaugguagguaggcccacaugcaggcaaaugaacacucaugcauaagaaauuuaaaaaauaauuuauuuuuuaaaaaaguacaagcauugggcaguaguuguauuauacaggucuguagacuggaggagggagaacuggauguagaugaucuggccggggucccccagaagcuggagaaacuacaacaguucucccugacagggcagguuacuguucaccacugagcugucuugauaauaaggaauugagguuuccaaauagaaaaccugcagcugaacacugaggaugcaacucagaggcagggcucuguucaccuucaggaggcucugguuuugaucacagcacugugaaauaauaaaaucucaacuuuccacuuccaggauuuaagauaauucgcccuucuaaaagcuggguggauugcacugaaguaugagugcauuagguagguggucaugaagauaccuuugggccugaaaaguaggccucauugucuuugguaaguugggaagcaugccaaagucuucaugcaaagaauguauuuuguuggcuuuguauuugucuaugcuuuauguuugauugcaggcggaugaucauuugauuauuggagagcaaaucuagggcuuucacgugcuagacaaagauuacaccauugauacauacccacaucaaguuuaggguauguauauggguguguacacauucauaugauuggcugcccaggagugugcauugaggccagaggaugaccucagguagcauccaccuuguuuaagauaagggucuagugcuggugagauggcucaguggguaagagcacugacugcucuuccgaaguuacaguucaaaucccagcagccacauaguggcuaauaaaaauaugcccguaaugagaucuuacgcccucuucuggcaugucugaagacagcuacaguguacuuauguauuauaauaaauaaaucuuugggccagagcaagcagggacugagcaagcagaauugaccagagugagcagaguuucuaaaaauucaauucccaacgaccacaugaaggcucacaaccauccagucagcuacaguguacccauauacauaaaauaaauaaauauuaaaaaaaaaaaaguuaagggucuggcauuggccucagguuugcuacuaagugguuaguaauuuccuggaauacgucgugucuuucccaguccuucaaacccuucuagauugagaaagacuaaacuucauuaagcuuaaauuucaucuuaaauuuaauauacuggggcuagagaggaccuguguucuguacccagcacccauauaguggauuguagcagcaguuccagggaaucugacaucgccuuacuuuucacagguucuggguaugcccaaugugcagaaacaugcaugcagauauucauaaaaaaauuagauuaggguuuuacuauuguguguauagguguguaugguauggguggaugcaggaguucuuucuauuaugugggcuccagggaaugaacucagaugucagucuuagcagugagugucuuuauuuguccacugagagcuuucuuaccaggcuaucuuuuuuucuuuuagccaguuuuacugugaaucccuggaugacuuggaacuugcuggccuugagcucaugauucaguaauacauuaaaaacaaaaccaaaaaaccuuaaguuuugaaguaguuauauguauaacagaacuggaaaaugcucuuuuuuuuuuuuuuaagcuuucauguuuuuuuuuuuuuuaagauuuauuuauuuauuuauuuauuuauuuauuauauguaaguacacuguagcugacuucaagcacaccagaagagggcaucagaucucauuacgggugguugugagccaccaugugguugcugggauuugaacuuuggaccuucggaagagcaguugggugcucuuacccacugagccaucuugccagcccgaaaaugcuuuuuuuuuuuuuuaauauuuuuauuacauauuuuccucaauuacauuuccaaugcuaucccaaaagucccccauacccucccccccacuucccuacccacccauucccauuuuuuuggcccuggcguuccccuguacuggagcauauacaguuugcauguccaaugggccucucuuuccagugauagcaugauauagcaguacaugaauuuauuuagucccuggagauggaggugggguaucuuuaagucugagucuaccuuggauuacaaaaugaagauucugucucuaaaacaagggcuagggaggaaguucagcaauagaaugcugaaugcuaggcuaucauguagauggcccuaccacuuaaaaaguggcaaaaguaauacaggguagucuguuguaaucagugacugcugaguucccuuagugagguaacuguaagacccaaaccaggccuuuuacaugggucuacucuucaaaguauauucagaccacacccauuuuugugugugaaguuuaguucuaauaauaauuuauaauuuauuuuuggaauuuuucccuuuuuggccuuggcacuuuuuuuuuuuuaacuuagggaggggauggcacauguacaugucauaguacauguguggugagaaugagggcaacuugcaggagccaguucucucaaucacauaaguucuggggaucaaacuugggcuugguggcaaagcaucuuuacuugcccagcuaucuugccaggccuuguuuuauuucuucgagagagggccuuagguggccuagguuggccuuguucauucuguuacuccugaucuuucugcuuagucucuggagugcugugaucacaggugccuaccauugcaaaccauuugaguguaaucaggcucacugcuaggcaccagauacauuuucccuuuggcuccucuguaacacagaauuuguguagugucugauuaugugacugcuaggaaagagucuugggauugaccagcuuuuuuuuaaagagcuggaucauaaaucaguacuugugucauauaguauguaugcuacucguccccuccacugucggcuuuauuguuugcauuaaaggcaaagccaugugaaauucagguuagugauauacuuaagccauuuuuggaagaaauugucuuuguaguaggcucagaucuuaagauuucuauguuacguggcuuugauuucuaauugcuacaguaauuuguaauuucauaagacaaaagauuugaggugcauaacacacagggucugguuuugcuguucaccaaaacuuuuuauuuugguaaaaaggaaaagaaaaagugagaaagugguuauauacugacaacaguuguguuuguauuuguaacugauaaccauguagccuugcauuugcauccuagcuccaaggggucuguggcaacaaacguaaugacaaaauccuguguaggugauccuaaagaauagacaggacugaggauuuagcucaucgguagauuaugugacuagcauguacaagccacacaguucaagccaaauaggaaaaaacaguaaauaacgagcuucaagaaauccacaaaugauauaucuuguaagcagaaaauuaugucagaagcagaagaaaugguauauaggauugccagauuccuugccuuugaaauaguaaagagucguaagaaauguguuucuauauagaaguaagauaauuucuguauugauuuccccuugagccuugcaaaucuagauucccugcugcuugauuuuuuuuuuuuaagauuuguuuauuauauauauauguaaauacacuguagcugacuucagacaccacagaagaagcaucagaucucauuacggaugguaauggauuugaacucagguccuucagaagagcagucagugcucuuaaccgcugagccaucucuccagaccccguuguuuuuuuuuuguuuguuuguuuguuuuguuuuguuuuuuaaaagauuuauuuauugguuauauguaaguacacuguagcugucuuuagacacuccagaagagggagucagaucucguuacggaugguugugagucaccaugugguugcugggauuugaacuccggaccuuuggaagagcagucgggugcucuuucccacugagccaucucaccagcccccauuuuuuuuuuuuuuaaacacuuuauugcauagguggggagguaguucacuguguaaaaaugguuacugccaagccuguguucauuucacaagucccacauggugggaagagggaaagagaacagacucuaguaauuugaaaguuguucucuucugagccccacccacaauaaauauuacagacaaaaccgauugcaugcuugcucuucucucuuuuccccuuuccuuccuuucuuuguuucuuuuuuuggagacagugucucuaacccuuucugucuuggaacuuuguaggucaagcuggccuccaacucagucugcuucugcuuucugaguucugggaugugcacugccacuuuucuuuguucuuaagcuacuuguuauagauuacuuucugacaauuuuuagaaacuauggggaacaacauaaggugugcugucugcuuaggagacuuaggugccaccacgccuggaguggaaacauuuuuuaagugacuuuguauuaagcuaaacagucaauaauaaaucuguagauuguuuugucuaauuguacauauugucuuuguuuugauuuacaauuuuaaaaguagauuucuuuguguuguaauuuuauggguucugacaaaugcaauguauauacacaauugauuguaugaagucucaaguucuuccccuuucagaauauuaguaauugggauucugcagucugaccucuuuuguuuagcuagcaacauacuuuuagauucauguauuugugcuugagcacuucuuucaaugauugaacaagauuuuaguguauggaugaacaaguuuauuuuccuuucaccuguuggaaguauuuagaauuuuggguacagaucuuuggcuaagcucagagccuuucaaagugcugggccauggacuuuacugaugaacuguaaucccagguuuugcuuaguuucuaguuggguucucuuauguugaaguuuauuuuuuuguauguauaaagcaagcccauuacauguguguuuuguaaauauuuucuccuaguuuaugauuguccuucauuauuuuaacauccuuuucuuuuuuuaaagauuuauuuauguauaugagugcccuguuuuaaugcacaccagaagugggaaacagauuccacuauagauccugguugcugugcucuuaacugcugagccaacucuccgcccucaauaucuuauguuauuaauagaacagaaguaguguuauuuguuuuuguuuuuuguuuuguuuucuaaagcacacaccaaguuucuuuagauuuauuuuuacuuuuaauuaugcguauaugugcuuguaggagguuaugugcauaagugcauguguccgcaaaggccagacuuagaaguuauagauggguauaagcuucuugacaugggugcugggaacugaacuuggguccuggaagagcaggaagcacuuuuaacugcugaaccaucucuguaucucuucaaagauaagucugucagucuaucugucugucuauguguauuacagaauuuauaaggcauuuguaguucagcauuagaacaaacugguuuacauuguucaauauaguaaguugagcccuuuucauuuucuauuuuggacuugccuguaacauguaaaaaaaaauguucuuagcuaggcgugguggcgcacgccuuugaucccagcacuugggaggccgaggcagguggauuucugaguucgaggccagccuggucuagagugaguuccaggacagccagggcugcacagagaaacccugucucaaaaaaaaaaaaaaaaaaaaaauguucucaaccuuucuaaugcugcaauccuugaauacaguuucucauguggugauccccaaccauaaaauuacuuuccuugcuacuucauagcuguaguugugcugcuguuaggagucguaauguaaguaacugauaggcagaauuucucuuaugugagcccuggaagugguugugacccacagguugagaaccauugccuuaauguauguaguaucaguaauaggcuuguuuacuaagcuauuguuacagugaugaacaugcaugugcagguaccucuccaaaccggcuuuugguuauuuugguugugcaaccagagugaaguuguuggauuagcuguaugguagcugcuuuuccauagcauuuaggucauuuuauaauuccacucagguuguacaagggaacauuuacuauuguguauuguaucuggauuauauuuuuauuaaaaguuucauaagcuuuuguaucuugcuguguuuuuugguuuuuccgagacaggguuucucuguguagcccuggcuguccuggaacucacucuguagaccaggcuggcuucagaaauccaccugccucugccucccaagugcugggauuaaagacaugcaccaccaccgcccggcuucuugcuguguuuauaacaauaucaugaugaguuuugguagaaauugugggcuuauauugcuuugagaaggugagaaguguucaagaaaagaaagcaaguaggugaaaguaauaguguggccagagugaaaggugagugauagccacagugggagucgccaagaaagacucacaggaaaacacuuggcauuuggguauauuuugguguuuuuuauuuuguuuaaguuaggaucucacuuuuuuuuuuuuuuuuuuuuugcuuuuaugagcccagacuuauauaccagguagguguugcuuguuucuguuucccagguauuaaagguuaugcuaccaugccaggcucuuucgagcauuuucucucucucucucucuuucucucucucugcauuuguaguuuauugaaaagaaaaacauauuaacauagaauuaggggaagaguaagacacaacuaagacuggguauggacuucucaggauuucuccauuuucggaagucuuuuuaguaguguguuagaauaggaagaggaaaugaauaaugaacaugaauguguauaaagaggcagaaagucacugaagugaaugaggauuuuggggagaauacgcugcagagcagccugagggaaaggucugauugcuggccagaggagguacaggugcugcacauacaagcuuuuaugacaguguugaaguguaaagaaucucaucugcguguagggugacuucagagaggacagaaugucaauaaguguccuuauggugguaacagaaucaaagaucaggguugacugggugacuguguaagaaagagaagauugugccuugcugaagacauguuuauacuuguaguaggucaucuacuuguucuuucucagucucuugguucugcuuucucaagccucaccuacucccagcucacuuugugugucuuauauagcuuggcuuuuauuucaguagagcugugauccuuagaaagaggcccuaccugucacucaugaugggcuaguuuuauacacaagagaauuaagugcuuagaaguuuuaaaguacuagcgauuuaaaguagcuaguacucugcuuaauguuuuuguuguggaaucuuagaauacuaauuuaaaaauguguguaugccugagaacugaacaguaucaguaguguccauagugagucuuuaaugugaagugaacuguuauauuuguuauuucauuuuaauuuuuuaauuaguagucacuguaaauuagacgugaaagaacuuuuggacauuauguaacaguugggguuaaggagauauggcuggugcguaaaggugcuugccaccaaccugauaacuuaagucagagacucaagcaguagaaggaaagacuccuuaaaauugucuuuucacagcucguaggaagaggucacacauaauaaauaggugugauggaacuaauuaauuaaauacccuuggucuauguauuguuugauacugugugugagagaaguaaacaguguuuccuaugguuuagagauuuacucucuagccaaagacaacacugaacuuuugaucuccuaccugugcuuccugaggggguuuaugguguaacuuauuuuauuauuuuuugauagcacuucacaguucagacaggccuuuaauucaggguuuuccugucucagucacccaaguacuaacuaguacagguaugcaccagaauacucgguuuacaugguauacuuagauaugcuuuugaauguugcuuuuaagugacugaaucuaggaaaaucuuuucaucucccaggguucacuuucccuuuuguauagguugaaaaugcauuuguuguuguuguucugugauuugaaacccugauuaacaaggaacagacuaagguuagugguuuuauggaauuuaaaaugggaaacaguacauuucacauuccauucuuuauuuuucuuuuucuuuuuuugguuuuuugagacaggguuucucugugcaguccuggcucuccuggaacucacucuguagaccaggcuggccucgaacucagaaauccugugccuuccaaaugcugggauuacaggcaugcgccagcacugcccggcuucacauuccauucuuuuugcagauagaucauggaagggaagugguuacuguguuugcugcugguccuuggaacugcagcuguugaggcucaugauggacaugaugaugacgcgauugauauugaagaugaucuugaugauguuauugaagagguagaagauucaaaaucuaaaucagaugccagcacuccuccaucuccaaagguuugaagcagaucaguccuuuucuuuuugcuuuuaugagacaggguaucuuggcugucuuugaacucacuauguagaccaggcuaucuuggaacucaaagaucuaccugcugggcuagagaggugacucagcggguaagaguacugacugcucuuccagagguccuggguucaauucccagcaaccacaugauggcucacaaccaucuguacagcuauaguguacucauauacauaaaauaaauaaauaaaucuaaaaaaaaaaaaagaucuaccugcuuauaccuucugagugggggauuaaagguguauguaaccauucucagcuuaaaguagauccuuuuaucuuuugguuuaaaaaaagaaaaauuaagccagaggcuggggauauauaguuacuugccuauuucuuaggcacuccuccaccccaccccaaaaaggggauuguuuuuaaaggcaaagcagcuuuuaaaaaaaaauacuugcuaagcuuucugacaagucuuugguacauguggauugaauuuaagggcagcuaugaaagcuuugugacaauugaaaccaaauccugagaguaaauucuagagaauguuacuaaaugacccauuccugccaauacaacaagggucuucuguagcucuggaugccuugggauuugauuuccuugggauugcaggcuugugccacugugcuugguuaaaauauugcugcuuaauuaauuuuauguuuaacacaggucaccuacaaagcuccaguuccaacaggggagguuuauuuugcugacuccuuugacagagggucucugucaggguaaguguuucccugggaguaaagguuugagaggugaaugucuuguaaauaaaaguaguggaaaagcacuggacccuuuuuaagcaguauuggggcugaacauagugucauggaggggaggcaagugcucugcugcuagauauagccuuaaauagugggccccugggauagugugucuaacuguacaucuccucauacauggauguaucuuggaacuuggccucuuguugcuuuuauuuccguuuuucucuucuacccuagauuuuauucuuuggggauuucuuuucucuugagucuuguuacauaggguagauagaacaggagagugaauguauuuuaacucuggggccuucuuaauuacagguggauuuuaucuaaagccaaaaaagaugacacugaugaugaaauugccaaauaugauggugagaguuccauuuguucuagauacaguauaucaaaguggcaucuugucuccauuguaucucucuuuuuagaauacaauauguuuauuuuugagaauuucauacauucauaugauacauugaucacuaucaucuuuccccuacuccuaaccuaacucuucccauaucuaacuuuguucaccccuccuaacuuagaggccacugauugugauuuguguuguccaugugcucauacuggggauauccacuaaauccaugacaucucuuuuggauuaggucaagaagauguuuaaucaggagaauguauugcucuuccagagccaaauuuguuucccaguacccauaucagugcuucacaacuaccuguaacucaagcuguagacuuuagacacuuucuuuuggccuccaugggcagacacacauuuuuuuuaaaaaaccuauuuauuuuaaaaauaucuuuauuuuuaaaauuaaaauauaauuauauuguuuucuuuccucccuccaauccuucccauguacuccauugcucucuuucaaauucauuaucucuccuuauuacuauauuuucccuaagaauauaaauacaaucugcuccuuauauagcauuauuuucauguauaugauuucagggcugaccacuugagaaccaauuugggggcuuuuccuugggaaggcuuucuucuacucucagcauuccuuaauugcuuguaguacuuugucugaaguugagccccuaugagauucccucuuucaaauuagcuugucuguuggugucuuccuuguuguggucuuguuuaggcugccauguugaugagacuucaugagacagggucucacuguguccuuggcuggccuaaaacuugcuauguagaccaggcauaucuggacuuugccucacaauacugcaaguaaaggcuugugcaguugugcacaucugagagauagguaaucuguugcuuguuuuuagagauaggguuucuuucuaauccugguuguauuggaacacuguagagcucuuguucugugugcuauccucaaacucagagaucuuccugccuuugccucuggagugcugggauuaaaggcuugugccgccauaccuugcugaaaaauaaguauucuaaaaagauauuuugagauuuuuuucuuggaaauuauaucaucuuuguauauggggcuuuuuaaagugugauagaauaagaacucuuaauauccauguuggaaaugaaaguuuuucuuuagguauaacaaauaggccacuguuauuuucaagccaugucuuaccauauaaaagauauauuaacucagcucauauguaaauguaaugguaaacaucgauuauuuugacacuuacacaacucagaauuuaguucguuaccauuuaaaagacuuuaaaucauguggcuaacagucaagagccauuuuguauucuuuuguaggaaagugggaaguagaugagaugaaggaaacaaagcuuccaggggauaaaggacuuguacugaugucucgggccaagcaucaugccaucucugcuaaacugaauaagcccuuccuguuugauaccaagccucucauuguucaguaaguucagugccaucuugauaauuuucuagaaaggguaaucucaggugacaguaugaaaguugaacauucuaaaaaaucauguuuauaguaggaauuuugugugaauuggaauauguugagugguuuuguuuuuaucuucuuguaaaacagucugguuguuuaccuucuuagaagcaaacaaaugucuggcuuuugcauuaaggauuacuuuuauuuuguuuuuuugauuuuuguguggccgaguggccacauaaaagcaguagacaauggaaccuuuuguguggguaugacaucugauaaaacaugaccaagcugggagaaaucaauuaggaaauauaggaaauaugaucuuucaaaaugccauaggacuuuuucuuuucucucugaaacuagguaugagguuaauuuucagaauggaauagaaugugguggugccuaugugaagcugcuuuccaagacggcagagcucagccugguaggcucucucuuuguguaacaugugcuuuaugaucuugagcuugggggguaugcaguucagugguagaguacauggcugccauucacagggcccuggguuuaguccccaucauuuaaagagagaaaaguuugcaagaccuaugaaaagaaaugcugcugcuggugaaccauggagacuuggcacuaauggccuuuuaacuuuaacaggggacuguagaagccuuagcuguauuucauugcugcuuucuuaacuguggaauuuuuagguuuuuuauuguuuuguuuuguauuuuuacacaggauaucauuggguggguaucccuugcugcauggaguuugcuguguagaccagggaggccucaccugugugcuaacaauuuuuaguuuucucaaguuuauuucuuguuuuugaaagaaguuuguauguacauaacuucucuuuaaaaaagcauuuuaguauuucuggugguugccaguuauuuuugauugguaucugaagaagcacuauaaaaucauaagguuuucuuuaaagcuaauagaauaauuugcaugcaguuuuaugagaggaaguauguguuuuucaaaguuugcucuuugaauucuuugacuagaguuacuuaaagcacuccaccuuugucucugaaggaucaauuccacgacaagacucccuauacuauuauguuugguccagauaaguguggagaggacuacaaacugcauuucaucuuucgacacaaaaaucccaagacagguguauaugaagaaaaacaugcuaagaggccagaugcagaucugaagaccuauuucacugacaagaaaacgcaucuuuauacauuaaguaagaaaaacccgcuguuuggggguuuaaaacauuacauaguuagcaucuaguucauguuaagauuguauacuuaaaagccguucuuuaugaagaaucuuuuuaaaaagaccccauguacugucuuccaaugaauguggguaacagacuaugcuccagcuucucuaggaaacuacuaaacugccuauggaucaaagcagaauuugaugaagaggagaaaacuuaugauaacugaaacagccccauacccuguguguaaauuaacaucuuccuagccgggugguggaggugcacgccuuuaaucccagcacuugggaggcagggcagaggcaggcagauuucugaguucgaggccagccuuccaggaacagccagggcuauacagagaaacccugucucaaaaaaccaaaaaaaaaaaaauuucuuccguggccacaggcuuacuacagaaagagaacaugcacuaaugccaggaacauuaaagaccauauuaagagcccagacuuaguaugcugagaaggaaacagaucaguuuuagagagaucccuucauagguuuuauccagacugugggaguguuaacacuacaaggccauauauuaauaggucuaccucuuagaauggaaaauuucacuugcaccuaaaauugcacuaggacuucuaaugacugagaacuucguagauuguuaaauaaaaaaaauuaugauucgaugccccaguguaggggaaugccagggugggaagauaggaguggauugguggguaggggagcacccucauaaagacagggggagggggggaugggauaguggguuuaauauacuuuuuucaauacuuaauaccugugggucagguaguguuuuuuuuuuuuuucuuuauauauauauauauagcuuguggccaguaaccauuugaaguucaaaauugcagagcagacuaucuucugucccuuuacauagcaauaggaguggaaauuuguucacuauauaaacagauuaauaacguuuucauaauaugaagguuuuuguuuuugagacauggcuuuuuacguagccauggcuguccuggaacuugcucuguagaccaggcucaaauucagagaucuuccugccucugccuccugagugcuggaucaaaggcguguguguguguguguguguguguguguguguguguguguguguguguguguguguguauaugucugugugcuacuuggaugccuggugcugagaugccagaagaguauauugguccccuggagguagaauguuaauguaggugcugggaauugagcugggucuuguggaagaaucgcugcuguucuuaacuacugagccgcuucucuagauccuaucaaugugguuugugggcaauuguauggaagucagaggacaacuuugaagauguuucucuccuacccuaaugucuugggcucuaacucagaacauugggauuguguggcagauaccuuuaucugcugcugugguguuucaccaauuagcauuuaaaauuaauauuuugagaggggggucucauuauguaggccugucuguccuggaacuuuguaugcagucagacuguucucaagcuuagaucugccugccucugcugcccaagugcugagauuaaacgcaugugccauuacacagaaugcuuuuuuuuuucugcauaccccguacucuugccuuaaacuccuguauagcugagaguaaaauugaugacccuccuaucacuguagugcugagaucacaggagugugucaccauacccugaagguuguuuuuuuuuuuuuguuuuuguuuuuuuuuuaagguuuuuugagacaguuuuuuuguguagcccuggcuguccuggaacucacucugcagaccaggccggccuuaaacucagaaauccgccugccucugccucccaagugcugggauuaaaggcgugcgccaucacuccccggcuacccugaagguuuuuauuguuguuuugagauggggucuuguuguacaugaccucaaacuaguauugccuaguaagugcugguauuagagguaugggcuacuauauuuugccuguguauguguguguguguguguguguguguguaucauguguaugucugcauuugccagaagagcgcauuuacucuccuggaacugaaauuagaggugguugugagccaccaugugggugguaggaauugagccugggucuauuggaagagcaaccaguguucuuaaccgaugagcaaucucucaugccccuuauuuauuuuuaauuauuauguaggguauuuuuccuccauccacauccauaugugugcuuggugcccauacuugccagaaaaaguugucaaauccuuugcaacuaaaguuauugaagauugugaguagccauuuagauccuggaauuaaaccuucauacucuggaagagcaguuagaacucuugaccacugagccauuaauucagcuccuuuaaauauuuucauaaagaugguccaugguaaaagugcuuguacaguguguacaagacccuagguuugaucuccagauuggagaaaauaauagcuuacuaaaauuuaucauuucaauuuguacagcagguagaucucugugaguucaaggcuagccugauguauaaagaaagcuucaagacagcuggggcaagacagaaaagaaacccugucuggauaaaaccaagaaaagaaagaaagaaagaaagaaagaaagaaauuacucauuucuaauuucuaggaacucaaggaaauggcauugaggccccaggcucuuaaagaacuaggcuuuguugacuaugacagucuaauuccaguaccuugaucucuuuuucaugacuauacacugggucuuccucuagaaggcaugaucuguuguguuagauugaugggaauguuggaaugagugguuuagucaguauuuuaauugcauuuucuuucuuuucagucuugaauccagacaauaguuuugaaauauuaguugaccagucuguugugaacaguggaaaucugcuaaaugacaugacuccuccuguaaacccuucacgugaaauugaagacccagaagaccggaagccugaagauugggaugaaaggcccaaaauagcagauccagaugcugucaagccagaugacugguaaaucuuggagauccaucuuugaguauuagcuuacauuuauauauucuacauagcuuaaacaacaaauguugauugagaucugauuauguaaauacucugugauacaugccuaggcacguuggaacaugccuauaauucuagcacucaagaggccaaggcagaaagauggagugugaggccagugugggcuuacauaguaagacccuaugcuugcuugcaagaaaaaaaaaagggggacuuaaguuccaauuacucuggaaaaaaaaaaaacccaauaguaguaaaauauauuaucccucacuauguuauaaacuauaggaugcuaaagcuuuuguaguuugucugcugacaaucuuuuuguacagccauucuagugcuucauuauuacaaguuaaauuggguuacagugcuaaggguuuaacccaaguccuccugcauacuaaacaugugcuguauugcuaaauacuccuccuauccauauuuaaagcuauuaaaguucugaaauuuuugguguuuugagacaguuucucuguguagcuuugacugucuuugaacuaggcuggccuugaacucacagaucuaucugcuucugccuccugaggguugggauuaaaagcauguaccaccaugcccagcuaaucaccuuuuuaaaaauaggaugaagagaguuuuaagcuuuaaaagaucgggcaaaaguuacauaaaacuuugaggucaucccagaguuaauuuaaaacuaagauaguuacaaaacagucucuguugagggaggcauuucucagugguaguggacaugaggccuugaguucagugccaaggcaaaacuaaacauuaaacuugagcacagggagauuuuuuuuuuuuuuuuuugguuuuuugcgagacaggguuucucuguauagcccuggcuauccuggaacucacuuuguagaccaggcuggccucgaacucagaaauucgccugccucugccucccgagugcugggauuaaaggcgugcgccaccacgcccggccuacagggagauuuuugauuaccagcugaaguaguacuuugacagugucugcaugacaaucuugucccuguacuguuuguuccugguucuugaggaggccagcggaagaaacuugagcuauauagaugguuguaaccugccaugcuaguagacacuggaacuguggucaucugaaagagcagcaagugcucuuacccaccuugccaucuuucuagcucccuugagucuuauuuuagaugagauuuucuuuguguguaugugugucuuuuuaaaagacuuuuucuaugccauccagguuauucucaaauucaggauucugucucagccuuaacagugcugaauuuacuguauaccacaaugaccaucuuuuuuuuuuuuuuuuuuuuugucucuuugagacaggguuucucuguguggcccuggcugucuuggaacucacuguguagaucaggcuggccucgaacucagaaauccgccugccucugccucuguguugggauuaaaggcguguagccaccaccgcccagcucuaccauaaccaucuugagaguacuuuuuuuugguguauaaaacagagaugguuaauguauauguaucugcagugcuauauauacacuacuaucuaauuguaggauuuuuuuuuuauauauaauguacccuacugucagucccuuguccccaaauucuggcaaccacuaaccggccuguuuuuuauuucuggauuuguccauuuggaaaauuuuauggaaaugacauugaauuauaauauguggccuuuggcauaugacuucuucuuaucaacauaaauuuuuucaacauccaaccauauugaaacauggauaagcacuucauuucuuuuuaugacugagaaauacuucaucauaucagugaaugauauacuaugcuuauccacuuaaccauuauguaauugauagauguguagguuguugccuuuuagauguacugguuuuuguguguguuuuuguuuuucucagauacaaacuuaggaaugaaauugucauacaguaacuuccaauuuugaggaauugccccugcuuuuuuucaccagcacuuuuuucccucagaauuucuuauuguaauagccuuucuauguggaugugugauaguggaauauuaccaugguuuuaguuucucugaugaccagugaaguuaagcaucuucccuuauaacucuugaugauucccguaguuccauuagaaaaauguuuaguugaucuuuagcugcuguucuuaguuaaguucuuuucuuuucuuucucucucucucucucuuuuuuugguauauguggugguggggagaguagccuagauaaugauuuauaaauguuuucuagaaugaauuaaucuggguuuguagaagagacuaccuugacugauucucuggccuguguugccaucccugguguuuucuguuuaagggaugaagacgccccuucuaagaucccagaugaagaggccaccaagccugaaggcuggcuagacgacgaaccugaguauauuccagacccugaugcagagaagccagaggauuggugaguuugagguugcuuuugucauuaccugguuuuuguuuuaaaaauuuauuuuuaugugcuuugguguuuugccuuaauguuugucuaugugucaacucacuuggauuuggaagagaagccaguguucuuaacugcuaaacugccccaauuaaaaucaagcauuuaaucccagcagaggcaggcagaucucugagauugaggccaaccuggucuacaaagugaguucugggacagccaaagcuguuacacagagaaauucugucuugggcaaaccaaaaucaaucaaucaaucaaucaaucaaucaaucaaucaaagcaauagcuaugugccccucucccccaacaacaacaacaacaaaaaagaagcaaaaggggaaaaaaaaaagcuggguauaguaguacaugccuucaucucagcacucagaggcggguggaucacugaguucuaggacagccagggcuaccagagaaacccugucugaaaaccuaaagggaaaaauaaaaagccaacugcccaaguuugagugaaaaaccuuacaaacuuuacuaaauuucauuggguaaaaacaaaguagguaguuuaugagagugcauugauaguggaaaugagaaaugagauaucguucugucauaugcugcugguauagcuccagaaacauguugagagcauaagacuaguuguuuguuuauaccuccacagggaugaggauauggacggagaaugggaggcuccucagauugccaaccccaagugugagucagccccuggguguggugucuggcagcgaccuaugauugacaaccccaauuauaagggcaaauggaagccuccaaugauugacaacccuaacuaccagguuugugucuccugaugguuuaaguguuuuuauuaauuuguucgugucugggcaaaagcuugaucaauaguaaggccagcaaaucaaaaagagaaaguaaacuuaagagacaggugaauauugggcuaaacauaaaaccuaaaaaacaggaaagaggaguguucgaacuugcuaugugacuaucuuaguuuggguuuccauugcuaugaagagaaacaccaugacuaagacaacucuuagaaaggaaaguaauuaaggcuggcuuacaguuuuagagguugauuccauugucauuauauugggaagcauggcagccugcaggcagcagaaggggacucugccauauugggcagaguuugagcauacaagaacucaaagccugccccaacagugacauacuuccuccaauaaggccacaccuaauagugugacuccccaugguccaagcauugaaacacaugagucuauggagcccauuucucuucaaaccaucauagugagcuauaucuaaaaauaaaaguaggguagaagaacuuaggguguggauacccuauuguugagugcauagauuggcuauaagggaacugugaugggaauuggaucuugccaagucagcuaauugcuuggucucaucaguuuucugccaaagauagguagguacauaugaagcgguaguaauauguauagugaagcuaugaagcuccacuuguguucugggaagguaccaauguagauccuuccuggcuucaguuucuaaaccaaaaaacuauagucauaaauuuucgcuuacacuuuuagauguauggugcaucuaucuauauguauauauuuuguuugcuuuucuguuguaaaauguuuuuaguuguccauuuagauaacugaucaaacaaaaauuauacuuuagcuugccauuugacuaucugaauaugucuuuguuacaugcuugucauucuagcacuugguuaucugcaugaggaccaggaguugaaaugucaacuucagcuauaacuaagaagaucagggauagguuaaggcuauccuggguguaugaaucccuguugaaccaagccaaaccaaaccaaacauuuagcuauucgguuggccaccaccaauuguguuuuguugaggauuaguauugagacugaauccagugucucaugcauauuagguguaagugcuguguuucuggccuacaucccuagcccauuuuuuaaaaucacuucuggggaaugggaaauggcuuuacugacuacauuccaccaucacuuguugaggguggagugagcuacgcaggaccagguguugguucagaauaagauccugcagauuggagacugaauuugguagaagucaagaauucaguauaaaaacauuacuagcauuuauuguucugugcuuguuuaaauuuggcaguuaauguuuaucuucuuugaucauauaaaaugagucuuacauagauuuucuuuuuuuguuauuaucugaaaugauguuuugaaacuucuuuugucucugccucacccccaaccuacuccccucuccaaaucacaaacuagggaaucuggaaaccaaggaaaauaccaaauccagauuucuuugaagaccuagaaccuuuuaagaugacuccuuucagugcuauugguuuggagcucugguccaugacauccgacaucuuuuuugacaacuuuaucauuaguggugaccgaagaguaguugaugauugggccaaugauggguggggccugaagaaagcugcugauggggcugcugagguuagugauuguucauuaauuguggauuuauauccacuuuugggggagacugauuacuuuauaaaaagcagauuuuuaguguuuaucuuuuuacuuauucagugucaaaauauauaauuguuagacuccuauucuggcuuuccaauccuguuauauguauguguauauuuguaucuguuuaucauuuuauuuuauuuuauuuugucuucaagacaguuuuucuguguagcccuagcugucuuagaacuugcucuguagacugggagggcucaaacucacagggaccuaccugccucugccuccaguguuucaauuaaaguuauguguuauugcaccuggcuuaaguauguuuuaaugcacugaaaaugcugaaucuugguuggaauuguguggaauuuucaaauaacuaaugguguuguugaguugcgauuuggauggccagaaaacuggcagaaagauaauucuucuguuuccugaguaaggaacuuuuugcaguuauuacaagccacaguuugcaccuaugcaggugaaacuucaugaugauaaaagcaguaaagcgggggauuuuuuuuucccccuaauuucuauuuuuuguuuuguuuucuuuuaacuugguuuuucgagacaagguuccucugugucucccuagcuguccuggaauucacucuguagaccaggcuggccuugaacucagaaauccgccugucuccuaagugcuggguuuaaaggugugcgucacccaccacugcucggcuuuuccuaauuucuuaaugugcauaguuugacuccuuuggaaauaaaggaguuaguuguaugaauaugaagcaaucagucgagucuguauuuggugucauaaaccaguucucugaauuacuguuguuugguauuucagccagguguagugcugcagaugcuggaggcagcugaagagcguccauggcuuuggguggucuacauuuugacuguagcuuugccaguguuccuugugauccucuucugcuguucuggaaagguaggaaugucuaacuaaauaauuguauccacugagauuuucuuuagugguaguucuguaaauacugggccguguuuuacaggggcucuuuguacccaaaugaugacaggauuuagagucccuuaauugucauuucacucuauucuucuccuuuauauggagugagccugucuaggggaaaaagaacaauggcuauaagauuacccaucuaggcacaaacuaguuuuccucauuauuucuauucuuauuuaucuaugacuccuucccugccuacacucucucaaacaaaacauccucaaacugugcuuuuagguucuacagccucaguguuuuucuuauucagaccuuguuucaugcugucuccacuaacuuaggauucuauuuaaauuauuuacacuuugucagauccaaaguugucuuucuagcuuuacccucacuacucacuguuggagucuaugagucagcuugucaagcuuagccugugccuccugaccaaguccuagugcuuguucugguuuucaugauaccccucccccuuaacuucccucucaaucucccucccauggggcaaauguguagaguuagaacaaugucuuucacaugucugcauaacugcccucuacacaaccuuggauagaauuuugccuguaaacauucaggaauugagggguaauauauuuguuacaacauaaucauggcuccuacacuuggcaauauuucagaaacaguccaaugcuauggaguacaagaagacggaugcuccccagccagaugugaaggaugaagaagggaaggaagaagagaagaacaagagggaugaagaggaagaagaggagaagcuuggugagcggagucuagaaaccugucauaaacccugacuaacaaaacaagcuauaguagauuguucuuaaaugaugauauaauuauugucagaacuuuuaugugaagaucuguucaguagauuuauuuucugucuuagaagagaaacagaagagugaugcugaagaagaugguguuacuggcagucaagaugaggaagauagcaagccuaaagcagagguaagggagggauaauaaauacuucaggcaacaaagcugacagcguaaacaguccugugacacuuauaucuccucacuguccccucaaagguauuucuugaauaccacugcauuuuaaacuauuuuugguuuuucaagacagggcuucucuguguagcccaucguggccuggaacucagaggucugcaugccuuugccucccaaacuuuuugagacaggcuuucauguagucuacacuauccuuucauucuguguagucaaggguaauauuuauugauccuguaaucuuucugccuccauuccuaguaugugcucauacagguaugugcucuacccuauuuuauguggugcugugggugcucccaagagcaccuggauucaauucucaguacacauaugauggcccacagcuaucuguaauuccaaucccugggguucugaugcccucuucuggcucugagcucaucaggcaugcacaggguagagauacagauccaggcaaaugcaaauuaaauaaaaguaaaauccuccaccacaguuuuuaaaaaguuaauagguuuagggaaaguacauguuuucugaaaagaaagacuaaaaucgaauaccuauaauuccaguaccuuuccaccaauugaaugacuuaguuuaaaugguuguggaauuuggcaacauuuguuuuuuuaaauacacuaacuuuuaugacuucucuuuucaacuaauaggaggaugaaauuuugaacagaucgccaagaaacagaaagccacgaagagagugaaacaaucuuuaagaacuugaucugugauuuccucucccuccccuuccccugcaaaugugguccuaggagagggccugguguaccuuaggugggagcucaaaaccucaagaugucaccaucaacagguuccagugaauacuagccuguaauuuuaaacaucuagcaguaaauaauugcaguuguaauguaaaggacccuguuucuguagaaaggaaaacauuuaacauaaugguugugaaauguaacaugaagcaacuaacuaguguuuuguuguuuuuaaaauuuuccagguuugucuuuuuuuuuuuccuuuuccuuuuuuuuuuuuuuuuagauacaaugauagaauuuuugccaguuuaaaaucuuggcuuaauuuaauauauucauuuguucaugcagaaauaacaccaacauuaggaaugcuagggagaaugaauugccguuuuuauaauaacuuuuuuaaguuugguauuaaagcauucaugugucuguccuaaaauuguaaucacguucaagugcaguuauuugugguuauaaaucuuguuuugugugcuuccauuaguuaauuccucuuaaagacacaagagcgauuggauggaagcccaaauuuauaucaaaguucccuuuacauuguauugaauagacccaaaaagaacuaaaaggagacuuugacuuggucauuucacaucagaucauaaagugcaguguucuguugcccuagagacugcuccauucacaagcaccuuugaagagggaaggagcuggcuucauguagcaguucauacuguacuucccacauaggaggucugacagcucggguccucuggagcacaaggcuuuuuaaggaaugcugguggugccuggguagauaauuacaucacuuguuccacuguguugacacuguuuuccucauggaucuccuccauuccuagcuuucucugcuaugcauuuucuucacagcgcagcuugcgguccguugcugaaaauuauaagcucugcauaguguuggcuuuacugugaugacauguuucuucuuuuuuagcuggcccacaccuuucuaggguccaacuacaggauagauuacagacuuuccauuagugucuauuucuuuuacucuguguagacuuuagaaagucuaaucaauccagagaugggccaauucagaauugacuauaauugaacaccugcuaaaaguauuuaugggaggauugacacacagcaugaguuauuugacuuuuguaggauauuuaaaaucuucauuugcaguucauguaacaguugugucuuaaaauucacauaauaaagcaguccuguucaaaaaaaaaauuuuuuuuuuguggcuuguagaauuuuuuaaaaguguauuuagggcuuuuuguuuuuuguuuguuuuuuuguuuuguuuuucauguggaaugcagaugggugcuagaggagccucucccacaucacuauaguguaauauuauuacaccacacugaaauguauucagaaacagauguuucaauuucauucuuucuccagaggugguccaguuguaccaaugauacuauuccuugcacugaauauauauaaacacucuucaguguuuauauuggggaaauacugggaaagaaauauauuuguuaaggaugaaggcuguaucuguugucuuuauaaacacugguucauuucuuuugaggguggaaugcauuuuucuuccuguucagugcuuuaucaccaucuguuguuuguggucacagugaccauagcuauguagcggacguuuccaaauguauagagugaaauaaacaguuacuagcaagaaaugaauacaugucugcagguuucuccuugaagcaaacauggggaugauugcuuuucuagaaaucgguuuaucuguuucaucauucuacauugacauuguuuugugccuacuuuauauucacccaggcuguacaaugacagguuuauuuaugucacuggugguggucauugccuuuuugggucccucuuccucccucaagguuccauugaagcuccagccuccuuaaauaccugacucguuaguaaaugaucagcagucuucagcucuuaaaaaaagcguagagggcagguauuguagcugaguagguagaacugcuaagcgugugcaagguuccgugggucugauuccuggcacugaauuaagauagauaaaggcccuuauauucugauuuucuaugcuggacuccuuguuguaaaauguccaugccaguaguacucuucuauuguccacuuuucagauugucacacugcuaaaugacauuauauuaaagcccguguuaaauaucuguaucauaacacugaauguuuuuacuguuugaauaaugguuaauuuagucuuuucucauaggagaccuuaauuuaguuuuguauuuaagugaugguuuagucauuaccauuguguaaaauggaccucagcccaaaaacuuuuucauugcuggcauuugaaccagugcucuaccacugagcuacacccuguccuccuagauacuauucuuuaggaua

SEQ ID NO: 5973 - RNA, 2899 nt, Mus musculus
cagaggauaggauaagugugguaaccaguaguauagggcucugaucaaucagagaagaaagcccaccuagagcuguuggugggcuuuagccauggcugccagugugacauauagcuucccuacaagccgagccuugucauagguugcacuuccagauaccucuguuuccuguccucagaauccuuuaaguuguggggcugaggucacccaggaauuucaggucuagcuccaccuggcuccaaccacagguuuccguuuuaacuacuaacuaccuggugcaguuucaaaaccuggugcucaaaaugugugcgguguuuugaucucugcugagcaggggcugugcaucuaucuaguucuuuccaggaaauugaugagauucuguaauggggggauucgagggcaguucugaacaagagccauugggucaaaggcggcaaggaccacuucucucuucuccacuucaccauggccuuacuugcugccccuacccauggcugugguagaagagucgcacuauucuucucugauagccugggcuaaaagacccagugaggaagaaugauggagucauccacucugcugggaugacccaacaugugguccaagaaccaggacucucucuuuccuagagucccaguucugccaccauggugguagauugccaggcuguggggccucagguuccgagaauggguuuugccuauggucugaccuugccccugcccaccuccaaccuuuagauguucuagaacguggcaaucuggucugcaaucugacguacagggugggaggugggagccccacuuuaccuuuuucuuuagaagcucagaugacuuuuguuugggguagaaugguguuuggugaguauauuagucaggguccucuagagucacaggacuuauggauagucucuauauaguaaaggaauuuauugaugacuuacagucuguaguccaauucccaacaaugguucaguagugaauggaaguccaaggaucuagcaguugcucaguuccacauggcaaguaggccaaagagcgagagaggcaacucccuuauuccaauguccuuauauggccuccagcagaagguguagcccagauuaaaggugugugccaccacaccuuuaaucccaaugaccuugaacucagagaucccgcugucuuaaucuucuggagugcauagccacuaugccucaagaucuccauaccaagauccaggucagaaacuucuaucuucuagccuccagauaagggucacuggugagccuuccaauucuggauuguaguucauuccagauauagucaaguugacaaccaggaauagacacuacagugagccagauaugaaugggaggaaaaugggagggaggaagggaagggugacaggaggguggugggcaaaggcguauuugcuggcauuuugugagcaugcuacuccagugccccacaccuuaguaagaccuaagggcauguuagugcucuagcugggcccagccuggccagaauucuaaggcuucuccucuguguccucaucaacuguagaucuaagauucaucuuccuuauugacauuccccagcccuucgcagaauuuagggugcugagacuuggguugacaccauuguggcugcuccuccauuaaauuuugaggugcucuguaugcuugugugaacuugugugugugugugugugugugugcgcgcgcgcgcgcuggggagaggugucugugugaaugaucuauggaaagaagucagagcauagacaccagauaaagauggugcuuaaccuuccucccagaagguagccagacccucuuaccauccauuccucugcccccacccgacccugcacugcuccagcucccaaagaaccaaacugggaaaugucccuuuacuaccccuccugguaugugguugagagcaauucuguucuccuucccccuuguaagcugggagugaaucccauggcuggcccgcauuuguugaauccaggucagcaggguuuacuccugggcuaaagaacugaguacuucuuguuugagucugugguagaauguagaggaaauguucuggacuaguacuaguugggaugacugaguuuacccauucuaagggcugugggauaguaacacuccauugucagauccuagcaaaucacagaagccccacaugggacagccccagcaagacagccuugagggagacaacauccuuggugcguugggccauguaccgcgaggccucuccagaguuaguggugcucauacacguguggcuaaggaacacaguguccacugggcucagagaagcugcgcaugcccgagcaugggaggaugguuuggagaaugcuuggaaacaacccucagcuucccaugaagcucuuauuucugggguguuccucagaggcagguagguguccucugaaggcagguagguguccuuugaaggcagguagguguccucugaaggcagguagguguccucugaagguuuccggcacgacguagucacccagacuguccugcaucacccagaaaaauaugaggcaccugggagucguucuucauucccagggaggucaggccacauuuaaagaggcccuuucggaaaccccguggaaucuuguauauaagccucucauuuguauuuuacaaguuuucuuucuuggucuguuuuaaguauauaaauggugcuuaguaccaauguuggucugagguaacauucugacucuauuuacuccugugugacacguggcugccaagugggggccaaacacggugcucaacuuaaaucacagaauuuuaucugacaacagccaucgaugcauuuucguucuguauagcaaaaacugacuccuuauuuucguaacuuauuaaagugucugugguuuugcaaaucau

SEQ ID NO: 5974 - RNA, 2899 nt, Mus musculus
augauuugcaaaaccacagacacuuuaauaaguuacgaaaauaaggagucaguuuuugcuauacagaacgaaaaugcaucgauggcuguugucagauaaaauucugugauuuaaguugagcaccguguuuggcccccacuuggcagccacgugucacacaggaguaaauagagucagaauguuaccucagaccaacauugguacuaagcaccauuuauauacuuaaaacagaccaagaaagaaaacuuguaaaauacaaaugagaggcuuauauacaagauuccacgggguuuccgaaagggccucuuuaaauguggccugaccucccugggaaugaagaacgacucccaggugccucauauuuuucugggugaugcaggacagucugggugacuacgucgugccggaaaccuucagaggacaccuaccugccuucagaggacaccuaccugccuucaaaggacaccuaccugccuucagaggacaccuaccugccucugaggaacaccccagaaauaagagcuucaugggaagcugaggguuguuuccaagcauucuccaaaccauccucccaugcucgggcaugcgcagcuucucugagcccaguggacacuguguuccuuagccacacguguaugagcaccacuaacucuggagaggccucgcgguacauggcccaacgcaccaaggauguugucucccucaaggcugucuugcuggggcugucccauguggggcuucugugauuugcuaggaucugacaauggaguguuacuaucccacagcccuuagaauggguaaacucagucaucccaacuaguacuaguccagaacauuuccucuacauucuaccacagacucaaacaagaaguacucaguucuuuagcccaggaguaaacccugcugaccuggauucaacaaaugcgggccagccaugggauucacucccagcuuacaagggggaaggagaacagaauugcucucaaccacauaccaggagggguaguaaagggacauuucccaguuugguucuuugggagcuggagcagugcagggucgggugggggcagaggaauggaugguaagagggucuggcuaccuucugggaggaagguuaagcaccaucuuuaucuggugucuaugcucugacuucuuuccauagaucauucacacagacaccucuccccagcgcgcgcgcgcgcacacacacacacacacacacacaaguucacacaagcauacagagcaccucaaaauuuaauggaggagcagccacaauggugucaacccaagucucagcacccuaaauucugcgaagggcuggggaaugucaauaaggaagaugaaucuuagaucuacaguugaugaggacacagaggagaagccuuagaauucuggccaggcugggcccagcuagagcacuaacaugcccuuaggucuuacuaagguguggggcacuggaguagcaugcucacaaaaugccagcaaauacgccuuugcccaccacccuccugucacccuucccuuccucccucccauuuuccucccauucauaucuggcucacuguagugucuauuccugguugucaacuugacuauaucuggaaugaacuacaauccagaauuggaaggcucaccagugacccuuaucuggaggcuagaagauagaaguuucugaccuggaucuugguauggagaucuugaggcauaguggcuaugcacuccagaagauuaagacagcgggaucucugaguucaaggucauugggauuaaaggugugguggcacacaccuuuaaucugggcuacaccuucugcuggaggccauauaaggacauuggaauaagggaguugccucucucgcucuuuggccuacuugccauguggaacugagcaacugcuagauccuuggacuuccauucacuacugaaccauuguugggaauuggacuacagacuguaagucaucaauaaauuccuuuacuauauagagacuauccauaaguccugugacucuagaggacccugacuaauauacucaccaaacaccauucuaccccaaacaaaagucaucugagcuucuaaagaaaaagguaaaguggggcucccaccucccacccuguacgucagauugcagaccagauugccacguucuagaacaucuaaagguuggaggugggcaggggcaaggucagaccauaggcaaaacccauucucggaaccugaggccccacagccuggcaaucuaccaccaugguggcagaacugggacucuaggaaagagagaguccugguucuuggaccacauguugggucaucccagcagaguggaugacuccaucauucuuccucacugggucuuuuagcccaggcuaucagagaagaauagugcgacucuucuaccacagccauggguaggggcagcaaguaaggccauggugaaguggagaagagagaagugguccuugccgccuuugacccaauggcucuuguucagaacugcccucgaauccccccauuacagaaucucaucaauuuccuggaaagaacuagauagaugcacagccccugcucagcagagaucaaaacaccgcacacauuuugagcaccagguuuugaaacugcaccagguaguuaguaguuaaaacggaaaccugugguuggagccagguggagcuagaccugaaauuccugggugaccucagccccacaacuuaaaggauucugaggacaggaaacagagguaucuggaagugcaaccuaugacaaggcucggcuuguagggaagcuauaugucacacuggcagccauggcuaaagcccaccaacagcucuaggugggcuuucuucucugauugaucagagcccuauacuacugguuaccacacuuauccuauccucug

SEQ ID NO: 5975 - RNA, 17477 nt, Mus musculus
uggucuugugggaaauguagucccgcgcgcccagugcggcugccugugccgccagccucuggcuucuucagugacuguggugagugcgcuuccucgggcgggugguccacgggcggggaggcggaggcguucccacugggagcccggggcucuggugccaaaagagcagagccggccagacagaaaggugauccuucguccgcaaggagcacgaagucgcaggugcgcagcucacgcgcgcgccaggccgcaggacacccuaaccgagaccccccagcucgguauccccccguaccccggggucauucgcgcccgacugcucuccagcucuaccuggccgagcagcucugguucgguaugcacuaugaaugcgugguagacccgcucucugaagcuuggcagggcacgggaccacaguccggggcucuggccauugugugcaccgcugcuggggacccgcccucugccugcgaaggaggagcuuguaaaaugaguccugaauaagcaagaacgugcccacccuuucuuuaaguucauuauuggucaacuagaaaaauguacgagcgaaaucauucgaaauuuguccuaaaguccauguauuguguuauauguauaaauagaaaccuuuugcuuccaaaaaaaaaaaaaaagauguuagugccuuuccuccauucaccuuuaaaaauggaguuacaaaaggcauuuuguaagaugcuugaagugcaucuaaaccaccacccaauggagaugagaauagccuuaagacacuaauuuuuaagagcaguuaaagcugucauuuucacgaaugguucccuuuggacuuuugggcuuuuuuguuuuuguuguguuuuguuuuuauuuuaauauuggacaugguacaguuaugucauucuuuguauugccucuuuccacaaaaccuuguagugaaauuucuaggucaacguuauaauuagaccuuugggcaucuccugucuuauucuuuccagaaaaguagcaguuucuaaagaugguugcgguguuaagagugacugacgccccacaucaacuggaagugcugcuaguagccucuuaagcuuuggagaggugcaagcuaggugugguagugugugccuugaaucccacagaggcagggggaugaguuugaggccaccugcuccacagagucugggccagccaaggcuacuuagugagaagacccuccuucaaauaauauccuuaugcuaaacuccagcccauuuuauuccuaacuuuugcaucuguuguacaaacagaugaaucuacagaaaaguugcauauugcuauagucauauaaaccuacauuucacuuguauguaucuauggcugcauguaugcauggguacaggugcacauauagccacauucaggugaagaccugaggucagggccgagaagcauccuccaucuuccuccaagcccucgggcauuucauccuccugcuugcuuucugguccucaugcuugcccagugcugagccauuccccagggccagcucccuccuccuccaccuccaccauguuuaccauaauuagagaggccuucuguuucacugcaucacaaagauguucauuuauacuuucuaguagaacucucauucuguuuuugcaucucuauucuuuuccaaacgacaacccuugcuauguguuauuguauauugaauccuuucuugauaaugccaacuuucuuauauccucagucuacccagcccaccccucugccuuuacuguaguaggggucaaguccagggccucuacugagcuauaauaacucaaugaauuauuccugaauuccuauauaugcaugcuuuuuuuucugaaccgcaugugcugcuaggauugcaauugugcauugguguucccuguuggucuguaacaugggugggggggagguaggggcggugguggugguggagucugccuguuguauuuacagcuguucucagcauugcuuagcaugccgcaugccgcuauucucacaguugauguugacaagauacuuaauuugucagagguuccucaguaauaguguugguuuguaucaacuugacacaaauuagaguuauccaaaaggagggagccucaacugagaaaaugccuccauaagaucuggcugcagggcauuucuuaauuagugauugagaagggagggcccaguacauugugugugugcuuggguucuauaagaaagcagucugagcacggcaauaagcaguguuucugcauggccucugcaucagcuucugccuucaggucccugcccuguuugaguuccuaucuugacuuccuuugaugauaaauagugauauggaaguguaagccaaauaaaggcuuugcuccccaagccuuggucaugaucccucauugcagcaacaguaacccucaggcagcuguguucuaguuaaugucauuuaaaauucugguggacaaguucuuuuucaugacuguuaguguugaauugaaacaaugugcauauguuuauguuguaguguuacaauuugauuauauuguaucuggucaaaugagacuaauuagcauaguccuuuucuuuguguugggagcauugaagaugcuuucuucagcugaguguaaccuuggcagcugggagccaaaggcagggguugaaggucauuguccauuacacaacauguucauggccagccugggcugugugagauccuguuucaaaaaaugaaaagggagacugaagagcuggcuggguugggagaagugcuucugugaaugugugacaacuugaauucagaggcaacgcccaugcaagaaucugggagagcuuuagaugaacuccagggcuggggagguggagcacagaggcaggaggauuacuggaguuugcuguccagcagccaaaguccagguucagagacugucucaaggaauaaggcaggacaccaaauacacacacacacacacacacacacacacacacacacacguguaucucuauauauccacaaacacaugugaacauacauaccacacauacauauucacaauaaaaaaaaaaugaaaauuccuugcuaauuuaaaaauaggcugaugugaauuaauuauagcugaccuuuugugcuguggaagguuaaaagauaagucccuugcuuaacuuuauuccugugccugguaacuaacgacccucugugccugccuacccuucucaguguccgguauccacuacauacuuucugcuucaaugagaucaacauauucagcuuccacaugagugagaacaucggguguucgucuuagccagaauucuuuuaaaaggcuagagacaugucugagugguuaagauuccuugcugcucuuguagaggacccagguuuuguucccagcacccacauagugacuuaaaacuauccuuuaugccaauuucaggggaucaaauacccuccucccaccuccuccaacaaacgugguacacauacauacaugcugucagaucacuuacugauacaaaaauaaagcaaaaaaaaguuauacgacaugauuagcuaauaauuuuuccauaauuaacuuuaaaauacugucauugaggucuauaaacugauuaggaauguaucguguauaaauucaggucaaggacaaauaguuuagaauccugagccauccuacucaggaauacagcaugccucuccacuuguuuauauacuaaguaagcuuaaaaguuuauagguauaauauuuaacuguauaugugucgacaccacaugcuucuuauuuauuuguaggaauuuuauuuuuuguugcagcaggagucucucaugucuuccuugccgucccucagcuccgccccuagagacugcacauuuucuaagaaggccccccaggaaggaggaaggcaauggcuguuaggccucugccauuggcagcucaggugagacaucauugucagacaucuuuuacucccacaaugagaauggacuugauuacagaggacagagaugugucagaguauugggucccuucgcugucccucaccuguguucccagcugcuacuggaguucuugaauggcacucaaaggcuagagaggggaccaaggucacaggagagguggaugggugcuucuagagcauauggaccaucaggagucagaaaagccuaggaaagggacggucagagcuaugagaaggaggaaguguccacccaucucacggucugggaaaggaugccacagaggauuugcuguaaugcagguacauguuucaauauggagucugucuuagcaguugugucaugucgcuccuccaugguggugauugagagucugccauguacacagcaugguuaagucuuacagcacuggcuucuguuuagcuaugaugaagacugcaucucucucucucucucucucucucucucucucucucucucucuuucucucucucucucucuguguauguguguguguguguguguguguguguguguuuagauguacaugcccauguuugcagaagccagaagaggucacagauauuuuccucuaucacuucaugauauuucuauguuuagacaaggucucucacugaacuagaagcucaucauucaagcuguguuagcugaccaguaacgugugaguccuuuuaucugagucuucaggaucuuaacucagcucugcuuguuugcuuugcucccucuuagcuacugcuccaucuuccccagucuuccuacaaucucuuaaacauugccacagggggaccaagcuucuaacacuugagccuuuggggucaaacccaggacaaacuuauguguaccuugguucccuauccuugguuccugagauagucaguguuaauugucaccuuaacagaaucuggaaucaccugggagaugggcuuuugggaugccaucuugaucugguugaaguaagaagauccucccaugguggguggcaccauucccuaggcaggacccugggcugugcgaggagaaagagagcugagcaguaggcauucauccccucucugcuuccaaaaaugugaaugucaugugaccagcugcugccaccuugucuuuugcagcaugauggucugcaccccugaacggugagccaaaauaaguccuuucuccuuuaaguuguuuuugucagaguauuuugucauagaaacaggaaaggaaacuaccacagcucucaaaccacucuguguuauuuucuccucaggcucauaauggcugugguuuguuacacauauuuugcuuuugucagaauguagccuauaccuucauucuucugguccugcuuggucucuccucaaggagaauuuuguauuuucaggaguuacugacauacaaagaugugucugaggacuucacuugggaggagucaaugcagcuauauucugcacagaggaaccugaauggcagagugaugcuggagaacuguagcacccuggucucccugggugagcacccccgccuucagccaucugccauauggaauacacagguuugacuugaaaacccugcucuuguagggcauuguucaggauaaugcuuuagugcccgucucucacaguggaaagucuguagauaauggagaacaugagaagggggaaauuagaacagugcagagguugcgugcugacugaggucagaacccaaaccuggucucucucuucccaagcagggcaucagccguccaaaccaaaugugaucucggagcugggacaagaacugacccugaaaaaaggagaauucccagguugcaucucucuggguaggugucagaaugcaaggacugucaugugugugucuuacuaggaagugugaacaggauuguagggcucuagaaagaccagcuccuacagauguguauuuuaugaagacagugccgcugugccaaugagaguuguccucugucacucaagcuuauguccuggucuugcacgaggggaugggcgcauugugaagcuugaguaacuacacguguagcaguuguccagugccuggagccacugagcauuggaaacguuagcaauggcuguuuccucucugucuccaucuguguucaguuaaaucugucccugacugaaacaccucccuuuacugucuuuguuccuaggccuaaccucuauuccuagcuuuccuccccuuguauauguaaacauuugagagcuuucuuuucuuccuuccuugauaggaauuuugaauaggcuucauauuuuaaaaagugagaagugacuguuaguuuuguuugccauucuaacagcuuuacaucuuacacauccuauuuucuucucuaaaagucucaucuguguccaccaucaauuuauucccugcccaguagcucuucaugcuugugccuuggucagucucccucacagcugagaguucucugugaggugauaucauuagcuuuucucugcagaaaacacaucuuauaccuugccuuucccacauuucuagcuccauucuuauaaaauauauuuuuuaaagcuagagagugagcaugggacuuagacaugucucuguugguaacaugcuugcuggguaagcaggaaaacccgaguucuacucccaguguucacguagaagccaugccuguagaguauaggccucacacaaccguaacucagcggugaggaggcagagccaggaagaauccuggggcucucugaccagcuacuguagacaagugggugagcaccagguucagucagagacccagucucagacaauaagauggagagugauggagacacccgacaucagcccugccucaaaaacaaaaggaugaaguacuacauuaauugcgauugucuugccauuaucccuaccaugugacuuguuggaaaauguccucaggagaagaugcuggggugcucaggggugucguguuaaaucagugagcucugaaguggcccagcaaagccgguucuugugcacgacacacaagugucugcagccagagaaucugggugagcgacagauguguucauuguucucucauuucugugcauucagacuuacaagauuaucaaugcaccaaggaagcuggggagagacuggccauugucucacugucacuuaggugcuggccucucccugggggccuccgcagaugcuuagaggcaucuguuugugcaguuugucaaggaaacaggaaaacagacacucugaguauagguauagcagcuacccugaauguauuuucugaagaaaagggagcuguuacaacuuuuauaggcauagacaaaaggaaaugauaaacaaacauguucaguguauaccuuggugggggaccaucuguaaaugaguuuaggcaaagaggaaaauuccuggcuacugggcugugucgggguuauucuguauucuuaucuuuauaucaccaugcagaaguugcccaucugguauuugcaugaagaaauucacaaaaaauucuuuaugaaugcauaauuuuacaacaugaauaaaauguccugaccaccacugcuggcuuuuagugaguuuccuugagaacaagacucuaaaggaugacucacuggguugaaggguauaugcauuuagaggucuugcugcuugcuguacaacuuguaaucccguuuuaugcuuguaaugcucacuuaucugauauaaugugaucccuuucgggagcuuaauugcuuucgcuauggauuucuguggcguugauuacucuugcuacuuacauuuauuguuuguaaauaguuuauucauuccacaaauggucauuaaacauuaggcagucuuucuggcacugggauuauagcaagaaaacaacgcaggcagaauuuccaugagcucauguucuauuuaagaagaucauacagagaagggugagacguggcagaagggagagagaagaaagcaguuaaggaggcgggagcagcaccaucagugagugggugggaagagaaagcagccuagagucagguuagaucugcuuugaacagacuuugaacagagaugcucaaauaaagccauaggucuguagccaggcuguuuucuaccagcacccuaguucccauguaaugacgcagacuuaauuauuuacuaauaagagccuaggccauaagcuugguccugacuagcucacaacuuucacaaucuguucauuguauuguuuucuaugugugccauguggcugguuacugcuccuugguuucauauguccaucuccuccgaguccaagugacgaaugucccaugccugacugacuccccagagcuccugucuuucuacuagaacuccccccuccuauuuccugacuugcucauuggccaucagcuuuuuauugacaguugaugcuuccaaagaguucacagagauucucucuaccuaggucuaggagaguauucuggcguggggaacagcaagcaccaaggcucugacauaggggauugcucuucuaaaggggagagagccuugagccuugagcaaaaagaauccucaaaauauaguucuuuaacuccagaggaaaaaacacauauuuucugcuuagagauuuucuauuucugcauugcgucucucucucucucucucucucucucucucucucuguuauauugacuuggguugauguaugcacauguguaugguauaugcacuuguguaugguguguaugugugugugugacauaugcauuugugugugguguauacacacaugugugugcugguaugcucacuggaggccagaagacauccaguguccugcuuuaccagucugccuuguucccuuuagauagggucucugaaccuagagccaggcuggcagccagcaagccacagcaguucucuguacugggacuguaggcauaaacguccaugcucagcuuucuaucugggugcugggauuggaccucaguccucacacuugcagagccaucuccagggcuccuguucccuuugucagcaguacauggacuucucuugcuuuagaaauguuagcguuucaguaguuuuggaguuuguugguauagacauguagugauguauuucuguacucuccagauuuagcacauuuguuuaggguucuuuuuugcucaucccacugucaugugcugagguuucuagaggcauggauggaaguguuugcuggcaguucuagagaucacuccucgccucucacauccgagcacaggcuuucccacuccgcugcauccugagccccaugcuuuggaugacgauuuccuaccccaccccuuuaccuucuuucagacuuuuccaucgggaaggauccaaaagcugcuucagcuguuuaugauuuggagugcacacuguuauuucccugucuucugggacgucugucugucugcaggcaugcgguuucauuauaugccuacucgcugccugcgagagucaauauuuaauaauauuuguugagugaauauuggaugacauuaaguagaacuucuagaagucgggugccaguagguuugagaacuguaaccauaucugugaaauugauaccaacacaaacuggaaaaugaucaggauagaaccaaaggccagagcgcucccacacagauuacagaagccugcccagggaugaggaaggagcugggucauggaacaaggaaaaucagaaagaauacagcagugucaaguaagaaaagauaaagugucugugggccaaguaacugggaagccacaugugacccagggaagagcguguuccgugcuaaggggcugugcuggggagaguacagaagcaagcgcagccugacauuucaucaaggcuagacagaagggaagaaggaagagaagaggcccucuacuuacuguguucuuuggggaauggaucugaauugcccucuagagaaggagaaacugaggagcuagaaaagaaaacagggugaaggccagggaggacagugagugaggugcagagcagaucacugucaggucaccuguucaguggugucauguugguggggaaaugucugacugcagaggugugucuugguuucugugcauucgcaguaauggcugaguucauggcucaagucacaugucucucuccucaccuuugcaggccuggcucguugucugugagcauccugugcucccaagaggaucuccuagacuggguuuuaaaacuuuguagguaaucuuuuuguuuuucuuuuucuuaaaaguuaagccuucagaauuuacauuuaaauuaggcaucuaaauuuaauaaagaauauauugaaccuuacuaaguucuuuaaugguguucucaguuuuaaaaauauauauauggauuuauaaagcauaugcuauuugacacaaugcauauucuaugacaccuuuaaugaauuaaugcuuuacuauuuuuuuucuuauacaaacacucuaagaugaguaccauuuaacaaaugaggagccuggcacacgcaaaaguuaagaagccuucauaaaaucacacagcuaauagugguuggaaucaaauuugagcaggauagauaaucuggcccagaguuauuaccuaaccacuaugcccuccugcuuuucuuuguaguuggugaugaugaaaauuagugaagaauaaagaaagcagaugcccaggguccagaaccuagaccaagaacaagcaucccaggcgagcacuaaccucuccccagcacugagcacuauucugauuugugauaauuucuauauuagucucgguucucuagagaaauggaaggggauuuauuaggguaguauacaggcucugguccaacuagcuaguccaacaauggcugucucuuaaagaaagggccaaaaauccaugagucugggugugucagcugcucuucaaucuguauuggaaucccacagaaguagguucugauaccaguaaaggaaugcccugggcgcaggacagaugagcuguuagugagagugagagcaagcaggcagaagcuuccuuccuccauguccuuuugugugaacugccaccaaauguggcccauauuuagggggagagggauccuacugcagauggcccaaauuugucuucccacuucaaaugauccaaucaaauaaauccccccacagauaugcccaacuauuggguuuuaguuauuacagaugugguaaaguugacaaccaggauuagccaucacaagucuauuccuugucaacuugacaaacaaucgcaucguggccaguuaccaauugaaaaugauaaugaggucauaauuccacuuaacaagauguaaccaccccaacuuuaaccauaaauguauuauagguggcaauauccccugaagaaugguuggucuuuuagugucucauaacuuaccuaugauaaccauuaauauuaucucaauugauauuauaugauaaaaaaauaaagaaacacaaauaucaacuaauauauauguauauacgcacaaacucauccuuaacaagauagaaaagaaacacucgaaucaauuguaauuuguuuuucuuucauguggccuaacuacccauucugcaccucagcaggucuugguucuuuuccuggaggagugacucauaccuucauuccugaaggucuggacccuuuguccuccugccuggauuggguuguuuuaguuucucacugacuuuaaucacaaacacugguagcaccaagacacacccugaaggcucuccugcacuccagacuuagucuuucuuaccuccauuguagagaagcaauugaauuucuuccugguaaucuugaccagccaccccuccuaacacucuucuuccuuuccuagccuguuugcuuaagaggaucagaacccaaaguggccaggggaugagucugagcuuccaguucaguggaguucuguugcguccuggcaggagcgcagccccaucuggaaccaaaacuucugggccagcagaacuuaaggucauaggaacuuaaugguucauaggaacaggaugcaagcuuuuuucaaacggaucaguaggguugauaacgaguggaacuauucccauuccuaccuccacuugauuccuggaccagugaauucuguggaaguacuacauauugggugaagauuaaaagcauauaccuucuucuuccagccguccaggcugcuugcugcucccuaauuggcacuauaacugugucuucaaaaggccaucccauccuucucucagaccagcugcuuaaggaucauggauuccaugagcuuaggcccacugucacacuucucugccuaugaguuccucgguuagaacccaugcuauauugaauagcauaacagugaacaaugcguucugucagucuccaaauggcacugcuggcagcauuccauacaggaaaggcaaacccauaaccagaaaaagaaucuauuccaguaaggacaaaauguugccguuuccaugaugaaaguggccccagugcaguccaguugacagucaaggucagcugucacaauucccuucuccggcucuucuuuaccauuugucugugcuaaagauuuucuccugcacuuuuuguuggcuucuggguagcaauucacauuucucaaagaacuuuaaugggauaacuggaugcugccagagugagccggagcaagagaccacugcgagcucauauugcgugcuaauaccacgagauagacauucucugcagaguucuuuaggacauauauuuggugguaauuccugcuugacuucugauuuuucuauuuauuagagcagaucaacacggaaagggaaagcccuguuguguauauuucuugauucucagccuuugguuuacugcucccccauguuaaucucugcuguuaacguugauugacagcccuacagcugguacucaggcuccagguuccuguccucauuccucacugccuccuggacuuguuuuugucugugauacgaacuggggucuuaggaaucugagcagcuucaggguccuuucuucugcucaguuaccuguagcaagcaguucaacagcuucucuucaccuuccucugcucagcacgaauucucaacuucauagagagaaauuuaaggaaagaguaggauguguaggccuauugcauuuaugaguggaacugucugcuuaaugguuaagaggagaagccuggaagacagcgucauccuccauuaagaguuggagcuucaaauauguucuguuuuuguguuguagaugcagguauuugcuaagagcacuuuacauauagugucuuacucacuaucgagaauuuuauccuccuuuacaucuguaaaaguccauauggaaguaaacaaguaaaucauuaagguaguguuaaaauucaguuuaaacuuguaugugugacuugaagggcaacaauauuuucaugcuuugauauuucauuagauugauuuaguguagaguuguaagaaauuacuaguaggaaugccagauggauaggcaucuugguuucuuuaaccgacauggggcagaaagaaaguauuucagcuuacaguaccagguuacaguccaucauggcagagaaaacucgguagaagaagacagagacugcuggucacaugaacacagcacagggcuugccaguacucagcuggcuauuccccuuauaaaggagucucugcccaggcaacaaucucauccacagucuauacgggucuucugacaucaauuaauguaaucaauauaaucccccaugggcauguccuuaggucacccaaccuaacaaucccucguugaggcuuccuucccagauaaaucuagauuaaguuaacaaugaagaugcucccaauuucaccccuugucaauaugauaccaaaacuaaucuauuuuaaaccauaaccuaccccuugucuccacaggcucauuaccauguuauaaaauguauuuaauccaucucuuuucuaagacauaaccuagaugcccuugugugcucaauuuacccuaccacuguccacauuaauuacuccacugucuugaaauacagcuuauucacguucucaggacaugggcagaauaaaggcagauauuucaacaaaauauagcacuaauggcccuuagaccagucccugauagacucccuguuuuccugugaaaccuuaugguccaucuuuaucucaaucuuguaagcucuccccagcacgaguuaaacuccgaauccugcauucaguguaccagauucuuccacauucuagccacaaauguguccaaagguguaagaacaacacagucaaguaacacacuaaaggucccacuucuaguaccgauuccugucuuaguuacuuaucuguugcugugaugaaauacucugacaaaagcagcuuagaaaguguucacuucacucacagcucacaguaaaguccauucuugauagagaagacaagaguggcaaguggcugagggagcuggucacauuacaucagcagucagaagaagagaacaaugaaugcaugcuugguaguggucagcucccugucuauccuccucuuauacaggauccccugcccaagagcaggcccagaugagcauucucacauguguuaguagaaucacaacaacacuccaaagucaacucagucuagguaauccugcuagauauggccuugccaggcgauucugaauucugucaaguggauuaaguaaucaucaaauagagcacaccauccucacccgcuuucccuugccagucucuucuggguauuguccccgaguucuacaguaacaauugauccgucccuccuggaugagguguccccuucucuccacuucugcaguggaucugccauugucuugguucuuccgcuuuuguggacugcuacauuguucuucacuuuuagacuucucuaggaauugaagaucuuuggucaaaaucucuucagugcagguaacaguuauucuaccuuuauucucuuaggcccuccaccucauguggcuucuagucacuuagcacaggaaucaauaugcaucugaauuuguuuccuuuuucaggcugcgagacaaaacuugaaacaagagagucaacuccaaaguccaccauuacuggaauuuugcccuauggggucauaauggacagggaagaucucuggcauucagcuuugggggcugucugggauccuaccuguugguuaaaggggcaacaggagagauaccugggccaagugacaguggcccaaaaggaaaucuauaaugagaagaguguguguggagguaauacaacugagaacucuuccacugagggaucaaugcuuaauacaccacaaagcauuccugugacaccuuguaauuggaauucauauagaaaagauucuaaacaaaauucugaguuaaugaaaacuucaagaauguuuguacaaaagaaaguauauggcugugaugagugugggaaaaccuucaggcagaguucaucccugcuuaagcaucagaggauucacacuggggagaaacccuacacaugcaacgugugugacaagcauuucaucgaacgcuccucccucacugugcaucagaggacucacacgggagaaaaacccuacaaaugucaugagugugggaaagccuuuagucagaguaugaaccuuacuguucaucagagaacucacacuggagagaagccuuaucagugcaaagagugugggaaagcauuccgcaagaauucaucccuuauucaacacgaaaggauucauacuggagagaagcccuacaaaugucaugauugugggaaagcuuuuacacaaagcaugaaucuuacagugcaccagagaacccauacuggugaaaaacccuaugaauguaaccaauguggcaaagccuucagccaaagcaugcaccuuauuguucaucagagaagucacacuggagagaaacccuaugaaugcagugaaugugggaaagccuuuaguaaaagcucaacucucacucuacaucagagaaaucacacuggagaaaagcccuacaaauguaacaagugugguaaguccuuuagucaaaguacauaccuuauagaacaucagagacuucacuccggagugaaaccuuuugaaugcaaucaguguggaaaagcuuucaguaagaauucuucccuuacucagcaucgcagaauucacaccggugagaaaccuuaugaguguaugaucuguggaaagcauuucacuggaagaucaucccuaacuguacaccaaguuauacacacuggagagaagcccuaugagugcacugaauguggaaaggcauucagccaaagcgccuaucucauugaacaucaaaggauucauacuggugaaaaacccuaugaaugugaucagugugggaaagcuuucauaaagaacucaucccuuauagugcaccagaggauacauacaggagagaaacccuaucagugcaaugaauguggaaaguccuucaguaggaguacaaaccuuacaagacaucagaggacucauacaugagaaaugcucuggucaacuccuucauuuuguuuaaccuuuugauacuaaucagaugucacacugauguagauacuuaguaaauauaacuaaugugguaacuuuuuaguugaagaacaauauagcauagcagauaauaaaaucauagagaguaaccaugugaaaguggagaacccuugauucagauuugaguagcuaugacauaaauaaugaagcuguauuuggucacacugggaaaucugauuugggcaucacaaaauucacauugaauggacaaugugauagugauuaacuggacagccaaaaaaucugauucacccaguucuaaccgcccaugagcccuuuaucuaguaaugagagauuuggaauauacaaagucuguaggaucuauauuauccaaaaugcccaacacgaagauucagugaauuuuuuuuugcuguuguauuugcuauggagaugcuuuuauuucauaguauuuuugggguguuuuagguuaaaguuuucuaccucugacucuuacuguccuucaaaucccugaauuacuaacucuuaaaauguaagcuaguugcuacuggguggcagauaaauugugcauauuuuaaugccauagcaugcuguuuugaguucucagcuaauagucauuaaacuguuguuaaauaaauuuacucuauuuagaugacaaugugacuuaaauauaaucucuaauuaucuaggaaucaaauacauaucuuugugucuuauuggagagucauagaaauuuaaauacagaugaauugaacacuaauugugcuggacaguauuaugucaacuugauugucaacuaaagucaucuaagaagagggaaucucaauuaagaaaaugccuuuauaagauugggccauaggcauaccuacagggcauuuuccuaauuagugauugauaggggaggauccagccauuuguggguggugccaucccuuggcugaugguccugaguucuauacagaaagcaggcugagcaagcagcacuccucauggcaucagcuccugccucuagguuccugccuuguuuaguuccuguccugacuuucuuuggugaugaaaagugauauagacauguaagccaaauaaaccuuuuccuccacgag

SEQ ID NO: 5976 - RNA, 944 nt, Mus musculus
gcuaagaggacuuagagccccuguugaggagccuugucacugacuccuucauguccuuguuccucaggcuguaaaugaagggguucagcauggggguaaccacaguauacaugaugguggcuaccguguccuggguggagaaggagucuggaggucguauauagauacccaguacugugccauagaacagagugaccacagacaagugugagcuacauguggaaaaugucuugugccggcccuuugcagaggggaucuggaggaccaccauggugauucggacauaagagaccacaaugagaaugcagggggccacaaagaggaccacagcucccaggaagacaaguugauugacucgugugucugaacaggccaacuucaugagcagguaagcaucacaguagaagugagagaucuccgggauggaggagcagaaacucagucugcucaugaggagugugugcaucagagagaugagggcagagcacauccacacaacggcugccagccccacacagagcuggggggugaugauggugugguacuguaguggguagcauauggccacaaaucuguccagggccauggcagccagcagaaagguguccacauuggcaaaagaaaucaggaaguacgucugaguuaggcaguggacauaagagaugguccuuguuccagccacauggccagccaggagccuggggaugagauugguggugaagcagacaucaacgaaggaaagguuggccaggaagaaguacaugggggugugcaggcggggaucggagaugauggccaggaagaugaguguguucccagcuaccgugaccagguacaugcacagaaaagcccagaagaggauuuguugcugcugugggucauuggugaugccaagcaggagaaacucgcugacuccagucucauucucccuccccuuggacauc

SEQ ID NO: 5977 - RNA, 13577 nt, Mus musculus
cagagggcuccgcggccaccacccucuggaccccaagaucugacccccccgugagccuucgcgggucuuagggcgucuguggcgcggcucgaggcuaggggccaagguccccgugcagaguccuuacccgcggcggcucagagcauaugugaggcgcggcgggagccggaggagggaaggugagugaaggcucgauauguucggacgucagacaggggcugggcuggguuuggcucggcggccuccugcgcgucccccuccccagaacgcgcgcucccaguggccuuggcucuggacugcaagugaccugcuccccaccgcccgggcagugaccacgcaggcuguguuuuccgugcagcucucuuguccugggcuacuauugguccccuuucuggaguuuuccccugguauucuggaaaucgaucucugacagcagcagugcagucgggugggcaacguguuauaaggaagaacaccgucccugcccguggucaaucugagggggcaaaaccggaggcgcccccacuguggccgcauucagacuucaauuuccuucccaaaggggcuggaaagugccugcugagauguggugaacagucuaaggguguucacaugggagcucagugaguccccucgguuauggaguacagugucgccugaaucuugcuucuggacauccacggacaagaagacuggugacuugucgauucucugaugcccacccccagcuccugguucccucucuugaggcagaagagccaggcucagaugaugggacacuuucggagaugcugcuucugacaggugccgagcaacagguacuacuccuuucuucuuuccacccucagauccucccucaucuucacccaucuuuggaagaagaaccuucagaaagaagauggcuccugagcaaugggaagcgacaucucagguaagcaccuugccgguucauuucguagcagaaggagcggauuuuguuugguuuuccuucugacaguuauccacgcaguucagccuucaccggguuucaucgcccaugcccuccuuggagcaguugguccucccuccgugggugguggauucuguggggagcacaccccauguucacaguuccagucuuauguaucucuugauagacaggcuauuguugccuggugccagucugguguaugccuacaaauuccacaaguaacuugccagguaccugggacagaauacacauacguacuugagaaaauuccuuuuuuuucugguccugccucccgcacuugucuguuucauucucugcccuuaccaaaauugguuuucuauuuuuuucuucuuucuucuugacaauccuuauguuguucaccaagccuucuccagucuguggugguugguugguugguugguuguuguuguuguuuuucccacuuuaugguuuuaucuuuugcuuguacaauuuccaugaaaguuuuuuucuuaucguguauguauguaugauguggugugcauacauguguauaugcguauucucauguacuuggucacguguuuggauggcuguaucucugugugaggauauacaucugcacaugugugucaaagccugaggcuauaggguggcuucucccauggaguugucugucccucacaggugucguugacauuugaagacguggccgugcucuuuacccgggaugaguggaagaagcugguucccucucagagaagccuguaccgugaggugaugcuggagaacuacagcaaccuggccucgcuggguaagagagugcccugugggcagagacucacaagcgagaccucgugccuucucuuccaaauggagauuucauugugaaaucuuagcagaguuuugccuucaggccuuacaaauaugaccuuauaaguaagcauugacacacacuuugcacagcaggccuggaacugcccaugugcaguggagcgggcguggcagugagggcaccgcuucccuugguaugaagcaaagguucauagucugggcaucuucccaaccagcagucauuccaugcuugcuugguucaucucucagcagagagcuuuguuccaucucuggaaccucuugcccaucuccuuugcuauguguuuuucugcaaagggccuugugagggaaacauuugaggcuucugguuacugagcucaucuugucuacaagcaggauucccguuuaccaaaccaaaagugaucucccugcugcagcaaggagaggaucccuggaagguggaggaagaaggcccuggaggcuucucucucggugagugugugcgcaggccuggcagucucugcaggcuccaguguggugaauaaggagagggugcagcuuagaguguggguugggaaaugucuucagguucucaguccacaagagauggccgggguggagggggugggaggcuggagagacagcucagugguuaagagcacugacugcucuuccagagguccugaguucaaaucccagcaacgacaugguggcucccaaccgucuguaaugagaucugacacccucuucugguguaucugaaggcaaugacaaugucuuaucuguaaugagaucugacacccucuucugguguaucugaaggcaaugacaaugucuuauauauauaaaauaaauaaaucuuuaaagaagaaagagguggucagggacugggauggagcucagugguaagaacaccugucuaacacacaaaaagcccuggguucaacucccagcacgcgcgugcgcgcacacacacacacacacacacacacacacaccaaugaaacaaaguaaacaaacaacucaauaaauuauccguaaauuagauaagagcaguggagggaaacugaaaucugggcuagcucuguuauucucuucugaucaugucccgaaugaauuucuuggggucuuuuuuuucuuguugguuguuucugaggagggcugcguuuucagagcucauuuaagaaguaugguauauuuaagggaugauaaagaacucacucagguuggaguucaaaauguaaaggaaaaggaaacggugggaaggcuaugcauguagggauccuguaacgagggccuuggugcuguuccaagagcuguguccuggacaugggagcugcuagcaucugcacugcaaauggccacuguacuuguggguagcucucagaaagcugguucuaaucagaaacaauugaaaggucucuuaguuaaccagcugaagaaacuaugguauguccuuguucugacagccaccaucucagagagugucaaggagugaggcagguuucagagcacugucgagauuagauugaaagaaaauugugugcacagagagaagggugaggaggcaacaauguacccuuuaaaaaugggcccggaaaaagagucuuuauuuguauauaauguuguaaguuguuacaaagagcuguuacauucaggaagugcugugaggugcacuauggaggauggauugaacuugagaugcagccagacaaccuuagggcgccacugcaggaaugaaggaaaagauagcggggucuagaugaaggccccugcuuagggcucuagagagaccccgugugaugauuuggggugguggugguuuucauucaauguauaagugaagugcuuggauacggaucucuggugagggguucuauaaggguuggaacucacaagugagaucagaacccuuggacccuugagccgaccagcuggggguuaggauccuggaaaacuguuuuuacaagaugguuaaaagaaaagaccuugugagccagaccugaaguaaccuaaagggaggcucaacagagguguugcuauggugauagaaacuaagggcugaugaguuggggaagaucccucacuggugaacucgcaaaguuacuuuccccuucaaaacuaaaauaacaaauacagggcucaguucuuuagugcauuggcugauuuuguagagaaccugaguucagguuccaucacccaccuaaccauucauaacuccagcucuagggcuucugaugcccuucuuugaucucugugugccucagggaugcaugugggacacccuuuuuuaugcacccuuacacauaaaaaaugugaaacagccuuuguugucccuggguuuguaagucuuaaacuggaggugagaggccauggcuugaaggaugucuuccuuugggucucuugcuuaagaauuggcgcagagccuaagcagugaggcugcgcucuuccugcauagcuacacuaagaaucaugggugaaaccacuuguguaucgaacaggcuuggcggguguccaaaugcacaaauauuccgaaauccggacauuuuuaaauuccagaaauggucuaguaaucacaucuccagugagaaguccccccagcccccuuuucuuuuccuuuuaucauuuuuaaugucagaagccaccaagagucugcugaaccgugugggguugucagccaucugcuggccucugggguuauaauccguucagaggaaggcagcuuuuccugauuuuacacaggugcuacgauggaggucagccacagccuuaaaacuagcgacuuccgucccauggagcccaaggcagaguccucaccaugguggucuccuguucugccucaaggacuuuguaccugacuuaucuaccugccuucuccuuuucuugauggccaagagcucuuguaguugccuuccuggguuucccaggauucugcccaggguuccuuccuccauguucuucaccucagcaggcucauucuccuuccacaccauccccgcauagcacaugggcgcgugaucucugucuuccucugcaucuguaucuggaggcggcuuguuucguuuauuucgauuuuccagugcuggcagaguaggcuucugguuaugcagaaaauacaggaauaacuugcaccauauaaauaaaacgaaaagcccuccuuaaauagugaaagccaaaugagccagugacuaauucaacauagaguauuuccacgaaugccuuuacaugagagucauuuggcuuauuugugguuucuguguaucauaagggugagacuaccugcgaacaauguuuuuaacuuggguagggucauguggguaguuuugacacauuuauggaugaaaugguugauagugggaauuacuuuaggcuuacuuuuguggaagagacguaaggguucauagugauaugagacagguuuggcauggcccugcucccucugagauaccaagacugaugccucuuuagccugugguugacccuugaagauccugccuugagugucagauaacucuaaccagcacucacagcccauccucaccugcacucucacugucuaaggagaauuuuggugguucucugugcgcauauuacccacuauuaguaaugaucacauggauggguauggaggcucaugcuugcagucuuggcacucaggagucuuaacgcagaagugaugguaguuuaaggccagccugugcuacauaguaaguuccaguccaaccuggacuagagugagaucuuguauucaaaaagaagaaaucaugaggcaaugugaucauuacuuagaaccuaaguccuaaccuuuucaccaaguaacucagcugcacuugguucucagagagagcaaaggcggagugguguguucguagauguggggguuucugaguggaucguacagagcaguuagcauauccacaaccugugacuggccugggccccaguggaaaaugaauggagagcuaaggcuuuggcacguggaaacugacauggguggaagagaguugaugcagguccuuguagcugggacugcuuucauuauaaacaaagguucucgugcucgcguucuuauuccgcuuggaaccagguuucacacgggcuuuccaggucuuccugccuuuucacuuugccuuauuuccugagacuuccaguuggucucucauuuacugcuccacuaaaagaacucuucuuaaauuccaugcuaccuccaucuccugcacuuaagaccaaacuccacagcuguuacaucugugcagagggccuaggucagucccuuguaugcucucugguggcacuucagucucuaugagccccugugggcccagguuaguugacucuguggguuuucuugugaugacccuucuggcuccuucaauccuuccuuccccaucuucuacaggauuccccaagcucugcuuaauguuuggcugugcaucuccgcaucuguuuccaucagucacugggugaagccucucugaugacaguuauucuaggcuccugucugcaaguauaguagaauaucauuaauaguaucaggggugggcucccucucauggcaugggucuuaagcugggcuggucauugguugucccuucccucaaauucugcuccauuuuuaaccccuccauaucuuguaggcaggacaaauugugagucuaagguuuguggcuggguuggugucccaguuccuucacuggaugucuuaccugguuacaggagauggcagguucaggcuucauaucccucauugcuaggagucuuagauuucugggggggggguccauuguccuagauuccauugucuaugcuucccccaccccaaccccaauccuuuugucucucccaguacugucucucucucucucuguccucccccuccccaccucaucccuccuauucccauccccaccuucuccccaacccaggccccucucucagggaacauuuucuuaauuaagauuccauucucucaggugacguuagcuugugccaaauuggcauuaaacuauccagcacaccaaccaagccguauacccaaaccagucuucaggguauuugacauggcuaaucauuuguuccucucuggcuccuggaauaccaucaucucccaguuuccuuaaauguucaggaagucugcugauuucuuucaguucucuagcuuuaaauagaauuuguaggcugaugauucccaaaugccugucuucagcucugaccuuuccccaggucucuaaagcagcacacagcuauuucagggucuccuugccuucuccucugaagccccucagcuaucacaaguagaccugaagcagaccccuagggcuucccauccucuccucccucuucuugguaauuggugccauaauucccuuucagaauucauaggcaugaucuuaauuaauugucuucuuuccuuccuaguacucuguuaggccauuaaucucaguccugagagcaaccuccucagcucccuaaaaccuucaucugcuuucacuucugcccuaggucucucuguucucugccaacucaaauagugcauauuuccccaggcauccuaucgagcuugguauaaaauuccacagccuucaccaauauucaggaggccuuccauacuuuguucuuuaaccauuuuuccuucuguucaguacauucuaggcaaggucagggucuuugcuccguccagaagucaacuauacuucuguuucuccugauggcuuugccugggacucucuccagauaaccauauggcuucuauguacuuguuugucacugcauccucucugcccaucaagcacacacauaugcacaugcacacauacaaaaguguacguuucagcaaugccggaaccuugucucacucagaacauuauccagccacagugugagagagugagggugaauggaaagguggucucuacauauguaaagauagacaaguaaaauuaaacuggacuguuccagaaacugcuucuaguccagcauaccugacaguagccaggggagggagguguuggcagauguagacaaaucuuuuacacuuuuacacuucacugugggaagaauccuggaccucaucaauaaaucauuggcauucuaacagagaucuuaaaagaacauucagcacgggaagaucuggauuuaggcagggugaucugguuguaguguagagaaaguugucagaggcaagacucaaagcuagggcauuacuuaggagaccaugguagagacaguaaugcauaggaaagagaaugccuucucagggccucuuagucacuguucuauugcuacaaagagacaccaugaccaugacaacucuuauaaaagagagcauuuaauugagggcuugcuuauaguuucagauaaguuccauagcaucauggcaggaagcauggcaacaugcaguuagacauagugcuggagcaguggcugcguagauauccucauccacagguggcaagaagagagaagggagacagacagacagacagggccuagcaugagcuuuuuggaaugucaaagcccaccacuaauuacauacuuccuucaacaaugccacacuuccuaauccugcuaauccaaacauuucuauucccuggugacuagacauucaaauauaugagccuauggaagccauucuuauugaaacuaagacauuuuaucuauggggaagaugcgaguucaguugcugacugcagugcucagaacucuggcaagggcaaaguaucagaacuguagccuuucuuuauaagaaggccuaaggcagugucuuagacucuucaucgcugugacaaguaccugggagaaaauguuuaaaggggagagaauuauuuugucauguggcuuuauggauuuuaguccauagcugcuuugcucccuugcuucugggccuguggugaggcaggguaucaugugggugagcguauggcagaagacagcagcucaccucaggguaguccagaaguugggggaagcagggauaagauauacaggauauucuuccauuaaccuauucuucaaagaaaguuccaccuccugacuuccaccacuucuguaugauaccauuggguuggaaacccauuggugauccagucacuacccuaaaccagucagcuaguagugaggcuuuuaauauaugagccuuuaguugacaguucaaacucaaaucauaacaccagucuugcuugaugcuuggauaaggcugucuuuacagcuuacagaucuugacauuaugccuguuuugugucaccucuguagaauuaauguaauaaugucuucccgggugaacuaguuuagaauucucucuaaucuauguuguguuugagaagacagguucuaugaggacuugugacuaaucuauaugaaauucauguuuaaguggucaagacuacuugacuuucuucaaauuagguagguauaaauaagaaaaaaaauuacuacacaagccagaugugguagcacaugcuuauauucccaguacucagaagguagaggcaggaggauugcuacaaguuccaggccagccuaaucugucaacuuaagcuguauagugagacuccauaucaaaacagaaguaauaauuguguguguguguguguguguguguguguguguguguguaugagauaccaucaagaggauuuguaagcgguagaaugugcugaucugcuuguuauauguagagagguacagaauaauauaucaguacaucagaaguggucaccaauaaucccagcucucgggaggcuaaagcaagaggucaugaguucaaggacagcuacauggagauugagauucuucugucugagaaaauaggaaaugcuggcuggaggaauggaccauguauguuuggagucaagcaaggauucucauaguaaacuuuugaauuggaucugcaagauauuguuggcaagaaacaaagagggcaaacuuagagguaacaguguaggugacuaacgugaguucucuggguucuagaugcuacacuuuccagcuccucggcccuguuuaaucgccaucuagaaauggauuugcuuuuuuuuccuucacuuuacuucuguuaccaucaauuuuguuucuauaugaacucuuggguccacccucuauuuuuaaccacacaccaagccucuauuuaaguagcauuaguauuuauucauucaacaugucuaguuucaauagucaauuuuuaugucacaucuuugguuuccuuuuucccuuucuaggacugaagugcagucagagaaccacuaagucaacucaaacacaagacucuucauuucgggaacugauuaugagaaaaucuaaaagaaaagaaccuuggaacaugaagucagaaaaucuuuccauacaugaaggcaaauuagaggaaaagugggaugugaaugccucgacuauagaaagaagcuauaaaagcaaugaacugagcccaaagucacauagagaaaaaaggucaucagaaugugaaaagcaaauaucauauuuaucuaauccauuaggaaucaccccagauaaacgcuauaaauguaguaugugugagaaaacuuucauuaacaccucaucucuucguaaacaugagaaaaaucauaguggagagaaauuauuuaaauguaaagaauguucaaaagccuuuagccaaaguucagcccuuauucaacaucaaauaacucauacuggagagaagccuuauguauguaaagaauguggcaaagccuucacucucaguacaucccuguauaaacaucuaagaacccacacuguagagaaauccuacagauguaaggaaugugguaaauccuuuggccgaaggucaggucuuuuuauacaccagaagguccaugcuggagaaaacccuuauaaauauaacccagggaggaaggcaucuacuucccuuucaggaugccagagaauucauuccagaaagaagaccuacuugugcaacgaauguggcaacaccuuuaagucuagcucaucccuucguuaucaucagaggauccacaccggagagaaaccuuucaagugcagugagugugguagggccuucagucagagugcaucacuuauucagcaugaaagaauccacacuggagaaaagcccuacagaugcagugagugugggaaaggcuucacuuccaucucaagacucaauagacaccgaauaauucauacgggagagaaguuuuauaauugcaaugaguguggcaaagccuuaaguucccauucaacucuuauuauucacgaaagaauucacacuggagagaaaccguguaaauguaaaguuugugggaaagccuuccgacaaaguucagcucugauccaacaucagagaaugcacacuggagaaagacccuauaaaugcaaugagugcggcaagaccuucagguguaacucaucccuaaguaaccaucagcgaacccacacuggagagaagccguaccgaugucaggaaugcgggaugucauuuggucaaaguucagcucuuauucagcaccgaaggauucacacuggugagaaacccuuuaaauguaacacgugcgggaaaaccuuuaggcagagcuccucacggauagcacaucagcgaauucauacuggagagaaacccuaugaauguaacacaugugggaaacuuuucaaccauaggucaucccucaccaaccauuauaaaauucacguggaugaggacccuuaaaaauacauuugcagguguaaaagccuuaaaccaaagcucuucagagaauaucuugagagauguaauaaacauaauauggggggucucuauaaucauuuaguuacugucaacuaaauuccauggauaaguuuuauguaacagguaggaacaaaauggucaugccugucuaacacuuuuaaaaauuacuugagauccagggguucauacauguagcuacugggacccagagacaugaggauugcuugacuccaugaguuugaagcagccucagcaaaccuagggagguuuccaucucaaaagaucagugaccugaaauggagaguucacaguugaagaccuugacuucagguauuuguaaaauggugcuuuucucucugcagcagugugugcuagaaacaguuguaauuauaggcaucuaagugcacagaggagugcgcuggacuucucaguagcaaaacacuaaacucuacuguggugauauuuuuauaccacuuuaauaacauucaaaagggaucaacucauuuuuaagaaaaaagagccaaaauaaaagauuaaaaugagcuguaaucuaccucuuaagucucuggaacaucuccuuuucuugaccggauuucaaauguguguggauauuauuauaaaugaaaaauaaaaagcucaucuccugguauugugaauuggagauaguccaccuaguuauuaauucuguucccagagguuuuuguuguugcuguuguuuugauugcuucaaagucaugugcuacuaaauucuaccuuugacccaugugcugucgucgagguuguguguuaaguacgggaacagcaacuaaggaguagcucagugguuaggaguuucugcaguuucaagugacccagccucagguuccagcacccaugucagguggcucacaaaugccccuaccugcaggcagaucugaugucucuaguccucacaggcaauugcacacauugcauauucauguguguguguguguacacaguuuaaaucuuucuaaaagugagaaauaaacucaaaguuacuaagaacauauaaguuuuaaccacacacgcaaaacccuuaucagaagacauggcaaaucuaacaccuguaggaaaaugcugaagaucuugcuauuauuuagagcugcgugugugccccccaaauuuauggguugaaaugcuagacucuggggugaugaaaagauuacuaggccaugugaauuagcuccucuuuaauggaguuaguguuguggugaaauaguaaacucuuuuucagcugucucucaaauagcauaagaagauaccuuugaaagguauguuuucgccagacagcaaaauaucaccccuuaaaaguuguauuuaccaauaugaauaucuuuauuaacaucacuggauuuaguaucaccuagaggacacaccucugguuaugucuucgaggguguugcuagagaggucuaccuguggggcaaagaaccauccuauaugugcauggaaucauuccacggacgaguccuggacugaaaaaaaaaaagccagcuaaauacaagaauuuuucuguuuucagcuccauuaaaacuugaggcaucagccuaaugcuuguacaaccacaagcuccuccuacucuugcucuccuaaugugaucagaccugugcuaauuguaacuguagugacauuguauguauguauguauguauguauguggguauaugugugcagauauauacauauauaugcuauauguauguuugagacaggguuucucuguguguagcccugacuguucaggaauucacucuguagaccaggcuggccucagagaucugccugccucugccuucugagugcuggaauuaaaggcaugggcuaccacugccuggccuauauuuguaauuuucaguuaaaaauuaaauucuucauuugcaguagccacagauccuccguugaaaaaaguuguguugccuuuugcugauccagacccagaaauuauuuggugugacaauuuucugcaaaaugcucuguagggacaugggaagacagccaucucacaccagguagcacaucacauugcugguaacuacacagcaccuggaaauaaaaugucaaaucaaaugagaugac

SEQ ID NO: 5978 - RNA, 6749 nt, Mus musculus
ugcaauggucaacuuuauuuagaacaucagauaauuuauacucugaggguuaagaaucgcaugaguaagguguucaaucauaaggacaagccacauguggcaaaaaauagguuuuccacagaagcaugugacuaacaacagcugagguaaacucacuccuaucugccugaaaacaugaacaaagaacaaaucuauguuuugaagaacucuugccuuguuuucuuggaguuuucucacaagcacacagaauccccauugcucgacuccauucuuggauguguucguccaucuccucuguuucuguuuuuugauagcaggauauccagaguggcucugaucugagauguuguagaaaaauguuauugucauuugaugcauguguaucccauaaccaauggguauuagaacagugaaugcauugugugucauauuccaagaacagagauccaaacuauaucuggcacuaugaguuacauuguuauauugaucagaaaaaucuagacaacagcuugaaaagagacccauaugacuaguaguucuagugucuuguaggacagaauauuugccuuuaauacagguauagauuucaugauguccuaugcaaaugggaagugguucaaauccuaaggaaaaauuaaaaucucuucuucaaaugaaugaguguaucuguuacaucccaaaguccaggcauaaacacggggucauuaaugaaauaacuucuccugugugcucaggccgucacuuggcccuggguaggcagacuccacucugauggaagagccaugaucuccucuaugcuuuagcuggaggcuugcucucuuccuggugacuuacacugucuccucacccucugcuggugucuuugauggcucagggcuggaggagcugaagaggaaucugugguguuucaauggaucccucugcaaugacagaugcauaaccccuccccagcucuuuuccggacaaguaaaaauggggcacguuaaugcaccagcuggcuuuuuuuccuuaacuguaauagaugaaucacaacagccaguuccaccuguuaggcugaggaaagagaaguauaccgugaaucccacucauacccuuaucaauaaaccaucaauaaaauaagugucgauggaaugggagaagguuggacaauuuugguagucacaaauuuaugagaaaaccccauagcuuaccagcaggguaaugaucuccuauccuuccauguuaagcugcaagugaaauuugagaaucaauagaguucuguaaugcuuuuaaaaauuguuaaguuuacuauaacagagcacagaucaaauccauauaauuguugccauuggguccucccugguuuacuaauugagcaaucaaaguacaauauuaacaagcuguuaauauuuuaugaucauuaugguguaaauaaauguaccccaaagguuucuuuucucgugucucuuauaggagacaauaguggagaaaauauguuuaaaagcaaugacagaucuacaagacacacaaaugucuggaauccaauagcuguaguucuugaaucccgagauaauaccuugcauauuaucuaucaaacacugggaauaccaagcauaccucaugaggcaaggaagaacagugcuucgcugcagugcauagguuguaaaguaaaguuagcauuuuuuuuuuuuuuuuugguuguucgagacaggguuucucuguguaguccuggcuguccuggaacucccucuguagaccaggcuggccucgaacucagaaauccaccugccucugccucccaagugcugggauuaaaggcgugcaccaccacgcccggcuaaguuagcauuuucauaagcucuccucaucccaaaauggagagacuucagcaugagacugauuaucauauucaccaccccaugcuucagggucacuuucaggcaauggaggauacaugucugaggaggcuccacaaacgagccgagggagcugucaccagugucgggugugcuguuuugacuuucgguuuugccucuuaucaauuuuaagguuugaucauccaguuuacauucauucaaggaguuagccuucccucccuggugacugauauccccccagaucuuucccaagugcuuuaauaacagcacaaaguaaugcccaacugaccuagaauugaacaggaaucuuucccccuuauuauuguccccucuucaauauucuuucagauucugccucaugcuucuucauccuaaguuccugcagaaaaccaggaccacaccugugcuccuccuuucuuuuuaaaaaaugcaaaagcacaauauaacgccaaacguucccugcuuucugcuucauccugcucauuuacccaccugugagaaggcccacucuuaucucacagccagcuucaggucccuguuuagacaccacuaauuagugaugcgaaccugggagagaagggcuuaagaccaaggugagcugaagucccaugcaauagccaacuucauucagagcaucagacaagcuauacucugaggguuaggaagagucaccgggguaaauuauaaaaccccaagaacaagcggcacaugccaaaaccaugguuuuuccauagaggcauaugaguagcaacagcuaaagcaaacccauuccuuccuguuacaucugggagggugcaacagagagcaacauuccaagaacauuucuguguuucugaagaagcugaggccauagcucuugcuuuauuuuccuguaguuuucucacaagcacccaaaauuucccucucacaacuccauucucuuuucuucucucagaugcuacauuccaaacaguuuccccuccuucuuccaagucuuuccaucccaccuccccucuccccccccaccccaccccgauccaucaccaccuccauccuccuucaggaaaaagcaggccucccaggaauaucaaccaaacacaggauaacaaacugcaaugagaccaggagcauaccaucgcaucaagacuggacaaggcaacccaguaggaggaagagggacccacagauacgcaaaagggucagggacggccucuccccuacuguuaggauuuccagaagaacaccaagcuacuuagacauaacauauauacagaggaccuaggucagaccccuacaggcuccuugaucucugcgacuccccaugagacccagucaguugauucugugggccaugcucucuggguguguucccucugguuccuuuguugauccuuccuucucccccucuucugcagaacuccccaaacucugccucaaugcuuugcugugggacucugcaucugcugccauguucuucaucacuugcuggaugaggucucuccugucucuccaaugaccauuaugcuagguuccagucccagaauagccugcaggcaggacaaacuguaggccacagguuguguggcuggguuggugucucaaucgcuccauuugaggccuugccugguuacagaaguuggccauucaaguucugugucucacaguacuaggagucuuugcuaggguuacucucauagaugccauggaguuaccuuugcuagguaaucucggacauuccauggaguuuccauugcacuaggcuugcaccucaugccugaaauucccaauuccagaaauccagucauuucuccugcccuccucccuccuguugacaaccccacccauccccagcccacccaugaaaucuauuuucccuccagggagaucucccuguuacuuagccuuucugggucucugaacuguauauauauagcaugcuuccccuuuaccuuacagcuaauauccacuuaaaagugaguacacaccaugguuggucugucugggucuagguugcccaacucagaauaauuuuuuucuaguuccauccauuugccugcaaacuacacaaugugauucuuuuugacagcuaaguaauacuccauuguauaaaugcaccacauuuucuuuauccauucuuugguugagggacaucuaggucguucacaguuccuggcuauuaggaauaaagcuguuaugaacauaguugagcaaguguccuuggggauagcauggagaauccuauauaauuuuuucuccaccuguguauguguguguguguguguguguguguguguguguguguguguguguauguaugcaucuaggagugcuauaacugguucuugagguagguugauuuccaguuuucugagaaaccaccauauugacuuccaauguggauguauaaguuuacacuucuaccugcagggcagaaguauuccccuuggucuuaucacaaaguuuacuaaagcauaaaauuacaauaugcuaauuaccccagccuuaucauuacacaagauaaauuuguauaaaacauucaauuguaccccauaaauauuuaugguuaauauaugccaaaucaaacugaacaaaaccaauacagaaucaagucaaaauacaagaguuuuggccccaaagugugagggagggagaaugaaaccaaggcagucuuccaggucucuugacccaacaaagauguuucaaacuguaaagagcaaguggcauugaaugguccucuuggcuaauggagacacaaaacuuucaauuguuucuguggcuuagagaaggaaaacaagauauaugugaaaugagaauagaccaugugucacugucaguacuauuuacauacacaaggcaacccuuguuucuuaucccuucccaugugccaaccucccagcccagaagauggacaguaucaagacuucuucauuucucagucccgauggaccauuuccaccccacaggaggcugccagggaacucugugggauugagggaggagacaaagguggucaauuuacacagacuagccaccuuugauucucagccagagaaaccucuaggaaucuagagauuguuucuucauuucaacauuccagagaucucuggucagaaaacuaugggucuccagaaagaaugagaccagcauaugccaagcccuuauguucuaccugcagcaucaggaagaaaaugugggcagcaaaguuuaugucuccuuucacagagagagggagacggagagggagaaggagaaagggaaagagggagaaggagagggagagggagaaagggagaggggagagggagaggaagagggagaaagggagagggagggggagggaggagggaggagagggaggagagggaggagagggaggagagggaggagagggagagagagagagagagagagagagagagagagagagagagagagaagaaagauuaaaaccaggcacaaauuucaaggaccaaagcuagaguuccugggacaauagaucagccacccaaccccacucccugcacccuuguccugagcauuucugggaaggcaaguucuggugcgguugcccaaucuggaccauaagacagcucuggaaggggcauuuuguuugacaagcacaaugcacuuuuagauauuuuaguuaauugccaaccuguacaggucuggugguuucacacugacaaguugaaagcuagccuccuggcucccaccagcagagcuggcuggccugaguguaggcuccugcuguccuccccaguuaaucccaucagcccauggcuucccucaggacuucugaccccugccugccccugaagcaacagaccuguccaucugaagccuggacaggugucucucuauacauuuucuuacucagagagcuaugagaacagauucacccuugggaucgagccagaugaauuaaaaucugagcugggaaaugaccugggcucuaaaagaggcguaaagguccaaguucugaauccagggcugagaguagcuagggcaggggaaguuguaacaacggauuuucuucuagaugccccuugacugucuuauaaucuaucuguuagaucuaaccaaacucugauuuacuucacuccucagcucuacccccuuuugguagcaacuaacuuacuuaucuuucccuaaacagccuugaugucuuggcuuucugauucacugcuugggcuguucaauucucaauaucccacuuauuuuucccuccauccacugcaaccuguccccgucuaagaccucccuucucgaagcuggaauaguucagagccuguugucuuuuccuggcgagguggcagauacucacguuucaaguguuugccaaagcgccugaacucuggucaccaucuagaacuauuagaaagcucugcgggaccaccuugcagucagugagaaagaacaagccgacugccagcugacaauuccccuaaaaugcuccugggugccgccaaugcagcgaccagguuuaauacugagucagacagccccuccuuccccggaggagcagcagaugacaggcgggggcggugguaaagcugggaagaccacgcgcuuugcacugcagucucccagccuuggccacaggaaagacugugcagggacccaccacgccaaguuucaaaugucaaagaauccucugggaaccuugcuucuuuccuauucacuuggaacauacaacugaucgguuaacagcaguauuucuuucgaaaacaaacaaacaaacaaacaaaacaagacgaaugacccaaaccaggagcgaguagugugcaggugagcuaaccugcaucucaaauggaauggaccuuaugugcagccuccuccagcccggcucguaccugacuccuggcccuugaugggauguccugggcacugcgcgaugagcaacaagccuaugca

SEQ ID NO: 5979 - RNA, 30590 nt, Mus musculus
gggagauuugcuacugugaugcggagaaaguuggacguauguaaccgaggagguaacuaggcagaacuuaguauaaaugggcuaauggaguuacgagcuaguuaggagcaagccuaagcuaagaccaaaaguauuguaaguaaauaugagccuuuaugccauuauuugggaacugagguggacauagagaaagacccacaguugcguuuggugcucaaugugcggaagaaaauccaagcuuagagccuggggaaaguccugggugaaggcggcuuccuagccaaagagcagggaagaagcaggagaccgccagaggccgagugcuucuuuaagaagcccucacugagcagaaaaaccagauccacuaucagagccucggggcagagaaggucagagcagcuuuagacagacaccugggagccaggccacucggggugcaugcacauacuuagccacacuuagcacaccacagccaccacccaccccauccccaaggcacagccacacgcacaaucugacuauguugcguggcaggcuucgucucugcucauagcuucaacaguggaaaggcugaagucagcccacacuacuccagugagagucuuggugcuaacagaggucugagcaagcagccccgggggcuuacacaugugggcccaggacaggcaggcaccccauccuacacacucugugagcuacuggcaaagcgaacagaucaggucccugcacuccaaagcccagaagccucggcucuuccaguaaacuguuagacugagcugaacaggggguccaacuauuccuugugggcuuaagggcuggggcggggccaacagcgggcuugacugggagcugaaugucuggaacaggguuacccucagugggaggugcaagccgccgaacagcucaacagagacaacacgcggaagauaccuaucuaagcccagacagaagcccuugaacagguaaaaaaaauauuuggaauuaugcuucagugcuaaagaaagaaaagaaaaaaauaauuuaaaaauuaauaaaauaaaaucucuuugggaaggagagaguuagagauugaaaaagaaaaaaauucuguguuaagaaauggaaaacacaacaacacagggcaucuggauuccauauaauuuugauacgaucaucagcauacaaauaauuacacuuucaguaaugauggcaauuuuagauauccuguuuaagagagaugaaaauaaagcagacuuagagaaggaaagacugaaaaauuaaaggcuggaauggagguaauaggaaagagauugggaaauuccgauucgaaauaaaugaucuucagagguagccagaccaaagccuagagccaccuuguaacucuagcccuguuccagacauucagcuagcuagucaaauuuaauggcagccuauuaaauuucuagauaaagagacuuaugccgaguuaagaauauagaucuguuuaaugaugccauacuauagauuauauguuucaguuuguagaguuugaagaauuacaguauauacauauguuaaugcaucauacaauugaugcacacucaggauuuccauaugcuuuugccuuaaauucugagagaaaugauucugagagugcacauuuauuagagaugguggccaucuuggaaaugccuuuacagacugaagcugaugaugcuacugucuauguagcuauuagaauacagccauauuguagacauuaucacacagagcaugucacagguguaucuuacauugcuauaggucagucaguuaugaaaggaucuaccuaugcuuuaaagaacaugcuaauagacagaagagggacaugggcucuuaagcccauguggugguuugaaugaaaauggcccccauaggcucauagggguugguaguauugggagguguggcccuguuggaguaggucuggccuuagagcaagugugucacucaggcaugggcuuugggguuucagaugcucaagucaggcccagucucucucuuccugugccugggaaaccagauguagaacucucagccuccucuccagcaccaugucuacuuguguacaaccaugcuuccuucccaucauaaugauuauggauuaaaccucugaacuguaauccagcucaaauuaaauauuuuccuuuauaagaauugccacagucaugguaucucuucacagcaauaaaacccuaacuaagacacacagauaaacuuuucuuccccuacacuauaucaggacugugcuuauugccacauuaagguaacuagcacacugaacuggugauaagacacauggaguuugaugaaaauugguucuagguuuguggcaggaauguggaagaguuugaagguucauguuagagaagccugagaaugucaucaaugucuuucuuuauauauaauuuauuuauuuauguauuuaauauuuauuacuuuuuuucugugcauugcuguuuugccugucuguauauuuguaugagggugucaggaccccuggagcuggaguuacagaugguugugaaccacuaugugggugcuggaauauuaagcccagguccuuuggaagaguaguugguucucuuaaccacugagucacccccuugucccccaucauuaaugucuuaaugggacauucuggugaggaugcagaauacuguaauuccaguagucaucuagacaguaagcacugugcuaaugagacgucacaugagaacggagacucuauauaaacugggaagagaagccauguugcauuaugacaaagggcuuguguauauucugcacguguccugaaacuuugauggagguuuccaguucaaaagccaugaagcugcuggaugaacuucgaaggcaacguagccuucaggcuguagcaugguuaccgcagacuacuuuuaaccagguugacauugagaauuguaaacgaacaggcagaaugggaguugagagagcuacauuuuggccaggaaacaggaucaugcacaguuaaaggugcugagugagcaagaugugagcaaaagugcgaugcaggcgaagugacaggaccuguuaagggucagugacaugaaacagacacagcgcacugggacaauagcaaagggcccucagggcauccaggaaguggcaagaugucauccauccaaggcuccaggaugucacacuggaaaggagagcuggggagguguccugcuggacgugggcuucacggagaauguguuguuuguuuaguuggcugcuugguuuuacuuugcuuuccccaggcacgcagagggugcugcagccgugguccaaggggcccgacuauugcuugagauggcagcagaauguggcaucauccacauggcccugucauacauacagagagcuuggguaugagauuauggcggcuuucgaguuuugagaaaggccuauggagcaagaaaaucuguagcaggaauggauuccucagugaaagcaaagaaagaaaauggaauuaacaguuucuggaauuggaaagauauauggauuuuuaaaaaucaaaccaugaacuagguauggugguacauacauguaccaccaacauaggccauauaguaacaccccuuucucuuacacauacacagaaguaaauaaaaucauauaucugcauaaguauguauaugauucugaugaaaguguguucuaguucauuaguuaccagugaauuaaaaucaugaaaugcaguucuugcagaggaccugaguucaucucccaguauccaugucaaguggcucacaaccauugacaacuucagcuccaaggaaucuuuuggucuuugugggcccuacacuuauauacaccuacccccacacaauuauaugcacauaguuaaaaaaauaaaaguaaaagugucuuccuuauuuucugaauaacuguagcugaaauggaaagugucagucaguugguaaguaacugagguagucaugguaacguuuacauauuggaauauuauacagcagauaaaaggaacugaagguaugcauguguuaacgaagauauauuugaaaauguuaugaaaaugauaccaaaaggcaugugauggagugguguguguaugugugugugugugugugugugagagagagagagagagagagagagagagggagagagagagagagagagagagacccgaagcaugucuaaaaaguaguaauggggagucaaaacauaccauaauuucagaaauuuggaacugaaaaaagaauccugcagcuuuuugucuauuuggcuuccuuauuuuagaaggcagaaaaaaugguagcguuaacccagucuugcuucccucccccgcucucccugucagucccuuucccuucuuuccccuuuucccuccuugucugacucccuuccuccuuucccucccuuccucauuccuuccaucuguguaccaguuauuuagcuaacaguucagguugagaguuucacagcuauuuucugacguggauuuugcacauaacagucaagcacucguggacuggauuuugcacauaacagucaagcacucguggacuggaugggaacuccacccgccucaguauacgugcauccagcggcauucagugccuugcuauuugcucugcagcuguguagaccaagagcugcaccuuugacucucauuacugcccuuuauucccugacuacugugggcucuucggcucugggaacuucauggaagcacucuuuccuugccucugcugccagagaugcucugggugccgguggagaggaagggaagcuagccuccggguuguuuuaacaugcccacgugaagcugucccugcacguggcugcagaggacauccagaacagcagcuuccucaucuggccaccuuuguuaaacaccugccuuggucucuacugcucuggaaagcagggggaaggagguccaacuuacagagggugaccaggggccugcagaaaccagggcaagauucaugacaugcucauggaaagaaauacuggacuaauggccaaauugaaagcagacuaccuauauagauagaaauggcagcaacaauguccacugucagggccaaggguguccgagguaaugcaauguuugaugaagaaaggggggccaggccuuucccccaggacagggggagaaaacauggcaaacauccugcugagaaacuuccugacuguuuuucacgauggcauagagaugucauaucacuuauuaauaauguugagauguccuuuuagccuguguuuaaaaaggaacaaaauauugaccuuauauucauuauuagaauauugaaaaaaaaaagucccaguacaaauguuaacaugucauugacacacagaaaugcagaacuugcuggcaggacagacaaaaagauggcaagacagacucacaaccaggcucuaacccaacauaauuaagccuuagucuacauguugcuucuccauauacaagccguguuccaugucuguucauggagguuugcuuaugaaauguccaccauggguucgaguauuugaacacuugggcaccugguuguagcccuguuuaggaagguaaugaugcccucagcaggguagggccuugcuggaggaggugggcggagccuuggcgucauaaccuagccucacuucuucuucgcucuaugcuaccucacuggcuucuuguucuugcagcuacgccuucccugucaugcugcacugcaucguucucuacauuguuucuugccagguacuuugucccagcagugaggggagugauaaggcaccacacacuugugggaagagaauccgcaauguaggcagcauguccauuucucuuuguuaaaaugcaaugugaccuaggaacccuuuugguuugaucauaggauaucgcuaacuuugaggcuuccagagguaacauauuaugaguuaaggggaggaaacugagguggcccauguaugccuuucuagcucccggaaagccagaacacagaaaacauuccgggauuugcuaguuuggaucuagaauguaccccccacacaugugcugauggcuugguucucagccucuggcaguugggagccuguggaacuuuuaggaguuagagccuagugggaggacauuuagucacuagggggugugcuuuaggauauugggacaaggucccuuccucuuuuuguuuugguucccaguggccagaagugaucagcuuccccugccacacacuuccaacagggggcgcugauucaacacaggaccaaaggcaacaggacugagugaacauggacugaaaccccccauagccagcgaagggaaccgccacauuggcuugcacaugcgcaaaaugaagggaguugcaccucuccgcaccugcacgcaagucuguucaaaguggaccaaaaccgguauguaagaccucaacucaaagacccaauguaagaccugaccucugaccugcuacagaaaaugaggggaacacuuuuccauguagcuauagccaaagacuuucugaaacgcucucuuagcagcacagguaguaauuggcuaaaggaauuacaucaaauacaaacgcugcauggcaaagaaaccaucagcggcugaagagacagaauggggaaaucuuccuaauuauauaucagaaaugagccaccaccuggauucuauaaagagcuccaacaauauuacaaccaaaaaccaaacaauuaaaaacccugaaucauucagucacuuaaauggaccaauguguagagacauacaagugaugggcuggggagaccggucagugaccgagagagcuagccacucuagcaugagggccugagcuuggaucccuagcgcccaugugaaaugcucugcgcaucugcauaugacccuguagccucagcucugagcaaaaggugggggggggggggcagggaaaggaggcagaaacaggagaauuacugggccuugcuggcuccagaaagcuauccguucagugagagauugucucaagggaagaacauagccaauaauaaaagauggccuccacccauacauguaugcauguggauacucagcugcacacauacguguuuuaugcacguauaccacacacgcacauacacacaagccuuuaaaaggucauuuacaaaugaccaauagauaugugaaaacuguugagcucccacagucaucagggggaaauuaaacugcugugaaauuccaccucauccuggucggaauggcaaucagccagaaaaacaaaauggcagcacauucuggccaugauguggagagagaccguuacacgcuggacuucguacagggcuguaaaccggugcagccaguuuggaaaucaguauugaggguccucaaguacaacugccagaaggccuaacucuauacccaacugguucuaacucaacaugccacagagauaguugaacagccauacauauugccgcuuuauucacaguagcagagguguggcuagucuagauguuuauccaugguuggaaggguaauggacaugucagguauguucauggugcugguuuauucagcaggaguuugagagauggcucaguggguaagagcacuggcugcucuuccagcacaccugguuucaacucucagcaugcacguguugguucacaagucucuuaauuccaguuccaggggaucugaugcccucuucuggcuucugugggcacuccaugcaugugguacacagacacaaacacaggcaaaacacucauauauguugccuaagagcuacuguuacugugaugaaacaccccaaccaaagcaacuuggguagaaaauaguuuauuuggcuaaaaauuccagguaauaguucaucauuuagggaagucagggaaggaaccuagaggcacgaguugaugcagaggcuauagagggaugcuguuuacuggcuugcucaucauggcuugcucugccugacuucuuacaguaccuaggaccaccagccuggggaauugcaccacucacagugggcugggccugcccacaucaugaauuaagaaauugucuauagguuugcccacagccuaaucuuauggaggcaguuucucaguugagguuccuuccuucagauguccaucuauaguugacauaaaacuagccagaacacauauaaaauaaagauaaaggaaaaaaauauccucucuccugcccauaguguaacacacuacguuaagugaaauaauccauauucaaagaaaaauaucacauuuucuccauuaugcagaaucuugauucaacuuuauauaaguguguggauauguguauaugcacacacaugcacauauauguauagaacaugacuaaggggacugugagaggugaggcuuuaaaugcgggcguggauaagaaggagugauggggacaugguuguggacuaugagggcauuuugcucuugccgaugguuugcaggaccaugugggugucucuucacccccugaagcucugccuagagugucuguucccagccucuucuggacucugaugcucugcucucagauguacacacacauauacacauaucaaaacauaagugaaucuuaauaaaaagagagcguguggcaauauuucuuuaaagaaauauuuuuauuugaaaauaaacacaaucuuucuuccucuugaguugaccaucggauacucugucacagcagcagaaagaugacuaacgguuuuaagccugacuuauugaacauagaucuucggacagggaggcugaugggcaggcaguggcccuguuaagaaucuggguuggguggaauccuguguggugggugcugagugaagucugggcugaguucuggccucagugagccugauggacuuccugguaucuauuuaguucaguguacccgaaucaccuuggagccaaugacuucugugacucccaaugccucugaauaggaagagguucaugccaggagccuucccagcaccaauucucucugggaggcagcggugggugguguguugguggauuucaggggcaaaacuuaguuuuucgagagcuaaaauugcuuauuuuuuuauuauuacguauuuuccucaauuacauuuccaaugcuaucccaaaaguccccuaugcccucccccccacuucccuacccacccacucacauuauuuuggcccugguguuccccuguacuggggcauauaaaguuugcguguccaaugggccucuuuccagugauggccgacuaggccaucuuuugauacauaugcagcuagaguccagagcuccgggguacugguuaguucauaauguuguuccaccuauaggguugcagaucccuuuagcuccuuggguacuuucucuagcuccuccauugggagcccugugauccauccaauagcugacugugagcauccacuucuguguuugcuaggccccggcauagucucacaugagacucaguauccuguggccauuaacaccugcuguauagcagguaggggagggguggguaaagaaagaaauugauuacucuggcucuguguuccuuuacaugggagucccucacugauccgcaagggacucaguuuuguuaacucugugagccagagaaaaaggaaaaggaagucaugcaugcagaaagaaaaucuuuuaugcagauaauauauaacacgcauucacacacacacauucauauauacacacauaugcugauugggccugaccaccugucucaucaacuccacaaguguucaugcauacuuacauaugcauaccuacccuuacauaugcauauauacauuugguggauggaaucaaaagcucccaugaguaaguuccagugagcaagcacuaacauagaaaaaaaaccuaacucauucugggugaaaaagaaguuccaaccuuuauugcucacagaagaaaaaaaagcccauuaccuuuuuauugcugaaaguaauaaaagccucaaaucuauuggugaaaggaagaaaaagcuccucccuauuggcauucuuaguucuuaauacuauucucaggauuaaaugaucauaugguauuccaagcgucuuuacauuccaaaagguccuagcaaguuuaagacauaaauucaaaucauaaauucaauaagguguuauaccagaaaugcucacacguguuuucauuaagauuaguacauaacuaagcauucauuaucuacuagauccauaaguucauuauaagcuccgagcaguuuuuauauuacaagucagcaugguuuugucaaagagcaacucaucugccuugugucucauuaguuuugaggucaauauuuuaucuucuguccuugaaccuacaaugaauggucuauucccaguuuaugaccuucagucaucagauccugauuucauggcuagccuagacagaaacuuuacccugacuguaaauuuguuccaagucugcuuucuauccuacugaacuuagcccgugacaugugacacaugaaggucuacagagcccuaucuacagcucucauacuauagagggcucaaaacuaccuguauaaauuuaggaauucuauacaaucauuauucagaaucaugaaaucauccauuuaucuccauagcaucacuacaugauaguacaccuucauugaucugcagaaaaucugcccuauugguaggcugaugcccaggaaucauuaggcuauguaagaacaacaggaaaggcauaucaacaaaaagaaucaauccugagaugagaucucugaugacccuguaauucagagcuuacccauugcagccgugcaaaacaaugagccagcuccagaaaagucacuuguuuuagccaucuccuugauggcuccugaaagguucaugugaaggcaaaaauguacugagaagaaacuugacauaacuuuggagcugauaaaaucaggaacuucgaacaccuuuggauuguucuggagauacugauaaauucuuucucuucuuauaccugcaccagcaucucuggguucacuaacuguggguuaaaaguauuugaaaaacgaaauaucaucuaucuuaaauaugcacacacacuuuaaaaaaaaucauuauucccuaaacagcacagcacagccacuacuauguuuagcauuguaagugacucagagcugaauaaaguacacaagaguauugcauagguuuugugcaaauuuaaacagcuauauaugggaccuguggaauugggugucagaguggucccuggaauccaggcuccauagauaccgagggcaccuucgcucuuuagaagaagcauaaagcucagagucagcauuuccuguucuaagaguucaucucuggaaacacucccauaggaugaagcuaccugguagccguggguggagcuacaugguggccuugagacauaaaaauagagauaguugcaccauccugaaaccugagagagggaguuuuggggcugaagggugcaggauaaaagguaacauuaaggaaauguuaaauuugagaugcuucccaaacacccagugagggucccaaacauagaauuuuaauggaggugagggauauccaacugcaggagugaauuagcaagucuccagcaagugcauggcuuuuaaagccaaggauauaaacuccaggaaaaauaacugcuagggaagaauggguuggugugaggacauagagaggagggugacccagugacaaaggcuggcuacacguguuugcugggauaggaggaaacccaaggcauuugcugaaucauggaccaucgagaagacagacuggaggaaaggaaguggacagcugaguuucaucuuacagauggcuaccuugaauuuugagaacauggaggucaguucuaacacugacagagaaacuuuagagaaauggagaagccauugaccacacauggaacugcagaggaggugguggugagaccgggaagugugagcaggaggggcaguggcagcaugcuccagacuaggcugcagaacauuuccuccgaggcaguguggagcuugggaggagggcugcagggcugggacagacguagacagacuugguuuuaaauggaaaccuccacaucguugcuauguaacuaacaaucacccuguagagaagauauugauggcggaauaaaaagagacguaaauagaagaaggaaauucuucacguggcaaacacuuccugcuuacccuuuagcaggcaucuucaugggugcaaacgagagcaucaaugacccuggugugguugccacucacccuggcugucauucugagggauggguuuucagggaacggaauucuuguggugugucaagacagguagagaugugaguguuucuguauguagagaacagaaccguccuuugauagcaucuauuuucucagccaugugugaaguaggacacugguuaucuuugugggggaugggaaggaaaaguaugaagagcugacugggaaagucucauaaucgaaaugccugaguaacuaggucacguccauuggagauuuguggucaugaacuugaagugaaguaacuugaccaaccaugugacuuuccuuugucuuagucaguuggcucaagggcagccaggagcacuuuccccaagacaguugcuccaccagaggcccaauaagccaugggccaagagaccaggggcugaaaacucugagacuguaagucaaaaccagucucuacaccuuuccaagucucuucccucagguguuuugucagugagcagaaaaaagcuuuuaaaucagagucuuaaauuaugauaaaguuagacauguguccuuuccaugcaaaaaaaaaggaugcuuaaaugagaauggccguguguaugcuugugugcaugcgguacacauguacgcauauguguauguauaggccagaaaucgaugcuggguaucuuuccucugacuccacccaccucauuuucugagacaggguuucucucuagccuagaacucccugacgaggcuagucuggcuccagcaaguugcagggaucuaccugucuuuaugucuuuagugccuuuaagaacaaccaacaaacacacaaaaacauauguuguggggguggaacacuggccuucaugcuugcgaggcaagcgauuugccaacagagccuuuucccuggucccccaacacagguuuguuuuuguuuuugacagggucucgcuauggaugugugguugguuaaccuucaaugcuuauggcuucaggaacugagaagcaagggagugagagaguccaccaggcaauagccacagagguggauccaguagucagaguggcugaagacugcacugaugagggauagggagauggauccaccaaagccagugacaucagcccaucagagcucuugggaaagggcgcuaggguacaggagagcugggagggaggggcuaucgaugugaggaugcuugagauggggggggggagaugauuaugacggugccuacaauggcucaaagcuggagcugccgaggaaggaagcagcauaaagcacagugugggcuaauggcaccacccacagcuccuguucuguaugaccuuggaacugcgacugugaucuucauguggggaaggagcauuugcagguagaauuaagaaauaucuggacaccccaucagccugauugacagguggccuuuaguuuggauccugaauguuccucauaagccuguguguuucaagguuucgucucuagccuguggcacuauaugaagguggucaagucuuaggaugguauggucgaagggauuugggucacuaauuugaagggcauguugguaucacagucugucugucugucucugagucucuuugucucggucucugucuuuguuucuggcucgcacagucucucugucucauugucugucucuuugucugucucuagugucucugucuuucuaugucucuguccauguuucuuucugucugugucaccuuggcugccaugaugugaacaggcuuccugcacacaauccaucugugacacacugccucaccacaggccaaagcaggaggucaauagucaugaacugaagccccacccccuuggcggugauucuuucagguauuggucauagugacaggagguagcucacaguuucuaaauuaagacaguucagaaucugccccaaucccugccccugcuucagucuuugaagucacaguaucaccauguauccucaguuggccuuaaagucaucaucugucuguuuaagcuuucuacaugcugauauuauagcaucugacugcauaguaaagcccuuagcauaagaaggugagagggcaaggcccauaagagaaggccagugaaagagacaaguauuccucagccacaggccagauagugugggugagauucuccucaaguccccagcgggacugcacauaucucaacuuaagccuuccagccuauacaacugcgagagaacagauuuuuaagcaccuagucugagggaauuuuuuaauagcauuccccaagaaacuaacuggcuuccucacaugggugugaaaacauugagaagaaauguguuagccagaccaguaagaucagggcuuucuuuuuucuuuuuauuaaacuaauacaauuuacuuuaaaauauaaaacucaguauauguugagaauugagaguucuucuugguagauuuuuccuuugaugaguaugaagugcccuuccuuauccuuguucauaacuuuugcuugaaaguugauuuuauuugcuauuagaauggcuacuccagcuuauuucuugggaccguuugcuuggaaaauuguuuuucaaccuuuuacucugagguagugucugucuuugacacugaggugcauuuccuguaugcagcaaaaugguggguccuguuuacauauucagucuguuagucuaugucuuuuuauugggaaauugauauuaagagauacuaaggaauagugauuguuguuuccuguuauuuuuuauuuuauuuuuaugauugugugacuaucuucuuuuggauuuguuaaaagaauauuacuuucuugccuuuucuaggguguaguuucccuccuuguguuggcauguuccaucuauuauccuuuguagggcuguauuuguggaaaaauauuguauaaauuuguuuuuguuaugggauuuuuaauaauuagucagauuuauauaucaauaauucucaauucacaagaugcccacacaauaauuccagagccaauuguuaaugauacaaguugcccaccuacauuagacaaguuaucccaauuauucuaucccuaugugauauuguaguuaccuguggcuauuuaaggccauguggaaucugaauuguccuggucauccuccaucuuccuccuacuccucuccuguuuugcucccuaucucugcaacucuuagcucugcaacucuuagcucugccucccuuuucccuguccauucacaggcuucuuguuguauuaauauucaaauuaauuggacagggaaaaauucugcuacauaucacccuuucuguucaaauuaaaaaaaguuaaaaacccuuuucucucaaauauaaauugagcacaacuauuacuauccucucaaaucuguucucucauuguaaauaacuuuggcugccuaugagacuaucaguagucuuucaacccugucagaaaucugagaaugaccaacauugacugaaaauauauaggaagccuaacagcuuccagaagugagacaaacuguagggacagcugccuacuuauauagccccaguaagucaggaaauuggagcaucagucuucagccuucuggcccaggaucauuugacagaccuuugagaagcaggaauuauuaaggacuagcuuauucugucucugcagaacuaagcuguccuaaccuguaaauuguguccuuugaagaacaguacaggucugcaggagagauuggcaauuucuucccuguggccaccuagccacaauguaccaccucaccuggagguaagaugcucagcuacuucuuugaguccacaaaugggaagcuguuaggagcagauuugucucaauaacaagugaauaaauaacauuaaaugucaaauucuguggauuucugacuuuuuugaaaaccaacuaucuauguaaaguaaucuggacuguucucuguuaccuacucucaguuauuucucauuaaauaucuugaaagcaccccaacaacaaacucagagccaucaauuuguuaucugacccuuaacgcacaggcuuaaucaucucagaucaguuuauaauaacaauuauagaaggacugggucuaagccccauauuuuuaaaaauuuuguauaaauggaagaaauuuauaccaaugaaaaccuugauuuuguaucaaaauaaauucugucauaagaaauuaugacuucaacuuaguaacaauuauaaagauuucuuccaaaugagauuaugacuauacaaugaauucuagcuauuuccucccuguuccaaguaugaccauuucuaaauuagaaaggcaaccuuagaauaaccaccucaggccccaaagcccagggaacugggacgaugacucuucauaacuucuucaagcugaauaugggcguugagauauuuaugaagggagggggaguagggaaaugggggaguugacugguuugaagaaaaccauaccaacgaucauauuagucucuggugucuguguccugacuggaucuggcugaaaguccaagacacgaggaguucaggcaggucaguuaagcacaucugacaaugagacucuccaagccuauauuuucuguaauauacaaaucucaaaacaaaauuuuaguaucaucaagauaacuuuuuuguuugauucucuggaaucuaguucucagggggguuucccucuaucaaaucugauccauauuacucuggaagguguauacacacuaaucaccuuuucuagaaaugcaaagauaaaaccuuucccccaaucagcauauccuugagccaguaaccuuuauauugaccucuuuccagaggaauaauauaaccacaaaauucaaaaucacacccuauuuugccaugcaugauaauaacccaaaauucccauggagcccacguuagacagaauuugaguauccuguaggccuguuagagcaauauaucuuuauaccaucuuuaaagcaauuaauucaaacuuucacuaguaucugcuuauaggaagcagguaguauuuacuuguuaaguucucugcuuagagcagccaucuuauuauaccaucuaucugguuggcucucugccuggagccacagacauuauuaaucaauaccugaucauagguaauuaucacugcucucucuacuuggacucagugacuaauuuuuccuauucuaguucugaaccucaggcaaaauuccccacgugauuuggacaaaaucuguauauaaauauuuccuaaaagcaaaucaucccaauuuuauaaauucacaguucaaucaaucucugccccaagaaguaagaggcaucuauccuccuuuuccagacucagagcagccugcacucccccacagcaggggaccucagagccugcuuucuuugcuucaaggucucugcacuagaguccaugugacucaucgcagcacuacccagcuacucacuuaaaaaauaaaacucuaacucucaggcuaauaaucuuaaguuucuaguggauucuugcccaacacauugguuugccaccuguugcagaaaauaauagauaagaacggcaaauucccacgcuacacccggcuacucucuggccacaguccugccgccucuaggcuaggcucugugcagcaaucuccccaccucugguuugccugccucagagcugccugaaccuucucagccauccacccacuggggucugcagucccaaauuccaguaacccaguaaaucaaaacucuagaagcuuauaauuaaucagucagauuuauauaucaauaaauucucaauucacaagauggccacacaauaauuccagagccaauuguuaaugauacaagcugcccaccuacauuagacaaguuaucccaauuauucuaccccuaugugauauuguaguuaccuguggcuauucaaggccacgcggaaucugaaucuguacauccuccaucuuccaccuacuccggcuugcuugauuuuaauacagggaccgacugacucuggcuggucugagugugacaagcaugguucuggcaaggccuuguccuuucccccccccauucccucuaccuugcagggcauggcagauugcauggucucugguaggaaaacagagcagggacugugcugacaguauugugggauagacauuacccggggagaugacuuaugucuacucaccccagguuaggaugcucagauagaucauagaaauacuuucagccaaauugaacuugaugaaccagugagcuuccuuccuuccuuccuuccuuccuuccuuccuuccuuccuuccuuccuuccuuccuuccuuccuuccuuccuuccauucguuuuuugagacaggguuucucuguauagcccuggcuguccuggaacucacuuuguagaccaggcuggccucgaacucaggaauccgccugcuucugccucccaagugcuaggauuaaaggugugcgccaccacgcccggcucugccagugaguuuucuuuggggguuauuaacagaaauaucauggguggcucaaagcagccuaucacugaaaagccuaagggaacaugggugacgauggacgagagcugcaaaccuggagcccuugcgggaagccgggcacggaagagacuccuuuccucccuuugucugccagucaccucccuagcaguucuuuacagcacccauaacccggagaaagaaccuggugauguuguguuuagguuucauagacaugugaaauuuguuuaccugcugggucucacagacccaacugccuccugaaggggaugcuucuguccagaagaaaucuccaugccaggaggcagaagcuugggcuggggguaugguggucaggcacuuuggcuuccaugggucaggcauuucaucuguuuccaagggccagaguuucuuuccacuauucuuguucuaggccaacauuuaaaaacaaauucaaaaucuuacaguuuuuaauaaaagucuauaugcuucacaucccaccuuauuuuagagugguuucccugggcauuuuaaaagcuuaaauaucgcuuauaaacgcaucaauuugaagguauccuuuugguaaacuaacuguuguaucuucuccuuuuaaauguguuaauuuuaggaugguugggagagguuuuuuaaaguaugcacaguaugucuauuguuccgagaaauguaggacuuauuuuguaucugaaaagccuuucugagaauuccuggaaagcaggagccccucauaguccuacaaauaagcacaaagcugucuggcuugcuuucagcgaugguuagccuuuguuugcuaacauuacugggcagggaagugacggagcugauguacccacagcuugcaugcauuuaaguuagcguugaugaaauugcugauauuuuuuuaacaccugcaaaaagaaaacaacuucccuuuggguucccaaagaucaguggaugugugcccuugucucaguacuuugaagaaaaugaauuuaucauaguugguuuuguuccaugaaccaugacuuuguagggacuagugauuuagugguuguggcuuuugugaugugggugcugggaacugagcaguuugcaagaacagugccugcuuuuaacuccucuccagcuccugcauuugguauuucaacugaaucugggcaucaguauacauuuacuauuugaucuucuaucucucuuuaucccuuuucuuacaugugacacagacauuuccugcccaguuguauuuucuagugcuagucucuguucacaaauugauuucauuaaacauuauuugaauagaaaucuuaucaagagacaaaugaacauauccaugcaagauaguuugaaaucauuccagcagaacuagugaggucuccuaguauuggaguacuugcccagugugugcaggccuuaauaagaaagacauaaucauuaaaaauaauacugguuaguaaaagauauuuugaagugccuauuucaguuccagucacacguggaguaacacuugauuccaauuaucgucuaggcacauauuuaaaacucauaauguuccugaaaaaagaauuuauuuucccauauauuccuuauaacuuauugaacuuugcaagaaaauguaucaacuuccagggacagaaaggguagaauguguggccaauaggcugagggaugguagucagagaacagucuagaaagagcaggucauucucugauauggcaacagaggaucaugacacccuuguuccccucaggguuuaaaaucagagggccacugcguuuguaagugcagaauucugcccuuuaugugauuggguguggaccauccauugcagaauuauuuuguugcuacucacaagcuuaaaaauuuuuauagccuggcacagaugugccuguccauuccaaaaauaggauucacugggcagaacuuauucuuugugucauauacuucgagauuucucagaagacugucauaucaggcagaaucuguggguagcaacuaccacugauuaccagagccacccguguaccaaaaccuccuacaugggggcuauaaauguagagucuagucagagcauggcauuaccuagccagagcagaggaagcccuucagucuguccuuccaaggaagcccuucagucuguccuucuggaguauuucuuccaauauacaccacgguuuuaccuuucagaacaacuccuggaauuuauguaccagcugccugcuuuugccaacuugacgauguuggugagacaggagcucuguacugugaugguguucacgguggaaagagcuggaaccauuguguuaaacgauggagaagaggucagcagggguuucugccacuuagaaagccugagggucagcgacacccagagaaaaccaccuuccuguuuuucccucuugaaaacucaucaguaaugaguuugaauagauggacacugauguccacgcauuuauucauagcauccaaccccgcucuucuauuucucaugugucaccauuucacgcaguguugcuggggauuuugcuuucgcuucgauaauggaaacugaacccauacuaggccugggggcccuucacgugcuaggcagcugcuucacccugagguacucugccauccugagacuuugcaauguauuagcuuuuuagucuuugcaacauacaucauagguguacugccgcuuaccagaacaaaaugauguaugcauugagaccauggugacuauuuuauuuucuuuacauauauagaggaacauguauuucuuugauacguacacauauacacauacacauacacacacauacuacuuugauauauguauauauuucuuugauauauauagaggaauuuuuuucaugugacauuuuagagaauaugcauuuuuagaaaugauuuuacucuaugcugggccuaaaauauguggauaucuucuauaauuuauugcuuguuugcucaacaguuaggauucuucagguaauuuguuccgucuguaagguaggugaucccagaggcuguuagguugcucuagcauuuaagaggaucacagcauuaccuucuacuuugucucagguuuuuuuuuuucuuuuuuucuuuuuuuuuuuuuugcucagcugaauucgugcucaaugauucucaugguuccgugauggugcugaauccagacgggaaagcagagugcugugcaugggaggcagcuuuggcauuucacauaccauggacagagaauacguggagggagucacgagggcgaggugggugacugccugguaugagacgugugacagugccgaucugagucuuaguaaaaaaacaacuugggaccaggugugccgccagcauuacucaggauugcugugaccucguggccucgugucuuccauaggaauguuaagacuguuuuguauuucugugaagaacugcccuggaauuuugauuggaguugcauugaaucuacagauggauugccuuugguggcauggccaaugucauaauacggauucuuccagucccagggcaucuuucugucuccauugucuucaauuuauuucuuuggugucuuaaagcuuucaucaaaggaaucuuuuauaucuuugguuaaguuaaauuaaaaguugcuuguguguguguuuguuaggguuauguguugauguuuuuguuuguuuuguuguuuuuggcccuauggauggaauuauuucuuuuguuucuuuuuuagugaguuuguuacugguauaggaaggccaaauuuugucuauguauuaauuuuguauccaaccacuuuccugagugcuuaugaguuuuaaugguuuucuagcggacucuuuaaggccuuuaaucuauagacuugugucauuacagauagagacuucuuucuuugcuguucguaccccugugauuugcauuucuugucuucuugcuuuggcuaagacuuccaguaacuguauuguauaaaaucagagaaaguaggugcuguugucuuguugguaauuuuacuggagauguuuggcuuucugcaucaaauauaauauggucuguagguuugucauauacaguuuuucuuaugaugagauuuguugcuucuauucugagauauuuuuaaauaauauuauuaaugaaaauaauuuucccucccccaaguucucccagaucuucacaaccuccuuaccucucaacucuaugcccugucauugcccuaucuuucucucucucuuuagaaauaaaccaaucacaaaccccuaaaaacagaaaccauaauauacaagcaaagaccaguaaugcaugcccccuccugcaagccaaggaaaguaagucuuuucuuugaaggguuuugucaagaagugucucuguuuaucaagauggccacugauuucugucugggagcccugcacugcaggacuuuaaagagaguucauggacggcagagaagagugugccuucugcagcgucgcauggaacauccugugcugguuagguccaguugauccucgaugucauuuaagucagauguuugcauauuuuacaccuggaugacuagucaccugaugauguuguauuaaaauuugccacuuugauuucacugggguaaaucuguaacuuuuuucuguaauauuuccuuugugaaauucggugcacaaggcucaaucaguuuacaauuaaaaucguauucucuucuguccucuugauggauugcucucuuaaccagcaugagggaccuuuacuucuucuuccuaguuguggcuucaagucccuuuugccauauaugaaaacagcagcuccuacuugucuucuagucccauuugucuagaguuaauuuuucuauguuuucacccuaaaguaguucuuaucuuuuuugaugaggcgaguuucuaggaaacaacagauagaugaggccuccccuuuaguucaugaugcaggucucuaucuuuggggcaagaaacugagaaccuuaauauuuggaguuccugaaagguuuaugcuguguccugucauguugucaauugugcaccauuuaguuguuuccuauuccucccuugccuaagcaucacuggucccaaguaugugaguaaaaacaauuauuaacauucuguacacauuaacuaaugguggaaauuaauaugguggcaguuacuccuuaaccaguuaguacccccaaguaaccagagaccuuuugauacuucaaagcuuaggccuuagcagggcagacucuaaagcaggccacuuagccguccagccacgugguuagagauaccuuccagcccuguagacauguccaucccuucucaugucuccuggugaaaggcccuuccucuuucuucuucccagaauuccucacuccuucacaggaaguccugccuaucucucucuacugccaaauuauaggcuuuagacugaacaaguaacugggggagugaaguuugugcaacaaaagcuaguguaugugagaauucucuugucuuggggugaccagaucuagggguacagaauuuagcguuugaacacguaggagcaccagacuaaccccaacagauguguuugucuuucucuucagucugaagaauuccuuaaauaucuuuguagagcuagcuuaguggccacgaacuaauuaagccuguuuuucucauuaaagguuuuccuuucucccucaguuggcaccgacagcuuuggugggcagaguaaccuaggcuggcaauugucuuuuaaaaacuugagauauauuauucagugcccuccuggcuucuacaguuucuguugcgaacccugugguuacucugacgggccugacuuucugcauaccauaguuacuccuucuacugcuguguaucaauauuucuauccauagcuacauguugguugaguauucggugagcugauaacagugaggggaaagucuucuuugcucuugucugguuaguguucuaaaugcauguguaucuggaggagcacuuccuugucuguuaggaaacgugguuuuaugcuucuagaaaggaauuccuuccuucuuuuauacccacaauuguuagauuagcucuucucauggugucccaaaugucuugaaaacacagcccgaaucuuuuuuuuuucccaagacaagguuucucugugaagcccuggcuguccuggaacucacucuguagaccagguuguccucgaacucagaaauccgccugccucugccucccgagugcuaggauuaaaggcgugcgucaccauugcccggccagccggaaucuuuuaaucauucaucuuuguccucauugagaugcucauauucuccaacacugucaagucuacagguuggcgggacuucacucggagauuuuguguuugacuuuuugugauuuucacucauuucuaguaguuugguuuuucuuuaguacuucuaucucuguaaaaacauuaagaugcguucucucaaguucuuuacggaacuguuugccucugugaggucuuugaacuuaaaaaucuaguuccugucugccacaggcugucucuggaggagucaggucccuuggaacuggaguuacagacaguugugagcugccaugcgggugcugagaauugaacucagaucuuuuggaagagcagccagugcuuuuaaccacugagccaucucuccagccccacucuggaggagucaggcugccuggcuuuuccuuugugguuugaguuaaaguucugcaucuggagcuauuucacaaguugaauuuguucauuuuuuauuucagcuuacucuaucaaagagagcauucacagguucauugggcacugcuuuguuaucauuaccagagcuacagguagggcuggagccugcuaacugcucagucuccacuaagacagcaggacuggaaggagagucccaggcugcacugugcucagaggggaaagggcagggcugugugucccucacccaugcagucaucacuuuggugacggguggggcuggagccucccaggugcccugcugucaccugguaaugagcaggacuaggccuaguaacuagcccaaguaaccaaggaaaaaggaaaacgcucccacuaaagucauccuuuauaggaagcagcuccauauguccauguuagaaauucguucaagaauacuuuugucuucuguuuggaucugacuaauuugugacugaggaaaugccgaauaucuggcuagauacuaaagauuucaaauugaauuucuucuaauuucccugagccauuagugaagacuaauuuuaguauauuuaugcucaaaaggcauuuucuuucauacacuacuuauucaucuuaaccuagacauguauuuuagaacauaaaugagaaaaaugauuuaauuguauuucaaaacuaaauuuaaaaaaggaccaugugagauuauuugaagauaaaacuuuucuuaaucuguaaaaauucaagaaacauuuuugcuguauuuuaaaaauuaaugaaaauaucuuugagauaagaaaggaaauacuacauauuugaagaccguccacacaccuagggucagcacuggacaaaugaggguuuuuauaaucuaguugaacuguuuauauuuccuguggcuuuugaauuuuuaacuuucuucuaaauuaauagaagaauuagugagcugguaucagccaaguuacaggagacaccggcaaccccuacauuguguuucucuagcuaaauagugacuacaggacacagacacagagcacuguauuuagaaaaauuaacacuacccauaguuuccauugaucagaaguaagaggggaucacuugaagcucaaugggagggacugagcuuucuauuaaucucagggaggacucugcaugagggcagauauccuguguguguagcagugucuccgccagcuugugacuuuguuuuccacggcacuguaaaguauaagaagccuaugagaaauagacuugggccacaguagucacuggacagcccucccgaaucuaucucugugucuuccuucugucauuccuaucguuaacccucacugcccccucaggggacucugacuccugccagcaggcccagcacauaaaaguaaaaaagaaauuucauguaccccauaugcaaacuagaguagauuacugagaaauuucaaguggugauuucuauuugcuaggauagcugcucuuguuuccacauaagccuuugguuauuuuauaaaguaagugauguauauaauuuaucuuuagcuuaaaacaaaacaaaacaaaacaaaaaacccaaaaacucuuaagugccagguaugguggccaguggguucauuucaacaauuuuagggugcugagguaggaugaaccccaggagcuugagaccaacuuggucuauagaguucucauuccugucucagggaaauaaaaagcacgggagcuggggcauuggcuuauugcagaagggcacuugccaugccagcaugaguucaccaucccaucacccauguaaaaaguuggguguggucaugugcaccuguaaccccagcacaggaggaggguggguuggaaacagaaagaucccuggggcuugccgaccaccaaccuagcagauaaacagcaaucuccaguucacugagagaccuugucucaagaggauaaagugcagagugaugaaggaacacacaugcccuccuguggcuuccacagcccgugcgcacacucgcacaaaccuggccuuugcguguccacaagcuauggaguaguaccauggaguaauaacuacuugauaacauccugcuguuaacuuuuucucuuaagagcaaggauuaucuuaauucaaauuaauaacagucugaaauauaacgaauaccugacuucaucugugaccuucuuuaaaguaggagaguuacuaaaauugcuguccaugucugcgauuaucagauuuacuccaguauacagacguuugaaucucuucaucucuaaaacccacuaauuuuuauauauuuuaauauuuuuuaaauauuuuuuuauauuuuaacauuuucaaaaugucugaagccaaaugguaaauuucuauucgguuugcccugggauugucuuucucuuuaaccucaguuuucuaacuaaaggaugcaagagagcguuugaaacuuuagauaguaagauuuuuuaauauaaauuauaaacuaaaaaauaugaaccaaggaggaaaugcuuuaagcagagaagucugauuaaggugcauuccugcauugauuaagaaagcaggagaaaggcaggggggugucaguauuaaauaauuaaaaccgaguuguuagacagguaggucuuucccaagccccgcaucauuagcacgacucacauuuuauccuaguuugucugcauugcccaguaaugaaccaaguagaaaagaacaugcaaagagucgaggaagaaggagagguuguaacggugaaggagcacugagaacuugaaaggacuggaacggggaagaguuacaucgucaucaaggcaggguaagaggcgccccugccaagggguagcaagcaagcucugcuggucaguuucuccugacauuccuuuuuucccccuuuuucuucuauguauuuuagguuagcauacacaguagcggguuucauugugguauuugcauacauagguauuaucaaacuccacucucauuuauucccuugccgacagaauacgacugaguggaaaguacagucugucucaccagaguucuuccuucuccaagccugcaucugagcugaagagauaacccgugugcucucgauguugcuuugcuuuggugaaacuugaacccaaggccuauggccugauuaaccaagcacucucagggaagccagucacacaaauaaccugguucuguuuuccuucuaguuuucuuuggaauaugucauuguucuugaguuuuacaugguauaggucuaagccauuacuuuuaaaccuguuuugucuaccugggaugguaaccccuuugcccucugucacuucuguucccagccccaacacuaauaaauacuuuuuuagggggucagagguugggcgaccucugcauuagcaucgauuaaccgcaguggaggacaucacucugugccugucaggggacgggacauuuaguuucuguccugucuggagaaguauguaaaagccaaucaguaggauucuguguccuuguuccuagaguuucacucagagaaggcaucugccugccaaaguggggagaggagacgcuacagagcaaaugucagggucuuauuuuuaucagguucuuaaaaggaucccaauacugccaguauugaccagccauuaggucacgguuuagacccauaccauguaaaacucaagaacaauggcauauuccaaauaaaauagaaggaaaaaaccaaacaaguuauuugugugacuaauuucccugagagggcuugguuggcaaggucucagguucaaguuucaccacuguauaaucaaagcaacauuuagagcacacggguugucucuuggacuugguugcaggcuuggagaaggaagaacucuggugagacaggcuguguaccuuccacuccaagaugccugcuugcuauucugacaaauuggggugauaccucccauuucccuagaugaguuucaugaaaaucuagauguucaaaaauuaaaaacuugaggcaggagagauaacuuagcaguuaggagcaauuguuggucuugcagaggaucugguuucuguuucuagcacccacaugauggaucguaacgaucuaguuccaggagauccuaugcuuccaucuucuugagagcacuaggcacacaugugguacacauacaugcaggcaggcaggcaggcaggcaggcaggcaaaauacucacauguaaaacaaacaaacaaacaagcaaacacuuuaaaagcugcuuuaagaucaaauagaggaaaauaaauuguuuuauuuucccaguuugugugugugugugugugugugugugugugauguaucuguauggccacaugugcuacaguauaugguggucagaagacccagaucucucaguuugcaugaaagugucucugccugcuaagccguuuugccagcucuguuacuaauccuccugggcaguaaauacgcaaacuucacuugagcuaguguagacccagcaaucgauagggccccucuucacugggaaacugaguaaugaccuugaguugauguuuauuuaaucugguaaacagcucucuucugucaccuuugacaaacaagcuaaaaguauuucaaugguagaaaaaauacagagcuagagaacuggcacaaaggaaucuccugugugguuugcucaguuccucuuaccugcugaguugguggcugucaccuggugguacugugagcuggugacacugaacugguggcuggggcaguaucuguaccacccaugcaggaugagaagaacucuuucgccauucccuuaguucucucccaacuccacccuaccccaccacaagaacuagcaauuuuccucaaggagacccacaggcuugcugugcagcugacaucugauggguuucugguucuuucagguacuauuugaaaaacaaggcaacuggaagacuuugcucagaggaagguacccaggagcugcugccaaagagccaaaucucgcuucuucagcucagcaccguggaggucgccaugcagcucuccacgaguuccaauguugaauucuuccacaacauugagccuaaugaauacauaggugauuuauuuaaacucaaauaaaaaaccagcuuagccaaccugaagaaacuugaggaagucuuuaaccaggaaacauuuggguggcuucugaaauccugggagagacaacuagcugaaagagaaugaagaucuucaagccuucauuaagauugccucgcacuguagggaaugcaagaauuuuaacuccauguuugcagucaucagguaagaggaccuguccuaugagaagcugacucuacagauuuaacuauauauauauacacuaguuuuggaauacuauauaauuauagaaauauugacuuca

SEQ ID NO: 5980 - RNA, 10020 nt, Mus musculus
agagagucucuauaaggaccuuuauuuaacuccacauuuuuuuccuuaugggguagagaaagaugcccacacccacaagguuucacagucccagguuuuucagaaaauaaacaaagaaaggccaccugucuucauugaguaucaggguguuauuccgcggugggccacgguugcuggaagcuagggucuccuggggcaaagucaggaaguaaguuuggagcugacauugaaugguugggguuccagugcuccccucuuggaaacagggaauccuccugugacaucauuggcagugcguucccuugaagcugugcagaaggaacagcgacgccauaaucccaaggcugguuccugggaguuugaggguacacagaaaguggaggguuaccagccccaucaucgagaggaccugagaggaagaagaaagauaaucuucauaagcagggcgaccuuacucucccuggaucaugcuaagugauggucuguucugugugucaggcuucacccuaaacaugcccaguucccauccccuuggggugacagaagaaugcagacaaacacagaggacagacauuuacuuuugcuaugugcaauguaggccugugggaauggggauucccacacugugugcucugcuccauccucaugaaggagaggucagcugauacugcucucuauagcacuugaaagggcaaugaguacaaaauagacuaaccugggacauggcuucccuggggacuggagcccaggauccuguacagggccucagcauaaggagaaaacaaggguucaaucccuggucuuucauuacagagaguccugugcagaucucgcaggcucagcaguaggucgaaacagcuuucccagcucuucuucaggcccugcugguaaaggcgccugcaaagagcccuggucuucuuguggaucuuccugcccggguggcccauuuccuguucaacuacuucccacuccagcaggaagacccugaucucagagucaguccaugagcuuccgguagaaccugcaaaggauggagggcugugcugagugccuuugaugccuuguacaugcacaucugaacuuuuuguagggaccugucccgcacucugacaaauugaaaguggccucauucggucaccaggggauuaaucacgugcuagcaagaguagaauuaucaucuacuuugcucuuaauagcaugcaguaaccuuacuugcauguaaguuuuggcaucuuuaguuguagaaaauauauuacagaauaaaagggguugucacaggacaagugcuacuuggggacauuaucccugcguagacucaagccuccucccuccaggggagugcucacagcuaccgagacuuuggguuugcuauaaaaaguacagaaaccugagacaacugaguucaagucuauacauacagcuguuuacaucuggggucucuuauaagcccauacgucucagaaaaaaacacauaugauagaagauuuuguuuuucucagaguugccucugaauaccugagggccuuuguccucccugcuucccacuccaucccacauuggauccuucaguguuucucaagcuuucaccuugguuugcuucugucuguucagaaugaauaaugaaaauauuaaaaccguuuucauucaacaagaaucugucucucggcugugaacagauuccgggaacagccucuugcagcauugcaaagacaacggacucuuccuuccucaccuacagaugccgguucauucucaccuaaggggaaaccuugguggugaaguguaacuaggggaaacauauuuggauauuggaguugcacccuguuggauugcaagcuaaagaccaaagccccucuccuuugagaagaccucagccacugccuccauuucacucucuucucaauuacuuuguuuuccuagugcuaggaauccauacuagcauccccuagaaaguccagcuuugcuacuuaucagaugaaccauaugacaaauaaacagaaaaaccacaacaagggcgcuuggcacguggcuaugccagcucuuucccaagagauggaggcaggauaagauauucagggucauuuuggcuauagagugggaugggggcuagccuuggaucuuugagaugcugccuuaacaaagggaaaaccauagaggccaaaaacaaggagaggggcaacuucaguaccuuuucaaauuggggacaugugcucauucauguucaagguaguuaaccauguuuugccaagguggacaaugaacacagucccaacacuuuccaugaggcuuacuaugagcaucaaacgaugucaugccagacauacacuuuugagcuauaaaguuucugagaugaauugaaaggcaaauuuuccagcaaucccccagaaaacacaagcauugaaucucccuuuccaauuaaccugcauuuucuucccacagcuuucaguauguuccaccgagucuuagaacuggggcuccauguguucuggugagugauacagggucuggaguguguagguagaccuguguucacuucccuggacuuccucaagucugacagccaggugcagacccaguuguuuauaaagcucuaggaugugacugaaucagacccagccuaccuggauguguaggguggaucagcaaagguuaacuaggacccguuaaucacaucucaggaggcugacccauauuucuggaacucuuagauacauagcaaggcucaguaucaauugaaaauauaaaaugcaugaaugaaaacaaggucaaguaauuaaaauuucuuuuuguguuagggucucguuacauugcccuggccauccugaaacucacuauuuagaccaagguguccaggacaucauacuaaucuacaugcuucugguuuccugucccaaguucugggcuuaaaaguauuugccaucaaccuggucaauuugauaguuugacacauuugcuaaauauuuuagcuucaucuaaacuuugauugaaaaccugaaacauacaaaaugucuuuaguccauuauuuuguaacuaagaaucaucucuaagauuguagcuaagccauaauaauuggggaaguggugucuggcaacaucuucacuaagaagcauaaagaucaaaacguggagucugggaaucccaggaaaguacagccuguggggaaggcaggugugguggagcaguggguccuccugugagagaggccacccuggaucugcuaacucugggccuggcacugagcccugcugucuuucaucucaucucaguucuauugacggccugaaugccuguguccugaacccuucccugcucuucaaaagcacccaguugccccuucuagcaggugugaugggaacaucuugucacuguguucacuuuaacacaaaggaaacugagggacagcaugagcucaacggagguccaugucuuuaauuuucaaggguagaaaaaaacaaucccucauucuguuccuuguuagguuuucuugguuugaguuuguugggaaauaucuuacauaacccaggcuauccuguaacccacucuguagacagaggugaccaccaacuucugcccuuccugucuugaucucccaguugcugggguuacagccaggagucacgcacucauaucaugugaucaugcggaggaaaaaagccacuggucauauggaacagcaagguuggcgcucucuaagcaacuuuaauauggauuuuaagcccugagacaggagaaagucaauuaggaagacagaguguuaacuccucaaaggauagaggcaucuuuucuuuucucuuuucucuucucuguucuuugcauuccuuuggagacccacacucucacuuuaugauacuaagcaauuguguggccugcguuguagucuaacugugaacaagucguacuggugaggucccugaguccuaaaguuucaaaauaauucuccuggcccagcuauuuauccaucuuuuucuucuuugugucuuuuuauguuccuuuaaacuacccugucuuuucacuuugagaacaggacacugaaccaacuaagcagggcacauaugagcccauguuucuaaagcagaaagugagagccuacaugguucugcaucagguccucuguauauauuuguggcucuuagcuugauguuuuugcauuacuucuuuuuuuuuucuuuuuuaaaauauuuauuuauuuuauguauaugacuacacuguugcuguauucagacacaccagaagagggcaucagaucccauuacagaugguugugagucaccaugugguugcugggaauugaacuuaggaccucugggagagcaguuguugcucuuaaccgaugagccauugcacccaggugcaaucuuucuugggagacccaaagagucuaaggugccaguuccucaugaaguuguccuugaacaucccaggggucugaauauacccuggaaaaacuguaaguccaacaagaaaaugaaacugagguccagauguguggagugcuguuccaacgaugucccaauacaaacucuugcuuugaggcugcccucaaacuccugggcucaagugaucuugugccagccuuccaggcauuuggggcaacaacuggcuggaauuuagccauuuuaaaauguguggcucaguagcauuguguaaagccacauugccuugcacccaucccuaucauacauacaucccuaggacaguuuccucuucccaaacuacaauucuaccuuuugcauuacuucuaacucugggagcugauguaucuuuuacucauuugccugcucuugggacuccucuuggguuaccuuguccaaccuuaucuuuaguuuuguuucucugccuguuuuacaugguuaguaacaaggcucacugaagucuguccuuuucugaagaaccaaggagacucuauugaggguagagggcaugugggagugggagggaacugaguagaguggagggagggaguaaacuauguucaggauuuauuguauaagagaaucuauuuuuaauuaaaaaaauauuacuuuguccagcagccccugcccacccuuuuccccuucuuucuuucaugacccagguucucagcuauguuggcaaucccucuaccaguugagcuacauagucauuuggcaucuuuuuaaucauuagcacagggaacauugaucugagcuauuccuugguuuaagcugaacaacugagaucuuuagucaaucugaauaggaagcaucuguagaucagaaaugaaguaucucuuguuuuacagaugaagccaagaguuaauucccuaauucaugcacugguaugugacuaauagauuccuacugagugaaaauaguuuuaaugcuuuauuuauuuguuuguuuauuuauuuuacuaaacaacagcagguuaaguuggagauugagauguaaacagcuguggugaugucagaacuguacucaguagucuggcaucucugucuagucucauauguauagguucagaggcugugaaagacucagagggagggaggcuggaugucauccccacuuuaggacucuucucuuagacaaccacaaaauccugucuuuucuuuucucugcucuucuuccuucagagacacauacucuccuuuuaucauacuaagcaauugucuggcuagucagaaucccagggcuuccuagagaguuuuaguaauccuuccaaggugaauaagaccaggucugccuggucaggugcagggaggguccaugagaagugcucagaugugugugauguaaaaauguucucaauucauuccucuguucuuuccaggucuuuccauuagucaugggguggcugagaaauuaggguuuuccugcagagugggauguaguuaaacaggaaguugaccucccagguagggagaggcccaggaagaccagagcuguuucccagcggcucuaucagccgggccugaggaagaguuaaagaaguuguuuccaccugcuguuaagccuguaggaucugaacuagacuucuugaagccaaugaaaaagacuaaggaguaaaccuuugucuugcucuuaugcagaggcacugcccaggaucuuuaguacagauggaaagaugguggacucccugguuuuucucuccuauauucaccuuucaaauccucucugucgagggguaugcuggccccuagaaagugauagagccuucuacugguuccuucuaugcaaggcuggaaggauuuucccacucugcagacuccccuugucuccccauuucuuauuuguucaguaccaauaucaugguccauacugccgcauuugaucauauuaugaaccccaagauugugaacuguuucuaaugguggugugacucagccuuugauccuagagcauucuauuuacaauaaacaaguaguugugguguggcucagcccuagcacacaccauuaauccaagagcuaaauaaagucaaccaugggucaagaggcaaagcaaguaaccagcugaauggagugaacagaaguaaacagaaagaagggucuuugaguugaagggcauuuugcacuguguagagaaggagaaagggccuucuccugagacauugguagaguuuuuuccuucugggacaucaguggaauaggaaggucaaaugaaugguuucucugccucuccgagcuuagcaggcuuucacaagggcaucuggcuccugagucuucauuuggugaguuaaagggcuagaauuuuuguuuuuuaaaacaacaccugaggggucaugcaugcuaggcaagccuuuuaccaacugagagaaagacaauacauuuuaaauauugagaaaaugcaguaaguagaguugggaagccaauguguuguuuugugagauggggucucuuguaguccuggcugccuuagaacuuacuguguagccuagaaugaccuucucaugauccucugccuuccaccucucaacaugcuggcaucacagcucuaugcuacugaucuuggugucugggauuuauuuauuuagugaaacuuagucaaugccaccaauuuuauucaagggaccuuuuauugagggacccagaagauggcucagugaguaagaaccuuuucuaccaacacuaucaaucuuaguuugauccucaggacccacauuguagauggagagaacugacuucuguaugucuuccucugaccuccaaaugugugccauagcauggauucacugacuauccacuccacagucucuagauagauucaauuacauuuuuaaauuuagauuuuaguuaaauuaacguagaaacagugacuaguaaugugugauggcaguuccauucuaauggguggguggguggggguuaucuaaggauccacuauuagaaggaauucuaucuucucuauaaacuuuugggcaugaccuagucaaaguuuugguaaaugguuucucucuugcaguuaccagaaccaauauccugacgaauccugaaggcugaccaagugccuguggcuaguauuuccagaggguacaugcaucugugaucuggcccuggaucugagacccguucauugauaggucagaccuaauagcucacaccagugaugccagcaauucggaagcuguaacaggaggauuucuacaaguuccaggcaagcuuagacuaaauaauaaguuccagauugucccuguguauacaaagacgaucacaaaggaagaggggaaaaaagaagaaagaauaguggggaaggagagaagagagacccauauaaguaauuaaaggagcagugcagggcacuuccuguauucccugaaugguaugaauucagaugcuuccugcccacuccauaugcucugcagagugcacugggaauugggaugcuuucaacauuguuugacugaaucuuuguuacuccugugcuguuugacuuucucuucagaaguguuaggaacccuggaggaaacugggauauuguccaucuugggcaguaugggaugccugagagauccauugugacucauucaugguguggccuuuaaucaacuuugcuaaaugugaagggauucauuguuucauaaugggagcuucagagacaaaucaccaugaaacgagccuuuucaagacagacccuuuuggucuugccaaaagauggacucagaauacuuuucucuaacugauuaagaaaaaaguaaguuguuuuuuacuuuguugcaugaauggaggcaguaaguaugacaaugaaaccguaagcuagcaaaguuugaaugguauuuucaggaguuaaauuugucauuaaagcaaggagcuaagaaucaccucuuagaguugucuagauuacuaagacugucuauaaagugauuggcauagaguauuuaauuaaucugguuaugacagcucauauuuaugcuucaagcucuuggaggaaggagauaagagauaggacgaccagaagaaguucaacccuacuggguuagacaguaauuaugguguuggauucucagcaguuuuguuuuuugaguuuugaucucauguagcucagacuggccuugaacuugcuauauggcccaggaugaccuagaauuccugauccuccuguuucuaaauccuaaaugcugggauuacaggccugcaccacaaaagcccaguucucugaaauuaaaaaaggauauauauuaagaauuuguuaugucgccaggcagugauagugcacgccuuuaaucccagcacuugggaggcaagaggcaggugaguuucugaguucaaggccagccuggucuaccgagugaguuccaggacagccaggauuacacagagaaacccugucucgaaaaaaaaaccaaaaagucugaccacaaaugcccguuuguugaguaacuguaguagaaaaucaugaggcugccaugguuguaaccggaagaauacugucagaagucuuaggacaaaccuccccauuccuuucgauuugcuggcugagaaggcgaggaggaagagagagaggaaggcaaagagaaagagaaggguaagcaccugcuacgcuuguuuuuagaggcauauucagguaaacuucuccaaauccaguuuagagcggaagcgccaggugacagccauauccuggucacugagcugcccuagcugggagcauucggggacucugcgcucugguggcucuaccuggagcugagguugaggggcgacugguagauggagugcgaugagcuucccacuuuaagcugaugggaaaaggucagagguuggcccuacccagcguggccacgcccagcaaaacucuucgagagcccgacgcgcgccgcagacuuaaggcgggcuuccagguucaccuaagaacagaaagaaccucagccugacaagcggacagaaccucguccuacccgcgccuccagcgcugcgcagccgcaguguggcugaucaagccccgccgucccugacgucacagaccccucguccccuugcacgaucugugggcgggcacgaggcuucgugacgcaugcgcgcuggcucggcguagguggcgcuggagccaccugaggagguuguagggugacggcgcggacgccauuuugucggugucugucgcagcggcuggagaggaacgacggcgguuuggcgacauuucucggccaaaaggccgcuugcuuuugcggaggugaggugggcagugucgcgcggagccaggugucugaggagagagugggcuuugggcgucagcaccgggaggaugcguccgcggggcuggcggggugccucucggccggcggcgacaacacccgagcugccgcgguuucgccgcucgagucaaggcccgcaggccccggguucgcccgacggugcgguccggcagcuugggccucgcucaccucuugucaaggccucggccguccaucgcaggaaccagcggggagacccuuggcgggacgcauccccgguacuagugccguccagagucgaagucaccccgacccccuacucaccccugucuguggccucggccguuugcauaaccggagccuuuuccaaaguccgcuauucgcucuguuguu

SEQ ID NO: 5981 - RNA, 10702 nt, Mus musculus
uuauaguuuuaauagauuuuauguacuuuguuguguaccugaaagacaguaacuugcaggaaucaguuuucuccuuccaucaauguggguuucacagauagaacuucaggccucuuuuuccaguccucuuccaguuuacuauccacguguucccucuucugugaaauaauguugugugucuuuuuuccauucucuaguugcuagugguuguggaaacuucuguguauaugcaugucuguuugucugucucuguguagaauggggagauacccauuugaggacaacaaucuaggcgagguuagugucuuguuuuaguguaugcugugcauauguuuagccaguuggcagcagucuucacuuccuuauauauauuuuuaagaaaccacauaaacauuaacuuucaaucaucuuuuuguuuuugagaccgauuuauguuagaacuuaauauguagaccaggcagcuucaaacucagaucuuccugcuucugccucccaaauucugggauuaaaagcauacacuaccaugcuacucgguacauuuggcuuuuuacuuuaauuccaggaaucaaacucauugggcuugcauggcucuuacagagcucccuggccaucaguuuuauaugaaaccagguaugguggugcauaccuuuaaauccagcacucaggaggaggcagagguagauggccuacaugaguucuagugaaguccuaccucaaaauaaauaaauaaagguaaaaaaaauacauuuuagaugauccaauuugucaaauuugggggaggggaggaggguaauuguugcuuauccuuuaaggaaucacuacuuaaccgcaaaagaaaaaaaaaauccuauguaaaaguagcuaucuuacuaaccuggcugugaggcacuuacaauacaguugaauaacuucagggcacugaacauccuguucaaugcauggaaauguuuauauuuaucugucuacaaugauguuuguaggcucaaauuguagcucaguaguacagcacauguuuagcaaguacaaagcccuugguuuguuugauuucagaaucacaagaaacaucuuaauacaucagggcagugcuaacgcccaaauacucugccacuaagcuacaucccuuagguuguaucuuguucuccuccuuccuaacacagucaaacacacaaaagacaaaaucaaacaaauccaugaaggacaagagaguucaguccauaaagcaguuugcccugcaaacaggaggaccaagaacccauauuaaaaaaacaaaaaaaacaaaaaaaagccaagcuuuguggcacaggccuguaaucucagaacaaggaaggcagugacuggguuccugggcuugcuacacagccagcauagucucuaaguauagcccgagguccuagugagagauuguccccaaaaccaagauggaugucuccuguuaacauccacauccaagguuagguuggcauuucauuucugcacccauauggaauauaugcacacacacauuuugaaacagggucucacuaaaaacuguuugggcuggaccuauguggaccagccaccugccucugccucuugaauguugccgacauuaaaugcuugccccucacuagguccuacuucuuucccuuuuaagacaggguuucucuguguagccuuagcugucauucaggaauuaaaucugcagaccaggcuggccucaaaaucagagauccaaaagcaucuccuuucugagugcagguauugaaggcaugugccaacacugucaaauccccaaaccauuguccauuggcuuguuuagcuuuucaaaagauuugggagggggguuuacccauguaccacugacaugccuggugucuagaggcaaggagacagggcuagaccaguucucucuagguaucuugcuaccuggcuaaguugaagacccaggaagacaaacagaguucauaaagacaaucccauccaagagaccaguuuaagaaagcccgaaguaugaaggcuuugugggucuguggccuucccaauuguccuuuuaugauaaucccacgggaucacaguccacuggcagaacaucugacauuguuauccccuaccucaguuugguggcaaccccguauccugugcuguggggcuagcaguccuagaugucuugaaaacagaacagcuccaggcucacgccacuaaugugggcaguuuccuucuggagcaccucacccagcagaaagccaagcacccuaucauuggagaugucagguaaggcucugggggugugcacacuaaccaaaacaccugcuacaacacugucccaccuuccugccacgggggaaaugucuacauccauucuccagaaggaacuaggauucuuaagauuuccaguccacaccaagaccacccccuccaggguaaauugggguggcuaaggucagggcagaauaaggcaaggaccauugcuaccagauauuaccuccuuuaggggcacuggacucuucaucgguguggaucucaucaaagaugagacccugaggacaccagcaacugaagaggcggaauauuuggucuccagguacuuucugcugaaauuaaguugcuuucccaaaaugggaagcacuauaaguuccuauauaaugagccuccagccaaccucaaacacccaccaccuucuaaugaacuuacuccaaccaugaagccuccuggaguuugaacauucacauuguaaaauuuauuuaccuacucaauaguaagugacauuagccagcuuauccacucaaaugaggaucagagauuagaagucagggccagggcguucuaauugcagucuaagggcuggcuauuguccuggguguaaccuuucucucuagcacaaaaacuggagauucaaaaauauaauccuuucauaccccuggguuaccaguaucuggacuacauagugauaauauagugcugggugggcauggugaugugguggccuggauuacaaucagagcaaauuaaagccugggcaauuugcuaaaaucuugugaaacuuaaaaacugucauggauggugguggcaguagcacaugccuuuaauuccagcacuuaggaggcagaggcaagucagucucaagaguucaaggccagaucuacagagcaaguuccacauagacagugguaggcuuaacaaauuauguguaccuugggugaggacaaguuaauuggccagagguaaaguaaggugggugccaguucaagguuaacuucagauagucagaggacaggggccugucugugaaguaucuuguucuugcaggcuaaaggaaaacuacauuuuacugagcauugauggcccuggaaagaauauucugaaguucaagcccccaaugugcuucaacguugacaaugcacaacaugugguagcaaagcuggaugacauucuaacagguaaacuugauagaaucccaucuagcauagaucagcccuuguguaacuagagccucccagcaugcgccagggaucuuauaacaaguauccauuagaucagaaaggauggccuuuguaaccaguagcaacuugcacugacuaaacaugggcaucaccaccuaugaucccaaaauuugguagguagaaugggggagaucacaugcucaagauaauccugggcuaccuacaccuuaucuuuuuuaaaaugcaagaugccuucauguucaccccagcagcgauggcacacauccucaaucccagccuggucuauaaaguuccaagacagccaagggccaucaaacaaagaaauccugucucaaaaaaccaaaagaaacuguuaaugacaggagcuucauuuuaucuucaagauaggggcacccucacaugugaguggcuaaaauggcuggcuggcuagagucaaauccuccccauaaccuuuaaaucacucaaggucaagaacagcccaaggucucccucaauuuauuuaagaaaacuaccgaacuagaaaugacuauacaccaaagugguuguuauacaaagcucagaucccaacagacaaaaaacaagcuaccaaggaucccuuccuauuccugcuuguuagccaccccuacugcguuuuggaauugauacauuucuuagaggguucuauguguacagaacagugaguggugacugggcuuacaaagggaccaucugugcuagggaaaugaugagacauaagccaaucucuaaacuaucccaagcaucuuagaaacugaggguaggccaggcgugguggcgcacgccuuuaaucccagcacuugggaggcagagccagguggauuucugaguucaaggccagccuggucuacagaguuccaggauaaccuaaccagggcuacagagaaacccugucuuggggggaaaaagaaacgaucugugaucauuuuccagacauggaagaaaaaguaagaaguugugaaacccugaggaucaagcaccccccagguaagccagacuuggccccaccuccaucagcagauccccaacauuucaacuuguacuugacugaaacuaagaacauggaauauauauaauacauggcaagauggucucugcuauggagacaaugggcacaaaagggcagcuaaaaagaucagaugggauaacuaaaggaccucugcuuugcuacaggagaccuggcaucuccaacacugggcaaggucucacagagcaucccacauuuacccaggcuuggggguuuuguuuuucauuuuuauuucaaaagcuuggauagcuucaauauccaggucguggcaaaaucaggacacguguaaaauaccuuacaauacauuagauucccaaaagguaccaaaaaguacaguaaaauuaacacuuccauuacuggaaauguaugacacaaauaauauaaaauuaaaaggugaaaaaggugacacugguuuccuaagauacaguuuuacucuuuacaaccaggguccacagguccaggcugcagagcggcaacaggaaauagacccuccugaucuagaacaggguaaccugguaauaaaaucagcccccuagugccgcucuggccucugagacgccacacgcugccuacaacuagagcucuggaauaguaaacaggagagugauuucugggggaaauuuuaaauaagaugcacaugggacaggccauaaaaguuugccaaguuaaauuugguacauaauuguguucacuccgcguccaaacaaagcgugugcggucgucacucggccgcuccugcugccucucaguauggcuuguaguuauucugaugaccaccacgucgcuggcucuuuccguaauuuguacuacccugaccuaggaauaagaacaacguuguggcuacuacuuuaacuauacauuuacccagugccaggcgcuugccacacauccucagaauaaauuaacacuacacagcaacaccagcuucuuacaccuuacugagaaggcuaagcuagagcuucauucaguagcuccagugccugugccaggccugucugacuccaaagccccugcugccaauggccccugcacuaccuaaccugccuccccuaggaggaaguagauagggccucccucuccuacuuacuguagucguagccggggccguagccguaauagccauagggcgaguagucguagccgccauagcccggcccguagcccugcugguagccguagcccugguuccaguaguugccguagcccugauuccaacucugacucugaccugugggggggagcagggcacaggggcccauggaccauuuagcacacgcaggagcuaggauggaggaaauccugcccuuuggguggcgggguuauuacuauggcaacucaaaagccaagaggcuacuguucugguacagagggcccuaggcccagccuuauaauccagaagggccaagaugccaguuaacuucacuugucaauacagaaagcuuuacacucacucaaaucacccucugaucaccuccgcccucugaucacuuccacccucccuuggcagcuuugccuugaaaaagaugcaguucaggcuuuggaguuagaggggccugggauggagggagcugagcuaagcgccuggcacagcuuugccuuucugcccacagcuauguguguaccaagacucaggacagccacaaagcuaagcauaacccagugucaccaccauucucucccagugcaaugcaaauaucccauuggccuggggcccccaagcugcacaaaugagaaagauaaggcuccuucauuccaugaagccaugagccauagcagcacaagcauacagccuccacccaaggaaaccauuccaaccccacuucacacccagccacccacccacacuucacagagcaccaaaggcaauccccaagacaggcacagaaagcucucugcaggcaggcaaagucuucauccagcucccacuuaccuccaccacugccucgguucccucgauugcgauuuccucugcccccagagccauacugcuguugcugauacaccucuuugggcugggcaaccuugauuucacacuaaaagccaagaggacacuaggucaaguccuguggaacaagcucaggacuggaagggugggcaggaggccacuaagguguuuacucuucuuuucacagaagauacucauccuacucaaauacuccuaacaagacagcaagauugacacccaccuuacagauaaaacaagugugugaggcuucacuggauuggugaacuacugauaggcuuuauuucuaaaucaaaacaagacccagucagacuuuuaugccugaaaacuuugaggaugguguacaugcuucaaaagaacauguuuuaaagacagaccugacauacucccauuuuuaaaaaaaaaaaaaaaagguaaaaaaugagcuggccauggcacaugccuuuagucucaucucacugggagguagaaacaggcagaacucuuaaguuugagaccagccugguuuuguauagggcagccagggcagcaguacggugaucucucaaaaggggguggaaagauaaacuuuaucucucccuaucaagcuaugacuuuuauuucaucugaauuaaagacacugaauaauuugaguauuuacuucuaagacccaucagcaguuuucacuaccauagaggcucaaagcucuccuacuacuucacauuaggguacacacacaaaaaggcacugcucacuagaauaacuaaaauugccccacccaacugccugcuuuauuuaauccaacccaagcuuuuuaaaacucccaaaaacaauggcaaagaaucuuucuggaaccccacccgagcucagugggcugccaguucucuaguaagcuccacucagccacagccagccacaccuucaauucuauuacuccacuaauguaccacuccacuaaacaugacuccugagccggcguaguggcgcacaccucuaaucccagcacucaggaggcagagacaggcagcggauuucugaguucaagaccagccuggucuacaaagugaguuccaggacagccaggguuauacagagaaacccuguuggggaggggggggggaugacacuccauuugcaggaucccaggaagcuuuuaggucuuugccuaaaauagaguugacuacagcagcaaagcuuccucugaaucaagaaaaacuuaucaguauagaaaccuauuaauuacuaaguuccagaaaacugaccacugcacuugggaggcagaggcaggcggauuucugaguuugaggccaaccugaucuacagugugaguuccaggacagccagggcuacacagaaacaaaaaaagaccacugcaagucucauaaccucuaacacugaagcaucuagucaacagcucuauucacagaaaccaggcuuccucuuugccuccuauacaccugcuguuuucauuuuuauuaaugguccuuguaaguauaguauauggugccuacagaagccaccaaagagcaucagguccguugaaaagugcgugguucuagguuguaauacaggugguugugagccucuuguggguguuagagaaggaccagaguccuccugaagagccagcuguuuccaguccagcauuuaagggccagaccauccaucuauuucaaucagcauugugugcuguagagaaaccuaaggucuuacugaccuagaaggaucucacagguagucuaauguaaucuaugccuccaagagccaaaagcaggugacaguuuugacaccuuaccuugcuuccacugacaguaugaaauuucuucuccagaacuuucuucacaggaucuuccucuuuaaauguaauaaaaacaaaaccccgucuuuuguucaacuugggaucuauuggaagcucaauggccucaaucuguaaaaacauacaaaagcccagguuuaaacugauacccaaaacaauacugaaaggucagaacaccccacuaauacugcauccaggcaagaccaacaaagaccaagaagaaacaagccacccucaccuccccaaacuggccgaaguauucucugaucuuuuccucuguggcuucaggguuuagaccucccacaaagauuuucuucacaggguccuucuucauagccauagccuuuuuagggucaaugacacgaccauccagccugugcuccuucugaucuaagaccuguguaaaacagaaaugugucagggucuaaacacaaguacauaccaaaugggcucaauucucucuggagcuaagccagacggaguucccagcccuauguucuuccaaaccucccauacagauagaugaucauuugaacaccuguaucccaguccugaacaguagucccaacuuaagacaaagcagcagugacaaagagcacaucuagugcugaaauccucucuacccuauaaaggcaugcaccuucacuuucucugagauuuaggaugccaucccuauguacuuggauuuaaauaacaacaaaagcaaaaaaaaaaaaaaaaaaaucacaccuauccucauagcaaucucagacuuuaaucccuacagugcagcauuuaacaccaagcccaugaauuggcacaauagaguuaguaaaggaaggcugaaaaggcagcucucuaguuccugcccagcucccuacccuccugcaggcuucucaguaagcuuuuuauaguagaauugcaaucgcccagaaucacucaaucuguacuaucccucaaaacgacucuaagcucacucguggcaaucaccucaacacugcaaugccugaguuccuuaggauucagaauccuaguagauugcugucaaauacccagcuuaccuuuuccacacuagaagaaucuuugaagagaauaaacccaaacccucuugaucguccaguguugggauccauuuuuauuguacagucaacaaccucuccaaacuuaguaaaauaauccuuuaagucuuuuuugcugguaucccagcucagaccaccaacgaacauuuuucugcaagugagagacaagaccacaaaccuuagaagcuguaaaagaauucugacacuuuuccuggcuggggaagggcuuauggagccacagucccauggaccagucugagauggugcccccuuucaaguuaacccuugcgucgcucugcaaucucgacucaacuggaacucacagcugaacgagacuguacagccacacacgguacauacgggacaagaaugugacccaugaccccucacgaguuuaaaaucagcgugcccugcacucaugaaucuacuugagcucacggccucccaaguaccugccccaaggaacucuggguuucccggugccaagaccgccccaggguucaggcuggaacuccgccccucgacucgcggcaggcuaggcccggcccgcugcgcgccaacuccgccuacgcagcagagacgcagcccucgcggcccgauucgcgauccgccgcuuuuccucuuccggggccgcccgccccgaggcccgaaguagcccaagcaccgcgcgagcggcccagaucggccucacagucgaccccgcaaacuccugcaaacuccgaggcgcguaaccgcgcccgggccaggcggcaagcgcgccaggcaggcacagcuccgcgggccgcccgccccuccccccgccgcguggcgccaacaaaagacggccccagaacaaaggcggcggcccgcggccgcaccuaccccgcguccuccucguucuugcuggcguugaucuggucgcccuccgcgccguucugguucccgcucggugcggucguggucccgcccccagacccggccgaggccgcgggggccgcggcagccgcgcugggcucgaccggggccucgccuucgggggcggccucguguccguucucgguggcgcccgucgucuccaugggcugcuccucagccgcguccgacauggucggccaggccgcagcggcuacugcaacgagcggcgacagcgcgucaggccccgcggcgcuccccgagcucccgcccaccgcccgcggccgggccgcucaccucgccgccgaugacgccgcgaggcccuacucgccgcagaaggcgacgcgcgggcuuggccgcggucacgcucgcacccccgagggcucguccgcagccacugacuaucgcuccgcucggccgccgccguacacugccgauaaagaagaccuuaacuccgucccgcgcggugccaccgccugacaaugccaacucguggagcucuuuauaaugccg

SEQ ID NO: 5982 - RNA, 2517 nt, Mus musculus
agcaaucucagacuuuaaucccuacagugcagcauuuaacaccaagcccaugaauuggcacaauagaguuaguaaaggaaggcugaaaaggcagcucucuaguuccugcccagcucccuacccuccugcaggcuucucaguaagcuuuuuauaguagaauugcaaucgcccagaaucacucaaucuguacuaucccucaaaacgacucuaagcucacucguggcaaucaccucaacacugcaaugccugaguuccuuaggauucagaauccuaguagauugcugucaaauacccagcuuaccuuuuccacacuagaagaaucuuugaagagaauaaacccaaacccucuugaucguccaguguugggauccauuuuuauuguacagucaacaaccucuccaaacuuaguaaaauaauccuuuaagucuuuuuugcugguaucccagcucagaccaccaacgaacauuuuucugcaagugagagacaagaccacaaaccuuagaagcuguaaaagaauucugacacuuuuccuggcuggggaagggcuuauggagccacagucccauggaccagucugagauggugcccccuuucaaguuaacccuugcgucgcucugcaaucucgacucaacuggaacucacagcugaacgagacuguacagccacacacgguacauacgggacaagaaugugacccaugaccccucacgaguuuaaaaucagcgugcccugcacucaugaaucuacuugagcucacggccucccaaguaccugccccaaggaacucuggguuucccggugccaagaccgccccaggguucaggcuggaacuccgccccucgacucgcggcaggcuaggcccggcccgcugcgcgccaacuccgccuacgcagcagagacgcagcccucgcggcccgauucgcgauccgccgcuuuuccucuuccggggccgcccgccccgaggcccgaaguagcccaagcaccgcgcgagcggcccagaucggccucacagucgaccccgcaaacuccugcaaacuccgaggcgcguaaccgcgcccgggccaggcggcaagcgcgccaggcaggcacagcuccgcgggccgcccgccccuccccccgccgcguggcgccaacaaaagacggccccagaacaaaggcggcggcccgcggccgcaccuaccccgcguccuccucguucuugcuggcguugaucuggucgcccuccgcgccguucugguucccgcucggugcggucguggucccgcccccagacccggccgaggccgcgggggccgcggcagccgcgcugggcucgaccggggccucgccuucgggggcggccucguguccguucucgguggcgcccgucgucuccaugggcugcuccucagccgcguccgacauggucggccaggccgcagcggcuacugcaacgagcggcgacagcgcgucaggccccgcggcgcuccccgagcucccgcccaccgcccgcggccgggccgcucaccucgccgccgaugacgccgcgaggcccuacucgccgcagaaggcgacgcgcgggcuuggccgcggucacgcucgcacccccgagggcucguccgcagccacugacuaucgcuccgcucggccgccgccguacacugccgauaaagaagaccuuaacuccgucccgcgcggugccaccgccugacaaugccaacucguggagcucuuuauaaugccgaagccgggcaccaccucguaacaacggauacucucauugggcaaagcgaaccgccacucaccauuguccuagcaucuuauuggcugcuucugcgcgcgcgcucuagauccgggcgggcuuuguccucauuuuagaacgcgcgcgagucggagaacugucuacgguuccggucaccgggcgagcacguccaauguccccagcugcccgggguacacggcagucugucauccuaucccuacauccuauucuacacuagcaaccccggccucccaaaagaggagaaugagccggaggaaguccccuaaauccaaggucgcccggagaaaggagccuaaucuuggagugcucuaaucuacggagugcugcggucaucggaggccuucagcacagccugcuccuaaaccucggcauccugagaugccagggcuccugcccucuucagugagcuagcuggggccauccauggaggccuggcgcagugaacguuggaccguaguauuuccagugucugcuugacacccauagauacuuaauaucgcauuaguguuuagcuuugccuuuaauuuuuauuucuuuccuuugguuccguuuuguguuuuuugagaccaagucugguauccuccgacuggccuugaacucuugacccuccauuuucacccccucagugcuggaauuaugugcugcaccaccacugugccuagcuuaauuucacugauuuuuagaugauccuaaauggaaaaauuaagagucuuuucauguagccccaggauaugauuacagacaugugucacccu

SEQ ID NO: 5983 - RNA, 13634 nt, Mus musculus
ugaugugaacgugggugugcuugccuguacaagugugugagggccagagaaggauuuggggagucucgcuccaacacucuccacuuuauucucuugauccuagagcucugcuuuuuagcuacauuagcuggcaggcaaacacaagaauccuuaagucucugcuaaccccacuccugcaauuacaggcccgcgccaguaggugcgagccagcuuucuaacaguaccugggaucucaacucagccccucacacuuguuuugcaagcacuuucccuguuaccucagacucuuccuuuaacauuauuugcuaguucaaaaugcaucgcaggaaauacuuaaucacuggaccacauacauguaauggucucuuaaaauguucauuuuucgggugcuggggguggaccaagggaccugcguguacuuuaacccucccccuguccucccccucucucugucguagcucaggcuggccuaacucacuuuguaucccuggaucucugaucuucuuauaauuauaagauuauaggcggguaccacaauacccagcuuuguuuauuuucugagccagagugucgcuuuguagucuagacuggccuggaacucccggcgcucguccugccuccguguccccuaucccagccuggacauuuaagaccuaguuuacugugguugggggcccggauuaggcaggugcgccagcuaauacuuccgguagaaacucgugacaacccgucggugguucugacgcgcggaaacccagguuugcuccggaucgcagaggccaggcgucccggcacugcgcaggcgcuaacuguugccuggcuccggcgaacgauucauucggcauuccuugcaaagccgcgggcgagacacacugucuccccacgcuccgcgacaccacgcaugggcgagcccggacccacccgagaggcaaccgccgcgccuuccgguuccgaugacagcggcgccggaagcgggcugagcugcaagacuaggugacagccugccggcucccggucccggggugcggggcgccccgaccaaagccuggagcagucgucggccacacccuccaagggcugguggagucgcccggacuccgacgucccguccuagugcaccugacugagucagagguaagcagccaguggguggcgggguuccggcagggcacugcaggagggucucugggaggauaaguaggaguuugucagucuuugcacuacuaugcgggucaagucggggucguggcaugccccuaggguaaauggugggcuuuccuguccuuucaguuuuaggugaagaagugacaaugugaaacuuucuaguauuuguagggauaugauuuguuugaguguaaaauacagggcauucgauacugugguuugaaaagaugacacguguguggagaccuagauaaggagccagccaugggaagaugugagagaguguuccgagaagaggauagaggcagaaauaaacuggauguacccuggaacagaaaggcugguggugguagaguguggcaagugauggggagagucauuggagugagcaucaccagggaguuuguuuggauagaacuuuuguuuuucuuuuguuuguuuguuuguugucuuugagacagggucucuuauagccuaggcugcccuggagcuuucuaaguagaccaggcuggccuugaacucacaaagaugcaucugcuucugccucccauguguuggggggugggguggguuaaaguccugcaccaccauacccaaccucagauuuauuuauuuucuuuuauaaugaugacgaugaugacaacgacgaugacgacagcauuucucuacauagccuuggcugucuuggaauucacuguguagaccaggccagucugaagucagacagaucugccugccucugcauccuuaguucugggauuaaaggugugagucaccacacccaacagauauuuuuuuuaaacuucuuauuucuagguguauggggaccuuuugccuucaugugugucugugcaccacgagaugcaguggaugaagagggcuucagggucucuagaacuggacuuacaggaaguugugacugccaugugggugcugagaacagaaucugggcuauuugcaagagcagcaaguccuccuuaaacaccgagccaucucuccagccccucuagugugaaguuuuaacauuuccuucauaucucuuucuauccacuggaagcuuuugauucaggccuucuuagccaaaggcuaggaaauggagguauuguuuaaucaguuaggccuacucagccccgugaugggcuagguccugcagggagggaggggacaagaccagucuccaggcuuuguuuagcugcuaguccaguugagacacaucugaagaagcagucaggaggauguggaaguguguggaaccgacacaucagauuugugaugcagaaaagaagggugcacaaggaagauagagccgugagaagaggccugagcuggagcccaggaagccauauaaaaugguggaugugaccagggacguagcacaugccuuuaguucagcagguggagcuuuguaaauucaaggucagccuggauuucagagagagaggugauuggugaccuuuugggagccuggguuuaacuugaguuggcagaggugugaagagggugcuuaugggagugaguggguguaaugaaauaaagaagagaagcagggcuuuggguguaacacccucuguggcuccgcacuuguccagcaugugugggggcuuggcccugaaaaaucaauagauuaauuaaaaaugaaugcauuccugaugauauguaauuccagcuacucggaaggcuaaugcagaaggauuccaaguucaaggucagucugagauacagaaugagcucaagggcagucuggucagucuagggaguucuugacucaacacaaaaagcugagguuggaacagggugguggcacacgccuuuaaucccagcccucagaagacaggggcaggcggaucucugaguuccaggucagccuggucuacagagagagagagagagagaucugaaaacaaacaagugcacaguagacuggggugcagcucagucgggguggggguuccugggggagggcaugcuugguguugaggccagcaugaacccauuucaaaacaacaaaauagcaucaucaagaugucucagugaguacagauauuuguuacauaguccuggugaccugaguucaaucccuggaacccacauaaagguggaaagagagaacugacugcacaaaguugucugaauguggcuucugcccagaucagaagcacgaauacauccguuuuuaaaaagcagaacaaagccgggcgugguggcgcacgccuuuaaucccagcacuugggaggcagaggcagguggauuucugaguugaaggccaaccuggucuacaaagugaguuccaggacagccagggcuacacagagaaacccugucucgaaaaaccaaaaaaaaaaaagcagaacaaaaaguugucuacuggacauguacagagacucuuuuuuuucuuuucacuuuuuccuuccuuccuuccuuccuuccuuccuuccuuccuuccuuccuuccuuccugucuucuucuucuucuucuucuuuuguuuuguuuuuuuugagacaggguuucucugcguagcccuggcuguccuggaacucacuuuguagaccuggcuggccucgaacucagaaaucagccugccucugcuucccaagugcugggauuaaaggugugugccacuaccaccgggcaggauacaguuucuucuuauguagcccaggcuagccaggaacuaaaaguggucggucugccucuuccucccaaccacuaaacuggaagguauaggccaccacacccggcuuuccucugcuuuaaaaaugacgucuuuacuuacugggggugggccucacugccauggcaugcacugagcagucagaacagcuccgugaggccucccuccuucuaccuguuguucccaugaucauuuucagaucaccaggcuggguggcaagcguuacccacugagcacuggccuggcucauccucaacuuuguucauaguuucaaggccucccucugauaguccugguaucaguugguaucuggcaaagccagucauuuugaccacgaugagguccuguccuugagccauguuaaucuuugaaaaacuguaacucuguuaaccagacucuuggccgucauauuuuucuugccaucuuaccuagcuggugguuugugcuugcuccaguuaccuuccuguugucauagcugagagacccuaugaguucaccccagugguucucacacacagcugucuuuuccugcugggacagcagccagcucuguugguccuguugugcaaaguacuugaggagaagaccucagccuagaaccagacaccaggcuuccucaguccccacuccuccgcucccccgcugaguggcccugggguguuuauuuuaucuuucccuggucucauuuucucagcugcauagugggucuaauaacuguaccuaccucauaguguugugagaagugagugauuuaaugggugaagucacuggagcagagccuagcacauaaugagccucuggggaauguuagcuauuaccaagccaaacaacuauaucauuuuaagugggagucccuguuacauuuuauccauaauauaacuguagagucugacuuuggggggucugauuucucuggccagugugaucacaaguuuuagugugucagaugguaucagccagggcccagcacuguuuccuugucauuugucaccaucugggaaggagaugaugacuaaaguaggcuugaacugggaaagccaagauggguggugccugugggacuaggaggguacaggaagugggaagaucccagggucaccauggacacuggcuuccugugaugccacuuuugagagaacuggcuucaaugaucccuuuagagggacacauaacucaguucuauuucuaguccugugugcggguacagaagcucuacucuguugcuggcauucuggggaguaucuguauacuccauguugcaggcuacucaaaaagggggcagcagaguggaggggaagagcccgcagugaggcguucacuuuaggcugggugcuggcucaguguugcuagcuauacaagcauaaggaccugagucugaauuuccagaacucacguaaagccaagcaugguagaggacagcuagucccagcguucgcucaguccuauggugagaugggaggcagagucaggaccauugcuggacgcucccgagccuaggguagauuggaauauacaguagugaacaagaaaaugaccuuguuucaaacaagauagaaggagaggacugacauccgaggcuggccucugaccucugugcucacacugugguaugcacuuaugugccuguaaucagacacaugcacacaagcauacauaucauacacaacuaccauauacaccuuucauggcauaacugagcaagugagagucugguguggcagggaggcagaacccagguugucagucacucagugaugggaacuaaggaugcagagugagaguggaggacaucagguaggucaggcgagggcuagcugccugcagcaacaggggaguugggcuggaggacucaaccauggagaggccacaucaugcuccagggucuggagcugugagagcaagggugcuggcugcccacauacaaggagcuguccguaggcagacagccgaggagggcacacaggucccacaauaggcagguauucccgaaacuguccuugaaauuaacacccauucugccuucauggcuuagcucccugcaguacaugaaaacccaguuccagcaacugaaagggaagguggcuauagugaacauaugaaaauacacgcagugugaaccuaggccguucugacauacagccugcugagggugccaugaguaagaaaggaacugggggugugucagaggcucagccucugaagcagguggucugugagaccugaauaugauacccagaauccuguaaaaaaaaaaaaaagccaguuguugggauuggagagguggcucagcagguagagcacuggcugcacuuagaagguccaggauugauuuuccaauccacaagguggcucauaacuaccuguaaagggauugaguacccucuucuggcuuccgcagacauuguacauacacgguacacauauguacaugaagcaaaacacccacacauauaaaauauaauaaagcacucgguguggugguucaugcuuguaaucucaguauuagggagcuggaagccagaggaucucuggugcucacugcccagccagccucacucaguuggcgagcuucagaccagagaaaugaaaaacccagucuaaaacgaugauacucgcgguggcucugugcauuaggaagggaggcuggagugauggcuugguagucacgagcucuugcugcucuugcagaggaccaguugguuuucagcucccauauggagcagcuuuccagcuccaagagagggggaggagauuugagacaugguuucucuguguagccguggcugucauagagcucucacagauaaaggcaugcaccaccacugccugucgaucagaagucugccucugacuuccucuggcacccacgcgcacacauauaaguaauacaaagauaacagcgaaaaguuggaaacaguaauuuuguuuuguuugucuuuuuguuuuuguuuuucaagagaggguuucucuguguaacagcccuguccuggaacucgaucuguagacuaggcuggccuugaacucacagagauccaccagccucugcuaggaucaaaggcgugugucgccacacccagcugacagugugugcgugaccacaauacaaaacaacccuguccuuguuuagcaggggaacugauuuauuauuaucauucaggaggggugaggggaucugaagaaacguuaugggaagcauaacaccccuccacgccaccccaccccaccaggauccacacuggccugacccaguugacaucaccaggcagaggccgccauggagcagugugccuguguggagagggagcuggacaagguccugcacaaguuccuaaccuacgggcagcauugcgagcagagucuggaggagcugcugcacuccgugggccagcugagagccgagcuggccagugcagguggguggccauccccggggaccacgugagcacgggcuacuuacugggugcugaagccuuggacacgaaucccugggcuuccuugaagguaguaaaggaagcuuccgcuccuucagaaaaccugacagaaaugauuaaugacuugaaaccacuaacauugccagcuuguuuucacaguuuuauguuccuagguucauuucuauuguaacauguaucagcacaucauaucugcuauggcugaccgauagccugugguaugcaggugugggauucuguaccuauuaguggauggaaauuggcuuguugcucuuucugugcuauccugaagaaugcugaagaguuccacacauggcuuucuguguuuccauuucuccuagaagugggauugccaggucaggguaaccuuugaguuuaaucugccgguucacaggaaagccugcacacagccaauaaaaauacacgagauaaaaccaaggcacauagcugcaaagucgucguucacagcauccuagacuuuuauagcugagaaaaugaagucaccaagguccuggcuugugggcuagagagauggcucagcaaguacaaggcaccugcugacaagccugaugaccgaaucccgggacccacacgguggaaggagagaaacucauggaaggugucuucucaucuccugugugcaucagggcacauauguguaucauguucugucccccaacaguucaaccccugugcaacuaacuagucuuuuuguuuguuugagacagggucugucuacauaguucuggcuguuaugcaacucucuauguagaccaggccagccuagaacuccacuugccucagccucccaagugcuaugauuaaagguguaugcuaccacacccuacaguuguuaaaaaucuuaaaaaauaaguaaacaagggggcuggagagauggcucagugguuaagaucacugacugcucuuccaaagguccugaguucaaaucccagcaaccacaugauggcucacaaccauccauaaugagaucugacgcccuuuucuggugugucugaagacagcuacaguguacuuagauauaauaauaaauaaaucuuuaaaaaaguaaguaaacaaacuagugguuuguuugacauggcaauuuccaaguccccgacaucugaguacccagaagcugaugauucuggcgcucuugagucagaggcaggagaaucucggugaguuagaggccagucuggucuacagagugaguuccagagccgccagagcuacacagugagauuaaaaaauaagcagcugggcacagacuggaagcagguguuuaacucuggcaugcagggcuguccucugggucuggguugccacacugacauguaguaggaagcagacaggcugcugcagaagcugcccacgaucugccuccugcuccugacacagucugcugucuccacagcucuccagggcaccccucucucagccacgcugucccuugugaugucccagugcugucggaagaucagagacacaguccagaaacuggcuuccgaccauaaggacauucacagcagcgucucucgagugggcaaagccauugacagggugagugugugaguguccagggucuaggagugggagcagcacagagcuaguguguacugguuuggcaggaacacauguaugagugcccgagucacaaaccgcucucuccucuguuagaacuucgacucugagaucugcggcguggucucggaugcugugugggacucccgugagaagcagcagcagauccugcagauggccaucguagagcaccuguaccagcaaggcaugcucaguguagcggaggagcugugccagguaaugcacaaggcacucaucuccugcuguuugagacaggcuugcuuauguaacccaggcuagccucauuucucagucuccuaaauucugggauuauggguguggcacacuaccaugcccagcccacugcauucaucugcuaguuuucagucagucccugguauucuugacuauuuuuguuuuggaauucacuguguaggcuaggcuggucucaaacucacagaaauccuccugccucucaaguguugugaccacauccaauuucuugggcuucugagauaaggucuggcugaauagagcaggcuagccucccaccggucuuucagugucaggucuggggacuaugcagaaucacacucugucugcccagugaugauguuuagccucugcaggauggaaagcgaacaacaggggcucuugcuaccagcagaccacaauuccuugccuuuuuccagccaaccuuuggcugaggaaguuuuaauauaugaaggauuuggggacacugccuugcaucuuucccaggaaucgacauugaauguggaccuggacuucaagcagcccuucuuggaguugaaucggaucuuggaagcucugcacgagcaagaccuaggaccugcgcuggaguaagggugccugacucauuccagccaugcuuuagggauucacugucuagggcccucuguagccacuacccacugcacuguauugucucuccccagaugggcuguaucucacaggcagcgccugcuggagcucaacagcucgcuggaguucaagcugcaccggcugcacuuuauccgccuccuagcugggggccccgagaagcagcuggaggcccucagcuaugcucggcacuuccagccuuuugcuaggcuacaccagagagguaagugcccagggugcugggggcuagggcuaggcuccagccuguguuuggacauguuggguggccugucuuuguacccacagauagucucuuaccagaaagaugccuccccacaguuuagaaacuuuugacucuuuugccucuaaagugaaguccaaagcaaaggcacagcugaggcaggaggucagcuuuaguguauguuagucauacuaguguaggcuagcguggcaauggcaaggaguuagaccauaaggugagauacaauuauuaccuauacaguggccuaccugcaugcaugccugcagaagagcaauagacauuaggauagauggucaugggccaccaugugguugcugggaauugaacuuaggaccucuggaagagugaccagugcucugaacuccugagccaucuuuccagccuacaauauuuaaaaaaauaaaaauuauaaaaccaaucagugauacuauuugugugugugugugugugugugugugugugugugugugugugugugugagagagagagagagagagagagagagagagagagagagagagagagagagggagggagaugcaccagggguuccaaccucacuuuaucaacacugcuuuaccacugacugacaacuguuuucaaggucagcuuuauauagagaccaggcucaaaaaaacgugggggagagugacuggagaccuucugugccaagcagagccaugcuugugauguagucagaaggccagagcccaggaacagccgccuucccaccugccuccauguucccaacagccuguagaugcccuccucugcacauuagagggcuuggcagcucuguggcuccuugaggaauggcccagagcucugccuucccucaacugucaucccauugucuuguagagauccaggugaugaugggcagucugguguaccugcggcugggcuuggagaagucacccuacugccaccucuuagacaacagccacugggcggagaucugugagaccuuuacucgggaugcaugcucccuccugggacuuucaguggaguccccacuuagugucagguacaucccagccuccugaggucagcauaaggggacaggcagggagggcaacaagugugcugauccuucccugugcuuccacagaccuaagcuggcucaccaucuuuccuugagauagacacugcuugucuuuacagucagggcccaucuugccugcacgguucccuugggaaacuacacuacucagucauccagccacccucucacaaccucccuaagacagcauuccccugcaugaagagugcugagucacugcuucaucucugcacugcaguggucucuccucacuucacagcaagcccaagcuagacucccuuaccccagcuuagcagauaagguggagcuuugccaugagcuaacuuguaggcucuuaaaggaacaaagagcaccuagauuggccccagaaagugacuucaccguaggggacagcugucaguguagagaacaggcuguacuugccuauauuguugcuguggagucaggucaccacagccccuaggcaggcauugggcagagcuauacuguacucacaacccaagguuccagccagugggcucccugcuacccagucaacucauagaugucuuugcuggcacucuuacuuuguaccacaguaauagaguuggcuaaacaggcagacucuggcucuuucaacugaacacuguccccccaaaccgggggguggggggcuuuccacaggaacacuucauaugcggauuucuuuacuagaacuuuucaaauuuggggguauaccagagcaaauaagagaguucaacauaccuaucuauguacauugcuaguggcuuuuuaggagcagcggagaugacucaggguuaacagugcuuguucuugcucagggccugaguuuggcucccagcacccacauggaaacucucuuauuagcuagcuccaggagagccgacacuccacagccaugcaugugguccacacacauacauaagcacuuuuguauucucaagggccaaucugacuuuaucccacuugaaaauuuuuguccccaguccuaucugggaccgugugcugggccugugugugaucccagcugcgucagucucugcucuguuccucagcuucgcgucuggcuguguggcgcugcccgugcugaugaacauuaaagcugugaucgaacagaggcagugcacugggguguggagucacaaggaugaguugccgguaagagcaggcugcuggggagguaccccaagaagcaggugcugggcacacggcucagacaagaacuuaacucagccucugcugcccccagauugagauagagcugggcaugaagugcugguaccacucaguguuugcaugcccuauccugcgacagcagaccucagauuccaacccccccaucaagcucaucuguggccacgucaucuccagagaugcacucaacaaacucaucaauggaggaaaguaaguugcccugccuguuuccauccuggccuggcuuuccuggccagcccugagacgcucuugccuuugccuuuccuugcaggcuaaagugucccuacugucccauggaacagaauccagcagaugggaaacgcaucauauucugauuccaaggaacauucuagaagguguaauccacccaugggccuuuguggagggacuggcuucagcagacugugaugccucucagaccagcauuaccaagagacccaaccugccuaggcagaggccagggaaggcugugaaccagcagccuaugcuuccuuaccuucuagggggacuggcuacucuguuccugcauucuguuuacacuugccccugacggagcagcaaaggucuuggucaucaaaugcagacaucuuucuacuccuggcaucaaagggguuuccagcuguggcccacuuccuacuguacagucucaacuguaucuacccauucauucuccacuguaaauaacccguuagaacugaaugcuguuuuauaacuuugagcaaauauauucauagcccuucuccuuaccaaugauugcauggucuuguguguauauauaugcguaucacucuuggaggugugugaagugggguuugggccuugaugccucaucuccucaccccaacuguccuagagugggaaaugaagacgggugggcuguagagccagugcagaacauuugccagguacacccuugaggcucugugcugaaaggcugcuuuugcuccuccugccaacuucaagaacacccacacacuugccacguuuucgccuuagcauuuacuucuaucccacauucuuggaacugucuucaucaaagcucaggaggagauggcagagaugcaggcuccaccuccaacacugcuggagcugccugggaagacucacacagcaagaaaucggggagaugcuguuagggugggcagcugccugcagccagccagaucucuuggaaaggggcuggguugcagcccaagucucucacagagguguaggcagugccugcaccuccuccaggcacuugucguaggucuccugauauucuucauggggcuucaccaugaucacacaagugggacgcuuggagccuguggcugcacccaaguccu

SEQ ID NO: 5984 - RNA, 2164 nt, Mus musculus
gagccccuccacuacugucucccccagguguuucuagugcucuaacuguuggcuugccugacuccacugggcugugaacauugccaacgcuggguugugaccuccauuuugcuuccgagugcuccggcuccaaccccagaaaguaggggugagaaagguggaccauggaagcagggugaccagacuccuccacagucuagcuuuaaggugagggccugggucaugguuugauucugagccauucaugggcacugguucuaggucagaucagugacaaguucaaggcucuagcacuuagucacuauugaaaccacgggucaaauacaguucacagggaaggaagacugucuucuguuggaggagggagacaugucuacacuagugaucauacuagugaauguuguucuagauagcagacccagggaggggaugcagaggacacaggucuggagaaauagcucagcagaagaacccugacuacucuuccagaggccccaguucuauacccagcacuuacaaaguggcucacaacuaccuguaacuccaagccuggggaauacgauggcccucgucgggccuucacuggcacagacauaugugcagagaaagcaccuacacacauaaaauacauaguuuuaagcagaggauagguaauccagaagaucuuaaauauggugcagugggaucaacagaggccuccaugguugauacaacucaggagaacaagaagaaagguaguaagaaccugccuaagacgaggagauugugauccugaggggggcguuccuccagggaggaugcaggccacaccaugaugcuucagcugccuugugugucacugggugcuuugcuccuaauggcugaaggcauauaccauucuccccuggcucacaugugcacuuuuguuuguuuucaaggcaggguuucucuguauagccuuggcuguccuggaacucacucuguagaccaggcugcccucgaacucagaaauccgccugccucugccucccaagugcugggauuaaaggcgugcaccaccacugcccggcacauauucauucacuauguucacuuuuaacaggauuuuauuuuuauauguguguuuugccugaauguaagugcaucauuuauaguccccaggcuacuuucucaaaaugcuuuguagguuuuuuuuuuuuaaugaguauuuaaucauacacacacacauacacacacacauauauauauaacuuuacacauugcaaaacaagaaaaacaauagaaaaauggugaaguacaauuaugaagagauccagaaauaaaucauauuuuugcaaaaaucgcacaggauaaagggaaggccuauggaaagaacacaguuuaagcagaacuguuuggcuugauuucugaauauggcgcaaaguaagccaccauuugcacuaccuuguaaaauaaaauaagcaucaacguuuuuuccuguuuguguguguagaggucaaaggucaacauugagucuauucuuaaauugcucuccaucuuuuuugagagcggggcucucacugaaucuguggcuuacugauuuagcuaugcucaucagcuaucaagacccaggaaccuacuguaugccuccccagugguuugcguuacaggaaguuguuuuguuuuuugcuuuuuuaaugggcggcagaaauugaacucagguccucaagcuugcaugacauuuuagcaacugaagugucucccuaguuucguuuuauucuucuuuuuaaauuaaaaaaaaaaauccuaggaaacugguccaaaagaaaggagauacuaaagaaacagcuuuugguuauuccacuuaaagcaaguuccuccaacaaaaaccaaaaguccagucugaacgagggacgagcaacagaaucaaacgaauuggaaaacucgggcacaggaaaagugcagaauaauucagaacacgaggcccgccacgccucaacaaggguucaaaagccuaaauguaagccgcuccagguucugguagaagccggcuuuguucacacccugcuugauggugaggcagggugggagaggaagugggaaagccuggggcuuucuagaaagcuugugagguccugccggcugggguucggguucuucagcucuggcuuuucgcccuaagcagagcucauucaacuccucgccc

SEQ ID NO: 5985 - RNA, 8017 nt, Mus musculus
auuuucaaacacauaagaccagagacugcaaugggguauauucuuuccauuguugggaacauagaaggaacuacagccuagguccaaggccuggagcacugaccauccaggagccucuggccucaggccaaggacaaucuuaucaacuaggccuccucauaaaaacgugcuuuuuauucuggagguggccaaucuucccaacccuggcuccuuccauggaggaagaccucaggccaggucacaugccacccuccuccucuccugcucuucugcaucguggggcugaagcuuggacggcuccaaccuacuuuaccaggccacacccacuguuggaagcagggcuagacccucccugggugugguucgcugcuagcaagacuuugccacagcuucgggagcagguacccuauccaucccauugcccgcuggagcccuccacggggcgggcgucccaucccugaucuggccucuacagauucugccuccaaccagugcaagggaggagccugccaucucaggguaucuucugacaguaugcccacugucagcacacuuggcgagccucagaucuuggaggacuccagccggggacuccaggauguaggaggcucccgcagcagccgcagcucguguucaagugccugguugcggcgguacauguccauguagcucccuuggauuucucgcugguagcgcagcacccucuccuuuuccuccugccaagucugccucuccugcucaaagcgcagagccugcuccuggccccuaagccgcucuugcagcagcucugcccucagcugcucggccccuucucuggcuucacugccuccugccucccccagcaguccucugcucuugcagucaucugucucgcagcugccuggggcuuccucccgcggugccugcuccugcaggcugugcacugccucccgcagccuggcuagcucagcguccugagccugggcuugugcccggcugccccgaaguugcgucuucaaacugaagaucucugccagcuucugugccagcuccgccugggcuucccggagcugcuguuucaacagacugaucuccgcggucuucuggcacaccugggguaaaggacaaaccgugagcaggggccaaacacuguaugacacuggggccggcugucugauggaauagagcaugggaucaggacaaagagacagcaugggaugccucagaugguguccuaccucccaucgggcuucuuccucuggccgagcauuggggucagccuccauggaggacccagacguccgaggcucuggggccaggcccugcugagcccgcagcuccuugcgcaggcgccgcugcuccuguugagccauaaacagcugcaguuggagguugcgcucgcugcgcucagcuuucugggccaccucaugaagucguuccacauacagacgcuucagcucagacaaccacaaccgcuggcgcuccucuagcaccugcagcaggaaagaggaacuaacugguuagcaaugggcacagccucgcucagauuuccauacuuggccuuccccauaacaacauucauuugugcccauagccagccaccauuaaugucuuaugcaccuaggcuacagaacccaggguccugaccacacacgcuucauacccaaagaggcucuccacacuguucuuacuacacgcaacucacagaaacagucucccuccuuccuacacaguucccaggcaggaccaaggggccauggaaucccuccauguaguugaaggguggcuaaggggagcugccucuuucuuuucaguggugagauucaaacuuagggccucacacaugcuaggcaaguacucuaccacugagucauacugccaguuuacaggcgguuuuugcugguuuguuugauguuuucuuuccuuaagcacaaugagagaaaggaccccaucagggccauagccucuggucucauucucugcugccucuaccacgcaaccggcccccaauaucauaccaugcuuaggccucgcucacgguuugucccuaccucaaguuaugccagaugucagagaugaaucuggucccuauaccaaugcaagggacaaagcacuccagggcagggguccccucaccugaguaaaggaguuagaaacauccuggucaccgaggucccucuugagcucuucacgggccucaggcaacacggcgaccucuucaguaguggggcaggagaacucauaggggggaggugguucgggcaggcagcucaggaccgccagagguccagacuccuuggggcuccuuggagcacgguccagggagccuccaaggugauuaauguggcccaaggaggagcugaaggggcuggggccaguaccuggacuacggccaaaacuacccccgcuggaagaguccgacaggcugggcucagggccaccuucaucuaggcugagagcgugaagcaacugugcacgggccugacuggcccgaggcccagggcucaggggugggugacaggccagagugugcaggcugccguugcuucgccacaacuucuggcccuugugggcugccaggcuuugcauggacaagaagccuuucccagagcccacaggaggcuugaacacagaaggacggauucggcacugucaggaagagaacguaggugugagcaagguugaguuggccacuuuuuucuaccucgugcccccgaaggcccuagggaauccccucugagaauacaggguaguaucacaaggaggcauuggucaggcuucagacuucccacaccucaaucugccccaucccacggucagggccucccagcuaaccaccccagcaucacagucucugagcugggcccaauccccugaaacgcagaugcaccuugucaaagcgaccccgcucaggcagggaagucuugcugaagucaccagcccgaggaugcucccgguaguagaggguggcauagucuggcucguuccgaggggcucgcuugguggucuugccaucuuucuuggggagaugcagguagcugaagaacucucguuggcccaagccuuuccggaggagcccaucgggcugccgggagccccgggagccagccagugcggcccgaaguucuucaggggaaaagucuugccguuccaacaggcuaccuacgcugcccauggcaaugccagcagggccugagguuguggccaugaagguucaacagggcucgggcagcugauucugggaaucagaaggcuccauuaguggcaggugggcacucaguacccgaguucccagaugcacuaaaaccagacacuugccaucuguaagcaacucgcucugcccaggccugucagaagcagauaugugugaacagaaugggagucacaggauggcaagcgauggaaaggguacacugacuacugucagacugagucuaaagcaaaggaaaugggacuuccacgggaacaccuaaaggcacagcucccagacaggggucugaagcggaaugcagaggcaaggcaggaaggugaggcccucaaguuguagggcaagggccuucuuccuagaaacgagccagcaaagggcagaggguggcucagguuuugucugacccaugaccuugcuuacuucugaugggcucuaaaucaaauuugggggguggggaaggaacaagaacugagaaccagaacgcaggucuguccuucuggcuucucuaggugggaaaccccucuucccucaaagggucagaggucccccagggaaacaucuggagugggugagguugggggcaggcgggauacagugggagggauacaaacaggaagggcccaaggggaggaaggauggugauacacacaggaagggccuaaggggaggaacaauggccucuguuuccggaacagguguccaggucuaggcagugacggcggcagagggaagagaggcagacagacuuuauaaugucgcuguguucuguuguuaggugccaccagccaggcucacagaaccggggcuggcagcuagcagcuugugaccuuagccaugccuagcccaugugagccgugccuacuucaggagcagaaaagcuacgauagucagcauuuaucauguagagaugccggagagcacgggguaagauaaugugaccaggacuggccugaagccacagucagcacagaacaccaaggcugagcuucacuacacacuucagcuccacaccacgggaccaggcuucugaacugucucccacauguucuggggccuaacucucaggaggcgggugugugugccacacccacugcccagcacacgguaggugcaaacaaccagcagugaauggcaccuuauaugcuucccauccacccacacacagcugcucccagugccaggcagaugucuggcaggcaggcugcaucugggaguacccaccgccacccacccaaugagcuuccgggacacccacucccaccccaaacaauggugguuaggaggcuccauccucaaccauuuccagguuuuguguuugugaaagacaaaggacucucugggagagggagggcagccugguccccacccccacuccacagccaacucuacccuaggcaauaaauaacuguaauggccugcucugcuccuaaaaaacacaccacucaagguggggugcaagucuuaguuuaaacacccagcccagcuccauaugaacagucggacccuucuagggauaucacaagcuauguaaacucaagagauagggacuacuggagcuggggcucuuucaguaacauggcauuuugcaggagucucaaggagaauauggcgucaauagcucuccuuuuaaaauguaauucauuuauuuaucuuggguuuugagacagagugcugagauuaaaggcgugugcugccaccccccagcucaguaucccucuaaaaaagguaagcccuuggaggcucaaaaagauggaaugaccuaccuaaggucacagaacuggucaugaugaagacucacgggauccgagcaccaccaggacugccaagugucuaggaggacucaggaugucacccacaaucaaaagaauuugaccuggucaccuugucuccccauucaacacugccucaccuugacgagcuagauagacaugaccgcgugugaaauauucaguugcuccucaaggaacaagaucuagucuccagccaucuccccccccccucggccccccccccacccccgucaucucugucaggauaacugacaaagaggccgcggaggagaaagggcuuugugaacuguuaaguccuggaugcccacuggggacagugucagauauacccauugcaccccaaacacacagacccucacuuuccugugugcagucacucgcuugcagucucaugagaaacaacugacacuaugugguacccacaaaaagggucucaggucucagggaugaaccaguguggccgugagccaaacuaugcaaauggccucauacggaaaacaguguccuguagacaaauguauguuacgagaccaaagugaggacaguccuguccaacaacggacaauauggcuuauacaaggucacccacccagaccaggucucacucaguagcacugucugcucgaccugcugggcugaggccaucccuggucuuaguuuggaggcuaacccuuuuccuagagaacccaaccuaccccugccccucccccaacacacacauuccuuccuuuccguugcuuaggagccuugggauugccugccugggccagggcagcugugcaggcucucuggccugugauguguguguguguguguguguguguguguguguaggagagagcuagcaagagccucauaaccucugggagaucagagcaguacagaaagugggagugggggggggguuccaccaaaugcuagggcugugcugccacaguagggugucuaucuuaaugcccagggcucuguaaggagcugaacacaccauuacucauccagccacagcaguaccccuucauuccugucucccucuggccccaggaucagccagcagugcagaaagccucaaauagagguacccagcggggcaccccagcaccagacccuggaugccucuucaaagcacauccaggagguggaaugaggugcccaaggucauguucagcaguaugggaggcagcuuucacugcauuuccuucagguuagggcaccucauccuccccgaggcaggaguuacaguucaaccugaacugccacuagucccaccagagugccccaggggagggucacaccaccugcuggggggaucagccuuucugaggggugugccugcagcugccacagaggaaugacacuggaaugucccaacuccaaaaauggggacagccugagaggcgaugggggcagcuggcauacccuacccccuggacagaauuauccacauuuugcucuauguccagugcuucaguguuucugagcucuucuauuucacaaugucacaucgucuccacacuagucgguggagcacggcauaaaggacccuaucuacacauagggaaacugaggcuugaaagaaggaaucacacgcugaaagaagacuccgcuuugaggaccaaucuggauucccacaguaaagcccucuauacuacacccagcugucccagcuaggggucaccuuccacuaguauacucugcugucuacguagccugcccagccccccaugcuuguuucucccaagggcaagguugagagggauggaacuuaaccccccucccagagaucccuccugcccgcccuggggaaagagguaagaagaagaaauaguggaaguggcgcagguuuagggacucuugagcucaggaaacugcuagaggcggugucgggaacuagcuggucgcuuucauucagucuugcacauacacacccacacgcagccagucggcagagaagcccugcuugugagagccugggaggaggcucaucucuagguccaggagggccucccgccucugcucccgcccaaggacaaccauucccaaucuguaucuuuggguuggguaugucccaagcucccaucuuaauacugagauaccuuaagaguccugguccuuacuuuugucaaaggcuaaagucaggacuggaacagagucccagaccuugggacguccccuguucgcagguccccaggugaggaccagacacaguagggggcugaggcaggaagaggguacccugagggugagggcaggugagugguguccccgggaaggcggcagagaagacagguuggacaucccgguggaacugcgcccaggaaggcuguggaggaagcaagggaucccagaacuaccggaggcccuccuagcuacccagggggcgggguggggugcacgucucccgcccgccgucuguggggccugcuuagagcuggugcagggggcggaggccgaggucagacuccugcgccaagggcgccugccccuccuagcugcggcguggggaucggggcgaugcuccacggaaaaugcauuuacaggucagccucgugcgcgggagcagaggacaccggggcgcgcacagcauccugccaacccccgccggguguccgagaacgaccucagcgacccgcccuacccacuuaccaugcuggcuccgugaauccuagggcgcgcugcaguccccagcucggucucgaaccuuucucuucccaggcucuucgggaacgcgcgggagccggaucggcgggcaaaggacgcacugggcgacacucguccgcuggccccagagacggagggaaaacccggccugacucacccgcgcggcgcgagccccagcgcccagcccggcccccggauguggggggcgggaaccggcaccgcccccgagcgaccugagccccgcccgggcucgcgggugcugcggggccgggaccccaccgcuagccgcgcauggugcagcggccaccgcgaugcgugcucguucgcucgcucacgugcagcagcucugcagaccccagcccggacgaggcucuagagcgcg

SEQ ID NO: 5986 - RNA, 8017 nt, Mus musculus
cgcgcucuagagccucguccgggcuggggucugcagagcugcugcacgugagcgagcgaacgagcacgcaucgcgguggccgcugcaccaugcgcggcuagcgguggggucccggccccgcagcacccgcgagcccgggcggggcucaggucgcucgggggcggugccgguucccgccccccacauccgggggccgggcugggcgcuggggcucgcgccgcgcgggugagucaggccggguuuucccuccgucucuggggccagcggacgagugucgcccagugcguccuuugcccgccgauccggcucccgcgcguucccgaagagccugggaagagaaagguucgagaccgagcuggggacugcagcgcgcccuaggauucacggagccagcaugguaaguggguagggcgggucgcugaggucguucucggacacccggcggggguuggcaggaugcugugcgcgccccgguguccucugcucccgcgcacgaggcugaccuguaaaugcauuuuccguggagcaucgccccgauccccacgccgcagcuaggaggggcaggcgcccuuggcgcaggagucugaccucggccuccgcccccugcaccagcucuaagcaggccccacagacggcgggcgggagacgugcaccccaccccgcccccuggguagcuaggagggccuccgguaguucugggaucccuugcuuccuccacagccuuccugggcgcaguuccaccgggauguccaaccugucuucucugccgccuucccggggacaccacucaccugcccucacccucaggguacccucuuccugccucagcccccuacugugucugguccucaccuggggaccugcgaacaggggacgucccaaggucugggacucuguuccaguccugacuuuagccuuugacaaaaguaaggaccaggacucuuaagguaucucaguauuaagaugggagcuugggacauacccaacccaaagauacagauugggaaugguuguccuugggcgggagcagaggcgggaggcccuccuggaccuagagaugagccuccucccaggcucucacaagcagggcuucucugccgacuggcugcguguggguguguaugugcaagacugaaugaaagcgaccagcuaguucccgacaccgccucuagcaguuuccugagcucaagagucccuaaaccugcgccacuuccacuauuucuucuucuuaccucuuuccccagggcgggcaggagggaucucugggagggggguuaaguuccaucccucucaaccuugcccuugggagaaacaagcauggggggcugggcaggcuacguagacagcagaguauacuaguggaaggugaccccuagcugggacagcuggguguaguauagagggcuuuacugugggaauccagauugguccucaaagcggagucuucuuucagcgugugauuccuucuuucaagccucaguuucccuauguguagauaggguccuuuaugccgugcuccaccgacuaguguggagacgaugugacauugugaaauagaagagcucagaaacacugaagcacuggacauagagcaaaauguggauaauucuguccaggggguaggguaugccagcugcccccaucgccucucaggcuguccccauuuuuggaguugggacauuccagugucauuccucuguggcagcugcaggcacaccccucagaaaggcugauccccccagcagguggugugacccuccccuggggcacucuggugggacuaguggcaguucagguugaacuguaacuccugccucggggaggaugaggugcccuaaccugaaggaaaugcagugaaagcugccucccauacugcugaacaugaccuugggcaccucauuccaccuccuggaugugcuuugaagaggcauccagggucuggugcuggggugccccgcuggguaccucuauuugaggcuuucugcacugcuggcugauccuggggccagagggagacaggaaugaagggguacugcuguggcuggaugaguaaugguguguucagcuccuuacagagcccugggcauuaagauagacacccuacuguggcagcacagcccuagcauuugguggaaccccccccccacucccacuuucuguacugcucugaucucccagagguuaugaggcucuugcuagcucucuccuacacacacacacacacacacacacacacacacaucacaggccagagagccugcacagcugcccuggcccaggcaggcaaucccaaggcuccuaagcaacggaaaggaaggaauguguguguugggggaggggcagggguagguuggguucucuaggaaaaggguuagccuccaaacuaagaccagggauggccucagcccagcaggucgagcagacagugcuacugagugagaccuggucugggugggugaccuuguauaagccauauuguccguuguuggacaggacuguccucacuuuggucucguaacauacauuugucuacaggacacuguuuuccguaugaggccauuugcauaguuuggcucacggccacacugguucaucccugagaccugagacccuuuuuguggguaccacauagugucaguuguuucucaugagacugcaagcgagugacugcacacaggaaagugagggucuguguguuuggggugcaauggguauaucugacacuguccccagugggcauccaggacuuaacaguucacaaagcccuuucuccuccgcggccucuuugucaguuauccugacagagaugacggggguggggggggggccgaggggggggggagauggcuggagacuagaucuuguuccuugaggagcaacugaauauuucacacgcggucaugucuaucuagcucgucaaggugaggcaguguugaauggggagacaaggugaccaggucaaauucuuuugauugugggugacauccugaguccuccuagacacuuggcaguccugguggugcucggaucccgugagucuucaucaugaccaguucugugaccuuagguaggucauuccaucuuuuugagccuccaagggcuuaccuuuuuuagagggauacugagcugggggguggcagcacacgccuuuaaucucagcacucugucucaaaacccaagauaaauaaaugaauuacauuuuaaaaggagagcuauugacgccauauucuccuugagacuccugcaaaaugccauguuacugaaagagccccagcuccaguagucccuaucucuugaguuuacauagcuugugauaucccuagaaggguccgacuguucauauggagcugggcuggguguuuaaacuaagacuugcaccccaccuugagugguguguuuuuuaggagcagagcaggccauuacaguuauuuauugccuaggguagaguuggcuguggaguggggguggggaccaggcugcccucccucucccagagaguccuuugucuuucacaaacacaaaaccuggaaaugguugaggauggagccuccuaaccaccauuguuuggggugggagugggugucccggaagcucauuggguggguggcgguggguacucccagaugcagccugccugccagacaucugccuggcacugggagcagcuguguguggguggaugggaagcauauaaggugccauucacugcugguuguuugcaccuaccgugugcugggcaguggguguggcacacacacccgccuccugagaguuaggccccagaacaugugggagacaguucagaagccuggucccgugguguggagcugaaguguguagugaagcucagccuugguguucugugcugacuguggcuucaggccaguccuggucacauuaucuuaccccgugcucuccggcaucucuacaugauaaaugcugacuaucguagcuuuucugcuccugaaguaggcacggcucacaugggcuaggcauggcuaaggucacaagcugcuagcugccagccccgguucugugagccuggcugguggcaccuaacaacagaacacagcgacauuauaaagucugucugccucucuucccucugccgccgucacugccuagaccuggacaccuguuccggaaacagaggccauuguuccuccccuuaggcccuuccuguguguaucaccauccuuccuccccuugggcccuuccuguuuguaucccucccacuguaucccgccugcccccaaccucacccacuccagauguuucccugggggaccucugacccuuugagggaagagggguuucccaccuagagaagccagaaggacagaccugcguucugguucucaguucuuguuccuuccccaccccccaaauuugauuuagagcccaucagaaguaagcaaggucaugggucagacaaaaccugagccacccucugcccuuugcuggcucguuucuaggaagaaggcccuugcccuacaacuugagggccucaccuuccugccuugccucugcauuccgcuucagaccccugucugggagcugugccuuuagguguucccguggaagucccauuuccuuugcuuuagacucagucugacaguagucaguguacccuuuccaucgcuugccauccugugacucccauucuguucacacauaucugcuucugacaggccugggcagagcgaguugcuuacagauggcaagugucugguuuuagugcaucugggaacucggguacugagugcccaccugccacuaauggagccuucugauucccagaaucagcugcccgagcccuguugaaccuucauggccacaaccucaggcccugcuggcauugccaugggcagcguagguagccuguuggaacggcaagacuuuuccccugaagaacuucgggccgcacuggcuggcucccggggcucccggcagcccgaugggcuccuccggaaaggcuugggccaacgagaguucuucagcuaccugcaucuccccaagaaagauggcaagaccaccaagcgagccccucggaacgagccagacuaugccacccucuacuaccgggagcauccucgggcuggugacuucagcaagacuucccugccugagcggggucgcuuugacaaggugcaucugcguuucaggggauugggcccagcucagagacugugaugcuggggugguuagcugggaggcccugaccgugggauggggcagauugaggugugggaagucugaagccugaccaaugccuccuugugauacuacccuguauucucagaggggauucccuagggccuucgggggcacgagguagaaaaaaguggccaacucaaccuugcucacaccuacguucucuuccugacagugccgaauccguccuucuguguucaagccuccugugggcucugggaaaggcuucuuguccaugcaaagccuggcagcccacaagggccagaaguuguggcgaagcaacggcagccugcacacucuggccugucacccaccccugagcccugggccucgggccagucaggcccgugcacaguugcuucacgcucucagccuagaugaagguggcccugagcccagccugucggacucuuccagcggggguaguuuuggccguaguccagguacuggccccagccccuucagcuccuccuugggccacauuaaucaccuuggaggcucccuggaccgugcuccaaggagccccaaggagucuggaccucuggcgguccugagcugccugcccgaaccaccuccccccuaugaguucuccugccccacuacugaagaggucgccguguugccugaggcccgugaagagcucaagagggaccucggugaccaggauguuucuaacuccuuuacucaggugaggggaccccugcccuggagugcuuugucccuugcauugguauagggaccagauucaucucugacaucuggcauaacuugagguagggacaaaccgugagcgaggccuaagcaugguaugauauugggggccgguugcgugguagaggcagcagagaaugagaccagaggcuauggcccugaugggguccuuucucucauugugcuuaaggaaagaaaacaucaaacaaaccagcaaaaaccgccuguaaacuggcaguaugacucagugguagaguacuugccuagcaugugugaggcccuaaguuugaaucucaccacugaaaagaaagaggcagcuccccuuagccacccuucaacuacauggagggauuccauggccccuugguccugccugggaacuguguaggaaggagggagacuguuucugugaguugcguguaguaagaacaguguggagagccucuuuggguaugaagcguguguggucaggacccuggguucuguagccuaggugcauaagacauuaaugguggcuggcuaugggcacaaaugaauguuguuauggggaaggccaaguauggaaaucugagcgaggcugugcccauugcuaaccaguuaguuccucuuuccugcugcaggugcuagaggagcgccagcgguugugguugucugagcugaagcgucuguauguggaacgacuucaugagguggcccagaaagcugagcgcagcgagcgcaaccuccaacugcagcuguuuauggcucaacaggagcagcggcgccugcgcaaggagcugcgggcucagcagggccuggccccagagccucggacgucuggguccuccauggaggcugaccccaaugcucggccagaggaagaagcccgaugggagguaggacaccaucugaggcaucccaugcugucucuuuguccugaucccaugcucuauuccaucagacagccggccccagugucauacaguguuuggccccugcucacgguuuguccuuuaccccaggugugccagaagaccgcggagaucagucuguugaaacagcagcuccgggaagcccaggcggagcuggcacagaagcuggcagagaucuucaguuugaagacgcaacuucggggcagccgggcacaagcccaggcucaggacgcugagcuagccaggcugcgggaggcagugcacagccugcaggagcaggcaccgcgggaggaagccccaggcagcugcgagacagaugacugcaagagcagaggacugcugggggaggcaggaggcagugaagccagagaaggggccgagcagcugagggcagagcugcugcaagagcggcuuaggggccaggagcaggcucugcgcuuugagcaggagaggcagacuuggcaggaggaaaaggagagggugcugcgcuaccagcgagaaauccaagggagcuacauggacauguaccgccgcaaccaggcacuugaacacgagcugcggcugcugcgggagccuccuacauccuggaguccccggcuggaguccuccaagaucugaggcucgccaagugugcugacagugggcauacugucagaagauacccugagauggcaggcuccucccuugcacugguuggaggcagaaucuguagaggccagaucagggaugggacgcccgccccguggagggcuccagcgggcaaugggauggauaggguaccugcucccgaagcuguggcaaagucuugcuagcagcgaaccacacccagggagggucuagcccugcuuccaacaguggguguggccugguaaaguagguuggagccguccaagcuucagccccacgaugcagaagagcaggagaggaggaggguggcaugugaccuggccugaggucuuccuccauggaaggagccaggguugggaagauuggccaccuccagaauaaaaagcacguuuuuaugaggaggccuaguugauaagauuguccuuggccugaggccagaggcuccuggauggucagugcuccaggccuuggaccuaggcuguaguuccuucuauguucccaacaauggaaagaauauaccccauugcagucucuggucuuauguguuugaaaau

SEQ ID NO: 5987 - RNA, 71374 nt, Mus musculus
cucgcccucaguuccgccuccuugcggucucgccaccaaucccugugcuccggaccacuucacuccaaccccaagaggcaugugagauuuuuuuuuugggggggggggguuguuuguuuguuuguugguugguuuuucguuucuuuguguaguccuggcuguccuugaacucacuuuguagaccgggcugccucaaacuuaagagaucaccugccucuuaaagguaugggucaccaccaccaccaggcuguuucuuucuuuuccccccucucaguaauaggggguugcaguccaccaccaaaacgcauuugccacccuuuaguuauuuuaauguugaaacaggaucucacaaaguugcucaggcaagucgugaauguaucaucuuccugccuuugcuucugagaaacugggauugcaaccuuguagcaccagguccaacuuggcaucucuuuccuaaaacuacaucuuuugagugacccuugaguuuaugcuaggauauguuuuacuuccugcaauucuuuggaaagcccacacccugcucuuggacgugucucauuuguccucugaacaucccuugcucuuaacccucgugcucaagccuauauuaaaaugucuuucuuaauuuccaccuaaauacaccuuuuauagggagauggcuggaaauagagcucaaugguagaaugccugccuuagauuauaaaauacucugaguucaguccccuguaacacacacacaaaaguggguccuguuugucuuguuugagaaagggucucucuacauagccacucuacaucugccaucaagugacaacuaggaguuuaaucccuggaacccacaaacugaauaaacagaaucaacuccugggaaaguugucaucugacuuccacaaguacaccacacugaacaaagggugacauguuuauuauuuaaaguauggaagaacagaaaaauaaaaacucagaucauuuuuuugaagaaucucaaucguaccauauuaccaguuuuuauuucaugggcagaguuguaaaauacaacacuuaagucaggcagugguugcaaaugucuuuaaucccagcacuugggaggcaagggcagguggauuucugaguuugaggccagccuggauuacagaguaaguuccaggacagccagggcuauacagagaaacccugucauaaaaagaagaagaagaagaagaagaagaagaagaagaagaagaagaagaagaagaagaagaagaagaagaagaagaagaagaagaagaaggggaggaggaggaggaggaggaggaggaggaagaagaagaagaagaagaagaagaagaagaagaagaagaagaagaagaagaagaagaagaagaagaagccgccacaacacuuggucuguccccaugaguuacuagucacuucagcuuucaguuccugcaucugcacauuugggacuaauauucagaaucaaucaguguuaugaagaaacaauaaccagugcaaaccugguggugcaccccuguaauuccagcugggagacagacauggggaggucaggaguuccaagauggccucacuugaauacauagcaagucugaagcccacaaggaccacaugagacccuguguaaaaccagacagaauaacagaauaacauacagaaagcaguaaauauggggacagcauugggaagcauuacugcuacacacuagccugagguauugggcagugccgacaauuucagcacuugggaggcaggggcaggcagcuuucugaauuugaggucagccuguuuuacagagugaguuccaggacagccauggcuacacagaaaaacccugucuugaaaaaaccaaaccaagccaaacaaacaaacaaacaacaauaacaacaaaacaaaacccaaagccaaaaaacaaaacaacaacccacuaccccaagacaacggagaacuuaaaucucagucuuagaaguuuuagccaggcauaauggugcaagccuuuaguuccagcacuugggagucagaggcauguggaucucugaauucaaggcaagccucgucuacagagugaguuccaaaacagccaggauuagagagacccugucucaaaaaaccagaaaccuuuuagagguuuugacuaaaacaagaaaaacauagaacuguuuggggcgguuucacauggcacagcacacaggauauauugagucagacugaaagcugagaguaguuuggcacgaggcagacccagugagacaggugagggguggccagggccuggguugggucaauggggagagagaaacagggagucaagagaaugaggaaauaugucuuguaagguuaaagagcuagcaaagucugaaguuuuaacagggauuaacaaauacacaucucgccaggcgugguggcguacaccuuuaaucccagcacuugggaggcagaggcaggcagauuucugaguucgaggccagccuggucuacaaagugaguuccaggacagccagggguacacagagaaacccugucucgaaaaaccaaaaccaaaaccaaccaaacaaaaaaaaaacccaaauacacaucucuguucuacacaauguacuuuagauccuguaaucuuugcauuccccucagcagcugcucuuugcuacuuugugaguucuuuuccccaccuguucucugcccaccucccauuucacucccuaccacuagauaggagagaaacaaggauggggggagagagaccugugaaucuaauuucuuuuuguuucuucuuugagcacuacuaacaaacugcaaauaacccccaugaacaaccacuaacuauaccuaucagggcucuagcacuuauauagucuuuaaaaaguuccuagaauuccaaauggcacccaaucccagaaacuaucugcaggagggaaaaucacgccccugcucgagcaugaggcaaaucagucagucagcugcugcaaagcagccccauaccccccacaccugggauuaaaacaaaaguauauuucugugguuuuuaaaggaaccaaaauucuagaaaccauugcuauaccccuccaucaguuauucucccagcaacuagaauuuuuuccagugagucaucuuaucuuggugguucucaaccuggagguugucuaacaaccuccuucacaggggucaccuaagaccaucagaaaacauagacauuuacauuaugacucauaacaguagcaaaauuauaguuaugaaguagcagcgaacaugaguuugugguuggggugaucacaacaugaagaacuguguugaaggguuucagcauuaggaagaaggcugagaaccacugccuuagcugucuguguaggcagaggcagcaaagcugggucaugaggggcuuugagagugugggcagggcuucugauuuuauucaguaggagaugagaggaauuuuaaguugacugagcaggcaggaggaacggcaauacauuuuggagagccagaaguaccuguacugaagugucuguaccuggggacuuacaggguggacuagggagaaagaauccagaagaaacauuccaguaguucuugugcagggugcugcaagcucaacacacuggguaaggagaacaggggugccauaaaggagcccucaugagcaaugaagcgccccggccugcugugcgauggccgaaccuauguuguguuucacaacagcuaaugucacauacaagcagguguccuaacacaggcaaaugagggcaaaggaacuguuccuaaaucggagcaaggaaguuucagagaaugaaacuguuguucaaauaucuauaacugaauuguucuguuugaaccacaagcagaaugaauuuuuguuguuguuggagagagaggcucucuacauagcccuagcuguuccagauauguagaccaggcuggccucaaacucauagggaucuaccugccucucacucccaagugcuggguuacagguaugcacuaccuggccucuccuuaagaucuuaaaguugacaaauuggaagguaaaacauucagaaacauaaccauaguuuggguguuaauaauagcaacaaagaaauuuaggaguggaacaaaauaguuuacuuauuagucaacuauuuauagcuauuuaacugauuuaaccaaucagguuauuuacuuuuaaaaaucugagcacaaagauauugcuuaaaugggacaaaguucaaagaaagauugauuuaaccaaaucaaaccacugugccaagguuaacaaaccaagauaauuccaaagggguugaauauaaagagauuaaaccacgggaaguuggaaauuaugccuuaagcauuuaccucuuugaagagagaccaauuuuuuuuuuuucugaccucacaaaacuucggcaguuucugagcucuauuuucucuuuaaagugaggcuuagauuuuuguuguuuuuuugggggggguuguuuuguuuugaaagauuuauuuuauaugaguacacuguagcugccucagacacaccagaagagggcauuggaucccauuaaagaugguugugagccaccaugugguugcugggaacugaauucaggaccucuggaagagcagucagugcucauaaucacugagccaugucuccagcccccugguuuuuguuguuauugcuuuguuuuacugcuuuuagguaugugguuugggauuuuuaucauagauguucuuuuuuuuuuaagauuuauuuauuauuauauauaaguacacuguagcugucuucagacacuccagaagagggcgucagaucucauuacagaugguugugagccacgaugugguugcugggauuugaacucaggaccuucggaagagcagucagugcucuuacccgcugagccaccucgccagcccaucauagauguucuuaagugaaaguuugauuaaaagucaucuucagccaggaguaguggcgcgugccuuuaauccuagcacucaggaggcagaggcagguagaucucuaugaguucgaggccaaccuggucuacaaggcaguaccaagaugagaaacugucucuaaaacacaaagcaaaacaaaccaaagaguuucaucuucauccuaaagaagccuaccuggaucuuguaauaaggagugggggcguggagagacggcugguagugaagagcaccggcugugcucccagaggacuaggguuccuuugcuaucacucacaucauggcggucacaacugucaacuccagugcugggggaugcagugcccccuucugaccucugugugggcacugcauacacaugguguaaaauacuuuuuuuuucuuuucuuuucuuucuuuuuuuuuuugguuuuucaagacaggguuucucuguguagcccuggcuguucuggaacucacucuguagaccaggcuggccucgaacucagaaauccaccugucucugccucucaaaugccgggauuaaaggugugugccaccaucgaccagcguguaaauacuucuauguagguacccauacauacagaaaacaaacuuuaaaacaauaaaacaaucuuuuuuuuuaauuguuuaauuccacucagagcaaauauauuuuaguaugguuuugagguaacuauuaaugaaaucaagguuaggguaaauuuguauaugugguuacugcuugcuucuugggucugacaguaguuuuagauugugcucuuuuucuguaauacuucguagccagcauuagauaguaaaugaguuugguaagauguacuuucgcccgagguugugaaacucauggcauaauacguuucaaucagcagcacacaucugugaaggacuuugucaucugcuuggagcagguaaaaccaaaguagcuaaagaucacacugauaucacuaaguauguugcauaaccaaccaguuucuacuucucuuuggucuuacaagucagaaagucuguuuggggguaaaaauaaaagcaacccacaagcuacuugcccagaaaggacauuugaauuauucgacuuaauguaaacucucauaauguaaacugccuuuaauucuuuugaacucagggcuucuuccuacaagguuagggaaacucuuuaugagugaccuacauaucuaaccccuuuuaaagaaacugaguccugguaaauugcccaggcuggucuugaauucaagaucuuccugccucacuuuucuguauccagaacuauaggaguacgauaccauuacaauuaccauuuuaaauguuauuuaguccggggccucaguauuuuuuuuuuuuucgggacaggguuucucugauuagcccugauuguccuggaacucacucuguggaccaggcuggccucgaacucaaaaauucgccugccucugccuccugagagcugggacuaaaggcgugcgccaccacgcccggcuuggagccucaguauuaacuaaauacuuguuauuauagaaguugccuagcucaguguaaacuaagggcuucccuaggacauuggacuccauugucaacacugggauaggagagggauggauucccgauccaugugugguggauguacuucggagugacuaugcuaccaacaggcuaacgucaaaauuaaucuuaauccuccaguugaaaagaagagcuuccuccuuaacgucaucagacauuuuaaccuugacccagcaucuucacuccagcccuggcugaccugacuaggccgccuucgaacuuagaacacuucugccucgaccuccugauugccgccaugucccgcccaugacacuuugacaaacacacguaauugaacaccucuuuuuaaaauucucuugcacucuacagcuggcauagcaucggcugggccaccagcgguagccgaggacaucggucgucucagguaauccucagagaaucccggaagaggagccgggucucuccugucccacccaaucgauucuaaaaauccgcaccaccccugggacugucagcaaggugacguucuccacgccggguauuuucgcaguggugacacaggcuacuuccggcgggcggcgggaguccgugacguggcaggcgaguccgugcacgguccuccgggcccggacacgggacugucaggugcccucggggcagcuccccggggacagagagcacggccgcagccuccagccggaaccggaagugccacguguccccacugugccugcgcggccggcggcuccgcccagggccucccuccucuccggguucggcugcugccuccgagcccggcguucccagcccagccggccugacuccggagccucuccgcgcccuggccaggucguggccgccggcgggcagaagacacggacacgccaugccucuacuuugacgugccaccccgcguguuccgcuucuccggccuccaggucccugcccucgguuuuccuguuggagcucuuaggcugggcgcugcggucgaccccgacggcuccgucuuacccugagauccccgggcgccauggcccagccccggauccccgcugcccgcggugccgcagcuagccuccaggcccagaacggagccgccucagccucggggucucccuacaccaacggugagugccgcacgggggcggggagggcggcacagcucgggccagggacaagucccagccaggucuaccgcggggaguggcggaugacggccuggacccgggagccgcgguggacaugcaccugcagauccacgcuggugggacaguuucauguguauuuauagguucagccugcaaacaguaagcaccugcaguaugcaacgucugagauaaacaagaggugaacaagaaucguagacgaaaucaguucccagaacugccuuauggaggucauagugucugggugucaucacgcaaugcgccaccucaguccuguguccuggagggcaggguucaucucggguccgcaggcucgaagugcagggggguggcgggucagugcuuauuaauacuaauuugcagagaugaaugaaugacuccgucuuugacagaucccuuuaggacuugcucaucucugcagggaucuuucuucaaggaucuucuuccuacgacaguccuugggccuccuguuuaguuuuucaguuguggaagaaccaaauagauggauggcuagggcuucguuucuagggcccuccucuucauuuagaauguaaguuagucacaacucucugaacccuagagagaguacaucuggcacuauaauuuaucauuuggcgggagaauaucuuauaauuggauaucucuucuaggauuccugacgccuuccuacagcgugauuugcuaagcuuauuuuaauugauauaauaaagacucauuuucugccuacuuacaaauuagccuacaaaucuuugcuuuaugggaagaagacagggagaauaauacuaaaguacuuacugugcccauuuaaaguuguagaaaauagccagugacuaaaauugcugguuacaauguauuuagagaagacuacuguuuucuuuacaaagaauguucuuuguaagacuuaaaaauguggguaggcagcuaugugggcagggcaagagaagcugagaaucacugacagguuuucaacuugaauuguuucuugaguuuauaguaagagauuauguaaacuacauuuucuucugugacauugacauuugcugagaagaugcaaucauccacuuuaaggugaaaacaacugaagaugucgccuguguggguuuugcuuacgaauugcacuuaaaucacaaaguaaaugugccaguaagcuuacaugcaaguagagcugugaggacuuugaaauguuuuugcaggaauugaaucaguauguuaggcucuguuggagauauuccauugcuauuuauuuauuuauuuauuuauugacacugucucgcucuuaucuccaguuggcuugaaacuuguggcaauucuccugucucagcugcucuagugcuugcauugcagagcuggaauuuccauagcccacuuacuuuguuaauuuggucaaagccaaacaugcaccuguugcacaucuauguucugaccuugggcauaagagugcacuccugucuggguugcuuagagcuauuugggaauccagauauggaauugugguucaggaugguagcagcuguaaaaacuccaauaaaaggaguagagauaagacuguaagaauaaagagcucgaguugacacuuuugcuguucuugguuguuagggugauuuauuuuauuuuauuuuauuuuuacuuuugagguuaucauauaacugcauaaucuaugccuuccccuuucuccucgguguuuuauaauaaccuucuuuaauuauuuuuguuuuauugaagcaggguuucucuguguagcagccuuggcugucccuguagaccaggcuggccuggaacucagauauucaccugccucugccucccaaguggugagauuaaaggugugugccacuacugcuuggcuguaauaaccauuuuaaaaguuuuuuugugguuuuguuuugaauuaaggucuuacuuuauagcccuggcuggccugaaacuuccuaugagauucaccugccucugcuuuccaaaugcuggcauuagagacuugugccaucagaagaagcucaccucaauuucuucuaguagcuuuucguguguguguguguguguguguguguguguguguguguugagugugacaggcucucacuaugaagccauugggguuggccuggaacucacuguguaggccaagcuggccucagaugcucagaguuuccucccucuaucugcugagaacugggauugaaggcguacccagccuauagugcccauuuuugaaguguguuuuuaguggaagucuugucagucaguggcugauuuccuguguuaagugguuguuuguucaucuuuaauucugagaauaggguuguggcucugaaggugaaauggagaacaguuacaugcugcaaucuaugcuugcuaaacucaugcaagucaguaauugcugcuuacacauucuguuuggguuuuguucuguuugagacaggguuucucuguagcccuagcuguccccuggaacuggcuuuguauaccaggcuagccuugaacucagagcacgccugguaguuacauuugaaaaagucuuaagauggugguuuaauguacauguauaaguuaacauguuauaguaguuauaucuuaagauauccuuuagauuuaaccaaaacacagcaagaauggcuauuuuuauuuucuguaaauugcuuuuuuuugcuguaauucugacacuaaaccguuuugcucugugauagguuauuauguuguauuauaaucuguauuauuuagaaauguuuuuaauagugauuuguuuauacauauuuccauugcaaaaauugauagugaagccucaagacaaccaucucauccugacugccauggucaggauaaaggagauaagggcucuaucacuguguacauccuuugcuggcuguuugaaccaacuugccaagacaguuagagacugaagcuuuguuacaugauuucuuuguaauauuuauguaauaguuaccuuuuacauauagaacuaaagcugagagagauaguauccuuucccuucccccugauagacucuuaauuuuaugaaauaaugucugacaucccucggccuguaagcccuguaacuuagagccccccacagugucuagcacauugaagagucacuaauuuggggguugaagagaugaaucagugguuaagagcaccugcugcuguugcagaggaccagaguucaaaucucagcacccacauaguagcucccaaccauuucuaucuucaguuccaggguagggaacccaucacucucuucuggccucugugagcaccagguaggccuguagugcaauauguaugcacacaaaaaauaccuauacuuuuuuuuaaaucguaguuuuguugaacaaaaguuuuagaauuagguguuuugcuguucauuucaaugaauagguauugauuuauucauaguaagauuagagcgcauuuucaacuuauaguucaauuuauuuauuuuaaaucuugugugugugugcacacugugugugcuguguauguguguauggugggggugccuacauaagccaaaggugcuggauccuguagaacucgaguugaggugguugugaaccaucugacaugggcucuggggauucaaguuggguccccugaaagagcaaucaauaccugcucuuaacuucugagccauuuuucuagcccacauuuucaacuuaaaaaguauuuguguauguucauacauucauguuucugugugugugauauacauaucuauacacacacacacacacauauauauauauguauacacacauauauauacacgcauauauauguauguauguguguauauacauauauauacauacauauauauauauguguauauauauacauacacauauauauauguguguguauauauauauauauauauauauauauacacauauauauauaugccacaaaugugaaggugcccucagaaaguaaaagggggcauuagauccccuggagcuggaguuacaggcaguuggcaguugugagccacuugauacgggugcuugccacugaauuugggucaucuggaagagcagcaaguucucuuaauggcuuucgucaugaaacaggcugugacuaaaggagaugucuugucucuuccacugguuauuguggcugagcuccauuguuuucagaaugggcaguaacucggcuuccaaagucaucucuguaccucuauaagcacuuaucacauugcaggccagagauaacacucagaguaaagcacaucuuuagcauguacaagacuuuagggggcuggcgagauggcuuagugguugaaucccagcaaccacaugguggcucacaaccauccguaaugagaucugacgcccucuucuggagugucugaagauagcuacaguguacuuacauauaauaaauaaauaaaucuuuaaaaaaaaaaaaagacuuuagguucagugcccugcacugcagaagccacaagaguguaacacuguugccuguaguaacuauugaacugcuucuucugugucugcugauagagggagggcucuggagagacauaguaacaggaccuagugcucacuguucuguugcagugcucucaggcacuagccaguggcacugggaauaucauccaauaacuuaccuacucuucuccugaucccaggacccagauccuugaacuagugugagaaucggggaucagggccuuguaauugcuuccuuuauaacuacaacaaauaguugcugacaauuuuuaagacugcuucuugcuuuauuucccuguuuuuuuucucucugaucugaguuuuaaguaagggguaacuaucuaguuuucuuccuuucucucucucucucucucucucucucucucucucucuuucuugcuuucuuucuuucuuucuucuuucauuaguauucugcuccuauuccagcauggacuuuccuauuaucguuauucucugucagucucauaguccucucuuuccucuguguguaugcaucuaacaggcgcuuaugcuugggaggcaaacacuccaccacugagccagaucuugaacuguucaucaauguccuguagaucccgagguugcuccgacccuaagguugauuugcuuuccuccuuuuguuacuguuuuguuuuguggugccucagcaccugagcucaccaugcuagcuaggcaaaucaccucauugcugagcuacagccucaacccacaccuccaccccugcucugugugugugugugugugugugugugagacugugucugugugugcgcucaucaucagaggccagaagagggugucuaauucccuggagcuggaguuacauggaguugugucacaugaugugggugcugggagcugaacuccagucaucugagagagcaggguuucucuguauagcccuggcuguccugacuaaaggagaugucuugucucuuccacugguuauuguggcugagcuccauuguuuucagaaugggcaguaacucaccagcccuuucuuguucuuuucuuuucuuuuuuuuuuaaagauuuauuuauuuauuauauguaaguacauuguagcugucuucagacacuccagaagagggaaucagaucucguuacggaugguugugagccaccaugugguugcugggauuugaacucuggaccuucggaagagcagucgggugcucuuacccacugagccaucucacuagcccuguucuuuucaaaagagggucucauaugcccuagcuggucuugaauucauuauguagaagaggcuggccuugaacuccuugauccucugccucuaaccaccaagagcugggaugcacguauuuuuacuuuauuaaccagguaguaaucuguggcucuacugaggacaguauggggaacaugugaaaacaggcuuguaacucaaaacaccuugauggcagaggcaggaggauuucaccaaguccaagaaaggccagccuguucuagauaagagugguauaggccaaucauagcuaugcaguaaaaaucuguucuaaagccaggcgugauggugcacuccuuuaaucccagcacucgggaggcaaaggcagauagauuucugaguucgaggccagccuggucuacagagugagauggcucaguggauaagagcacccgacugcucuucuaaagguccagaguucaaaucccagcaaccacaugguggcucacaaccauccauaacgagaucugacucccucuucuggagugucugaagacagcuacaguguacuuacauauaauaaguaaauaaauaaaucuuuaaaaaaaaaaaagaacaugaaagaaaaacacccaaauccgguggggccagagagagggcucaguaguuaaacguacuuuugcucugauaagagaggauccaaguucuauucccagcacucauaucaagcagcucacaaccaccuguaacucaagaggauccaacaccucugugggcaccugcauuccauacacauacagauaacauauacauaauuaaaaguaauaagaaaucuuuaaaaaacaaaaacuggaaaaaaaaguauuuuugguuugauuuaguuuuugagacaaugucucauuauguaacucuggcugucuuagaacuuacuauguagaucaggcuagccuccaguucagagauacaccugccucugccccccuagcacuggauaaaaggugggcauuaccaugucuaguauuuauuuaggguuuuuaaugcagucuuacuggcagaaugaggagaugggcaauaaggggaaacaaaugacuuuaagaaauagcugccccccccaguugcuuuaagauaauggaaugcagaaacaaugagcaaggaauaauuguccaguaauuggugugaagggaauguuguguggauggaauguuacugcagguguuucuaagcaccugugaggucgguggggcuggaggggcacugcuuccuggaggacacuuacuguuggacuaggaagaggucaggaauaaaggaacaaucagugucgcuucucucugcuuucccucacacaacagagaacccucuugugaccacgcuggggugugagcacaugcaguucuccaauggucacagcuacaacucagccuauccuauucaguugugaccccauccauccagaaauacaccagauucuucaggucauguaaggauucugucccauaaguugccgguaccaagucaagguuucugacuugugcuucugauuggcuauaucagugaaucccaugacccuccugcuuggaugcagaaauuugguagauagcucacagaacuugaggaaacauuuauaaugaacauuauaaaguuuauaugagcagccagauucauaagaguaagcaaguguggggaagggcaaccccucuuagaccacucucuucagcaaccuggaagggcaaccccucugugucuucagcaaccuugaaggucaucauguauacaggaugggaugguuugguuugguuugguuuuccgagacaggguuucucuguguagucuuggcuguccuggaacucacuuuguaaaccaggcuggucucgaacucagaaauccaccugccucugccucccaagugcugggauuaaaggcgugcgccaccacgcccggcccaggaugggauaguuuuaugucagugaccagguguguaguauggggguccccacaccuuuuuuugagacagggucucugccacccagacuggccucauacucuggucauaaagaucuuucugccuccaucuuuagaauuccgagauuaugggcaugagcuaccacaccuggcauuggccugcagacuuaaagaaaacaauaauucuuccuuccuuucuuuuucuucuuuuuaauauuuauuuauuuguuuguuuauuauggaugugagucuacuguuacucucuucagacacaccagaagaggacaucagaucccauuacagaugguugugagccaccauguguuugcugggauuugaacucaggaucucuggaagagcagucagugcucuuaacugcugagccaucucuccagacccucuuuucucuucuucucuucucuucucuucucuucucuucucuucucuucucuucucuucucuucucuucucuucucuucucuucucuuuccuuccuuccuuccuuccuuccuuccuuccuuccuuccuuccuuccuuccauccuuccuuugguguguauaauguguugggugacauguacaggugcuauggugcacagaugugggggucagaggauaucuuuggugaguuggcucucuucuaagcuugcauggcaaaugcuuuuacccaaugagccaucucaguacccaaauuucagaauauuacuacuuccaaagacaaggcaaacccuuuagcagucacuauaguaccccaaccaugaaucagccuuuggguauggguuuucuuauucugacauuguauauagguuaauuauacaaugcauguauaauuagagccuccugugucuggcuuuucucugugugugggggggggugggcagagguaguggugguggugguguugggacgugagcuccgugccuuauacauaguagacagaugcugugcuccagucccaacauacaguaauacuuuuaaggcuuauagcauuuauaaccuguuagcagcacuuauuuuuaugacuaaaucauaucccauuguauagauagauauauccuacuggguuguccuucgucuguuaauggggugauuguccccauuuuggagcuauuagucacuguucuauugcuguaaagagacaccacaaccaaggcaacucuuuaaaagggaagcauuugauugggggcuugcuuaguuucagaggcuuagucauuuucaugguaagacacauggugacacacauggcacuggaacaguaucugagagcuacauccugaucuucaggccacaggaagagagaaagcugggcuggcauggguuuuugaaaucucaaaguccauccccagggacacccuuccuccaacaagaccacaccuacucuaacaaggccacaccucuuaauccuucuaagauagugccacucccuaauuacuaagcauucagauauaugaaccuauggggacauucuuauucaaacuaccauauuccacucccugcccccauaaguuuauagccauauuauaaugcaaaaugcauuaguacaacuucagaagucccuaugugcucugcuucaggaguuuuaaaaguccagaguuuagccaggguacaugucuuuaaucccagcucuggggagacagaggcaggugaaucucuguguucuaggacaaccagggcuucacagagaaacccugucuugaccccccccccaaaggccaaaguucaaagucucuucugagauccgugggauucucuauaaaaucaaaagaaaaaaagcagauuacauacuuccaacauacagugacacauuaccauuccaaaagggaggaaaggaaguguuaguguaauuuuaaaggugauagguuuuuuuauuccaaauagcuuccaaauaaaugagacaaagacuauaagacuuauuuacucaagccuuacagcacaauagcugaacaguauuaauguauuuuaauccucuaaacuaaucuggcuacuucccagccagagucccugagauucuugcaucuuagcauuggucuagcucucucugcuccagguguguucucauaaugucuccuugacccuuuguucauggagaauccucccucccccacccccacaccccuccccuggcugggaucagaaguccaguccuauucucugcucagacuuuggcugaucggcuuuuauugacaugucagagaauaaauguuuauacaacauugagucaagagauauuuagaauaagcauuaaaaugucaugucuggauugcagccagauacaggggcauagaaaucagcauuuguauaauacaagcauaaucucuacacaguguacaauaacauagugaggaaauaugggacaaagcaagacuaaaaccagcagggaaaacuugaaaaucugcaucucuaugucugauaucaaaaugcucuucagaucucuuacucuauucagcuuuguucagcacacuucucucacuugggcugguuccacaucggaucuucaguucuccuuggcaaguauuaaacaaaucuagcacccccauuuucuuggagucugcagugaaauccagguuucaucuucacagucucaugcaguggucucucuaggccuccaugcacagggacacuccugauacacuccaggccucagugacuuucuuuagccauggagggagauuccacaaccccuuucuuguauccuugacucuaaagccagaaccaugugaccaaagcugcccaaguuuagcugcuugauggugcuuggcccucucuugaauuauaucugcaccaguuuucauuuguagguuauuuccuccacugcuuaagcuuuucuuuaaauucauaaaaucaccaauuggaagcgaggucaccacucccuuuauuccauccagccucuggcuuuucuuuaaacuguucaucuccuggagcauugaacuccgcuccaugacacuucauggagcuccuugucuccucacacugaaugaagaguuuguauuucuuuuuuuuuuuccauuuuuuauuagguauuuuuuuaggcucauuuacauuuccaaugcuauaucaaaagucccccauacccacccccccacuccccuacccacccacucccccuuuuuggcccuggcguuccccuguacuggggcauauaaaguuugcaaguccaaugggccucucuuuccagugauggccgacuaggccaucuuuugauacauaagcagcuugagucaagagcuccgggguacugguuaguucauaauguuguuccaccuauaggguugcagaucccuuuaguuccuugggugcuuucgaguuuguauuucuucuugccuugccugcuccuuuucacucuauagaucagggagauguauagaaaaaggacaaaaagcagccacauucuuugucagaauaucacaagaauggucuccgggauuaaaagcaucaguccucugagugcuauuuacuacuauucuuccucucugaaauuucuugaaccagacccccacaguccuucaugcuccuguuaggaugacccauuaagcccuacuuaauguauccaacugcuuucuaauuuaaaucccaaagucuuccagauuccuccaacaaacagcaugguaguauugcugucacagcaauaccccaaucucugauaccaaccucugucuuagucauuguucuauuguucugaagagacaccaugaccaaggaagcguuuaauuagggacucugcuacagucuuagaugcuuagcccauuauuauaaugugagggagcauggcaguaccacagauauaaguaaugcugcucuguguaaagugacggcaguuuaagggauggcaagaccguaugauaacuuugaagguguagacagcaggaaugguggcugcaugaguuaguauucccacaagcaugcugaccuguuacugcaccucuuuuacuguuuuaguuucauuucucauucuccaguggcuauuauguugaauaaaugucugauuuuagauuuauuuuuauuuauauguauauacgugucucugugagucuguguguauguguaucuuuuuuuuuuuaaagacagguuccucuauugaauagcccuggcugacccagaacuugcuuuguagaccagacugaucuccauuacacagagauccaccugccucugccucccaagugcugggauuaaagcaguggcucucaaccuuccuaauaccuuccucaaccauaaaauuauuuucauugcuacuucaugacuaauuuugcuacugucaugaguaguuuuguaaauaucuuuguuuuccuauagacuuaguccauaaaugugaaaggguccuugacuuucaaaggggucaugacccccugcuugagaugccagaugaaaguauuguuauauuguuugcaaggcuaauuuuucuccugucucuucugaagguccuguccacaauacacugaugucuccacaagugucaucgagucaaggcuaugauucgcaaccuccaggauccuacccucguccaaugccagcaaagacuuugaauccauucucugcacagucgaacuacggugguucucagggaucugggcagacucuuaauaguccacuugugacuuccgguccaguacuaccuucacuucauagugguccuguuccccgaaugccacuaccuacuucucagaacccagcugcuacaccaaugccuucugguagcuuucuuccuggagccaacccacccccaccuuugaauuggcaauauaacuauccauccacaggaccgcagacuaaccauuuuccucauguagcuccaccaacucuaccugggaauccaaauuuaacagcggaucaucaauauguuucuucuggagacccugcacuucaaaccagcuucaaaaagccagguacucaugaagggauguuugaaaauguugaaauggaaagcuagcuucuuuacauuuggacucaauauuuacagccuuaagccucauagaaaacaauuuaaaaaaaucaaucagucuuuaaauaaguuccuucucaccccuuaggcguaauagguugcuuccauuccugagccguuacugcucuugcuuuguaggcauucuguuuuucuuccuuuguaaggagacaagaucuuguuaguugccuaugaugaaucgcgacuccuggacucaagcaauccucuaucucagccucccaaacaucugguucuccaagcuguuuuucuuucagucccuaagauuccaggaacuuauauuuuugugcagucacuuucauaggacugaaagaugacaugcugguggcacaugccuucuuaaaucccaguacuugggguauacacacaugcaaaaaggguuuggugguguccuagaaaauaacuaauaaaaguuacuccuaguaauuaauggaaauuaauuucaaaugguugccguggccugacauagucacagugagaauagaaaggacuugggguuuagcaguuguucucagauuaguuugucacuuuuguuccuuucugucuuuucuuuggggagacaguuguuccggagugugggucauucuugcccuugaguuuacuaagcagcuaaagaugacauugaacucagcagcugccuuuaccuccucagugauugcaggcgugcacuaccaaacccagggagaugggaggugccaagucacagauauguguccugcagucgcuaggaccgucagccagucuggagaacugcccacccuacucccauaaaaauuacuuuuagcagcuaacaagcuacaugcuugauggaaaauaucugauuauaguuaagggaauaugaauaaaagaagauaacauuuggaaauuguuacugguucauuuucucagaguauguacugagaauaaaccugaaaacuugagguugacaggcggcucagugggcagacaugcugauccaagcuugaugagcugaguguaauugcaagaacagucagcaguagaaaaguuaacuccagaaaguugucucugaccuccaugcaggugcaacaugcggcccugugcccccucacauuauacauacacaugcacacaauaauaaagaacguguucugggaggguggcacauggcgguaaccccagcacaggggaaacaaggcaagaggacugaggcuugccggcgcuacacagugaggaagagugcauauugcuuuuguaaaggaccugaguuaguucccagcacucagguggggcugcucuggaggaucugauggccucuuuuggacuccacaagcguaacacccaagugucaaacauacauuuaaaaaaagaaaaaccuaaaaaaaaacaucuccacaaaaacuaaaagggacacauuagccagggcccaugugacaccaguuuucuaccaaacuauuacauacauuuuguuauuuaaucaucacugcagaacagaauuggauaugaugagacaugucuauaagcccucuuuugggaagcugaggcaggaagauaaugaauuucagauuagacuaggcucuguaagugacagguuuugucuuaaagaaauuucauagcaacuucuucccagcugagcagugugaagcuugaguaacuugcucaauguacaaaagcauuguuugggagagcacacucuguggaagcuauuucagggacuggggagacggcucagcugugagagugcuugcugugcaguccugaggacaggguguagaucucagugcucaugcaacaagccuagcaaucugggauuucugcaacuacagcucugccggacccagugcccucuucacgcauugggcccuugaacaaauguguacauacacaaacacaaguaguaauaaaaauaaaucuagaagaaaaugaaaaacaauuucaucuacuuccucaguugcucagaaggcuuaggcaggaagauuacaagucuaggauuuggggggcagggcaagcaucacccuaggaaacaucucaagaaaacagucagccacagcacucaggaggcaaagggagguggaucucugucaauugaagauuagcuugaucuauacagugaguucuaggccagccaagacuacaaagugagauccugucucaaaaauaaauauauaaauguaaaggacacaugaucaauaaccuaaaauuuccuuggccuaacagaagcucuaagauagaacacuuugacuccagcauagaugugguuauaaaaacauaaaaaaaaguccuuaaacuuugaacauucccauguaaaagaagggguugggaauguagguaggguagcauaagccuuaaucccagcacguguaggcagaagcaggagaauccuaguucaaggcuagccugcuaagauuguaucucuaaagagagaaagaaagagaaugugggcaagcuauguaaaauaaaguaugaauaugaaacuaaaauguaugguucccaaacaaucccagcuuucauuucuguguccucuacuuguacaugagagccugaaacuaaaacucuacuaucaagcuggguguggcagcucauacuuguaauacugguaauuuggagauaagccaggagauugcccugaguuuuaagccaaccuaggguacagaaugagguccugucucaaacacgcacacacacgugcgugugugcacugaagagauggcucaauggauugagaagcacugucuaccaaugcuaguaacuuaaguucuaucuccaguaauauacacagaaaauaacugucauuaauuuuuuuaaauggcuagaagugguguugaacccuuuuaauaccagaggcaggcuaaucucugaguuugaagcuagcuuugccuauacagugaccuucagcccagccugaguuacucaguuacugagaccccaucucuaaauacaaacacacaaauaaaaaggaagggaaagggacuuggguugucaggccuguugucaagcgccuuuacugacugagccaucucacuggcccacguuuccagaggacaaagcaaacuggacuagagugauugcucggcggucaggggcgcuuacugcuucuccauccagagaacugaguuugcuuuccagcacccuuggcagaugguucacaccacugggagcucuagcucuaaagaucuagugcccucuuuugaauucuguagacacacacacacacuugucucacacacaugaaucuaaguuaaaaacauaaaaauaaauguaaaagaaaccauacacaggaaagccuguauuuaaguuacaccuguuuccaguccucacauucuauguucugguuuuuucugccuuucuucgcccacacuugaguuagcuuuagggagcugaaaaggccaagugcagaacucuugacacuugguuuauaaacaggugcugauaagcuuuacuugcuggcauaugccaggcuccgggaccaggccccagcagcgaagaagcaggccuuccucagccucuguuaugaccugggcugguggugcacacuuuugacuucauuuaauuaauuauucucuauauaugaugaguacacuguagcugucuucaggcacaccagaagagggcaucggaucccauuacggauggcugugagccaccaugugguugcagggauuugaacucaggaccucuggaagagcagucagugcucuuaaccacuaagccaacucuccagccaguggugcacacuuuuaauucuaguacuucugaggcagaggcaggugcaucucuugagaauucuagcacagccagccuguuuaaaauuuuuuucuaaaaucucuuuuaugaaauauaacauauucuuaauucagaaauguucuaaaagauuugaaaagcaacucuaagcuaacuuguggguuguuuggguuuuuuguuguuguuguuuguuuuguuuugguuugguuuuggucuuuugguuuuucgagauaggguuucucuguguagcccuggcuguccuggaacucacucuguagaccaggcuggacuugaacucagaaauucaccugucucugccucucaaguccugggauuaaaggugcaaaccacuacuaccugcacuaccacagcuuuaaguacaaguugguuuuuguucugacuuauguuuuguuaaacauuaagucauugaaacuuugugguuagacauauuuuggugucaaacauucuuuuuauugcugaguugggagugcaccuugcccugugcuccuuugaauugugggauugccauagaugugugcguguuuucuugcuaagggaggugcaggcagcagucuuaucuuuacuugcccagugcuauacugaguaauccuggcuaagaccaacaguguucauuaauaacaaagcguucccauuggcuguggagaauuuaacaguauuaagaugacuuuuucaaauuuuucauauuugacuacauuuguuccuuugguuuuauaaaauauagguguacuauaaguaaaaugaauuaaaugugucaguaauaaguauaaaaacaaugagguuuuuguuuuguuuuggguuugcuuuugguuuugaagucuuggaaccagauguggggaugauccaugccuaacaaccccagcacgggaggcucugcagaugcucauuagccagagcauugguugccuuuacagaggcccuaggcuggcucaugagacacaucagguagcucacaaccaucauuccagcaccaagagauuugaugcccuuucuagucucugggcacugcauguaugugcuucacaaacauacaugcaggcaaaacacccauacauauaaaauaaaauaaaucuuuaaaaaaaagacaagccagucauuaggaggcugagguagaaggauccugaguucaaaauuaauaguuagacuuugucucaagagacuggagaaagaaggcugagaguagagcugagcuggcaguguuggcccaucuaaagcucugggucuguaccuccaguuccccagaaccguaaaccaggcgugacagcuugcacucaggagguaguggcaagaggaucagccuucagggucauugucagccaguuacaugaguauaucugugcuguaagaggcccuguuucagacagacagacaggcaggcaggcagacagacuaaagaacuggagugaugacuccauggcuaagagugugcugcuuuuacaaaggaccugaguucaagucccagcacccacguaguucucaaaacugcuauagcucuagcuucaggggauccaaugucuccuggucucuaccauugccacauacguauggugaacauacaugcacucauaggcacacacacauucacauaaauaaguaaaucuuaaaaguuagauuguggggcuggugagauggcucaguggguaagagcacccgacugcuuuuccgaagguccgaaguucaaaucccagcaaccacaugguggcucacaaccacccguaaugagaucugacucccucuucuggagugucugaagacagcuacaguguacuuacauauaauaaauaaauaaaucuaaaaaaaaaaaaaaaaaaaaaguuagauuguucaccccuggcaaugggcaaagagacaccuuguuugugguguugaucuuauaucagucaggggcagagcagauggcaguccuuuguucauccuagcuugaugccuggcuugguggccaaagcuguuucaugccuagggcacauuaaaaaaauuuuuuuuagauuguugugcaugaguguuuugccugcaucuauguaagugcacuauaugcaugccuugugccaugccaaaagucagaagaaagcauugcauuccugaaacggaaguuauagacgguuguaaaaccuagcauguguucuggaaaccaaacaccaucaucugcaagauucuauuuguucagugugugagugagcaaguuccauggugcacaagagaaggucagaggaaccaauagaugucgggcagagugaguguggauuuauuagagggaagugaggggggacucccaccaagagaggaaugcccucaucucucucucucucucucucucucucucucucucucucucucucucucucccucccucccucccucccucccucccucccucccucccuccccuugaggcaggguuucucuguguagcccuggcuguucuggaauucacucuguagaccaggcuggccucgaacugagaaauccacuugcuucugccucccaagugcugggauuaaaggugugugccaccccugcccggccuauaaucucauuuuaacagguccuaccaggcaaaacaaaacaaauaaaauaaaacuuggagaauuagucuaauacuuuauuuuuagaaaguaaauaaaaugaauaaaaugugugagacauggucgcacacacugguaaucccaguguguggagacugaggcaaaaggauuccaucauguuugaggccauuuuguacuauaucgugagauccuguauuuuuuuuuuaaugcaaauuuaaauugacaaauuuuauucauuuuaauuuauucuuauuauuucuuauggccucuuaaauuuuuuaugaucaguuaaugaaaaagauaaucagaauauucuguuacccuagaagugauuuggugcuaauauguguauguacguucuaugggaaugaggucuuaguauguagcccaggcaggcuucuagcuugcugacugguccucuugucucagcgcccuggaugcugagauuauggguggcugguuuauuuuuauugcuuuaagaacugacaaauaugaagaaagacuuagaaaauguagacucugcacauagagucacaaagucaagaaguuaauauauuucuauuaguuuauugauggcuauuuuuauuaaaauguugauuuagagucuacuugguuuuaguaaagauuguuuggaaccuuugucuucaguucuuacgugacgagaaaaacccauguuuccauagguucugcacuucccuuacagaacccaccucugccccccacuuuucagccaggagcuccuccugggcccccuccagcuggaggcccaccucccagccggggccccgcgccccagaaaacaccuccucgggcugcacccccaccuucauuuaacucagcugucaaucaggaagguaagugaaugaaaggcaaagccgcggcucagagucucagcuuagggcagaaagugagagcgcggucugcauccauaccucagaauuauguuacuagaauaccuuaguguaagaauagaauaguuuaggauccuucuucagucuguaggggaaaaaagauuccuuccaaggcccauguuucuuuuccacaaagacagagcuccgucugagugaacugagagauugguguguuugguggcacacacccaccuguaaccccagugacuaagaggcugagguagaggcuagcacggggugcaugauggcaucccaucucagaaagcaaacauccaaaggcuugcauuuauauguaaguacacuguagcugucuucagacaccccagaagagggcaccagaucucauuacagaugguugugagccaccaugugguugcugggauuugaacucaggaucuucagaagagcagucagugcucuuaaccacugauccaucuuuccagccuuugcacuuuaguuuuuauuuauuuuauuuguuuuuguuuguuguuuuacaaugcugagcagcaaacccaggaucuuguguauguuaggccuuuaaacacacacacacacaccccuaccuucuaucuuucccuguguuuguacauguguacucgcauguaugccugcaccucaugcaugucuggggcccaguaggccagaagcccuucgaguucuuuacagcugaaguuauaggcagauuugagcugcuaagugggugcugggaauugagcccagggcuugaauugaggcacuuggauacuuuucuguaauaguuuccuguuuuacauuccuaauagcaguguggaagaguucugcuuucccacaucuuugucagcauucgcuuguugagaguuugcuguuugcaugcauccuucucuuuugagauggguucucauguagcccuugcgagcuucacuguguagccgaggaugaccuuaaacucuugaucuuccugucuccaccucucaagugcuaggacuuuagcucuguucacuagacuuuuauuacagucguguguguguguguguguguguguguguguguguguaugugugugugugaaguacaacuugaaggagcugguuccuuccguccaauagugaacucaguucaucggucaggcuugaacugaacccucagacccuggaaagauuuacuuucauuacuucucauaugugucuauguguggguaugugcacauguguacagugcccuuggacacaagaaaagaguaccagauucuccccuggaguuggagucacaggcauuugugacaagguucuagggacccaauuuaaguccucgagaagugcucuuaaccacugaguggucucucuaacuagaguuuuuguuguuuuuguauugguuuuguuuuugagauaggguuuuacaauguacccuuggcuguccuggaacucacuauguaaaccaggcuggccucgaacucacagaggucagccugcuucugccuuuccagugcuaggauuaaaggcgugugccacaguaccuugugacauuugacguuuuugauaggcugcgauuuaaauuuuuuucaaagguuaucuaaauuuuuagauaguaguucauuucuugaagaaacuauagcauucauucuuauuucagucuuguugaugaauuuccuuuuagguauuacgucaaaugccaauaauggaucuacggcggcucauaauacuuaugaugagauugaaggagguggcuucuugggugagaugcuaugagcguuucucuccucucauuauagaagcaaugcguguucaucguagggcacuaggagaaggaaguuuaugcuaugcgcaugugagcacugucgauaggagaaggaagguuaugcuaugcgcaugugagcacugucgauaggagaaggaagguuaugcuaugcgcaugugagcacugucgauaggagaaggaagguuaugcuaugcgcaugugagcacugucgauaggagaaggaagguuaugcuaugcgcaugugagugcugucgauagucuuccuuccagacagccaggcuuuaugugcugcacuuuaaucuguucuacagauuucaguucauggaccuaaguccuaaguguaaguuaggguguauucagaaguuuuuuaaaugaaaauuuagucuaaauauaaauuuauuauauacuauagagguaaaguaaucaugcuaaacuugucuguauguuuuugucuguaguccacaugaacuagauugaggucugcuuuuaacuaacgauuguuucuuuuuaaguugguaaauggaacuauaauucaaaaguugaaguuuuaauucucauaguuuaauggaucuuuaccgugauuuuaagugucuggaauauaaacuagaacuuaaagcuucccuuguuucuagcaacaccacagcuuguuaaucagaaccccaaaacaagccgaagugugggcucugcauaccccucccugccaccaggcuaccagaacagcgcaccaccuguggcugggaugccaccacccucccucaguuacccaaguggcccccaggccuuuacucagguaaacuauuuuuuuuuuaauauauucuuuaccuuuucgcucaagauauaagcacggagaaaguuuucaaagguauuuugauuauuuuauaaccauuuaggauaauaaugaauauuucauaaugcuucugugccugcguauuucucuagacccuagcccagcccuacauacagacagaaguuacucacuuugaaccugucuguagacucccuuaggugcuaaucauuuaacugcaagcaugaguggauuaagucugcauccagagggacuaagaguugucaaucuucuucaagaaaggaacaugcuuccuuccacaccacugcagccuccagucccaaaucugcuugaagacauccagaaacucaacuguaacccagaguaagacuucaaaugcuguuuuuauaaacauggcaguguccauguucuuagauugucuggugugcuuuuuagguguuguggauaagcggcccagguagacuguaugacauaagacucuguuauugcuuaccuggaacuugcaucucuaaauuaagaaauggaguuggcugucccuuacagagugcagcccugccacuuccucaucugcccauuuucugaguugcccuguguucuuaacgcccuucccuaacacuuugcauuuccuuacuguucucugaagcuuucucccagccaugagacucccuguucacccugugucaccucuaagccagccaauagcauggcagcuuguauaugaguugcagcuugccuugccugaccugguguucucuguugacuggaacuuaaagagaaaagggggagggaggaagagaguggguuuaugucccuugaauugcuuguugcuuuuauuagcucuaauaagacuuauauuuaugaucaucaguguaguuauauuccagaaaacagggauuagguuuguuuguuuugagagaggguucuguguguagccuugcuguccugaaacucuguagacucggcuggccucgaacucacagagaucugacugccucugccccccaagugcagggauuaaagacauguaccaccaacacccugucuggcuucagacuuuauuugccuugacuuagucucccagauuugaagacauuauacacuguauuccauaaauaauuuaaauguauguuguaaagacuuaaaaacuguacaacuuguaauuuugaaauaauauuuuuaaaagcuuuaguaagacugcucuucaacaaacuuugacuuggugugguggucuaagugccucuguaguccuagcuguuugguagaguuguaggagaaccacuugacccagaaguucaagaccagucuagguagcauagcaaaaccuaucuaaaaaaaaauaaauauguuaaguaauuaauugauuguaaaagguauuuguuugaggauugagucaucaccugcuaauaucaagguaagauuaauuauuaguccaggcuauuguaccaggaugaaccuauucuuuuuguuucuuuguuuuuugagguuucucuguguaacgucccuggaacucaaagagaucugccugccucuggccucugcccucugcccucuggccucuggccucugcccucugcccucuggccucugggugcugggauuaaaggugugaggcacugcugcccagccuaugguuaguuucuugagaccuagucucacugugguagaugcuggauucauaguuauguguggucacgcauggcaauuuaaauauuuuaauaaaacauuuaaaaaaggucuauauucauuuguaaucugaucuaaucccaagaguauugagauaggcacgguuuaucuuuuuucugaagccgugagcgcagcggcagcugacauacgcuguucugucuuacagguuguuccgaugcacgcugacgagugucccucagacucaggccuuacugaauaaagccaagcuuccucuggggcugcugcuccaccccuucaaggaccuagugguaugcuucuuuguguguguguuuuuguuuuuugagacaggguuucucuguaacagcccugacugucuugaagccuucuuuguaggccaggcuggccuggaacucacugacauccagcugccucugccucccguguccugggauuaaugagacgaaaggugugugccaccacagccagcccagugguaugcuucuuuagaguagaugugaaaauuaucuaaguggugaaguauuuuugcaacaauguaagaaugaauauaaagucugauauaugacaggguucuuuuccuuuuuuaauuucuaauuuaaucaacauuuuuauuacaaguuaaaacaaggaaagugaaauauuacugagaaauccaagggaugcuauguacguaggcagaacugaaaagauggaugcagguacacacuugcgauuccaacacuugggacugaccgacauggguggauuuugaguauuuaucuaaguuguaaauuaccauuaaaauaguuucuccuagcuuccugacucugcugcuccuggaguaaagucagcugcucuaagaaguugcugcccacacauuuauaaauaaaauaaaauaaaguaaaauaaaauaauuguuccauaaucuaaacaaaugaagaucacuuauguccuaaaucuccagaaccuaaacaugugaucacaugcccuugaguauuaguguggucagacuuuauuguuugauugguugguuucaguugugauauuggggauuauaaugagggucucaugcaugcuagaccggugcugcacaccugaguuagacuaccgaacuccuuuauugacuuccauuuauuugcuugaagaugcuguuuugccauguaauagcccuggcuggccugcugcuuguuauauagcucagacuggccuugaacuguuaagaauccuccugccucagccuucaaagugcuagaauuacagguaugggcaacaguucucagcuucccuuauugaaguauuuuaauaugaagagugaaauuuuuauuuuuucuuuucauuuucuuuuaaagauuuauuuauuguuagguaugugaguacauugucacugucuuuagacacuccagaagaggacuucgaaucccaauauaaaugguugugaccuacccuguaggugcugggaauugaacucaggaccuccagaagagcagucaguguucuuaaccgcugagccaucucuccaacucuauuuuuuauuuuucuauuguuuccuuuuguaugcuguagcuauaugaguucaaaugcaugcagauggagguaagaacagcuuuugagagucaguucccaccuuccaaccuuacugagacagggucacucuugguucugcuaugcucugaacucugggcuagcuggccuaagaauuuccuggugauucuccuguguuucccucuuacagcgccccuaccccccccccccccccgcccauaggauuggugagguaauagaugcugccacaccauccuguuuuugacaugggcuuugggaaucaaacacaggcugucaggcuuuuacugcaaagugcuuugaucuacugagacagaucccugacccagaacuguuaauauagaugauaacccuugaagacuuuuuaaaaaugguuuuucagacaggauuucucaguguagaccuggcuauccuaaaauucacauugccuaccaggcacagaaaguucugccuccucccaaguacugggauuaaaggugugggccaccaccacccagcuaguuaaguagaccucuuaaaguuuaauucuguaagaguuucauuuuucauuguuuuagaauguacuuucuuuccuuggaacugagacaggaggauuaugugaguuaaggaguugggaacuagacugggcaacaugaugagaccuguauaauaaaaagagagugcugucccugaaaaugccuuguaccauguacccccuugauucugcagugagaauguuuaaugaaaagaggaguaguuuucuaauagauacauuuucuuguggauacuacccacuugugguguugggaaauuaguucuugcucuguagcccaggcuggccucagacuuauugcugcccuccugcaucuugcucuagcauagagacccuaugugugagccucagugcccacacuuuuuguacuaggauuuacuccgaagguaaaggaagagauggauuaacuccuuagcuccauuuuuuugguuuguuuuuuccagcaguugcccguggucaccuccagcacaauugugagaugccguucaugcaggacuuacauuaacccuuucgucaacuuccuugaucaaagaagguggaaauguaacuuauguuaucgagucaaugaugguacgauucuuuaaaauguuuaacauuugaagcaaaaaaccauauuuuuguuugggugguacacacuuuuaaucccagcacugaggguuggggagcagggggaguggggaagggauagaggauuuuuggagggaaaacuaggaaggaugauaacauuugaaauguaaauaaagaaaauaccuaauaaaaagccaucuaggggggcuggagagauggcucagcgguuaagagcacugacugcucuuccgaagguccggaguucaaaucccagcaaccacaugguggcucacaaccaucuguaaugagaucuggcacccucuucuggagugucugaagacagcuacaguguacuuaaagcauacaauaaauaaauaaauaaaucuuaaaaaaaaaagccaucuaggugccuauauauauauauguguguguguguauguauguauguauguauguauguauguauguacucauaagguagaggcauguagaucucugagaggcuggccuggucuacauagagagacccugucuugaaaaagccuguaauccuaguagccacuaacaagucugauaguaaugaugaaagccuauuuaaaaaaaaaaaaaaaagcccuuuuauuuauuugguauacagauaaccagguauuuaggucagauagauaacacuaacuuuuuuuuuacaccuuuauacuuagaaauacauauauacuuugggggcaggaauugauaauuauauuuucgagaugaucuuuuacauuuauuauauugaacauauaaaugggauaguucacaguaugguuuaagauuuuuguuuugaggccggguaugguggugcacgccuuuaaucccagcacucgggaggcagaggcaggcggauuucugaguucgaggccagccuggucuacagagugaguuccaggacagucagggcuauacagagaaacccuguuuugaaaaaacaaaaacaaaaaaaacaaacaaacaaaaaaagauuuuuguuuuguuuuauuuugagcuagucucaagugcacuuaaggaugcccugaacuucugggaccucuuucuucuaccuacugagugcugguguucuagguguaugcugcugguccuaguuuaugagaugcuggagguugagcccaggacuuccuccguguuaggacagcacucugccagcugaacuaucuccagccagaaauuuuuuuuuuuuuuuuuuuuuuuguuuuucgagacaggguuucucuguauagcccugguuguccuggaacucacuuuguagaccaggcuggccucgaacucagagauccaccugccucugccucccgagugcugggauuaaaggcgugcgccaccacgcccgaccagaaauacuuuuauuuugaaauuauuuugugugauuuuuuuuuccuccuaggauaaaagaaaauagguauagaguaauggcugcuuuuugucacucacugcuguugaacagacuaggacgguacucgauuaguugaauacagugugaucaguaacugaagaggugcucucucucaguaacuacuuuauaauuuauauuuuaagauaucauauaaccaacagcucucuguuugaauucuuagcacuugggaggcagagacagaaggucuuccugaguauuuuacagagaauucaaagccaaccugggcugccuccauaagaccuugacucaaaaaggcagagagaagggaaauuuuuaaaugucuuucuggaaaaaaucaggaaaaaaaagucguguuaaguuccccuuuaaaaucugaaguguaugugcugcaaugcacaaguggaguugugauaaagguuguagccuccugcauauccuguggagcuacugaaugaacuauaguuucagccuuugaguacauaaccauuuuagguugguuguggugguugugguuugcuauuuucuuuaucgugugugugcgcgcguguguguguguguguguguguguguguugugagguagggcauguaugccacaauaugcacauggagguaagaggacaacuugguaggaaucaguucucuccauccagugugggugccagggaucaaacacagguuaagcaugacaggaaguacacuuaccuguugagccauuugcuggaccuuuguuugaucuuugagacaaagacuaccacuguacuccagguuggccugguauuuguugcucucuagcuuagucuggcaucuaacuugguggugauccccuggcccagucuuugacguggugcaauuacaggcaugcaccaccucauggauuuguuuguuuggaauuuuuugacucccccagccuaaggauuuuaaucuuuaaacaauuacugggaaacuagguucaaugacagcuaaucccuaauauacucugagcauagugaauuacagguucaauucacugaggcacuugguguuguacaaaagcaauuggugcuaauaaagcuuguugcugaucccucauggcuuuaccuugaaacaguugcaccuugacugucugggagcagccuucugggucaaaggucaacuucuguacaguugggagauuucugaaaaacaacuggcauuuguugaguuuuuaaucaucuuuucaagcuuauuuggaaaugagccguaaggauuuagccaggacacugggugcugggaacgucacagugauugcaguugucugcaaagccucuugcugccguauauuauaggaggaguuuaaauagaacccuuuuaaaaauucaauuuguuccuuuauuuuuaaccagguuuaaauuaauuacaacaccuaaauuaauaaaaaucaaaauguaaguuauugaauuaauccuuuuuuuaaucauuuuuuguuuugcaccaguuccugaagaauucauguacaacccuuuaaccagaguuuauggagaaccucacaaaagaccugaaguccagaaugcuacuauugaguuuauggcuccuucagaauacaugguaagcucccuuuuuuuuucuuucuagagcaggguguguugguuguuuuguuuguuuguuuguuuuugauguacuauguagcugugguuuuucugguaguugcugguuagcuaaggcuagcuucaaaguuccuauaaaucuguuuuagacuuccaaguaauaugauuacuauugcaagccauaccccaagccaucacacugcgauuuaaaauuauauaauaucuuuuaacaaaguucucuuucuuagcugagaaaguauuuguucacaaaguagaagugcuugcuaugcaagccugaugaccugagccccuucccagaacccacacaaagcugcauugggagcaccugguccugguaccggcacacgcacacagcauacacauaugucaugcacacacacacgugcaguuagguuacaguguucagagcguaaaguugcaugggaaggucuacuucagugucucaucuauagcaagaaacuugcagcaugauauugggaucauauuuauaucucaguuaaaucagacuucuguguuuuauaaauaaugcuauguaaucucagcauucaggagguagaggcaggaggauuaguucaagccugaauuacacuguaguuaggccaguguggacuguauaaaaucgucuucaaaaacaaacaaaaaaugggcugaagauauguuagggguuaagagcuuuggggcuggaaggaugacucaggaguucaagagcacuggcugcucuuccagaggaugcagguucaauuccagcguccacaaggcagcucacaacucccuguaacucuauuuccugggggucugacacccuuauacauucacacaugcaggcaaaacacuaauauacauaaaauaaaaauaaagaagucauuaacaaagaggguaggguuaagagcucugacugcucuugcagaagaccuaaguucaguucccagcacucauguggcagcucacaauguccuauaacugugguuucaggggaucugaggcccuauucuggcuucuuugugcacuacauacaagcagugcauguauguacaugcagacacucacaaauauacauaaaguuaaaaaaaaaaaaagcccaggucucuugaguuagauacucuuuuacugagccuuaauugcauuuaagcaaaaaggaauaugaaaaugaugcuaacacguaacaccagcuugacuugucuaaugagcauauuucuuucuucuucugugugugugugugugugcgcgagcgcgcgcgcacgugugugugcauguaagccaaagaucagccccuguaucaugucuucuucugugugugugugugugugugugcgcauguaaaccccuguaucauuucagccccuguaucaugccucgggugcuauccaucauauuaguagcuuuuuguuugaauaaggucucacuauguaguucugaccuguccuggaacacuugagaccagacuggccuugaacucauagagaucuacuugccucugccuccugaaagaagcuaggauuuaaugcauguaucacuaagccacccaccuugguuuuuuugagacaggaucucucauugaccugggagucacugauuaggcuaggcucacugcuuagagagcccaaggguuccuccuuucucugcuuccuuagcccuggcuacaaacucaugcccaacccagacuuuucacauggguucuggagauuaaauuuggauccucacacuucucuggcagcacuucaagugagauauauauauguguguguauguguauguauagguauagguauagauaguuguuuuguuuuguuuuaaccuguaugugagauuuagucucuuuuacuauguaauuuauaaggggucaaucuuuuuaauugagucacugaaguuauuaguaauaguucucugucaaauuaaaguuaaagaacccaagcaucugcugggugugguguuacacaacuacacaacuuuaaucccagcacucgggaggcagaggcagguggauuucugaguucgaggccagccuggucuacaaauugaguuccaggacagccagggcuacacagagaaacccugacucgaaaaaccaaaaaaaaagagaaacgcauuaaaguagaggaggaggagaagaagcgaaaaagaagaaauaugcuuaguagacaaaccauacauaaauguauauguuaucaaauaauuaugaaguaaaccaguuguguuaguacuaucuggaucaaggcuguaacaucaguugcuacagagcuagcucggggguuaaaagcacuggucgacuuccagaggaucuagauuugauucucagcacccacaugagagcugacgaccaucuuguaacuccaguucuagggacuccagcauccccuucugccuuccagguugugugcacaugguacacaacaaaacacccugcacauuagagcauugccaacacugccagcagcccgugauagcauguguucuuuccugccuagagaagucucuucugagcuaugccagacacuugucuuucaguuugaaacggauaguaucuucagaugagcaguuuguguuuccagagguauguagguguguucuaaaggcugcuuucauagguuagcuuaggucuuacugagccccuguguaagugggaagugcaucuguguucagggaagugcuuccaucugcugccuccacuuuauaaucuguauguaguaauuuuguuguaugugaccccaucauguaaauacaaauuuaauacuguuggauauauuuaauugaacucuuuuuccuucuaguuacgaccaccacaaccuccaguguaccucuuuguauuugauguaucucacaacgcaauagaaacuggauacuugaauucaguuugccagaguuuguuagacaaucuggaucuguaagugucuuaacucagcuuaauuugaaacaacuagugucuucaaaugaacacuuagguuuuugggaguuuguuuguugagacaggguuucucuguguggcccuggguaacugagaacucuacucuguauaguaggcuggccucaaacucagagaucuacccaccucuaucuuccaagugcugggcuuaaagguguaggaaacccagugguuuuguuaaagguccuuacauaauuauguucugaaggaucacguaaauggguuagcauaggccuucccugacccuguguaaaugugaagaggacccuguguaaaugugugaggagccuuggugcugucaccuucagcaggcugcugggcugcuccguggaauccuccuucccaccccuuuccacuugacuccuuucuucuuuuuuguuuuuuguuuuuuuguuucuugcuuuuuugaaacaguguuuaagcugggugugguggcgcaagccuuuaaucccagcaucugggauuuuaaaaaguucaaguaguauucauguauuccauuuguugucauaguugugucucuuaagagagcuauguuuuaaauguuauaugcacaggauauauauaauguauaaaaauuagugugaccuuucaguauaagaaaggauagacuggauuuccccauaaaccgaguaucuuccucacauuggccaagggcauucuugcuccucuguguguguauaucucacaaucuaagcuauauaugggaaccaaggaugaaauaggcuggaagcuuguuccuuuccacuaagaaaucuuguucuguauguuggguccuuuaaaagauucuuuugauccucuuuguucuuaaaggcauuaaauaauagaacagguuuguguaauuguuuuaaauagagguaguagcuaaauuuacauuguauuuaauuuucuuucuuucuuucuuuuuuaaugaguguuuugccugcauguguguaugugcaccacaugugugccugguggcagagaaggucagaagagagcauucaguccucuagagcugggauuacagacaguuguaagcuaucauguggguucugggaaucgaacuggguccuaugcaagagcagccaguguucuuaaccacugagcuaucucgccagcccuacaaugcaguuuaaaaugcuauaucacaauuuuuuuuugaagcauccuuuuuccugugauguuggagacugagcccagagccuuauaccugucugccagguucucuaccacugagcuaaauucccagccucaagcauucuuuauaaaauaacuugaauuugggcccauuuuuguacauauuuucaagguuuuuaaaaaaacucacauauacuaaagaaaauuuccaccuuuauuauagaaguagcugauuuuaaacagcugcaguuuugcuacuuuuuauugguuauuugcuuucacuugaagagaguguuuucauagcagguaacccuuggcugcuguaagcaccuguguaugcugggccacucucgauacuauuacaguggugcuuacgugugacaccgagagagagagagagagagagagagagagagagagagagagugugugugugugugugugugugugugugugugaacaaugauuaaaacuuuuuugugaauuuguuucuaggcuuccuggcaacacuaggacaaaaaucgguuucauaacauuugauagcacuauccauuucuacagucuucaggaaggucucucccagccucagaugcuaauaguuucagauauugacgguauguguuauacucaaacucacucaacuuccuggagaauugucccuuucagaaauguuuccugaggucuuugaugugucaggaaugugugacaugacucuaguauaauaaagagaaaucauuuguuuuguuuuguuuuuuucagagcuaaacccgcugaauagcccaggcuggccuuaaacuuguguguaccacagggccaggcugagaaguccugaguagaaaguuauuagacuguugggguuaugagagucuuuaagucuagucucauuuuaucagggaccagaaggcugacggaggagaaaugauugcugagcaaggaaauaaagucagcuugauguuagagcuugggggagauguggcugugucuuccccuuggaaguaccugagggcugugggugucacugugugggagagcuccugccugugccacauagauagcaaaggacauuuaucacugacgugcgaugaaagguagacgaugaagcucaaaagcagacccugggaaacagucagugauguauugggucaaggcuauucagcgagggaaagcugacgugaaaaagccugagcuugggcuguuugaagaacaugaaguaaagcaaauaugguagcacaugcuugcaaucccgugcgggaaggagacaggcgacucagcacagccuaaggccgaccucaucuccacugcgagugccagggcagccagcgguaaauagugagcuccugccacaaaaaacaaaaagcaaaaaaagaaaguaaauuuaagaguuaaaaauaugcuaggcaauggugacacgcaccuuuaacuccaccaccggggagacagaggcaggaggaucucugaugacuuccuacaaguaacacgccaaacacaggcaguuagagggaaaagcaaaaccacgccauugguuuucaucaauacugaaagcucuugcacuaaguaaagcagaccuccugaccggaacccgacaccggaacccacagaagcagauggagaacacggucuccuacaagcuggguucugaacuccagaugcaugcuugccucuccccuguugcacacagacaaacauauaaauaaccuaucugacaggcuggagaggcucaguaaugaaugcuugucagacauucauggauccccaacacacauaaaaccaugcaugguagcugugguggccagugauaguaccuguaaauccuagcacguacucagaagcugauacagcaggaucacugaguucaaggccagccccgcuugcaaguuccaggccagcggggccuacauaguaaagcccuguuuuuuauuuuuuauuuaguuucuuuguuuguuugguucuuugaguuuuguuuuuaaaggcagaaggaucaaaguugagguucauccucagcacagcaacaguucagccuggaauaugugagacccugucucaccaacacaaguaaaccuuuaguggguaugguagcauauaccuguaauauaugccuuugggagcuaguguagaaaguugaaguacauaguaaagcccugucuuaaagggcuagguggcuagggucucauuaaguaauagaaugcacccuucauauaugcagggcccugggcuuagucccuaaaacugcaaaagaaaaacaaaauaccaguuuaucagggaauagucuauguagagaggaaaacagcccauaguguggggaaaaugcuuguaauuauguaucugauaaugaaguuuuuaaaagguguauucauuuuauuuauaugacuacacuguagcucucuucagacacaccagaagagggcauuggaucccauuacagaugguugugguugcugggaauugaauucaggaccucugaaagugcucuuaacuucugacccaucucucuagccucugauaauaaguuguuuuuauuuauuuauuuauuuauuuaauccaugaaugugucucugugucugcuaaugucagaccaaaagugccgggucacuggauccccuaaaacuggaguuacaguaggcaguuguaagcucuugacaugggugcuaggauuugaauuagcaccuucuggaagaacaaauguucuuaaccuacugggauguaacuccaacacuaauaauaaauuuaauauggagaauaaauucaaaauauauuuuucuuaggaauuaaaucccuuuucucugaugaaaucaaacuaggaagaggcauuauaaggaauuuacauguucauccucucacuuaucaaaaaguaaggaauuuuaugaagguccuaaaaauuaauaaaacauuuuuguuuucagacaagaucucaugcacacuagguuggccuugagcaggaguuauucuuuuccuuuuaacaguguuuuguaagcuggacauuguaguauauacuuguguucucagcagucgggagacagaagcagaacaaugauccaggccaguuugggcuaccuaguaagacccugucucagaaccaaaugaggggcuaaggagcuagcucugucaguaaagugcuugccuugcaagccuagggaccuguucccaccuccagaauccacauaaauucacauaaaaaacaucagaaguggugguauacuuggaaucacagguuugaaaggcagagucaggcauucuagccuaauuggucaguuccaagccaaugaaagaucuuguuucaaagaaagugaaugguauuucugaagaugcuacucuaaacuaucuuuuacccccacccccagccccaugcacuggcauacacagcaugugggcauuaaaaaauuaaacaaacaaacaacaauaaaaaacacuaccuaacaagaaaaugaaagcguggcuauucuaagaggcuccccugaagugauggcgugccuucuaguuccccugcuucugcaggaccauaggggcacugcugugcaguuuccuuuuggaagaagccuugccugcgugacaaaaauauuaguaaauuauuacuucagauaaaaacaaagcaucacuguaugaucugauaagugccuucagaguuaugccagaaaguagaauuggaugcccuggaacuggaauuacagauaacugugagccacgugggugcuggcaacugaagcuggguccucuaggagaacagcuagugaucuuaacuguugacccagcucuccaauuccacagcugucuuugucauacucagaauguaucuuuggccaggcauaauaaccacacagcuuuaaucuuagcacuugggaggcagaagcagguggaucucugugaguuuuaggguagacuggucuacuuuaagaguuucagagucccagcacuugggaggcagaggcagguggacuucugaguucgaggccagccuggucuacaaagugagcuccaggacagccagggcuacacagagaaacccugucucgaaaaaaacaacaacaaaaaaagaguuuaagagcuacacaguaaaauccugucuuaaaaaaaaaaucaagagaggggcuggcgagauggcucagcggguaagagcacugacugcucuuccgaagauccugagauuaaaucccagcaaccacauggugacucauaaccacccauaauaugaucugacgcccccuucgggugcaucugaagacagcuacaguguacuuauguauaauaauaaauaaaucuuugggccugaacaagcagggacugagcaaguggaguugaccaaagcaagcaaagguccuaaaaauugaauucccaacaacuacaugaaugcucacaaccaucuaucugugcaguguacucauauacauaaaauaaaauaaaucuuaaaaaaaaaaccaaggggcuggagagauggcucagcaguuaagagcaccgacugcauuuccgaagguccugaguucaauucccagcaaccacaugguggcucacaaccaucuguaaugagauuugaugcccucuucuggugugugucugaagacagcuacaguguacuuagacauaauaauaaauaaaucuuuaaaaaaaaaucaagaggaaagauaaauaauaaaaugaaugcuucuuuacucuuucagauguuuuuaucccuaugccagagaacuuacuaguaaacuuaaaugaaaguaaagagguaaggcgcgcuuuccugccugccauguuuaacuguaacacugaaugcauauuucugaacuaaacuuuaaguuuugcuuuucuuugauguuuuuaggcuauguagcacuuuauaucuacucuuaguuuacguucauuagcuggacaguucuugaggucagccuuguacugguuguuuuuacucuaaggcagcagguuaucugugguggagcuaaagucgagucucuucccaagggaagagccccuggaggaggccuggccugcaggccaggccguguggggagaggggggguugcugaaagaacgcugcuggucacugcggaagcacauagccaggcugcucucagugcuuuugcuuuucugauucacagagugucauugggucaguucagaagaaacucuuauuaccugccuggaaauugccaugacauaauacagugagaggugaacagaaugugucugaaggggggauguugucuacccuguaccugcauauaugccguaggguaacauuuaacuagcaagucugugcucuccacuguugucaguggagacugugcuguagcacaacguauuuuuccccauuaauucucuuaucuguacaaccuaacuuauauaggcaguugguuuugacuuuguuuuucuuuuguaguaauacuacuaguuggcaucguuacuggauaucuuagauuuugcaacaggaaaaaguuaaacucacuuuggaacuuaaaagaauaaaguuuguaaaggugauagagaaagccaugcuucauggcauuaaaauagauaauuuucuaaauugugaugguucuuuugcauacauucuggacuuacagucuugcuagacuauugcaugugcaagaacuguaaggccccaguguugaugucuugcuugccaauuuauaauguuuauuuaaaauggcuuucuugucauugaccaacuucauuguuuauuguacuguccauagauucucagaccaucaucaugauucaauguccugucuauuauauuaaauaaugauauauuaugaaaaaauuuucauuguaacauucuugagucuucuugcuuauuucacaagcuuguucaagauuuacugaaaacgcugccacaaauguuuacgaagacgcuggagacccagagugccuuggguccugcacuucaggcugcauucaagcugauaucaccaacugguggucgaaugucugucuuccaaacacaacucccaacgcuugguguaggagcucugaaaccacgagaggaacccaaccaaaggucaucugcuaagguuagaccaccaggagcauggccugggcuggcuggagcugucccuuuaaccagagaacuuguuuccauuugauuuguuuuuucagcugugaggaggaggaguaaugaguaaaggguuucacuuguauuuccacauaacuguccuauuauuuuuuauaccugccuggcacaucugugcuuuaucaucuuuagugcuuuaggcuguuagaaauccaaccuggcuuugaugagagagucuggaagacuaagagaauuuacuaaggagcaaaguggaaccaaaaugaccauuucuaaugggcgugguggugcacaccuuuaauccugauacucgggaggcagaggcaauuggauuucuaugaguuugaggccagccuggucuacagagugaauuauucuaggacagccagguauacacagaaaaaaaccuguuucaaaacaccaaauaaaaauaaaaaagaaagaaaauggucauaauuugauagacuaacagccuaguagccagggguugccucugcgcuccuuuuguguaagaggguuaggaguuugcauuuccuaaaagagaagagaagaguagguccaccauauaacauaguuuccaugccauugugccaugccagacagcuuaaguucuaaugccuauaagcuagggagggugcacgugaguaacggaugccuuagcgccuguuccucuguagaugaagagacaaccacacgccacgcaggcaucauuagcguguccucaucagguggagaauguauuaggcuaaaguguaaauaauaguuaccuuugucuuuucauguaauuauuaugacaaaauuaauaauaguuauuauaaguaauagagguuuuucuuuuuucauuuauuucuucuuaauaguaaacagaauaggggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauauaauaauaauaaauaaaucuuuaaaaaaaaaauaguaaacagaauaaacauaagcccucaguacuuuagcacuguaguauuacccuaaccauguauuuauuuuuugaugaauuuaaaaauuucuccuuauauucugcaauuaauaggaaauacaucugacaccauccacugacuucuauaagaaauuagccuuggacuguucugggcagcaagcagcuguugacuuauuccuucucaguggacaguauucugauuuggcuucccuagguauguucuugucccuuccucccucccucccucccucccucccucccucccucccucccucccucccucccuuccuguuguuguuguuguuguuguuguuguuguuuugaaauaaagucucaaagcccaugcuaaccuugaacuuccucugggucccgagguggcccucauguccugauucuccugcucccuuuccucauguaccgcaauuacagacuugugcugucacacccagcagugacuucuauugaauguuuuguuugucuguuuggauuuuuguugaaugaauaucagaaugauuuguaacaguguucuaaguagagaagcagguggagauaagccuuauucuaugggagccuuagucuuauucauugcuguggcuguuguuucagcuuucuuucuuguuuuaaguuaauuuuuuacauucauuuauuuauguuuguauacaugugggcaggugugaaggccaggagacaaccuacaggacuugggucuccuucuaccaccuagguccgggaaucagacucaggcugucuggcuugguggaaggcaccuuuacccacuggcccaguuuucuauuuaugaaauggagucuuaguguuacccagaucuuggccucagcaauuauucccgcccuccaccauaauacaccuucaaguaacggaaaccauaugcaugugccaccguguuuggcuaccugcugaccagucauuuuaucagacacuuuagucuauucaagccuguccuuuuuuuaaucuauuaaaacucuuguacuuuuuuuuccuuagugguuuuucgagauuguuucccuauguagcccuggcuguccuggagcuuacuccgugcccagcuuuuuuuuuuuuuuuuuuuuuuuuaaugagacacuguuucuuuacauagcucuggcuaucccagaacguacuguguagaccaggccagcccccaaaucauagagaucuucuuacucuugcucccaagugcugggagcaaaaucauacagcacuacacaugacauuguacucuuaauuaguguaaaggaaguaaagaaguugcuuacuauagcacuauucuaaaggaguagaauagucuuuuuggugguacuuggagacguuagagaggaauguauacaguuacuuugaugggaaguauuaguaguuacuauuuuagaggaguguauugagaggcugagggguguguguguauauauauacaauauuacccaaauuauguugcccacauuauggcuccuagccgccuauaacuccagcucccgggaacuugaugcuucuggccucuguagguaccuguacucauguguacagacccaacauacacaugcaucuaauauaaauaauaaaauugaaaguaaauguauacuguagucccacgcacgagugaauaaaggggugucuaaaaggaguguguucucuuccaggcugcaucucucgguacucagcggguaguguguauuacuaucccucguaccaucaccagcacaacccagugcaaguacagaaacuacagaaggaacuacacagguaccucacucggaagauuggauuugaggcagucaugaggauccggugcaccaaaggugggaacaguuuuuuucccucauagaggguacaugauaaaaauauuuaucuuacaggauuuacccugcagagauacauugaguuuuagaaugugaaauuaugggcuggagagaugacucagagguuaagagcacagacugcucuuccagagguccugaguucaauucccagcaaucacaugguggcucaaaccaucuauaaugggaucugaugcccucuucugguguaucugaagacagcuauaguauacucauauaaaugaaauaaauaaauauauuuaaaaaaaagaauaugaaauuauacacuaugcaauuaaagggggaaaacuauuuaaauaggaaauauuagggcuagagaguggcucugcaguccagagcacagacuacucuugcagaugaucuaaguuauguucccagcauccacacuggcucacaaccacccuguaacuccagcuccaaggcgucgaugccccugcccucucuguagguccugcacucaugcgcagaaacccacacacaggcacgcacuuguacagaauuuaaaauaauaacaaucuuuaaaaauagggaauauuaugaauguauuuaaaacuacugaacuguguacauuaaaaugguacauuuuaugcuauguugguuauuucagcuuuuuaaagggggggccaaaucuccaaagaaaaugccugggugugccauacaugugcacaugcguguguucaugcguauguguguguacuaaauaugaaaucaaaaugcuggucucagagagacagcucagccagcaaaggacuagcugcuaugcuugauaaccuaaguucaaucccuggaacccacaugacagaggagagaaccaacuccgguacauuguccucugaccuccacaugugugugcauuguguacacaggugucccucuccccucaaauuaagugaauauauguaacaaugauaaacuuuuaaagauaaaauaaaaugcugguauauacugccaguguccuccaaaaagauuucugaaaauguuucucacuauuacuuaagagaugcccacuugccccucagcaucacugagugcucugucuucucuaagcuguuuauucucugauaaaggaguaggaugaaauagccauaaguaagcacauaacaaucauggugguaauuuucuauucuaggucuuuccauucauacuuuccaugggaacuucuucguccguucuacagacuuacugucucuucccaaugucaacccagaugcuggguaugcgguccagaugucaguagaagagagucucacugacacucagcugguuuccuuccagucagcacucuuauauacaucaagcaaagguaaugguuuguuugcauuuauuaucacaaaaaacaugacaccuacccucuugaguuuuugauacaaaauuucuauguucugcucuggcuggccuggaacuaacuguauagaccgggcuagccucagacccauagaaauucaccugccuguaccucccaaguccugagauuaaaggcgugcgccacuacacccagcugagaccuagccucucaacagauguguagcccugguacugaaaccccaccuaccucucuccugcccaccuaugggcuaugggcauccuuacucaccagcuggggcuaacuuggagggguaaggugacauagcaucacuugggucuacaugagaauuuccucagcccuggguacaaccaggacuaguauuuagcauuacaauacauagcaacauaccuuaccucaaaaauucuccuuuuuugccuaaauaaaaagguucucuuauaauaacaauaaacaacauacaguaggaauaauuaugaaaaguauuaaguaagaguuaaauucaaaauuccaguuuuguuuguauucagcaacgcaggagaaaguauuuuauuaucuauccuauucuggugaguucagaguucuggauuuaaaucaauuuuuauccuaauuuguauuguuaaaaaaaaucgucuuagacuuaaaacacuucuguuuuguuuuguuuuguuuuuguuuuguuuuucgagacaguauuucucuguguagccuugacuguccuggaacucacuucauagaccaggcuggccucgaacucagaaaucugccugccucugccucccaagugcugcgauuaaagacgugcaccaccacgcccagcuaaaacacuucuuuaaauguuaaaugacuuaaauuuaauugugagacuaauugucuagucuucaaccucauuagagaccugagaaggaauaaguauuaccugagcauacaggaaacacaggacugcaguuuccaaaacuauacacaugacagaggcuggcugcugagcugacugccaggacaaugcucuuaauugaaucuuuagcuuugaaaaugcuaaugaugaaugcaaaaagguuccaagaccauuaagagcaagauccguaccucuuuaugaauggacauagaagcaaauacuaacaauccagucguggugagaaacaguuacaggagauaaaggaaaacaagauaccaggagcuggagcuaucaaagaucuagucauucccuaacugucugcagccaaacccaaaggcuuucauauugguuuuuuaauccauagauugcuguuaugauuaccaaagaaaagguaguaagauacuaauuaaaaaaaaauucucccuauagguggaacaacauuaugaacuaaccaguaccccggagcucuugacucuagcugcauauguaucaaaagauggccuaguuggccaucacuggaaagagaggcccauuggacuugcaaacuuuauaugccccaguacaggggaacgccagggccaaaaagugggaguggguggguaggggagugggggacuuuugggauagcauuggaaauguaaaugaggaaaauaccuaauuaaaaaaauucuauuaaaaaauauaacccaggcacgguggcacaaccuucagacccacuacuugggaggcaggcagaucccuaugaguuugaaccauucuagucuauguaaugaguuccaggaaagcuagagcuaccuagugagacccuaccucaaaacaaaaacaaaaaccaaucaaauaaguauauauaaaauugagggcuggagagauagcucagcagcuuaaaguacuugcugcucuugugaagacccuaguuugguucaguucccaauacccacauggcaacucucaaccacccauaacucccauuuccaagagauccauugcccucuuccuaucucugaggacaccagucacauacaugauguucauauauacaugcagguaaaauauucauacacaaaaaauaaauaagucuaaaaauauuauauauauacacauacauacauacauauauauauauaugguguuggagagguacucagcacuuaaaggaauuugauucuucauccagaggccccagguuuauuuccuagcucccaccaggcaguucacaaucaucucuaacucuaguuccaagguaucccauuucucuggcaccaagcacaaacauaguacauagacauacgugcaggcaaaauauucaaaauaaaaauaaauaaaucuuuuuuucuagggugguaaaggguuuugaaacaggguuucucuguguaauaguccugacuggccuggacucuuuguaucuuuguagacuagggucaccucgggaucugccuaccucugccuccuaaguuugggauuaaaggcaugcauugccaugccuggccuaaaaucuuuuuuaaaggcagauuaguuaggccuagacuuaguugugugcuucucugaucuuagcacucagguagcugaggaaguaggauuaugaguugaaggccugccugggcucuaucuugauccuguucaggaggagagaggaaaaacuagcacauuaucaggugucaacuacaauuucuccugucuauuaaaaauaaccuaaacaggggcuggugagauggcucagcggguaagagcaccgacugcacuuccgaaagucaugaguucaaaucccagcaaccuuaugguggcucacaaccaucuguaacaagaucugacucccuuuucuggaaugucugaagauagcuauaguguacuuauagauaauaaauaaaucuuuuaaaaaaaauaaccugaacaagaagaguuucacaguuaaaauauaaaaccugaacauuuuuucugauacucuuggguauuugcuuucucuaugaccuucuugguucugaguuaaaaaagaaacgguuuucagggcuggcaggguguucagcaggugaaggugccugucaccaagccugagccuggagugcacauggugacagagccaacucuguagacauuauccucucaucuuugugcaugaauaguaauaaauaagcaaagugauugucugauaaauauuuuuuaaaggaaaagaaaaaaaagaagugacuuuaacauagccucuuuuuaaaaauagcuauuacguuuccccccaaaggugaaagaagaauccgugugcauacuuuguguuugccgguaguuucuacccugaaugaagucuuucuuggagcugaugugcaagcaauuucaggguuauuagccaauauggguaagcauuguuauugcuuuagauauuuuccauaccauaccaccuaacacauacauauauuuuuguucuacaugaaguugguaccuuagagguuuugacguaagagugcuuuggucugcuccaacagaaagguccgcugagcucaugugccuguguuugcuugagcuucauggaggcauggucgcguauuagagggauuucacccuuucuaacuguauaaguuuacagggcuguacagccaucaucacagucuaaucuuagaacauuuuuaucaccccaaaggaugucguguccaaucagugcucccuccuacccucacugacuaggccaccauuaagugauuuccuauguuuauuuggcuacauuggacuuaaauaaccaucuuuuuaaaaauaucaaauauuuucuucugaaaguucuuuuuaaagauuauaaauauaaaagaauagaaauguauuuuuaaauuauuucuauuuuauguuuauggguguuuugccuauauguguaucugugcauauuugugugccuggugcccgaggaggccagaagaggacauggaaccccuagaacuacaguuaaggaugguuguaagcugccguguccauguugggaacuaaacccaaguccuuugcaacagcagcagugcuccuaacugcgaugccacgucucagcccgucacguaaccaacucucauagacugugcagugcgagcaccugcuggagcuguugcuaaugcuuuuucagcucugacaggaguaacaacaugugaaagauggcuuccuaaauagcugcacccuuaacaacugacccucugcagccaaggugugccgauauacaaaucaaacagauauugauaaugaaucauaaagaaacuuuaugacuguauauuuauaguuuuucauuuaguaaauacaaaagcaaauugcauauuaaugagaucacugugcuuacuuuauuuuuacauaaaaacucgugccugaacugcuuaauauuuucaucauuucuuggaguugaucuauuauaucuuuauuaucaucaaugcugaaaaaacugccucauauaaauacauaccacaaaauagccaaaauaugguucgggccguuauucuguccugaucucaaggucagcuucguuaacagcuuuuaggaacagauguguucauucauaaccuugcuuaagucugcucugaaaacacuucacugagccucuggaugucugggcaccuugugggcagaggcaggcaggucucugugaauuuaaugccagccugauccuggacagcuagagcuguuacucagagaaacccuaucucaaaaaaaaauuuuuuuuaauugggccaggaagauagcuugacaaguaaagguguuauuugccaacaugcugacuaccugaguucaaccccugaauuuacauaauggaaagagaaccaauucccgcaagcuauccucaugcguguguguguguguguguguguguguguguguguguguguauguguguguauguguguguaugugugugcgcgcgcccgcgcgcgugcaugcgugaaugaaugaucucuucuguucuuucuagaugaaucaccaagccuguauccugucucucuuuuuguccugcccucaccucacuagcuguugacaggucggugacugccagccugagugaugcccgggaugcucuggugaacgcugucaucgacucucucucagcuuaccgcucuucaguccugaguggucagcagccaggccucaugguuccuuucuccuugaggcuuuucccacuuuuuguguuggcucuccuaaaacagguaagaaaacucaggcugacacacuaagaauguugaaaagcuuuuuauugaacucuuaaauauuguauaaguagcuuuagaccauguucugagacugggaacccugucucucacaggagcauuggaaggauuuauagccaaagacauuuaugaauaacuaauuuaauguaagugccucacucaccaacaguucagugaugugaccacaaauuuaaaugcuaaccaaagaaagaccugaaaguuguaguguugcucugagaagccacgcaccugcugcauguucucguucacacuggaagcuuaaaagugaacacacagacucagagccgagugacggcggccguuagacaccgggagugugagggauggagaggcacugcucagggcacagugggaccacuuagacaagaugaauccuacauguacaguguguguggggagugguguguauggggucacaaaugccucuuucugcugagucaucuuuccagcccaguucuaacuucuuuacuuaagucacagaaauuaccuaaguauuuaaauuuuaacauuuaacaauccaagaucuucucuugaacgccuuuuuuagccagguggugguggcgcacgccuuuaaucccagcacucaggaggcagaggcaggcggauuucugaguucaaggccagccuggucuacaaagugaguuccaggagagccagggcuacacagagaaacccugucucgaaggaaaaaaaaaaaaaaaaaggccuuuuuuaauggucugccuuccuugauaucuuucccucccgccccccccacacacacacucucaaaguuagacauacagcacugucaucccuucccaucaugcagcacugcgacaccuucguuccucuugccuccuacauuuuuucuaugucaguuaucacugaccacaguuugcugauuuauuauuuuuccuuuuuuuguuguugagacaaggucuuaccguguaacccucauuguagaacucacuuuguagaccaggcugaucuugaacucacagagauccaccuaccucuaaaucuugaguguauuuuuauauucaccuuuauuucuccuuuuucaggaaguaaaccaugaauacaaaaguuuuugucuuuuuuuuuuuuuuuuuuugguuuugguuuuuugagacagaguuucuauguguagcccuggcuguccugggacucacuuuguagaccagucuggccucgaacucagaaauccgccugccucugccucccgagugcugggaagguuuugucuuuuuuuauucauuauuuaaucacagcaccuaguauguaauaacaguaagugaaaaagauguaagugcauuauuucaccuauaagauauagugauugccgggcgugguagccgcacgccuuuaaucccagcacuaaggaggcagaggcagguggauuucugaguucgaggccagccuagucuacagagugaguuccaggacagccagggauacacagagaaacccugucuuggaaaaaaagugcagugauuauuuuuuuuauacuuuguuuuaaauuuacuuuacuuucugugucuguguguuuugcuugcaagugugccuagugcuuguggaggccagaaaacaucagaucuucugggacuggaguuacagaugguuguaagccacuauguggguguugggaacugaauuugggucuucugcaagaccaaccagugcucuggaucacugagcuaucucuccaggcccuauuuauuuaauacuaacaggugaaauaauucacuaaaauuuuucucgugguaugccaaaaagccucugugcgaugagcuagaccaccagcuuucgacacaugcugagugcuuacagugugcugcauguuguagggggaugggagagacaucauugaacaaaauugcccagacucuuuccagggcagccuuguucuaggggagccucacaaguuagugaccugggcauaaaagcuggucuggguucuuuggcaaagucaccauagaggagcaccuggcauagagccaucagugagugacaugugacagacugaggcucugcuguuauuaaacacucuugcuuccugcagaugccucaguuuaccugaaccugccuggagaaggcguucuagucacauucagucugugaauauucauuguucucugccucuuguauuccucuccaccaacugagacacuagcccucaccucacagcuccgccagccugagugcagcuacuacagcacuaaaacugucccagccucagcucugcucugccacuguccucaugugugguaccacccugcuucagaggccgugggaucugcuguauugaguuuuaaugucucucguuguggaagaaacaauuaccauccagcagacguggcacacuugcuggggucuucuugcuaugccauguguaccuuuaucuugucgccaggguaccauccuucccaggcuucucagcuccaucacagucacugcaguuaggccuagccuagcagugaggaaacagacaccaggagaucgggugacuuagcaauggucagguauugacuaguugagacuuccagaugaggcuacaggguaaugacuucuucaaagauaaaauaauuuaugauaaauuugcuaauucugucuaaugauaaucuuuuagcaauugacauuuacaaaacucuuuuucuaauguugggaggcgggguguuguuuuauugcagaaaucuuuccagacugggacaaguauacgucuagaugaacgaauuuuugccaugugucaagugaaaagccagccauugguucaccucaugcucacaacacaucccaguuuguacagaguugacaaccucucagaugagguaagaccaacucccuguucuguggcuucuuccgaaaaacgugaagccugauuauauucuguacagaaaugaguuuguuaccuaaauccuuguuuguuuuuuccuagguaaauguacagaaacuuugauaguuagggacauuccugaaaauauuaacuuuaaguuuucuaagacauacucucuuuuuuucuaauuugagauuuaaagauacagauauaguauacaaggugucucagagugucuauugcugugagaaaacaccaugaccaaagucaacuuggaagaaagggcuucuuuuagcauagaguucaucaucaaagaaguuagggcaggaacgcagggcagcagcugauggaaaagccauggagggugcuguguacagguuucucuauggcuuacucagucaggcuucuuacacagccaagaccaccagaccauagggggcgcuguugcgggaaauauuuaaaaagaaccaccaagcuccugcacuucauccgcccacucuccagcaggaccagagcuccuguguucccuucucuuggcugccaugccagccacacgcaacgcaccgcaacgaccauccacccagcagucagcaccucaacacccagcaacccaguagaaacaaaacucuagaagcuuauaauuaacaagucagauuuagagggcuggagagauggcucagcaguuaagagcacugacugcgcuuccaaagcuccccaguucaagucccagcaaccacaugaugacucacaaucaucugugaugaaaucugaugcccucuucuggggugucugaagacagcuacagccagcguacuuuacauaauaaagaaagaaaucugggccagagcaagcaagacuggagagagaagaaaaagugucugaagacagcuacaguguacuuacauauaucugaccuuuuuuaaaagauuuauuuauuauuuauaucaauaaauucucaauucacaagaugccuacacaauaauuucagggccaaaugauaaugauacaagcugcccaccuagaucagacaaguuaucccaauuauucuaucccuauaugauguuuauaacuaccuguggcuacuuaaaaccaaucccacccccgugggaucaggaucuuccuguucaucugcucucugucccugcaacucuuuguucugccucccuuuucccuguccaaucacaagcuuccugcugcacuaauauucuaauguaauuggacaggaaaaauucuacccccgggcacugcccacaacgggcucuucucacauuacucacuaauugagggaaaugccaaucuggugggagcauuuucucaguuaaaguuuucucuucucaggugacucuagcuugugccaaguggacauaagauagccagcacagaaggcucuuaccaguuguuccuaauguuuaacuuuauaguuuccugggcuauaccuaaauggcuuauuccuauaguucaaacaacuuuggcuaaaacaagaggaucacuugagcucaugaguuugaaaucagucccugccucagaaacaaaauucaaaaacucuaagaagaggaagaggaagaagaaaaggaggaagaagaggaggaagaagaggaggaagaagaggaggaggaaagaaaaaaggagagagacuugauuaaucuauuauuaguuguauuucacuaaugucacuuaucuguucacuauauauuauauuuuucaauuuaauuuuuaaaaaccaaagucaaggggcuggugagauggcucaguggguaagaguacccgacugcucuuccaaagguccagaguucaaaucccagcaaccacaugguggcucacaaccauccguaacgagaucugacgcccucuucuggugugucugaagacagcuacaguguacucacauauaauaaauaaauaaaucuaaaaaaaagaaaaaccaaagucaagcuugauggcaccgauaauccuagcacuugcaaggugggucaggaguuccaggccugccuggcuaacaggaaacccucucuuuaaagaauguaacagcccaguugguagaaugcuugcuuagcaugcaugaagccuggguccacucuucacccuggcauuaaccuugcauggugguucauaccuacauugucaacucuuggaauauggaggcaggaggaucagaaaagaaauucagaguuaucuuuagcuacacagggagcuggcaaccagccuguaccuaaagaucuggucucaaaaaacuaaagaugggaaugggcuggagagaugaucuguggguaaagugcuucgcugcacaagcaugaggaccugaguuaguucccagaauaugacacuauggaucuguaaccccagcacuggggaagcccagggaccugcuggccagccagguaacugagucaacaagcuccagguucauugagagcuugucucaaagaauaagguggcaagugacagaaaacaccugccauuaacuucuagcuauacaacuaagaaauaaauaugaucagaauuuaauuuuaauuauuagagucauguggcuuuguuuaauauacauaauauuccauguuuauuaugcauaacugacuugccuauuuaagauccaaacucuuauaagucaauucauuucauuguguuagcuacuuaacccuggcucucgagagcugagcgugguaccccaggccaguaauuucagcaauuagaggaggaggcggaacaaucuggaguucaagaucagcuucagcuacguaaaaaguuugaggccagccugagcuauggcagacucuuuuuccaaaaaaguacugagguuaggaauaaaauguuuauuguggaagcaugaggaccagaguucagaacccacaugaaaaacaaggcaggcauggcagccaccugucauuuuaucacucgaaauuuucagaggcagcagaucccugggauaaucugccuaauuagacucuacguguacauguuaaccuguaucuaaccuguaucuaaaaaacuucauucuuugccuccuucagggagcucucaacaucaaugacagaaccauaccucagccccccauucuucagcucucgguggagaaguugagcagagauggagcguuccucauggaugcaggcucagugaguggauuaacucagccuuaugagcucagugugcugcugagccuccuuaaugguuggcuucagcugcuuuucuuuauacauuagcgcugaccauucucccugcugucucccauuucauaguguuuaguaguucucuguacagucucacuaagcaugcucaugcuuugacguuuuaaagcauaaccaaugauaaaaguaucagacucacuauuaggcugucucucaaaucaguguauuucuguuugcaguuacugaugcuuuggguuggaagaaauuguucacagaauuuucucagccaaguucugggaguucaaaacuaugcaucaauuccacagacaaugguaagcuuuuauguuaguggucauaaacgauuuaaaggacauuucaaauauaauacaaacaugaacccuauuuucagaucaggaauuaauacuccaaauuucucccaaaguaaguaucuuuauagauaauaucucuaccaacugcaagugcucauuuuaugguuugguuuggguguguuuacaggcagguucuugcuauggugcucagguuugucuaugucucaagaacgcagaggguuccuuaugccucagagucucuauuagauaggacuacagccacacaccacuaugccgggcucaucuugucuuguuuguugugguuuuggguuuuguuuuuguauuuuuuuuuguuuuguauuuuuacauuggugaacauguagcucuggcuggccuagaacucacuauguagaccagguuggccucaaacugacagagaucuacuugucucugccucuugagccacuauaccuggcucauuuugucuucaaaugauauuuuugguuagccuugggguuaauuuuguuuuauuuuauguguaugaauguuuugcuugcauguagauauguguaucacaugcaugccugguuccugugaaguuuagaacaggguguguggauccacagaacuggacuuauagauggucaugaguaccaugugggugauaggggaacccagguccucuguaagagguguacaugcuccuaacucugagcuggccgucuacagccucuucgcaguuuugugugcauuucaucuggucugggugguuuugaaauaguaucaccagacugucucugaccugccagcuccugaguaacggcacagagacguaguguuuauuaagcuuaggccuuagcuggcuaccucccagcuagcucaucuaacuuaaauuaucccgacuauucuacuucaccucugccacguggccccuugccucucagucagucagucaguuaguccuggcacuugcuccuucccccucugugucacaaugacgaaucucucaccucugaauuuuuucaaaguuugguaggaaccacaguuccuaccucuaccaggaagcccugccuuuccucuccugucuagcuauugccaugagcucuuuaugaaacccauuagaaggugguggagguguaugugaaggugguuaauccauaaaaauaaugaugccaccagguguaguggcucacgcccuuaauccuagcacuugggaggcagaggcaggcggauuucugaguucgaggccagccuggucuacagagugaguuccaggacagccaggcuacacagagaaacccugucucaaaaaacaaaaaagaaaagaaaaacaaccuuuaaacagugcacaaaaggguuccccaagauaggucuuauucuguaauccauguugacccccaaauuauggcaguuuccucaccccagccuuucaguugcuaagauuauauauagauuuacaguacuguaccuagcugagcaugacacugguuuuuuuuggagugugggggggaagaggauagaaucuuuuuaaccaggauuuuacuauaucccuggcuuaccuggaaccccugguguagaccaggcugaucucaaucuuacagcauuucuuuuaccucagccuccaaagugcugagcucacagacaugaaucagugucuuaagaguuuuauugcaacucuuuuaaaggaaaacaugaguuggguuuggcuuacacuuucagagguuuaguccuuuaucauggcagggagaaugguggcacacaggcaaacauggugcuggagaaggagcugagaguucuacaucuugaucuguaggcagcaaggaauaucuucugaagguagcaaagaggaggcuguuuuuccaugaugggcagaacuuaaccugggagaccucaaaccuccucccccugcccugcucccaacacacacagugacacccuuucuuccacaaagcuauaccuccuaauaguaccauccccaugggccagacacucaaacacaugcguguaugggggccaaaccuauucagaccaccacagccaccuuucuaaaguguuuaaaaugguaauucucagcuauacaugguagcacucaggaggcagaaucaggaggaucucuguguguuccgguccagccacaauuaguugcugugaccuucucugagucugauccccaaaacccagguaagcugagugggagaagcagcuccagaguuuuucucugaccucuguccacucugacauguguccaaaauguucaugugcauagacauacauacuauaauaaaaauuugaauguauuuuguguuuauauguauauaguuguuuugccugcaugggugucuguguggcuugugugugccugaugcccaaaggggugagaaaagguuaucaguccuuugaaacuggaguuacagacagcuguuuacuaccauguacgugcuagaaaccaaacccuuguuuucuggaagaacagugugugcucuuaacuacugagccacaaaccauuucuucagcccagugauaaaauuuuuaagaguuaaaauauuguugggcuggagagauggcuuagcaguuaagagcacugacugcucuuccagagauccugaguucaauucccagcaaccacaugguggcucacaaccaucuguaaugagaucugaugcccucuucugguauguuugagaacagcuagaguguauguguguguauguauguauuugugugugugugugugugugugugugugugugugugugugugugaauaauauugucuuugaaggggaaagcauugaauuuaguuaaugaccaaaaaauaaaauuaaaaacuuguauugcugggcaugacauuaguaucuguguuugagugucuuugucuguuucuuugucuuucucccaacccccucuuuuagcaaggauuauugaagccaaagccuugcacacucuaggcaagcaucauuugagugcugugucugcauguauaucugugugccagaagaggacaucagaucccauuacagaugguugugaaccaucaugugguugcugggaauugaacucaggaucucuggaagagagccagugcucuuaacugaugagccauuguuaaaauugccuuauuuuuucaguaccuacugcuagcuaguauguguccagcuuuggaaaacauauuuaucacuuuauauaccaaucggguucuaugcugcacuuuuggcaauaauuaaaggacuucauuuuuuuuuuaauuuauuuauuuauuauauguaaguacacuguagcugucuucagacacuccagaagagggcaucagaucuuguuacagaugguugugagccaccaugugguugcugggauuugaacuacggaccuuuggaagagcagucgggugcucuuacccacugagccaucucaccagccccuuaaguauuuauuuuaaaauuuuuauuauaucuauuucuucauugaaguuugggguguacauaucaagggucaagugaggucagaggacaacuuuuggggauugauucuuucuacuaagugggucccagagaucaaacucaagucaccaggcuuuguaccaagugccuuuacccacugagucaucuccaguccucaggacucauauauguagaaagacuucaaugucaaaguuauauagaggauauaagcuuucaguccuugagcaaaaauacuagacuagaugaauaggcauuuaaguagugaaaucagaaaguguuguaucuguaauaaccaccuugaugaguuggcugauucuaaauuucguuaugaagugaagaguuggaagguuuuccuaggucaauacagugcugacuagaucaagacugugcugaccaggcccaagagccugccacccguuuuguauuuaugaucuuacuggaacuuaaguguagcaauggcagugcugaguauuugcaacagaaacagaauuacuuucaagccuaauauaaacucugguccaacaaaaucaacugauuuugagucauaaaucuaaagggugcagacugcaagguagauaauagagcuaauuggaguuuuauuuaacagacagaucuuccagaacuugauacaccagaaucugccagaauagcagcguucaucucauggcucagagaacagaggccauuuuucccaguacucuauguaaucagguaagucaauguucguuguuuuguaggguuugguuuuuguuuuuuuguuuuucaagauaagauuuuucuguauaauagcccuggcuguccuggaacucauuuuauagaacaugcugaccuccaauuuacugagaucuccuugccucugccuuccaagugcuagaauuaaaggguaagucagacuuuuaaugugucaaugucuggucuuacaagaacucacuuugaauaacaguauguauaugaccaaauuuauaaguaaccuuuuaaaagaacauagaaagggcuggcaaaguagauuaguugguauaauuuucuuuuugaggcaagguuuuucugucuuggaacuagcucuauagacuaggcuggccuugaacucauagagaucugccugcuucugccucccaagagcugcgauuaaagguguauugcccaacaauugguagugucuguguugcacaucuuagguucaauccucagcauaauauaaaacagugcaugaugacacaugcuugugaucccagcacuccaaagguggagacaggaggaucaguuuaaguucauccucagaauucugaguucaaagccacccugagcuacaugagacacugucucaaaaaaaauaaaaagaauauggaaagauaaaauauacuucuuuucaacugucauaaacuauacaugauaaccaauuauuagaauugauaaaauuuugauaagcuuacucauaaaaaugucaguaguuucuccccuaaauaacaaacauuuacaucagagaaaccuccaggcauaauuucuuugguuuuuacagucauuguguguguguguguguguucugcgaguguguguuuugccuacauguauguauguaaacuuguauguauguauacuuggugcccuugggagucagaagagggugcugaauccccuaggggcuggacuuagagacaguugugagccacuguuuagguguuggaaaccaaaugagucuaauggucuagguccucuauaagaguggccaguccaugcaucaaaagauggccuagucggccaucacuggaaagagaggcccauuggacacgcaaacuuuauaugccccaguacaggggaacgccagggccauaaaaggggaguggguggguaggggagaggggguggguggcuaugggggacuuuugguauagcauugcaaauguaaaugagcaaaauaccuaauaaaaaauggaaaaaaaaaaaaaaaaagaguggccaguccuuuaaaccacugagccaucuuuacagccccuagacauagcugguuauaugaucagaauuacccuaaguaucacaguaaaucaguagccuaugaaaagaaucugagguuuauucuacugcaucuaacacacaugaucauugcugccuuuuaucucuaagggaggagagucuuaugaaagcagccuuccuucagagcuugguagaagacagaacagagucugcacugucauauuaugaauuccuccugcacauacagcagcaagugaacaagugaggagucgcuggcggaguuccugaggaugcaguaccuuucuuuccuccuuaagauugugaacaaaugugaugaugauuaagauguuucacugugauuucaacuaacuauagcaaagaaaggaccacagccgagagucagaugugcaacuccaaaauacuguauuuuucaaaucaaauagaugucuacacaauuggaaaccuuuuuuuuucccuuugcugccaacuauguuugaguuguuauggauugagaugagacaauauugcagaggcaaagaacauuuuauaaaauaaagacuucuguguucugcauuucuauuucucauuuuuuuauuuuuaugaguuuuuggcugcuacauuuaaaaacgucacaagacuaaguguuuuagggacguuucaagucuaucaauaaugaucuuuuuuaaauuggaaaauccaaaagucaguagacuguagaaaagcuggaauccaucccuuuacauaucuguuuuugccccgcccgcccccccccccacuucauuuuguagggaaggaaaaggaucauguuaacugaaauuggaguacacuagcucugguccugcuugggaagaauauaaaguaaauugucaagcuuuaacaucugucaguauuuucucuacuugaacaaagucacuuuaauuugaggugaaaacuaauuaggugguuuucugcuguuuuauucugccgugaauaaaauuugagcugucuucauaaauauaucaggacuggcaaugauaauaggagcugguucuguugguucgcugaguggguuuuuguuugguccauuucugcugugguugauagaguuaaaguauuacaagcaguuaaagguucccuagaugcaaucuuagaaugcaucagcguaucucuaggaaguuuaaggauuaaauuggaagccguucauguauucugggauauuaaaaccuuuuaagguaugaaugcugcuguuugaguugguggauacuaagauuguacaaauccaucauuuuaaaauuauaaaagaaacuugauuuguuaucaugcucuaaagacugcuuguuuugauucaguuagagaacuauuacagucaaacuaucagauggcuuuuguuuacaaauagguaaauuauccauguguauuuaaagugcuaugaugugucuuuaagaguuugccucaguuuucacagguucaucaucuuguaugaacuucuuuaguaauauuuguguguaauacucagagauuuuuuuuuuuuuuugguuuuuguuuucauagauuagaaauguguuuacaaucuccgucucaugugaucaccaauauaauaguaacuuccagguuuacacccacacgggcugacuguaacuccugggaagggaagcagcaggccccuggaguguacagacagcuaugcuugccagcugcuuccggacaacugugcuuugugagaguaacaguguuagaguuccuuuucuuuuuuaauuccaagccacacaugaugguggcacaggauccuaaccccagugcuuggaaggcuacggcuacagcaggucgauugcuagccugggcuacauagcaagugccagaccagcuagacuuugucucaaaaagacaauugaaaauuuuuguuucaguguacauauaguacauucaauugagguuuuuuuuuuuuuuaaacugcuucauuuauugagaagcaguuuucaaacuauaaccaauuaaguguauauuauuuccccucuuuuuaagaaacagccauuauauacaauguuccuuuaaaugaacuaaaguuuucuuuuuaaugggauuuuaaauguuaguauuuuuagguucuuucuucauaguaaggaaucuuccagagggaaauguacuccuagggaaaccuuccucgugccuucccugagugagucugacccuuauuagcaccugcuugguuaguauauuuuacaaauuuacuuuuaaauuuuauuuuagauauuauauuaugugcaauccagaguaauuuuauaacaguuauaaaaacauaacuauuaggguucacaacuuuguucuccagacaagagaaugaaccguuguggaauauugauaugauuauuuuuuugcuauauugaauguuuuucaguuuugacuuuuuuuuuuuuugcaguaagacacuacccguccuaccauccuguauuacuuucugauguaaagcaacuaauauuuacacuaugccauauuuuuuuuauuguaguuguaaauuaugaaagauccuugaauuuucuacagaucuacaacuacuaaaguaacagacaagggcaaucuugauauauaaaucugagcaugcaguucuaccauaaaaaguacucuauuuuucuaauuucuagaauuuuuaaaauaauguuccuguaagucugacauacuaauauucacuuacgcaguaacacuuauuuuagcuugcauauauuuuaauuuaauguaauauacugagucuaauagacuguuuugcaauaauuagaauaaaagauuuacuucuucuaaucagagaugcauaacagcuauuaucuaggggaccaccaaaugugauuucacaguuuuaacuauuauaaacacaauuguuacauagaaauuuuaauuuuguaaaguaguguauaugauauuguaacauuaaguccuuguucucaaaucaaaaguauauguugaccuccaguguauugugcucagucuugcuccccugaaauguugagacaagauuggucuuccuuuuuacagauuguaauuuucacuguuuuauuccuguuuuuuuaaaaaaaagucauuuguaacccaugcaaacaauguuugaucugugcuaacuuauaaauuuggcuauucaauaaaguuaaucaaaagagcuuau

SEQ ID NO: 5988 - RNA, 28301 nt, Mus musculus
gacugucacuagcgaggcacccgccgacccggaaggagcugagaagagcuggggcccuggcagccauagcgcuuugcacagccggcuuggagcguguaggacgggcacggagcaggguugcguucucugaagucgcaggugaguggcagugcccucgucgggcaagagagcgggcgacagcuguggcccuucggaaggccacucuuuaugcugcccacucacccagagcucuugucucggguccuucgcgaacagggagccuguuguuuuggguuuuguuuuuguuuuguuuuuuucacgcagggugagggacaacaccgaucccuaccugcggaaaccgcucuaguggcucuagggguaaaacagugguugccacagggcaaguauuucaggaaagagugagaguaccgcacgcgagacucuuuuccuuccccuggcccucaguuuccccauuugguaggaugagcgaauuaggggucauagacagcuggagaggcuaggacggcucuguguugucccaguaaguguggcggucacugggccuccucauucuccguacuuaccguauagcucaagccggguugaaugaaggggaaagauacuaauggggggaaaagucaagauuuuacgauaagauaaaauuuauuuugaaagguucaaguguagucuuguuaacugaaggaaaaaaauuuauuaggaguuuaacguauugggaugaaguaaauugaacuuacugucacguauuugaacauucuuaaaucaagcucugugugggugucaucuuaccuugaaugucuguguccuuuguuuaaauauuggucagaguaguuacagugaaaaagaaggugccaccuguacagcaccgcagucugcuaaggaagacaccccugucaauuauuuuacaggugaccaauaagggugauuuuacaguuugccaaugaugagugucaucagucaaacagggcaaugcaugccuaccauugcaccuuuugguacauuuggguuugugaccacaauauuuugaccuuuaaaaaauuuuuguuugaacauaggcaggcacucugacccuacaauuccaccuacucaagagggcaggggcaucauuugagccaagucugccuucgaagaucuuaucucaagaaaacaaaauuggucucagaguuaagcugcucccaggcauuucugaguuuacagaaaaggaaaguguccuuguugucaggauguuagagaagcgauucuguaguugugaaguuuugcaguuugaauacggugaacucuagauuuccucugccuugugcuauuggaguagaaauguaagcaggacuugacacaaaggagcagucuaucagauguggaaaucacugccaccucauucgaaacuuacaaacuagagugcuauagcagugauucaccucauccccaccccucucucacggacaaaguuggcugaaacucacugaaauuacuuuuuuugcaaaacaugauaaaguuucuccauuguauguacuuuuuacaaaaaauuugguuauuguuuuauuaauguugguaauguuuuauuacauauguauuaugagugugucugaguuaaagaucauaucagggaauucaugccaagguguggguuucugaaauuaaacucaggucaucgggcuuggugauagcaccuugaccuaauaagccaucuggauagccuucuauugguguuuugaggauggaauuuauuaucagauauaccagucugaguugucuuaguccacuagaggcaaguccaaauucacugccagucucacaacauucuuuuaguuguuaagacuaggucuugcuuuguaguccaggcuggccucuuugagauucucccccaucagccucucaaguguucucucucccucuuucccucucuuucccuuccuccuuuuuucuacuauccuuuugacagaagguuuuuucuucuucuccuguuauacacucuuaaagcuguauuucuuguggucuuaaccuucuuucaaauggcugccacuuuucuccagaggaaacaaguacccacuuuuuaaaaauuaaaugaauuaaaaaguuuaauucagggcuguagacauggcucagcugcccuuccugagguucugaguucaauucucagcaaccacaugguggcucacaaaccaucaguaaugagauccggugcccuuuucuggcgugucugaagacacugacagugugcucaaauauauaaaauaaauaaaucuuuuaaaaaguuuaauucauacaauugcuuuguauuggggauugagcuggagucaguuauugucccguaagcuguuuuagguaagaugugugaagcagagcacuucugagauuuagugugcagaacaccgaggugcaaggcagaugggguugugcaucccuuuagugcagcccucaggcagggguggcuggggcucacggaaagucccaggccagcuacauaguggcacccugucaacaaacaaacaacaauaacagaacuuggucaagcauaguuuuaccugguagcacaggcuggccuugaacuuuggaucucaugucuaccucccaagugaguagauuacaggccugugugcuaucccaugccuggcuuaugugcugucaaacugcaagcuaagcaagcacucuacuaacugagcuaugucuccagccuguccuuuguauuucuagugguaaauuagauuacagauagcaugcuaucucuuugucuuguaugugggggagggauuguguaugccauguugagcauguagagaucagaguacaaccuggggaaguuagcauacaaaauaaugaguuuuauugugacuuuuuaaaagcucuauguuauggguauuuugccugcaucuauuuauguguaugggucuuuugccuacauauaugcauuuguacugcaugcaugccugaugccuguggaccagaaguagccaucagauccccuggaauuagaguuacagauguugugagccaccauguaggugcugggaacugagccugggucagcaagaacaagaggucuuaacgucugaacugccuccccagccccuguguuaacauuuucaucuucguguaucuugcuuauauuugcugugcuguuuuuggucgucauuguugucuguuggagacagaaucucauuaguccaagcuggccuuaauucacuaugaucugucaugucacaaaugcuggacuuauaagcacaccauacuccaagaauagugguauacacauuuaauuccagcacugggaaggcagaagcaggcagaucucugaguucaaagccagccugaucuacacagugaauuccagcccaacuagggcuacucaguaagauccugacucaauaaaaauaaaaaaagaaucauaauguaguccauugcuggucucaaaccaggaauccuucagccuuagccuagagcuaugaucaggugagugucacacuuuuugguuuguagugaaauuucugugccuguguuugcaggauacuuuccuaauacuugcuaugguggcacucagugacaauauauuccuaugcaacauggaaacagggcuggcaaggugcuuccucuggucaaagugcuugcugcacaagucuggcagccugaguucaagccccagugccuacaaagcuguccucugaccuccacacaggugccaugacacaugagccccuaacacacacacacacacacacacacacacacacacacacacgucaguagauuuuaaaaugagaaugcuauugauuaauuucauauuaaaaguuauuaaguugggcauggugacaugcuuauaacucuagcacuugggaaaugaagucugagcuacaugguaacuugucuuuuaaaaauaaaaaccucaagaauaaggauucuguuuccucauaaauuauuuguaaacauaaaauguccauuuaagguuuuuauuugcuuuuaugucgaaugauagcuuuauugaacuagacuugacauaccguaauauucuccauuuuauaguaugcagaguguucccaguauagucacaauguuacacaaccuucaccacuauucuagaacauuuuuucucaccucugaaagcaacccuguucccauuagcaguugcccagacuccucucccccuucugacagcacuaaucugcuugcucucaagcagauuugccugcguggacauuucacguggagaguuauccauacaaguucaacgagucagaguuuuaagcagugauuuguaaccugaguucuguucacugcgcugauuuucauguuacaugaguagauugcaaagucuuuuccuguuugguguucgugcaauaaauaaaucugcugaugugggauguuuccuugucagugaccuuugcucuucacaucccugugauguguuccuggguuguguaaccuguucccagggcucaggugucuguuuguagcuaaguggcuuuauucuuaguuggauguuuuuauuuuugcuucgacuugaacaaaacagaaacaaagagauauuuuuauuuuaguaauuccuagcuuguuuugaggguuuaguaaauuauaauuuuauagaacuaugacuaucuucuccaguagaguuucucuguguagguagguaauuucugaguuagauuuuauaaucauagacuggcagcacccucgugcaggaaaauccuuuuccuguucuacucgccagcacuuuuuguagcuccccugacacaccaucaucccagugaagacuuugccucuugacucagugcugcuuuguguagcaaugcccucugcucuuuuagaugagucuaagaccugucacuguguacgcggcaccuccuacccuggcuuccugcaccuuucaccccaaugucccuuuaucuuuccaugccugaccuuagagcugccaccacccagaccagaacuucuuugaacccugcucuuccuauucugaugcacccuggccugcuucaccucucccuguuuacuacagccacacuugucuucugguuuccagacccucccucuacucuguuggcgcuguucuguggaagcuugccuuuggucagcucuguucuuacaccgauccuuugucugcucagccugcacugggucagcucaccagggccucucacugugcccuccagugcucuucucgagcucucuaugcuccucucagcuucagggucacacucagagcccucuccccuuggcccuuuuuucucuguccuggaagucugaauuuucuaaagcccaacaucacagaaggugggguuguaauguggggguguugaggagaaacacaucagugauggccgcugcugaaaauguuucuuagaucucuaacuuuuuuuuuuucuguuaaacucagugcuggccugguggugguaucaaauaccuuuaaucccagcaugaggaagcaagaggcagguagauuucugaauucgaggccagccuggucuacagagugaguucaaggacagccagggcuacacagagaaacccggucuugaaaacuaaaaauaaugaauaaauaaacucagugcuauggcucaaauccuguuccuuucauguucuuggguaagcaugcuacccacgagguacauccccagccuuuugaacagucauuuaacuugauccaccauuacaguacuuguccuauauauuucaaaauuuccucacucccacuauuuuugagacagguuucaauauauguguagcccaagcuggccuuaaagucagucuuuaaacuuagcuuucuaaacucugggauuuuaggugugugccaacaggcucuaugccucuccaucuuuggaagucagauucucugggccucccuccucugacccauacaggaaggggugcucucaguguaaacuccuaaucagauuaguguuccccucuuucucucuauuauguagcucucugucuuggaccucacucuguagaccaggcuggccuucaucucccagagauccaccugccucugccucccuaggcugagauuagaggugugcaccccaugcccagcucuuccggaagguuuucccuuucauuuuaucauuauacccaucccucacuuuuccugaagaagaaauucuuauuuuucucacuccauuucaaauguauuuauauauuuagacuucugcuaucuagcucaggcuggccuaggaccuucaccuuagacuccucagugcugggacuuauaaaaguauucuaccacauccauuucaaauguguuuuuguuuuuguuuuuguuuuuguuuuuguuuuuaaaucuauuuggggacuggagagauggcucagcaguuaagagcacuggcugcucuuccagagguccugaguucaaaucccagcaaccacaugguggcucauaaccaucuguaaugggauccaaugcccucuucugcugugucugaagacaccuauagggcuggugagaugucucagugguuaaaaauacugacugcucuuccaaagguccugaguucaauucccagcaaccacuuggugacucacaaccaucuguaaugggaucugaugcccucuucugguguguuugaagacaacaacaauguacucacauacauaaaauaaauaaaugaaucuuaaaaaaaaagauaucuauaguguacucauacauaaaauaaaucuuugaaaaauaucuauuuuacuuuuaaaccuuuaaauuuauuuuauguauacaaguguuuugccuguauuuauguuacauguaccaugugccuguaguuuuaagaagaggggaucagauccccugggauugcaguugcagaugauugugagccacuauguggguacugggaaucaaaucuggguccucugcaagagcacagcuacuuuaacuacugagccaacuccagccuaggguucaaacuuuuggaaagaggaagaggaucucacugucccucuaucuuuuagccucuguucuucauucauggcucaauaauaguagcauccaguuuaacauuguacauuuuauaugguguauacagauaggcaugguuuacaugaaggucagagaauggcaagucaggucucaccuuccacuucauugaagcagggucucucuuguuucugcugcuguacuguguacuccacuccaggauaccugcccucuccccccaaacuucuaggaaauuuccugucucugucucccaucucacuauaggaguaaugugauuacugaugugugccaccauuuggcuuucgguggguguuggggagcacacuuggauaugaggcuuuuguggccagcucuuuuaccuguugagccuucucccuggugaguuuuguguuugugugugcacauuuuagcucaccuugucuuuaccacgugcucgcagguauuucagaaaaaacuuguaagucauucaaagucagacuuuaaaucggagcuaguaucaacucugcuuuaccuccgacagcacagcuccauuggaggccucucaggcagucaguaauugcuucuguggagcuaaagcuggcauggcuccgcugcagcugcauugaugucacuaacaucuuuccuuuuugacuacucacuccucugguucuucuggccuuccugcauuccaugguccaccccugguuucccuaaaagaucgugccaaguaugacuuauucauagcacggugguggguaucagaggcaggaggauuuuaagcagauauuagggggacauucugaugacaaagugugggucaccaguacuuugacccagggaaaacuacaagaagggaaguaauauguguuaauuuuggaaagguagccaagagauaaguagagaaaguucuggaauacuaggccaggaauuugguucaauuauuucucagcucaaaacuuguggaaggucuucauccaucauacaggguguauagagucaauggacaguuugccacaucaguuguuauacugaaguaacagguagaagcugagacuguccccagcaaauagcuguuguuagggugugcagcaagucacugccaagauagcaguuuggcagagcuucucuggaggcagcauaugggaguggggacagauuuuaaaaugauacuuuguaguuuaggauguggcuuuuuauuugggggacugcaggcaucuaucauucugcugagcaacacaaauuucuuaaccaggaggcuucucugggggcagacagacugcacugcaagcccuggacaggacuguggcuuaacucaaugugagcugugauuuaaacaaacacacaaacaauaaaaaucacugcuguggcucagugauggagugcuugucuagcacuguuuagcacugcaggcuaaaggguaaugauuuaaacagguuacuuauuuaguuuuauucugggaguuauacguaggacccuccuaaaugccuucuaagcucuuuaccacuaggcuauauccagaaccccccuuuugcugguuuugggacuagucccacuaaauuuccuaagcuucccuuaaacuguguacucagcaguucagacaaaccuugaauuuaagauucucuugccucagccucccaaauaacuaggaauacaggcuucugccuauagaccggagguggaaacuuaacaguucuuuggagaaucaauuguguuggaugauguuuugcuggggcaaacacgugaaggaguguuuuccugaaguggacacagaugaaagacuaaggcagacucaugaaggaauguuucgcugaagcagacauaggagaaaggauguucuucuaaagaaaacauguggaaagacaugugauggguucuuugcuagcaacaugcauguauugguccgccuuacauugcauagcugagcugcauuugucaggacucaguugacucaggcugcuuagauacacaugcugaggcaagaccuaugcugaggcaaggcacgugaccgucuguuguuguuuuaagacaaaauuuugugcagcccaggcuggccuuaaauuagcuauauagccaagaaugccuccauuucccaaacuaugaggguacaggcaugagccacgaaaccccuggaguccagggugaccuguuacuuacuauguggccaagacuggccuugaacucacaacaauccuccuccucuuccucuuagauuuaguuuauuuuuuuauguauaugaguauuuugcacauguguaccacaugugugccuggugcccucagagaucuggggucagauaccuuggaacuggaguucugggugguugugagcuuuccuguggaugcugggaacugaaacgagauccuucgcaagagcaaccaaugcucuuaacugaugagccaucuccccaaaccuguuguuuagcuuaagugcugggauuauaggugagaaccuguauuuuagaauguggugguuugaaugugcuuggcccagagaguggcgcuauuggagguguggccuuguugaaggaagcguguuauauagguaugggcuuuaagaaccugucuagcugccugagagugagucuucucagaugaagauguagaacucucagcuccuccugcaccaugccugccuagaugcugccauguuccuaccuugaugauaauggacugaacuucugaaccuguaagccaaccccaauuaaauguuguccuuauaagaguugccuugguuauguugucuauucacagcaguaaaucucuaacacauaaaguucuaguaguuuuuguccaaauugcauuuauguagcuagguugcacuaaggaacaauuucucuccauauuuuguuuuguuuuuuggugcuggaucuugaacccagagccuugugcauaccaggccuacacccucagccccuacacauuucagugucccucucauccagagaguaaugguaagaggauguguaacuuugaagggaagggauauuuuugagcagguucucacuguguaaccaggcuggccuggagcagucugugcaggccuaauugucauuaaacucaaaauccugcuucauccccaccaagugcuaaaauucacaaauaagcauccugcucaagguucucauuccuguguuacugacacacccauagauuuuccauguguuugaucccaaauuggaauucuugggcuauaaaaacaaaauuuggccaggagguagcaguggcagcggcaaauuuaaucccacucagcgcuugggagacagaguuggguaggucuauggaguccaaguauagccuggucuacaaagugaguuccaggacagucagaacuacauagagaaaccuugucucaggaaaaaaacucgcucacaugcacggguaugcacacacacacacauaccaccaccaccaccaacagcaacaaaaacaaaaacagaaaaaauuugaguuagguuaaaagaaaaaaaaauaccagcuacacaggaggcugaggcaggauugugaguugaaagccugcuugaggaauuuaaugagccccagcucccugccccaaauuaaucuaaaggguuagguguggguguuuagcaaaaucucaaucguucgauuuuaccaaugaagacuugagagccagcugcuggggugaaagaaagcauccagaugaccucagcugaugucccaccaggaaugccccucucucaugacauugcaccaaacaaacucuacuuccugggcagcuuucuaugcauccuccugacuuccucuuacucucuguuguuuuuuuguuuguuuguuuguuuguuuguuuguuuuuccuuaauaauccuguguucacugccuaucaauggguuguuugcucagccuuuugaccugugguuugacuguuuauaauauucaagcagaaagcucuuggauuaaaggugugagcuaaggcugagccccaccucagcuaaaaccagguuuuucuaguaaauaacacaaucugggggugggggagucacagugugaucaacagcuugggaugaggcucagugggugagaauuguccagcaagcgugagacccugguuugacacccacaccucaagcccucucagacuaguccauugccgggacuuaggguaucucagaaaagcgagcugggcucauacuagcugcagguggguuugcucccuuuucacgcuccaaggugguguggguaaaggaccgcuuagcugcuuacccucuuuagccacucaugucaauuugacagccuacugcagagaugauuaaaaaacaaacaggacuugucuaaagaaugacaaagagcacagccuucccaauguugggacauggcccaggguucacaucuagaaaguuaacuuuguugaccugugaaagugcauuucuguggcuaugaucuucucucaagaaacuuucugucccguuuuucuuuuacccuauuaguuuuaccaagcuauguugcauaaauacugaauuguauucuguuuucuacuaugacuuaaaagguuuguuuaacauguggugaugguuaaauauugaaaaauucagaaagauaacauaccccaaauguaucaccuagagcugacugucgugugaagaggaguucuguaugaagguacaugccaggaaucuuagcucuggggagaaggaagcuggcgacuggaaauccaaggcucuccuuggcuacacagaagccagccgugucucaaagaauaugacauauguuagacgagcucuuuacacuaaguuuuuuuuuaacuuacauuuuauuuauuuguuuguuuguuuguuuugaaguuuaggcagcuggcuaggacccaacuugcuucuuuuuuuaaaaaaauauuuauuuuauguauaugaguacacuguagcugucuucagacacaccagaagagggcaucaggucccauuacagaugguugugagccaccaugugguugcugggaacugaacucaggaccucuggaagcgcagucagugcucuuaaccauugagccaucucuccauuccuaacuuucuuucuuuuuuuuuuuuuuuuuuuacuggggagagguacacacaugccaugguuuccucacagaggucaggagaugguuugcaggguggaguccaggaauugaacucagacugucaggcuugacagcaggugucuuuauccaucaagccauccaccaacccaggcacguagcuuuuugcagggguggggugggagauaagagaaugggaugggcucauuuguuuuuauuuuugagauggucuaaaaaagccuaggcuguaucccugagccuggccuugaaguccucuucuuccugccucuacaaucuaacugccaucacuucggaucccaggguuuuuauuucuuuuugagacacugucuugcuaaguuugccacgcucuugguuuggagcauacaguguaguccaggcaagacuugaauuuggagaucaucaugccucagccuccugaguaccuggacuuacagacuugugcuaccaagucuaguuuggaaacucuaauuauuauauagcuuugccuagucuggaacucaguaaacaggccagacuggccccuaacucaagagccuguuugccugcgaguaaaggcugcaccaacacacuuggccuuacugauuauuguuacuuuuuguuguuauugaaacagagucacacauaucccaggcaggccuugaacuagcuaugcauucaagaugaccuuaaauucuugacccuccagcuuuuuaccaccuuagauaucaggaauggaaacuuaacaucuuuuuucuuuucucccuauucuuuuuccccaauccccagcucuuacaacaaggauuugauaaauagcucauaucuaauauuuagcacagauuguuucuaaaauuugucuucuuaaaucuuuaaagauuuaauuugugugugagaggggaggagagggagggagaaaaaggauaaagagagagggaggaagggaagggagguagugagggagagagagagagagagggagagagagagagagagagagagaagccaauacccucagaggcagaagagaucguuggagacccuggagcuggaguaguugucagccuucacacgggcacuggcagcugaacucaggcucucuggaagaacagaagugcccuuaaccacugaaccaucucuccagcccccaauuuuuuuuuccagauacaaucuuacaguuuaccuuacagucuaaguuggccuugaauucauaauccuccugccugagcuucccaauggcuagaguuacaaguaugugucaccaugcuuggcucuaacauaguuuugaguuuuuaugccaguuuauacugcaacuuaguuuauuuccuuuuuuuuuuuuuuuuuuugagcuagaucucaucauauagcuguggcuguccuacaacugcuauguucaccaguacagccucaacugcagagaucaccucuguccugaguccugggauuagaguuguuggccaucacacauggcucuucauuuuuuuuuccccuauccuugguuguugucauucauuuuguuccuuccauggacaaagaauggucccugccugaaauuuaauggcauuuugagauuuaugcauaagcauagaugagguucuaucagccuggguaacagggacuuguuguuuauguaugcacacaugcauauguuuaugugcaccacaguguauguauagaggucagagggcaacuuguuaguugguucucucccaccgagugggucccaaggacugaacugagcacaucaagcuuggccccagguguccguauccacugagcccucucaucagcccugcuuuauaguucuuaacacuuacauaauguuagaagauuacgcagacuuguuuaacaucugucgguauccuguguauguuggccaugcugacuguuaagucuaacuaaaccuuguuuuucagaccuguaagaucuggauauguccuucauauuugacuggauuuacagugguuucagcagugugcugcaguuucuagguaacuucggcuuugcucuuuguagcuauugcauuugacccuguuuaugcacuuguuuguagagagcgccuuuauauaagccugugguuaagaaagugagcuuugagauuaugaaauacauccaagugacucaccucuugaaaucacguaaucguaggccaggugugggagagcaccccuguaccucagcccucacaaggcugaagcugugaucugagaccucgaguaauuaggaacuaagguugguucuggucagcaugucuacuguauggagaggugaagccuuucucaacugaagguaaugccuguacacuauggaaagacauacaguaaccaacuugucucuucaagaaacuagaccacaugaaaagugaaaagaugauguuuuuuuguagauagaaauaauuuaaucauauaaaaaauaacuuugagugcucaggaguuagugguguauaccuuuaguuccacacuggggagguagagguagguggaccuuugugaguuugagacccagaucacagauacaucgaugcacuugucugucugucuggauuguacuggggauaugacccaggccuugcauauacuaggcaagucauauggaaggcaaguaccacugaacuagagccacagcccuauuuuaaaacuuguaauggggacacaauuaauuaguugcucaggcuggcuugcaacucauguucuuccuggcucugccuccuaaguacauaagaugacagaaauggcuaugaaacccagcuggccuggaacuggcaugaucccugccucuaucucaccagugaaugcuggauugcacauauaugcugccaugccuggauaauguguagauuuuaaguuguucuuuuaaaacugaaaaugagggcugaggagauggcucagugguuaaagguaucagcugccugcccuuccagggggccugggcucaccucccagcacccacacggcagcucacuaucuaucuaucuauuacuccaguuuuaggggacccgauaccuaugugugcugauaccucaggcacugcacugcacacagaacagccauacacaugaaauacaauaaaauaaaaccugaaaauaagagcugggccuuacuuggugguacagacuacucaguccaacuacucaggagacugaggcaggggaaucacaaauuaaaaguuagaaugaacaacagaaugaauugauuugaagccaaauugggcaauuuggugagauccugucuuacaauaaaaagcaaaaggaggacugggguguagucagaauagaaagcacuugccuauccuauccugggguagcacugccaaacaaaaacaagaucagaaaacuuaaagauaagcuuagcuuaaacaagcuuguuuaugcuaaauguacuuauugaggcagaguuacaacugauuauuguuuauuguugguuuuuguuuuuuacauuuaguauuuuuuauaauuuauuuuaugugcauugguauuuugccugcaugcaugucuguaugagagugucggaucccccggaacuggaguuacagacaguagugcgcugcuaugcaggugcugggaauugauugaaccuggguccaucuggaagaguggccaguguucuuaacugcugagccagcucuccagccccuauuuuguuuguuuuuuguuuuuaaacagucucucuacacagcucuggcugcccuggaacuauguuaaccaggugagcuccgccucccaagagcugggauuacaggcaugcacuaccauacuugaccuggcuuuuuuuauuuuuugagacagggucucauguaggccaggcugaccuuaaacuugcuguagagcuaagaauugccugacuuucugguucugcugccuuuaucucucacauguugggauuguaggugugguaaauuuggguucuauuuagguuuuaauauagauuuaagcacagacauuaaagagggucacuuagggaaggacagcgcacaugcacucaggaauucuagaauucucaaguuguauuucaagcaucuuaauaauaacuauguguaacuuuaagucaugucaaauauaaaguaauuuucauguuccaugucugaugucacucugacugauuauagcucuuauucugcaggauuguauaaaaagucugguaaacugguauuccuuggauuggauaaugccgggaaaacaacuuugcuacacaugcugaaagaugacaggcucgggcagcacgucccaacgcuacaucccaguaaguguuucuucccugugagugaugcugagucauagcuccugccucaaaguguuuugauuuuggacuuuugauggcuaaggugugagauuguuuauccuguuccuaaaauagcuggguaaguaguaauugaccugguucccagagcacaaauuaagaacuagaagcaaugcucagaccuuucuaucccugcacuuagcuauaccaugagcccagccuaugcuauagaguaagaaacgacagagccaguagcagaaagaaacacaagguuaauuuuuauauguaaugucacagugaaaagauuauaaaccaggcagauaacagcuuaaaaauaaagucagccgaaggaugugcgugguggcacacaccuuuaaccccagcaguuggaagaaaaggcaggugggucuguguauucaaggccaccuuggucuucauagcaaagucugugucagccaaggcuccauggugacaucccaacgaguugucuucuggcauacacaugugcgugcguguggcacgcacacaccugcacauacauaaaauaaaaauaaauaauauuuuaugagagcucgagucuucuuuuaaaaagggagggggagcauggcagaguuagaagagauuaucgaguaguuuuacuucucuuugcugggacugaucccuucacuuaucccaagauaguucuuuuuguuuuuucccgagucaggguuucucucuguagcccuggcuguucuggaauucacucuguagaccaggcuggccucgaacucagaaauccaccugccucugccuccugagugcuagguuuaaaggcgugcgccaucacauccaacuuuuuuuuuccuuuuuucuuuugguuuuccaugacuguuucuucagcaccuguugucauagcuggaucuagacacaggaaccugcagggcacagagcaggugcugucucggcugccuugcaucucacauucauucuaacuuacauuuuccauuuaaagcauauauagaaaaaguaacgaccgucugucuuuuggucuggcaacugagcuaguaggugcuuaugugggaaagugaggauaugcguuuaccagacgcccugugcaggaaacacaggggaagcagcaggagcugcaggaaaggaauggaagccagcgugcgcuccuguggccagcgcucgggaggcacaggcuagcagucauacacuugagccaggacacaaaaacucuaccaacugagaccucagucaugacacauuccaggagggagugaccaacaggaagucacaugaccauuuuagaauaagucggaagagucuguggugauagacuuaagcugcuucuaggggugaggucuaagugagggcugaugggcaagggagaggagauagucugagacacuggcagucuucuacuuuaauucaauagaguguguacaggauguaaccaugugaguggguaggcagcauagccaagcacugcccuuuccuuauuguagagacuuugaacacagacccugguauuucauuuacuugaaacacugcguauaauucuuccuuaguuuuugagauagggccuugaguguagcccagguuaacuucagacucaccauccugcaucuucccuagcuucccggucuacuagagaugugugugugcuacccagccagcuuagaguuccuuaacgacauuaaugcucugccaccauguagcuuuaugugcaaauuuuuguuaugauuauggcaagcuucucuauaggcuaugagggaagacaacagggucugaaagucuucuccacuacacacuagguaacagacagaguauguaugcaugcacagggguuugcaagcacuguauuuaggaugggucuucccaccucagucaaccaagcccugcaguccuggcgcaggacggcucuuccuaagagaaugaaacagacucuucuguauucuggcuuugugccaggugguuuugaacucaggugugagagaaaagccagacaguacagucagcugaggaaacagagagcagaguugggaggcuagaacuugcagccacaguacuggaggaaagagaaggggaggaaaucacucccaaaguuagcauggagaauacuuguuugugcuugcaugaaguagaccuccccaaagaaccacaucugcaguaagaaaaaucccacuacagugaacuuuuacaaauacaguaaaaucuaguauauauuauaauuuuacaauguaaaauuaguaagacaugcaaaaaaguagguuaaucagugagccccauaaucaaucaaaggaacagucucagaagugacagggaugguaggauugacugacugauagggacaucgagacagguguggugggcuguggauguggcuuaguugguagacuaucugccuagccuucaugcagcugugcaugaucugcauaaacugagcaugcuggaccaugccuguaaucugcuucacaguaaguuuaagaccacccuggguugcauaagaaccaucucaaaaagcuaagguugugacacuucuuuguuucuuucauuauacugauuuagucugaggccgggcacaucugcgcucagauggggcgagcagacaguuguggacaucaagucuuucgugugcccaggguucaggggaaucaaggcuaggucacugggcuuggugucgagcaccuuuauuuggcgaacuaucuugcugacccuuuuuuuuucuuucuuucuuucuuucuuuuaaguuuaagaagaucagugaccacagauuuaaagggaaacauguacucaaugaggagguaaauggaagauaacaaacaggucuuuguaguccaggcuagcuuugaacuuacucuguagccaaggcugguuuuaaacuucugcuuuuccugacuuuaaaguguuaggauuacaggcaugaguccaugugccuggcagauuucugauuauguuguaaaaauaaucuuguuuuuauuuagcuucagaagagcuuacuauugcuggcaugacguuuacaacuuuugaucugggugggcacgugcaagguaagagucuacuucucuucgucuuuguuuuaucuuaacuuaguaaguguggccauuaugguucagagcuuggaacugcguguucuucaaguaaggcagagaaagguuaaggucguccgucacuggacacauggaacuucugagucccugaagucccugaacugcuugugggugagguaugaggaaaauuuagcuuugaauuucucuuugcuucaggguaccucaucuguugucagaaucauauuaugaacacaugauacuguuccccccaccccuaaaagcuccaguaacuaaccuguuuuguuuauuuauguauuuuauguguauggguaccuugcauguacaucugcacuccaguacacagcauuagacaauugugaacuguuaugugggugcugagaauugaacucagaaccuucagaagagcagcaagugcucuuaaccacugagccauuucuugaaccacaugaaccuguuucucaugacaggcagagcugucauaaucccgaauucucugguccuuucucccaucagagcugcccucuuguucuccccuuggcuucugcucauaaaucccaucugugagguguggcucuuccccggagaagccucccuagcuaggagugcucugcuguccuaauggaacuuagugcuucuguguacguuucugcagcaagugugggaggacuguccugaacccugagcugaacuucuguggacuuccuguccguuuuuuuuauaccccaauaacucuuagcaugugggucacaugguacagcacaaguagcaaaugcuccagaccuaaaggcccccuaaagccugguguuaguguggggugccaacccacagugcugaugcugugugagggcauaccaccucacaugggcuucauucccagcuccauaaauaauaauaauaauaauaauaagguauuuuuaaagccugugacauauauuuggaaaagacuuucaguggcuguggcuagugaaagcacauuuaagacacauguguuaaucucugggguauaaagauuagagaauuagaaucuagagcugggaggauggcuuggugggucagagugcuucccuugcaaaccugaaaaccaaguucaauuccagcauucacagcgaaaggagagagcagacuucacgggcuauccucuaaacuccacaaguugcucugcacgcacacacuuguacucacagguacaucauuaguaauacuacuacuaauaauauacauagauaaaauauagaaucaaauggaguuugcuugaaauuucaucucuacaauauuuuucagcuaggccauaaagcucaagucauuaguuacuucucaucagaguagucuaaaaauuguuuucucaggcuggagaguuaagagcacuuguuauucuuccagaggcccacauggcuaauugacaacugucuuuagcuccaguucuaagggcucuggugucuucugacuuccacaggaaccagguacacacaguacacauacauacauacauacauacauacauacauacauacaugcaggcaauacacgcaugcacauaaaauaauaaaauuuauuuuuuaagaauaaaaauugagccuguggugauggugcccaccuuuaauccuagcacucaggaggcagagggcagccuguucuauagagugaguucuaggacagccaaggaugucccuguuccaaaacccugucucaagaaaaaaaauuaccuuccugauuuuuuuuuuuuuuuuuuuuugguuuuucgagacaggguuucucuguguagcccuggcuguccuggaacucacacuguagaccaggcuggccucgaacucagaaauccgccugccucugccucccgagugcugggauuaaaggcgugugccaccacgcccggcuuuaccuucaugauuuuuuuauagacuuuaguuaauuaauuuuuaauaaaaaaucaaagaauuauuuguaaaaagucuuugauacauauauacauauaauuuuaccacuuauuaaagauuaaggcaaauuugcauacuaauaagauggcuauauuugcuuguuuuuacauaaagaauuaaaugauagcugaauauuuuuacugugagacagaaucuguaacauuuuucaaauucccuuuuuuuucugagacaagguuucucuguguagccuuggcuguccugaaacucgcucucuagaucagacuggccucaaacucaagacccacgccaggccuggcucuuucuuucucuuuuuaagauuuauuuacuuuuauauguuuggguguuuaaugauuuaaugauuuuuacccucuuuuuaugcaaccgcaaucagcaacuuaaguaaaaggguuuuuuuguuuuuuguuuuuuuguuuuggauuuauuuauuuauuauauguaagcacccuguagcugucuucagacacaccagaagaaggcaucagaucucauuaugggugguugugagccaccaugugguugcugggauuugaacucgggaccuucagaagagcagucagugcuuuuacccguugagccaucucgccagcccuaagcaacaguuuuuaaaauaagucauucaaaaacaguacaaugcagagcuauauuaguuugauacuuacauucugagaaacggugguaggaaaauauugaaagucuuugcuuucugaaauuaaaccauaucuuucuuucuuuuuuuauaaauuuauuucaugugcauuaguauuuuggcuacauguaugucuaugugagggugucagauccucuggaacuggaauuacacacaguugugaacugccgugugggugcuggaaacugagucaauccagguucccuggaagagcagccagugcucuuaaccacugagccaccucuccagcccguuauguuucuagaagaacagaaaacugucugcacagcuaagaccuugcaguuccucacaugguagucgggaauccgagccagggcaucugaagcaguguugcuuggagcuguguggugugaugugcccaguacauguucaugugguugcaccaagacugcggggaagccaagugcugcaacagacgcacgugagccagcagugccggagacacaccagaaucaaggcgcuccgguuuuuuaguuuguuuuuguucuugaacauucagaaaccuuugacuguuaucagauuuuucuugaccuacauuuuaagaaccugaagaaugggcuggagagcgggcagagugguuaagagcacugaaugcacugaccggcuuuaauucucucacuuacgugaugccucccaaccuucuguaacuccaguuccaggggaucugaugcccucugcuggccucuguggggacugcaugcacguggacagacacacauacauaccagcacaacucauacacauaaaauaaaaacauuuaaaaagcugggguaaaaugcauguguaccaggaauuccccaggaaagggauagaaaaaaauaagugagauaucagaucccaguuuuuccacucugaugaaaauggaaacuuagggcuggagagacggcuuagugguugagaaugcuuguugcucuugcagaggaccuagguucaagucuuagcaaccacauggagauucacagccacccauagcuccaguuccagggaauccagcuccuuuuguucuucuuggcucccaggcacauaugcgcugcauagacacguaugcaggcaagcacuuaugcauaaaaagugcaauaaauccaagaaaacugucaccucucaaaugcaaagagcucgaugaauaccaagcacaaugugaugcaaacaacacuaaagccccagaaaugaaagugcucgggccauuaacugagaagaacaccuagaggagggaagcagaaagacauggggcccgcagagaucgcagcuaagagagaggaaagcauaucaggccaggagguggcucaguagccgugggcgcuugcugccgaguugaguauaaggagagagcagacgcccaacauuuguuuucugacuuccacacgugcuuccccccacucucacacacagaaauaagaaaucaaagcagagaagcagcacauuugucaugagaaacaagguaagcuugaagacaguggagaaauguuucucuacuacugaaagaaaaugcuuuuuguuuagauuuacuuacuugaguauuuuucacacaugcuugucuguguaccucgugugccuggugcccucagggucagaagagggcaucggauucccugggacuagaguuagagaugauugugaaaagcuagugggugcugggacaaagccuugguccucuggagggaggagcauccaacuuaagcacggagccauggcuccagccuccauuugaaugcucucagaguugaggaagaaauguucuuacaaggcuauauguugaccauuuugucccuagcugguggcacuauuuagaauauuuucauuaauuaaauuuguuuucuggggcuggugagauggcucaguggguaagagcacccgacugcucuucugaagguccgaaguucaaaccccaacaaccacaugguggcucacaaccacccauaaugagaucugacucccucuucuggagugucugaagacagcuacaguguacuuauauauaauaaaaauaaauaaaucuuuaaaaaaaauuguuuccuguuuugaauacaacaguuuguaacuugccaagcuuguacuuggcacuaacacccaucuguuguugauuucauacuuaccacuuaaacuucagaaaugagaaaugucaaaaaauacugcacuuacacacacacacacacacacugcuuaaauuaguugaugagaguuuauagugguuuucuagugaccuuaauaaugagagucacugugucugugaguguacacaugugugugcagccugugugcaggcaccuguggaagcagaagaggguguuggguccccuccccugcaacuggaguugcaggcaguugugauccaccugauguggguuuuggggaccaagcugcgguccucugggagaacaggaagcacucuuaagcaccgagccauuucuccugcuccuaacucuauuucuuaauggggaagaguaaaggauuucauugccccgaaucacggagagucugacauuuguuuugguuuucuggggaagauuugguacuaaagucuuuggcaaaaaaugcaguuggcuguacaguaaaauagcagccaaagggagacgccaguacacuggaggccuuguuggacucuuccaucaaaccauccgcuagguuugaccaacacauaaauccuaacuccugauuguuuuuguuagcccgaagaguauggaaaaacuaccuuccugcuaucaauggcauuguauuucuuguggauugugcagaccaugaaaggcuguuagaaucaaaagaagaacuugauguaaguugaauaauuaaacuaaacacagugaacucccucugggcagccugaugauaguugcaguuggaguugucggagagcaacucucagcuuugucugaggaagcgccugacugggucagggauggucugagcuggugcugacuguuagagugcgagggaguagaguccacuggcuguggcuagugaggaagugcuaacaggagcaccucugaagaccgagcucacccucuccagagugugcucugcaugugugugcaugccuguugaguccugccgccgucgcaggauuccagcccuucagcaguuguccagccaucuuugugaccacuuccagaaggaaguaggagcauggucacucccucugcaccccucccucuaggucagauauuuuguaaagaggcacaggaguuuccagcaagauagagcuaaauauggguccacagaguaaggagaucucugaucugacugaaggucagcccgacuguuccuuuauucagagacacucuguggucugagauagggucuguuagcugcugccuccuucuugugugcuguccucucuacacaaaguauugcuucccucaguucucaggccagaaucuaagucauuggugcugcuccuucuccaucuucugagaagguaauugcccaagauuggaaucuagucgcugaaccagaagugaagcugggcugucccaccuccaaggugaccaugcucccuuagugauuugcauagugagcaucuccagagagcuuuagagaugggagaaucuagcauauggcuucuaaugcucacucaagaugccaggagagugauucagcaggccagggugucaugauacagugaagacugaguccuuggcuauuugguaucuuuucaaaauaagcuuuuuagauggcuuuaaaucaacuugucuuuccuguuauuugcuuuguuucagucacuaaugacagaugaaaccauugccaacgugccuauucuaauucuuggaaauaagaucgacagaccugaagccaucagugaagagagguuacgagagauguuugguuuauauggucagacaacaggaaagguaaaaccuuuuguuuuuauuuuauuuguuuuuugaaacaaggucucaccauguagcucuaguuguccuggaacucacucuguagaacagacugaacucaaacucacagagaucugccagccucugccucccaaguacugggauaaaagauaugggccuccauacccagcuuaagaaagguaaacuuaagccgggcagugguggugcaugcuuuuaaucccagcacucgggaggcagaggcaggcaguucgaggccagccuggucuacagagugaguuucaggacagccaaggcuacacagagaaacccugucuugaaaaaacaaaaacgaaaacgaaaaggaaagaaaagaaagguaaacuuuaaaagugauuuguuugggguuuuauuguuuuuuuuuuuauauuuauuuauuuauuuuauguaugugagugcacuguagcuguacagaugguugugagccuuccugugguuguugggaauugaauuuuuuaggacuucugcuugcuccagucaaccccgcucacucaggcccaaagauucauuuauuauuauacauaaguacacccuagcugacuucugacgcaccacaagagggcaucagaucuuauuacgugugguugugagccaccaugugguugcugggauuuaaacucaggaccuuaggaagagcagucagugcucuuacccacugaaccaucucgccagcaucugguuuuuuuuuuuuuguuuuuuuuguuuuuuuuuaauuuguuucuuuguuuuaaacaggagcucaugaucuaugccuggcuagucuugaguucucuugacucuccugauuuuaccucacaaagagcauagauguacaccagugugccuaccuuugaccuauuggauucuguaguagcgcccugugggugcugggaauugaacccagcuccucugcaaggacaagugcucuuaacuaaugugcgugucuccaguaccccucccucuuaaguuuuaacucuauguuauggguguuuugccugcauguugucugccaaggaggccagaagagggcaucuccuggaacuggaguucagacuguugugaacugccacaugggugcugagaacugagccuaaauccucuagaagggcagcuuacuugcucuuaagcacuggccaucucuuugcccccagccagggauggggugccaguacagaaaguugcagaaaaccacaggacaugguaguacaugucuguaauucuaauacuugggacccggaggaggaaguucaaaaguuuaaagcuacccugggugcuacauaguuggucucaacaaaacaaaguaaaagaaauauuuccagauaaaccaugcgacaaaugucauaguuuauaaacagacccuccuacuaaggugcguacacgcuccuucagggcaaaggaaaacugcagcagaggaagggacuuuacucuagguaggacuucuguccaugcugggaagcgcucuacugcuguggacaucuuagcccucugugccuucccugucauaaaucugcugcauaccaguaguaggccguggucucauuacaguuaaggcuggccuugcacuuugaucccuagagugcugggauugcguggauguaccaccaccuuaccaccaggaaggaaagcuugcauuuguuucuuuuggguuuuugagauugggccuuacuuccuagccuaggcuggccuggagcucgagacccucccaccucaggcucccaagugcaagaaauacaggcgugcccggcacuuggccguggagacucaagucagauuaguuugauuccuuugcaccucccaugcucacaucuuugcuacucauuggccgcauugucauaguagaguaaggaagacuucacguuaaaggaugccaaacaaccgugcuuuaucauugacacccucuguucugaaggagaaucugcaauaugcugagaguagaacuuuuauuccaggagaccucaacauaacagcucucuucucuuccaggguagugugucacugaaggagcugaacgcccggccucuggaaguguucaugugcagugugcuaaaaaggcagggcuauggagaaggcuuccgcuggauggcgcaguacaucgauuagcagcggccggcccacacacuuccagcccucagagauccaucccccaacaugcauaacuugaauucaauagacuuuuguugguuucagaauagguguuuuuagauuauuaauauaucuaccugagugggaauugcaaacugauucaaguuugaauaucacaauguuagcuuucuaauuccacacagauaguuuuuacaguuucuaaccccacaucaauccaucaccguuuauaaagaucagcuucccaucaguacauuugaagcacuuuuuaacgaugugaaacuacaaauauaaaccauauuuaaaagcucaucaugugaaacuuuuauguacuuuuuggaaauaguuuuucaauuuuagauugucugccuaucuuguguacaguuaaaauccgcuuaucagugauugcaugaugccuuacgguuuccaagacuacuuuuucuuaugcaaacgucaugcaauaaaacaaacuccaacauuugacucaguguugggcagcuguuuccuuuga

SEQ ID NO: 5989 - RNA, 962 nt, Mus musculus
acuggguuuuuuacucguuuuuuuuuacauuuacuucaacagauuagucauuggcuaaagggccaccccucuggaagauggggcuacccuuuaggaguguggauuuacccuggccacacuaaagagauaggaagaacaauuaauuauccuucaaugagauaauguacuguuuacaguuuucacuccuauuauuugugugugugugugugugugugugugugugugugugcaugcuguaccugaagaggccaggagagggcgccagaugcccuggagcuguuguuuauagcucuuaugagcuacccgaccugggugacgggagccaaacucuaguccuauagaagaacagccagggcuuuuaacuacugacccaucucucuggccccgagauaacacacuucuguuucccacaauuccugccucugugugcauuugcugagcugcagccacacagcugacuugguaaguuggcuggauuuccugaagcucgggaaagugaacuuucucucuuuccuaaguuugcuguccauaagcauuuaacuucacucuuucucuaaguccccuucccuacccuuggcucuuucucugcaguguggcugacuccaugcuagccaaacucaaagcaauggcagacucucuuucuucgccaccuccuuccccuaugcagcccacgagguucaucgcuuaccugcuuuggaacuuuucuucuaaacugaaaugagaugggauucccuuagaguugguucuuaaguucuuuuauggcugagucugacccaagagcgaacccugauuuccugcuaaccccugggaauggaaguuccuucccucuuccaccccacugugucuggaacauacuguauacaaucugcugcuauacuaggcugcccaagacugcuuaugacucaccagccggggauucgcaguaaaccugggcccuccugcauucagccuggcagagcacg

SEQ ID NO: 5990 - RNA, 962 nt, Mus musculus
cgugcucugccaggcugaaugcaggagggcccagguuuacugcgaauccccggcuggugagucauaagcagucuugggcagccuaguauagcagcagauuguauacaguauguuccagacacagugggguggaagagggaaggaacuuccauucccagggguuagcaggaaaucaggguucgcucuugggucagacucagccauaaaagaacuuaagaaccaacucuaagggaaucccaucucauuucaguuuagaagaaaaguuccaaagcagguaagcgaugaaccucgugggcugcauaggggaaggagguggcgaagaaagagagucugccauugcuuugaguuuggcuagcauggagucagccacacugcagagaaagagccaaggguagggaaggggacuuagagaaagagugaaguuaaaugcuuauggacagcaaacuuaggaaagagagaaaguucacuuucccgagcuucaggaaauccagccaacuuaccaagucagcuguguggcugcagcucagcaaaugcacacagaggcaggaauugugggaaacagaaguguguuaucucggggccagagagaugggucaguaguuaaaagcccuggcuguucuucuauaggacuagaguuuggcucccgucacccaggucggguagcucauaagagcuauaaacaacagcuccagggcaucuggcgcccucuccuggccucuucagguacagcaugcacacacacacacacacacacacacacacacacacaaauaauaggagugaaaacuguaaacaguacauuaucucauugaaggauaauuaauuguucuuccuaucucuuuaguguggccaggguaaauccacacuccuaaaggguagccccaucuuccagagggguggcccuuuagccaaugacuaaucuguugaaguaaauguaaaaaaaaacgaguaaaaaacccagu

SEQ ID NO: 5991 - RNA, 71066 nt, Mus musculus
cgucagucccagucccggcugcgggagucgagucgucgccgccgccgccgccaccgccgcccccagcggacggggcggggaucuuggugccagggccccgucagcccgcccccgccucagucacccguccggggcucggccgggccgucauggagcggggcggaacccuggcguccgcggugugaggugcgccgccucggcuccccguggccuccggaucggccgcugccccucgccccaggcagccggucgccgccuccugggcgggcccgaaugcgcguccggugaaggugcaggccgggcgccgccgccgccgcagccgcggucgggaaaugguucgggccuagcggagcggggacuggaggugagaagccgccugacugccugccugacugacugacugacgucugaggcgcggccgcgccgcggggaaggcgaggcuccggccgcugacgcuggcggagacccgcggggcggggggccccuggauccggcuucgcccuacguuuucucgucccacuuucucuccgaaaucaauuucaaacaagaaaaaucauuuuuuuuuucuuuaaaggccaagccguucccauccgacauuccagacgcccaucaucuggccguuucuucuuuuuuuccuccccccccccccccguugucccuuccuccauuccucccuuugauucggucggcggauuuauccuuugaaaaauuuuuccuucgucugacucaagucauuccuaguuaaagagaaaauaggcccagauucuggcuaucauuucucaacuaguucucgccuuccuucucgcgauccugcgcaccuccccccacccccacucucccaccuccccuccaccgaaagaaaaaaaaaagggggggaggcuggggggguguuaauuuccguccuugauggucgaugggguuugaguggaaaaaugggaaccuggguuggaauaggagaaacccuccuucccgcucggaaccggccugguaccuggcgaucgccauggccgggcuuuggguauugauguuuaggccuccccagcugccugugcgcaggguuaaucucguaauugacgucagugcuuuguuccuuccacuuugcuguugcuucccacucucugagaacggaucaugggguacaggagcccaggguguuuguggggucuccuuauuaggcuuuucauucacagaugacaccuuuauggggagucgagagcccugaucugaaaaugguugugagugaaguucgaaccaagaguucgauucaggguucuccgaguuucgucaguugcaagucagaauucugguuuuucuuccccgcugagguuuuaaacugaagcuagccuccuuuccagugccggaaucuaagcccuaggugcccgugaauaggcuguuugugugacauuuaaaaugugugcuuuuuguggagccgagguggugguggggggagguucaaagcuuaaagcuuuguuuccauguugauucuccgaagcuuuauaaacucuuuuguuuggaugguccuuuuaacuuaucaguauugaaauguuuaugagauucuuuuuaauucgagauuugaugagaagcugauguggaccaagaggaagccuagacucugucgucuuuggucacauaugcguaaagaaguguuggcaaguggccacuugguuuuuaacaaagcuggcuucuucaacuucuucagguuuauguuccuuauugucacuaacuuucgcagcccucagucuccaaacaaaaagucucaaaaaguuguuuuuuaaaaaguuauuuucaaaaaguugccuuucaugaugaacuuccugaaaaccuagacgcagucuguuuucuuuucuuuuuaaaugaauaccagcaguugucauucaguuuguggcuaucugcaggcugauuuuuguuggcucuguaggaacaguaggcacauuuuaaguaaaauuuugcuucagguggagacaagguagggagucuugagaauagccaaaagccaaaucucuacuguuugguugggguggggugggcuuagaggugugugauuuggaucaagcugcacaguuuggggguguaaggugacauacagugcuuggugaaguugugugauuaauuccuauaaagagaauguuuuuauuuuaguuaauguucuguaugucauaguuuuacauucagauucauguggucucuucugucuucagguuacugcaucccuuuuggaacaaugauuccacuugcauguugugauuuucuuaaagaucuacuguagugucuucagagugaguuuauucuaacucucuauccucuccaguauuuauguaguuagauugaauuugauagcauuuugagguuggaauaguuuaucuauccgaucuaagaguuuacagguaaccuaaaguuagaugaacaaguaagugaucaguaucugaaaggagggaaauggggauuagcuucagaaagugcuauggaagaugaagacugcuaaaagcuauggcucuacuuauuuauuuauuuauuaaucuauuuauuuuugagguaguaagguagaagucaugguuuuauguguaccugaaaagaacaaagaaaacagguguuuaacagguauuucuucuucuugacuacuuauuggccuaaaauggaguucaaaauguauggaaacuucccccuuuuuuguagugccuuucauaaaaaucaaagguuuuuguuuuguuuguuuguuuuuuuuuuuuuuuaaagauauguuuuuuuuuuuuaagauuuauuuauuuauuauauguaaguacacuguagcugucuucagacacuccagaagagggcgucagaucuuguuacagauggcugugagccaccaugugguugcugggauuugaacucuggaccuucggaagaacagucgggugcucuuacccacugagccaucucaccagcccguuuuguuuguuuuugagacaggaucucauuuuguauccacaacuggauugaaacuugcuguauguagaccagguuggcauugaacucauagagauccaccugucucuaccuuucaagugcugagauuaaagguuuguacuacuauacccagcuuuuaauuuggccucccaaauuacaagcaugucuagauuccacaaacauucuagauaaaaaucuuugcuacauguuauaaauaagauuuugcagcuuucuguaguccucauauuuuuacuuuuuuuaguuccucugaaaaauugaaacaaugaauucauuucugggagaguguuugcuaguuguuacugugaauacauuguaguuaaagguucaaaucugaguagauacacuucuuuguuacuuuguuacucuuauuagccaucuuguuacauuuggagugacacuaucuaguacaugggauaacaauaauaaauauccuuuuuuuuuuuuuuuuuuucccccuuuuuugguuuuuugagacaggguuucucuauguagcccuggcuguccuggaacuccucuguagaccaggcuggccuugaaaauaucccucuaauuaacucuugccuuaccaccugauccauuuagcuugauguucauuuucacuggcaguuuuuauuuuguuuguuuuguuugauacaagucuucugugucauuuuggcuucaaacuuucagcucucuuccugucucagccucuuucuugaguucuaggacuauagacaugaccacaccuugagaauuuuagugauacugacacacagagagaaggagagccaagucaauuuaguucugguucaauuuaguuuuauuuagauguuggaauuagcuuuuaaucuuauuuuuaaauuaaaaaaaauuuuuuagacaggguuuauauagcccagucuguccucaaacugaauguguagcuggugcuggccuugaauuucucucucucucucucaauauauauauauaugaauauauauauguauguaugcauguauuuuuuuuugccuuuucuccccucugaguaucacaaaaauauauuuagcaaaaaguuucauaugaaaauguccaugagccaguucuacaccacagccugaugggcccuuuggggaguuucuuggggcccuuuuggacuccucugcuaaacagccauuguuuagacacuuagacacaaggugucugacaugauguugcugucuccuuguauggccaccauuuugauguuauccuguugucuacuaauugucaucuccacacacucacucacaagauucauggaagggcccaguaguauuucuugagcaugucugccagcauuagcuucaaugauaacuucuugucuauaaauuucuucaguuugggaggguggcccuuguuuuugguaacucaugguuuagcaagauguggaaggacugauuggacugaccuugaauuucugguccucuugcauccaucucuuaaauggugggauuacugugaaccaccaugguuuaagauucguagauuuuuuuucuuuuuacauuuuuguuguuuuguuuuguuuuuguuuuauuuagacagggcuguccuagaacucauggagaucugccuaccucucuagugcugggauuaaagauauucacuaccaagccaggcuuuugaaauuccacagccuggguugugcugaauguauguaucucuuugguuuuauauaguacuucugguccuuguauuuucuauauguuauaauuauaugaguaagcuagauuuagcucacauuagaaguguuuuuucuguuggcuuuuugagaccaggucucuuguauaacccaggcugacuugaacucauuuuguagcugaggaugacuuugaacugugaucuuucuaccuaugucuccguacuuuuaaugggcagaagagguaguguugugcacuucuccacuccugaaccuucaaccugguuucucauucaucugccaguugauuaucaaguccuguaauccuguguggccaaacuauguggucauugcuuccucccuuacuucuuaccauacuugcuauuaucuuauuuccucuauacuguuguuuucuuccuuaacuucugagacugcuguuguucuuagcagucacucuccuuuuuuuaaagaaaauuauuuauuuagagacaggaucucucuauguaucccuggcuguucuaaaucuuuauguagaucaggcuggccucaaacuuggaaaucugccugccucugccuucugauauaaagauaugcaccacuaugccuacuccuuugcagacucuucauucucugauuaacucuuugauuuugguagcucuggaauuuuuuuuuuuuaaauuuauuuuaacacugguguucugauuccauguaugucugugugagggugucagauccccuaaaacuggaauuauaaacaauuguaaacugccauauaaguguugggauuugaacuuggguccuuuggaagaauagccagugcuuuuuuuuuaaaagauuuauuuuuauuauuauuuuuaauguaugugaguucacuguaacugucuucagacacaccagaagaaggcauccgaucccauuacagaugguugugagccaccaugugguugcagguaauugaacucaaaaccucugaaagagcagucagugcucuuaaccacugagccaucucuccagccccagccagugcucuuaaccgcugaguuuuuuucuccagcccugguauaaucuuggacuucucuauuuauucuucugauuugaucacuuuuuaaaaaaaaaaauucuuuaguuguugcuuacuuuccauugcugugacaaaaugucugaguuaaacaacuuaaaauagaaaauguuuuggggcauguuguaacuuuuuuuuuuaauguuuauucugugucauuguauguuggaagugugcaaccuguuuguuuuaaagauuuauuuguuuauuuauuuauuuuauguauguggguacacuguagcugucuucagucacacaccagaagagggcaucagaucccaguacagaugguugugagccaccaugugggugcugggaauugaacucaggaccucuggaagaacagucagugcucuuaaccgcugagccaucucuccagcccauguuguaacagcuuuaauccuagcaauucuggaggcagugacaaauggaucucugugaguuugaggccugccuggucuacaugaguuacaggccagcuaaggcuauaugguaugacuuugucucaggaaaaaaagaaaagaaaagaagagaacagaacagaacagaaaagagagagaaagaaagagagaaagagagagagaaagaaagaaagagagagagagagagagagagagagagagagagagagagaaaaagaaaaggaagauuuauuuugcuucagggauccagaaguuucagugcguauuuuuugacuguuauuuuugggacuguggugaggaauuauaucauaguagagggucagagugucagaaaccaauucaccuuauggcagccgugaggaagagaaaggaagggaaagaaaugaaggaagggagcgagacccacaaagauaucccuaaugacccaguuugcuuucacuaggcccugccuucuaaagccucugccauccccagugauacagacuggggauuaggcuuuuagcacaagagccuuuggggacugccuagaucuaaaccauauuaucuuaucaagaagucaagaaugguugcauccaagggguuuaagauggguucaggaguaguucuuuaucauuugagauaucuucaguucucuauugcugcaaccugaauuuaucaucugaauuuaaaauguuagguuuccuguuauccuagugagaguaggccuggcucuuagucccaaauccauucucacacugucugcuuuaguggucugucuuguauuaacguacagcuacauuaaaugaaagaaauggaguaaaaggcaucuauaccauuuauuucuugucugucuaauacacauauaccauccuuuuuccgauauagaauacaucuuuaacauauucuaacuacaugcaucagcaaaccacuucauucuuuuguagguuauuuagcaaauuuaccuuaacaaacacauuuaaagguuacuguucucuuagauacugauauuaauauccucuuaagaguuuauuuuaauuauuauuuuuuuaaugauuuguguguugugucuguccccuggaacuggaguuagaggcaauuugagcugcccaacauaggugcuaagacccaaacucugguccucuggagaacagguaaccaucuccucaguccccaauagccucucauuuacaggucugaaaacugugagcuaaagacuaagugugauuauuucugacauagcugauaagcaguggagggggaacagcuugcuagguuggauuggguuugguuuuacaguauugaaacugcacucaggauuuauguaugguagguagguccucuucuacugagcuaaguccacauuucugaaauaucucuuuuagggaagguguuagguauuauucucaagcuuacacugaucuugauguuacuggauacaugguaagaaagccaugugaucuaagcagcaacuguauugauuuaauugcaaacugagaaauagagugacuucuuuuuuguuguuguuguuuuuuguuuuuugagacaggguuucucuguguagcccuggcuguccuggaacucacucuguagaccagguuggccuugaacucagaaauccgccugccucugccucccgagugcugggauuaaaggcgugcagccaccacgccuggcgaauagagugacuucuuugguuagucaaguaaagauuuuauguuuugucaacugaaagguuuuccuuguuuuuuguuuguuuguuuuugcucugucuuauauuaaaauuaacacuggagggauauuuggaaagguucggugaguacaguucuguguuguuuuaguaguuagcugacaagggucagugaacuauggccaguagacccaacguaaccugcugcccguuuuugugcagccuuugaaguaagaauggcuuuuauauuuuuauuuuguuuuguauuuuuaaauaguagcagagucaaaagaauguuauuugggaagagaauauuauagggggcucaaauuucaguguccauaaauaagauuguauuggaacuuagucaacucauguguuuauguauugucuguggcugaauuuugcugcucugaggacagaguugaguaacugacucuaugaacugccaagccuaauguacuaucuguccuuaaaaagguuuggugauucuugccuuagcagaucaaauagguuguaauggauauaugggaauggcucugauguaaauuacaaggucucuaguuuacugugguggcuguuggggguuuuguuuauaggauauacacacacauauauacacaugcacuauuugcgcacauaauaugcaucacauaauguaguagguaaauguaguagguaucuuacauaauauguaauauugaauauaauuuuuuuuuuucgagauaggguuucucuguauagcccuggcuguccuggaacucacuuuguagaccaggcuggccucgaacucagaaauccgccuggaauuaaaggugugcuccacaacacccaguugaauauaacauuuuauauugaauaauguauauaaaauuuauaauuauauagcauaacagguauuacuauaccauauaccauauaaaacagguagaggcugagcauugucuuagcugucugcuguauucuuaggguaaggucauaguucacaugucuguuuuaguauagcucugugaauugggugcaguccagaaauacagaaguugagauaaggcuagaaguggucagaucacuaugaauauauagcuauuucaucucuuuaugccuucaccuccaaauucuccucuuuucuuugcuuuggggaaugccaccacuguccuaauuuuuuccuauaacuugucccucuucugucuuacuuaucacaucugacaggaauccaagauucuacuuuuuuaacacacuugaauuuaaccucuuuucuuuucuuuuuuuuuuuuuuguauuuuuuuuaauauuuauuuauuuuuuauuagauauuuucuuuauauacauuucaaaugcuaucccaaaaguucccuauacccucccucaaccucuuuucaauauuaaauuaaguuuucauuucuuagcauuacuuucuguuuuuaaaaguuuauuuuugccuagcaguuuuggcucaugccuuuaaucccaguauuugggaggcagaggcaggaagaucucugaguugaggccagccuaguuuacauagugaguuccaggacagccagggcuauacagagaaacccugucucaaaaaaccaaaaaaaaaaaaaaaaaaaaaaauauggaacccaaggcuggggauauagcucagugauagauuacucuccgugugugugugugugugugugugugugugugugugugugugugcaugcacgcguguguauguguauauaugauauaugaauauuauguauuuaaauauaauauauaguauguaauauuuuaaaaauauaaaauaaguccuaaugcuacauauuuucauacuuaaauguugcucuaguuuuugcaaaagucauuuguuauacucuuauuuuaaacuuggguuugagguuuuguuauauaagcuauaaugaugaauuuauggcuauuucaauauguauacuaucuuuaaucauuuugaagucagcacuuagacucugggauauuucauuuuuacugagauaguauccuuugcuguaagauuugagaggcaaacuuacuggucaguacaggcccugaauguucucauucguaugucuuuuguuuugcaucucggcuccucaaaccuauuuucuaacuacacuugguccacauucauuuccaggguaugucuuuccucccuguucuucauauuuguugcacagggucuuugccuacaacucacauagcccucuucuuuuauccugccuuuaaucaggcuagcuacaaccaaagaugcuagcuuucauuucaaagaugaaaggaccuuucauuucauuucauuucuuuuuuuuaaaaaagauuuauuuuauguauguaagcacacuguggcugucuucagacacaccagaagagaguaucagauccuauuacagaugguugugagccaucaugugguuacugggaauugaacucaggaccuuuggaagagcagucagugcuuuuuuuuuuagucuugucuaguauauggccuaguauauguacuaaguaguuguugaauuaaguacaggguuaacacugcuuuauacuuccaggcuggggauguagcuuagguggugaagugcucagcacucccaaguucugucuguaaucccaguucucccacaguuugagaagugaagacaggaggaucagaaauuuaaggucaucuuaaacaacaaaucuaguuugaagcuaguuuggauuauaugagacccuaucucaaacaauccacauuuaucugucuauguauguguguaugcauccauacauauguguuuauaaguucagguauccuagagaggcagcauuuauuuguauuuggugaauuuuacacgauuauuccccucccccccuuuuuuuucucucauuuguuugagacagggucucucuccauaacccugacuguucuggaacucauuauauaggccagguagggacuaaagacauucguuaccaugucuaguaagcauagggcauuaaggaaaaguaaaaauugauuguuuccuuuuuuuucuuuuuuuuuucucucuaaacauagucucugccaacuuugaacuuuuguugauuguccuguugauuguccugccuugcuucuugagugcugggauugcucacgugugacagcacaacugacagugcaugucauuuuuuuguguacagaugugguuuuuuacuagauauaagcuuucagaacaguugccuuaaaaacaaaauuugcaaauuguuauugucaaugcucuuauugaauaauaauuauuuuaggaaaagccuuaccucuuacuuuucucagaugucgaaguagagaauaagagugacauggugcucugagcccagccuuagugaguacuccugauauagucugucuuuuugaggcaguaacccuucaguugugacuuuuauaaaaaucacaauuuguuuugaauuucuguaugcuagucacuaaguuaagcauugagggaaggaaguagaaauuaaaauacuagccacgucguuaguuguucuccagguccugugauaugggaauggguuccuacuaaggagaugaaguaauaguaaauaauacacuaacucuacuggagcaaagugcuaagugucaaagagauacaaagaagugcuuugagaauuaagugacguuagugacacagaagucuucgaagguucuuagaggaaaugggugugugguguuuaugguggauguauuggaaacugggaggauaaaggacuuccaucuugguauagagaacagucuugaguacagauguggcucugaacguauguagguuauuuucauagucauacuuuuuuuuuugguuuucugagacaggguuucucuguguagcccuggcuguccuggaacucacuuuguagaccaggcuggccucgaacucagaaaucugccugccucugccucccgagugcugggauuaaagacguacgccaccacgccggcucauacauuuuguuuuguuuuauuuuucaagacaggguuauucugugucacucuggaacucgcucuguagaccagucuggccgcgaacucagaaauccacuugucuuugccucuugaguggugggauuaaagguguugcuaccacugcccagccagacucauaaaauuuuuuuaaagguuuauuuauuuauuuuauguaugugcguacacuguagcucuacagaugguaugagccuucaugcgguuguugggaauugaauauuuagaaccucuacucauucuggucggcugcucacucagucccugcuugcucaggcccaaagauuuauuuauuaacauuguagcugacuucagacacaccaggagaggguaucagaucuccuuacuggugguugugagccacuaugugguugcugggauuugaacucaggaccuucagaagagccaucucaccagcccaagacucauacaguuuaaaggguuuauacaauaaguaaaauagguaaaguugaauaaugagaauuuuagagcagaauaacuuacuuuugagacagggucucacuauauauuagcccuaacuggcuaagaacuucaucuucuuguuucuaccucccaaguaacuacauaaaagucccaaaugagacaacuuuuguuuuguuuuguuuuuacuuuuuuguccuuuugagacuagaucuuucaauguagucuggaguucucuguauaaaccagguuggcguugaacucacugacaucugccugcuucugccucuccagugcucagauuaaagauauguaccaucauaaagaagaaaaauauauuuaaaugcugauggauaggauuaaaaggauucaauagaggggaagaaggugaaguuguuucagagauggcaggaacuauuggagauccagaaaauagcaaguugcaggagauaguuuuugauaagaagaacuauuucuuuguaguuuuucauaaucaggaggaacgaagagaauaggcucagaugaugacauuuugagaacugauaggagauaggguauuacuucaaauuuuguuguuuuuuuucaaggcaggguuucuccauguagcccuaacugucaugaaacuggcucuauagaccaggcuaacauugaacuuagagauccaccugucuuugccuucugaacgcugagauuaaaggugugcaccacacaccugaccccugucuuuuaauuuuaauauucuguuucuugaucuuugucucauaagagaaaguuacuuguggaauaaguuaggaccaggggaaaucacaggacucaaugggauacuuuuugaaauagagaggagaaagacugcaacuuugaggaagccuugaaccugguugggaaugauuuaugagacagguuaauagaaaguugagguaacacauagacauuugacuaagagcugggugugcuacuacaaaucuguuuucccagcaguugagaaguggaagcaagaggaucaggaggucaugguuauccugagccauuuugaaaacagccugggcuacaugacaccucaacuuaaaaaagaaggaaaagaaaaagaaaguuuuguuuuguuuuguuuuguuuuuuuguuaaagauuuauuuauugauuauaugcaaguacacuguagcugucuucagacacuccagaagagggagucagaucucguugugaugguugugagccaccaugugguugcugggauuugaacuccggaccuucggaagagcagucgggugcucuuacccacugaaccaucucaccagcccagaaaguuaauuuuaauuaagaaaauagaaaugacaugcuaaggagauaacucagugggaaagucucccaggacucggguaggaagaggacaggcagauauguauagcuccucuguuaagugagauauccuggcucaaaaaaaaaaaaaaaaaaaacuguaaaaagugauugagaaagucacccagaaugcuggguggugguggcacacgccuuuaaucccagcacuugggaggcagaggcaggcggauuucugcguucgaggccagccuggucuacaaagugaguuccaggacagccagggcuacacagaaaaacccucccucgaaaaaccaaaaaacaaaaaacaaaaaagaaaaaaaaagaaagucacccagaguugaccucugacuuccauagguacacaugcauguauccauacaaguacagcacacaaaacagcaaagugcuauagaaucauuaucuuuguuuuaauaauuuuuacuguauuuuacaucugaaguuuagagaggaaugguaagcucagucguggauuuuguuuguuuguuuuugcuuagcauuacugaagcacuuauuaauuguccagcacugagaagacaauagagacuaaaagcuguacagcucuuagcgcugacucuugggccagagcccuucugucuaacacagugucucgggaccugauguuuuguuaguuuggcuuccaucuccaggugugcacucuuuguuuccuuaccuggcaggaagugaucucuucacaaguucucauggguagagaaauccugcaaaugaggccaugagggguuuuggguccaugaggcuuugugcuuuaacauaguauguuuugguaaaguuaaagucaaguagcaguuguuugaaaauaauuaaaauaucagcucaauucccauuuugacauuuggaguuuaaaccaucaauaaucugguaguugaauggcccacuuuuuuaguaggauaauuguuagaagguaguaauggagguggagacauagcagauucuucacuugaaagggcuguguuaaagcaauacuuuacuuguuuguuuguuuguuugcuuagagacagggucuuucuauauagccccagcuguccggaaauuauguuugccaugccagcugaacucacagacauccaccugccucagcuuucuuuccaagugcuaagauuaaaggcuugcauugccaugacuggcccaacauaauuuuaaacuauuuacaauuuuuaacuuaaaauuuauuuuaaaaaauauaaaauuaaugacauuuauaaaaaguagauuauuucugauuaauugggaaugcauauuuagauuuuuauuuuuaccauaugcuucuuggauuauuuucaauuaaaaaagcuuauuuuggugguuagagugcucaggguuuaggagcacagucugcucuuccagaggacccagguucaauucccaguacccacauggcagcuucacaacagucuuuaauucuaguccaggggaucaaauacccucaucugcuucauaggauccugcuuguauguuauaaauaaguacacuguagcuguccucagaugcaccagaagagggcaucagauuucaccacgggugguuuaagccaccauaugguuucugggauuugaacucaggacccccgaagagcagucagugcuuuuaacugcugagccaaucucuccagcucuaaucugcccuuuagauucuagauaacuuuguauuggggcagggccuuaauucaagaguccuaacugaaacuugauuguuaaugcaguaacauuaauuugucaaaauaugcuaaaggauauuuucuguuuuuuauccucugacaacaguauuuauccucuauaacaguauuuuuguguacuucaguagguuauauauuagcuacacuagaauauuauacacaaauauaagaaacaaccugagggccaggggaguggcuuaguggguaaaagcacuuauucccaaaccugauacuuuuaagguuaaucucuggaauuuacccaguaggaguacacacauacacaccccagaauguaaaaaaucuuguauuuaaaaagaaacaacuuguuucuuuuccuccagggagccacugaagaucccauugucaucauggacagcugcccugcccaguguuaacugguauuguaagaacaggcccagaguuucccuucuggugagggggcuccugaugcuaagaucugcaucuuuaaccugggacagaagaaggcaaaaguugauguauuucuacuuuguagcuacagggugucagaugauuagagcaauucucuucugaagcccuggagguugcccauauuugugccaacaaauacaugauaaaaaguuauugcaaagaugacuuuaauauuugagugagacuccaaccuuuuuauaccacccaaaugauguuauccugugcugggcugacaggcucccgacaauuaugugccuuugggaagcccccagagcacaguggccaggguucacauuggccagguccuucugcaugcaccaagcugcagaacgaggaaucugugauugaggcucugaguaaaaccaaguucaggaccccauaucaccagaagauccacaucucaaagaaguaggcuuuacuaaguuuaaugcaaugaauuugaagacauggucacugagaaguggcucauuccugaugcauguggagucagauauauccccaguugagguccccuagacaaguggcagccccuguacucccuagggcuuccacagugcucuccuguacucuaccaaauuauguucuguaagaaaucucacaucuagucugaagaaaauaaaaagaaacaacuugaacacaauuugaaaucucucucucuccaugcauuauuguugagaaauguuguguguauguauguauacucugugcauguuuggugucugaugaagccaaaagagggugucagauucccugagcugaaugaaguuaaggacauuugugaaauacuguguggauucugggaacugaaccuuggaccucuguaaaaacaguggugcucguaaucauagagccuucuauucagucccaagaauauacuaguuuuacugaucaucguaaauaagugagaaauguuuuccuggucugauuaacuucuguuuucuuuuuccucucucucauccucucccucucuccaccucuucuuuguuguuuuguuauugugggcgguggugguuguuuuuuguuuuuguuuuuguuuuuugagacagggcuucucuguguagccuuggcuauucaguagaccaggcuggccuucaacucagagauccacuugucucugucccccaaguguugggauuaaaaaaguuugccagacuugacuucuguuuucuuauuugguuuaaaauaguuuccacagauauauacugauuuuccccuuugguugaucuguuucuuugugccucucuuuuuuccucuuuuaaaacaaaaucaagauagagguuuaaucccuauuucaacuugagggacaggaacagcagagguccuggugucacucacuuagcauuuuguaaucucuuucauuauugucuguuaagacaaaggucucugcuguucauaaauaaauauauauuccucucuguuuauucuagugacaauauaguauuaucaugauugcagaaaugacaguccuauuuuuuccuuugaccacaaauaaguuuucuuuuuaauacacuuuuaguuauacuuaccaacacaugcuaauuuuagauucacugaaagccuugguuugccauuuauuaaggcauuaauugaaauauuaauauauuuagaguagaaaugucguuuucuagggaaucuagaacaacagcaaagcugaggucaaacugccauaaggauggacaucaaagaagcuguguuugggacaaaaagaaaucaagauaagguagaugcaaaguagagaaaaaagcuggacauaggggugugggugguagaugggaguggguuaugugccaccaaagguauggccaguuagcgccgugaagaggaaggacugacagguggguuuaagaaaauccuuucccucugaaugugcagguuuugacucacuuucagauagcagaguauuugaaaaauugucaugauuuguguagaggaauugaagaugcuugccuggguucuguuccuagcacuggaaaaaaaaaugagguuguuuugagaagcagguuucucauauuguagcuaauguuuucuuucugggugacuguggaagaugauaaugccuagugccagaaucccauuucagcacuaacuaacaccuguuaacuaccuagaaguugacagaaauugaaauguccauuuggaguguuaaauugacagucaguacagaauguucaauuuuuauuuuugugauguaaaaauugugcuucuccucauagcaacaugaaccgugaagaccggaaugugcugcgcaugaaagaaagggaaaggcggaaucaggaaauucagcagggugaagacgccuucccaccuaguucuccucucuuugcugagccauacaaagucguaaguuaucuuccuuugaauauuuuuuuacccuacuuauaugacguuugugcuucuaggguucuuauguguuuuuuuguuuuuuguuuguuuguuuguuuguuuguuuuggugugagugugacucuuccaggcauauucucaggucucuucagaggacagaaggcaauaucaggugcccugaaucuggaguuacaagcagcuuugagccauccuacaugggugcugggaaccgaacucaggucuucuggaagagcaguacaugcucuuaaccauugagccaucucuuuagcccagugcaugccuuuaauugaagcauucugugagguggauacaggcuggaucucugaggucaaggcaaggcagacuacacagagcaacacugucucaaaagaauuuuuuuuuuuuuuuugguuagugaaccuacaguaucuacuguugacuauguauucuguauccuuugguuauaccauccaucuaccauaucgacagucacagaugcuguguuucccuguuucuugccugugcuuauuuaguagguaccauugacuguuaguauguugggauguuucuuauauauguucaucuggguuaucauagauuaaauucucugauauuucuucuaauauauuuauuuaaucauuaucaguugcauugaagcaugucguuagagguguucaauaaagagccaaguacccuuaaucacugagccaucucuucagacccaguagcuauuuuuucuuaaaauuauuuauuuauuuuaugcauaugaguacaguguagcugucuucagacaccagaagaggccauccaaucccauucuaguuggcugugacccaccuugugguugcugggaauugagcucuggaccucuggaagggcagucuguguuccuaacugcugagccaucuagcuaguccccgauugcuauuuuuuuuuuuaaagauuuauuuauuuauuauauguaaguacacuguagcugucuucagacacuccagaagagggcgucagaucucguuacggaugguugugagccaccaugugguugcugggauuugaacuucggaccuucggaagagcagucgggugcucuuacccacugagccaucucaccagcccccgauugcuauuuuuaauuccuaucauugcccuuaauuugaaauuacuaaaaaaggaacacuaaguaguaauaauucccaugucucugauguagcuuuaguggugacaucuuucuagcauuucauuugccuuuggguuucauuucaacaguuguuaaaacuuuaaagucuuaugcaugauagcuuuaguacuuuauacauuaugaaaguaauggccauugcugguuuauaauaagagaguauuucgauuucuccccuuucucuuucucuccuuuccuuccugucuguucaucugucugucugucugucugucuguuuuuuucaagauuguauauuucuauguagcccuggcuauucuggaacuuacucuauagaccaggcuggcuuugaacucuuccuuccuuucuuuuuuguuuuuucaagacaggguuucucuguguagcccuggcuguccuggaacucacucuguaaaccagguuggccuuaaacucagaaguccuccugucucugccucccaaguguugagauuaaagacaugcgccacuacugccuggcugauuuuauuuuucugaugaaauauugacaggcuggagagaugucucagggguuaagaacaguuauugcucuuguagaaaacauagguucaauuccuaauauccacaugacagcuaacaaccuucaguaauguuaauuucaagggaucugauuuccucuuaugacccccccuuuucugauuucuguacauacaugaugcauauaaauucaggaaauauauucauaccuaaaauaaaaaaaagaaauaucuacaguauaacauacccuuuuuacuccuacauguuugguauauauaaaaaccuuuauauacuauauaaagccauauaucuacagcuuuaaaggauauuccaauuuuaaaaugucauauugacaucauuuauuugaguauaacacaaagccuauaguaauuugcuauuauggauuaaaucagagauaaaaaguuuuuuguugguuugguuugguuuuuuuuuuuuuuuuuuuuuugagacaggauuucucuauguagccuuggacuagaacucaaucuauagaccaggcuggccuugaucucaaauauucuuuugccccuaucuucagaucaccacaacuaacagugugcaccaccaccacccagcuaaaacacguauuugaaacaaaucaagagcugugaaucacacuacuauucacuucauaauuuuauaaaaauaauaaauugggcuugguuuuguuuuuuuuuuugguuguuuggguuuuuuuuuugguuguuugguuguuuguuuuuucgagacaggguuucucuguauagcccuggcuauccuggaacucacuuuguagaccaggcuggccucgaacucagaaaucugucugccucugucucccaaguugcugggauuaaaggcgugugccaccacgcccggcuuuggacuuuuuguuuuuuguuuuuuuuguuuuuuuccgagacaagguuucucuguauagcccuggcuguccuggagcucacuuuguagaccaggcuggucucgaacucagaaauucgccugccucugccucccgagugcugggauuaaaggcaugcgccaccaugcccggcuuuggacuuguuuuuuuaauguugauguuuucagcaaauagcuguauauguaucuugauucuuucagcucuacagauuuucaaacaaucuaauaaauagugguaguucaguuaggguuuuuuguuuugauuuccuuuuuuaagauaacaucacccauuuuccaggccuaaaacucacuauguggccaggcaugaccuugaauuugugauccuuccuagugcagagaauagguuaccaagucaauuuauuuguugauggggguugaacccaauccagggcuacaugcaugccauuuaagcacucuagcaucugggcuucauccccagcccugguuauuuagucuugguuuuguuuuaaugcaauccuuagacuuucuuuuauauuuuagaauguuaucuucauauacauuuuuguggguuuuuuaauuuucauauacuuuuaauuaauaauuuuuuuuacuaugagaaauguauauguggacugagaguauaugugguagaguauucacccagugugugagagauagugcucacccagcguguaaacgguucuaguuuuuuguugguguguguguguauguauauuuagugauuacuuguggauguuaacuuuaauauaaaaaguaagacuuaucuuuaaaaauaccucuucugucugaagauuauaaagugaguuuggaagauauuuuguuucacauuauacuaauuuuauauuuuacuuuuuccuuuccuuuuuguuuuuuguuuguagacuagcaaagaagauaaguuaucaagucggauucagagcaugcuuggaaacuacgaugaaaugaaggauuacauaggagacagaucgauaccaaagcuuguugcaauucccaagccugcaguaccaacgaccacagacgagaaagcaaacccaaauuuuuuugagcagagacauggaggaucucaucagaguagcaaauggacuccuguaggccccgcccccagcaccucucagucucagaaacgcuccucugcccugcagaguggacacagcagccaacggaguggugcaggagggaguggcgccagcagcaguggccagaggcaugaccgugacuccuacagcaguagcaggaaaaaaggccagcacggcucagagcacuccaaaucucgauccucaagcccuggaaaaccccaggcuguuucuucauuaaguucuagucauuccaggucucaugggaaugaucaccauagcaaggaacaucagcgcuccaaaucaccucgggacccugaugccaacugggauucuccuucccgcggaccuuuuucaagugggcaacauucaagucagucuuucccaccuucuuugaugucaaaaucuaguucaauguuacagaaacccacugccuauguacggcccauggauggacaggagucuguggaaccaaagcuguccucugagcacuacagcagccagucucaugguaauagcaugacugagcugaagcccagcagcaaagcacaucucaccaagcugaaaauuccuucccgaccuuuggauguaagucucacacuuaguguucagcauugugucugaaaaaaaguaauucauagaaauuucagugaguugcaccugucuuuuugcuuuaauaguaagaaguauaaaaauuuuaaaagcuuaagaagaaaagguuuaaauaacaacuugggaauugaccaugaauccauauugcugugcacuuuccuucuuguauaauaaagaaaauauucaguuucuuuuuuuuuuuaagauuuauuuauuuauuuguuuauuuauuuaauguacacuguuauacucucuucagacacaccagaagaggucaucagaucccauuucagauggaugugagccaccaugugguugcugagaauugaacucaggaucucuggaagagcagucagugcucuuacccgcugagccaucuuuccagccccauucauaguuuuucaaguauuaaaaugaaaagucaaauuauaggcuaaaaguaagauuuaucaauagcucccguuuccuccuuuugguucuaugggauaguauagcuuguuuaaguaaaaacuuaaaaagaaaauuaccuuuguuauuauagcauuacagauaaaugcaguucauaguuuacggugacaaauguuggaacuuuugaaucuacagaaaugauaauacuuuguaguucuguuguugcuuucccuggcuuagcgcuaaaaagcugagacagccacuguaacuguguauaaaaguugacauucagaaugaccagagaacuaagcugaaauuguucuucuuuauuaacauauaccaaauugucagaauaacagguuucaguaaaacauugucauauaagcaagauuuauuuuauuuuauuauuuuauguguaugaaugucuccccugcauguauaucgauucaccuuuguguauccuaguguccauagaggacagaaaagggccucagauccucaggaguuauagauguuguaagcugccaugugacugcuuggagucaagccuggguccucuggaagaauaggcaguucucuuaaccacuaaggcauuuccccagcacuucaaaguuuaucuuuuaauguaguuuauacaauaaaaaaguugaaaagaccaaaggcauagcucagaggucagaauggcagaagaaggacucaaaguuauaaaaaauguuugcuaacauuuaggacucuugagucggcaagauagcuuagugcauaaguguaaauucggugccuggauuccuuaguggaaggagacaaccagcauuuaagaguuguucucugagccucugucccacauggcccacccuuacagauacacacauacaccacacacauauacaauaauaaaauuaaauaaaaggaauuuuggggcccgaagagauugcuuacugguuaaggacauuuucuacucuuacagaggacaaguguuacuuuccagccauagagaaguaguaauuuguucuuucuucaaacauaugaauuuuugggacuaaauuugaguuuaguuuuuugauuuuuauuuaugccuuaaaauuaucagucugagcugggugugguggcacacgccuuuaaucccagcacuugggaggcagaggcagguggauuucugaguuugaggccagccuggucuacaaaguaaguuccaggacagccagggcuacagaaaaacccugucucagaaaaccaaaaaaaaaguuaucagucugccuucuacaguuuaugagaugcuagguaaguauuguagcccauaucacuaaucuuucaaaaguuaauuuuacuaaguuugugaggaacuaugucucuuaugucauauuuuguauaugaauaacuuuagaaaauuuaaggaagucugauuaccuaaaacaaaauuacauugaaaaaaaauuguaggaguuggagagaugguucaagggccaagaccaguggcuguuguuguagaggaucugacuucacuucucagcaccacugguggcucacagcugucucuaacucuaucuaguuucaggggaucauacucccucuucuggaccacaggcaccagguacacauacagugcacagaccuacacacauacaaagcacucuacacauaaaauaaaagugaauaaaccuagggccuagacagaggcucagugguucagagcacucgcugcccuucuagagggagagggcccaucuucuauuccuagcauaagcacagugguucacagcugccuacaacuccaguucuggggaauucgguacccuccucuggccucuucaggacuaggcacacacacacacacacacagacacacagacacacacacacacacacacaaauucagccaaaacuguuacauacauaaaauaaaauaaaaauuuuaaaaaguuuuauauaggaaagcuauuucaaaaauucuaacuaguguucugacuuaaaauaaugagaucauaauaguuccuuaaauuuuauguaauuucuaauacugcuuuuaauacguuuaguaaauacuaaaaaucuaaugacaaauuauuucaaaucuaaugucuguuucuuuuucucugcuuaaggcaucgguuucuggugauguaagcuguguagaugaaauacuuaaaguaaguuucuuuuuaauuauuuugauaauguuuaauaaugauaauaauuuaauuaugaugccuauauuaccaacucuguuucauguuccuaauuccuuuguaacacagauugcuuauauguguaacuugauuaugucauguccaucauaauaacugacucuucugagguucuagucacaugauuuguugacuguguguaaauaaauaaauccuaguuuuacucuugaaaagaggaagaaacaaauuacaacuacauuucuuuagacugaucaucuaguaauuuaaaggccaaaaaaaaaaaaaaaucucaguaguuaccaagucauuggugacagcauuugguuuguaacugaccugugcauucuggucagaugcuacaguaaagcauccucugagugucgcucuggaguuguuacuagacaugcucaaaaaauuuaugauaaccaaaaaaguaaauuccgcugcuggaaagacggaaagaaaaguuagggagugacugacugcuuuuuugcuccuaagagaaaaacauccacauaacuuguacugcuucuuagaagcugcugaauuauugucuguacuuggguuuuauggcauuuccccccagacugccugucuuggccuguuuccuaugaucuguucucaccauugaaucucccacgucuuucuuuagcugcuauaaucucccuuuaccauuuugcucaaccuguuuuucucauguccuccuuuuguccucugccugggguauaaugcauauaagaagucauguucuuauuuucuuucuugucucugcuguuugaguuuuuccuuugggaaacuguuccuuccuugucacugugcuucauuguuugguuuccugucugccuuucccacuuccuuugguaugacugugguuucuuuuucuauuuacacucuucuuccuuccccuugucuaucauccuuagcuuuaucggaugacuugcuauucaguccuucucuccuccuuggucuccuaaagacuuugguuuaugugucuuaggucuuuccuuuuaguaugcuuguccauaccuuuaaauguaggauccucacuaucucuaaugucuuccacauauucugucuguuaaaguaggcuuagacuuuaaauuucuuugaaaaccuuuuuuuuucccccauuucuuccaacugaaacuucaguaguuuuaaaaauccucacuugggccaguaagauggcucaucaagaaaagguauuuuuccacaccagccugauaaucugcauucaacccuccagaguccacagugggaaaauggcccacucuuaccuccacauggcauucucugacaucaaguguaugccauagcuacaugcccacacacauaguuuucuuguuuuuuuguuuuguuuuguaguacuugaagacaagguuucuguguagcccuggcuguccuggaacuugcucuguagaucaggcuggccuugaacucacagagacccaccugccucugccuccugcaugcugggauuaaaggugugugccaccacugcccagcucacaaaguaguaguaggacuaguacuaguacuaauaauaacaaacauuacaacaaucuuaauuauuuuuguuucuaccuuuaaaaucucccaacugucuuuuuauauugccucaagucuucccucagucccuggccuucauagcuugacuuuuuugcuagagguuaucaguggcucaucucucuccugagauugagcuggcuaagaccacuauucagagggagaauguaaugucucagacaucauagccaguccucaguucuccuuuugcugacugaccacuuugccaaacuaguuuuccuaagccauaccuuuucuuuuuaaaaaauagucuuucuuauagugggugcuggcuuugaacuucuguccucuugccucaccuugcacugguaguagaggcuugcaauuucaccguagauuuuaucacuuccuuaaaguaaaauuccuuggaacacugcacuacucuccuuucucuguauaauaguaccuacuuaguugucuucuaucaaaucccagggaaauuuuacuucuuccugugucaggcuaccauuuucuccuuuaacucccuucucccccucaaacuuauuuauuuaauugaugucuugccugcauauauguuugugcacuguguguguguguugcccaaauaggucagaaggagcugucaggucuacugcaguuggaguuacaguuguuaguugccacauaagugcugagaauuuuaccuagguacuuuggaagaacagccagugcacuuaaccucugagccaucucuucagucccaagcauucacuuuuuuaagagacacacacauacacacacacacacacacacacacacacacacacacagucuugugcauaagaaaugcuaauguguauguguuuuguuauuuuuguuuguuuguuuguuuggcuaguuguuagggugguguguguguguguguguguguguguguguguguguguguauucuaagggaacauacaugauucccccugaagguuuaguaguauaugguaccuggaagacuuucuucaucucuuuguucuuaauaaauauuuagccuacauuuuuauguaugaccuugacacauggccuugagaguuuuagugcccaaccaacuugacuguugaaacaauuagcaguugcacauauuuugauauuugauuugugaaaugccaauacuagaaaccuguggugcagaagguuccauguuccuuucauagguuuuguuuccauucaauuugcaaucacacuguuucuagcaacucuguuaagaacauaaggaagaaaucuaucuaaaaagaauauguguuuauugaaaaaauucccuuguuaguuauucaucuauuaugugucaaguauuagcaguguggcagugauauuaguuguacuauuuuuuuaauuuuuuuuuuuuuuuuuuuuaaagauuuauuuauuuauauguaaguacacuguagcugucuucagacacaccagaagagggcgucagaucuuguuagggaugguugugagccaccaugugguugcugggauuugaacucuggaccuucagaagagcagucgggugcucuuacccacugagccaucucaccagcccccuuaguuguacuauuuaagcugaccuucuagaguuugguauaggaauuaauacaggaauuuuaaaagaauagagagcaauuauaugcaaguggcuugugcuuuauuguuguuauuguuguuguugguuuuugguuuucugccuuuuuauuauuucuuuguauauuuuguauaauguuuuuugaucaugcucacuucugaacucccccuuuccuacccacucagcuuuaguuaggucuuguuucuuuuucccagcaaguccaguuugugcugcucauacacucuuagauauguggccaaccacugggauuuggcugaccuaccaagggccacacccuuaaaggaaacugacccucucccagcaacuagcucuguuaucaguggcuccucagcaugggauggggcuuugggccucccuccuucucugcccauguaaaaggcugcuuauaagaggugguaguagacauuguuucuucccccuucugucauucuguugcucaaagguagccacuguugcacaucuuuucagacgcuugacuuuucauauauaaauauuuacuagguuguagauugugauuuguguuugacacuaauaugcuauggauaucauuucauaucauaguugaauuucucauuuuaaugucugucugguguuccauuuuauguaugccugcuaauuuguuuaaucaauacuguauuguuggauaucaaaguuuuuaacauuuuuuuuuaaaccuaugaguccuuggaaucucuuaauguaucuuuauauaaaugugguuauaccacaguauaaauuucuaaguaucacaagucaccuuuuauuuaccuaauugacuaaguuugaagaaaaugauggaaauaaaauacacccuuauucuaauugauaccucugauauccacuuugauccucugauauacacauuguuaucuaaacuuauuugagccuuuuuccuccucuuagacugggugccauuagugcaggcugucuugaauucuuccucuuaagaauuaagauuagaggcacaugccaccaugcucagcuguuuauaacaugauuaaauggguagaaggcauugaauaacacuagacccaaggucuuucuuaccugguuucuuccuaauauacuuuugaaaucucuauuuuaugucuucacaugaccaaaauuuuugaucagcaugugaacucugaggucagacuuccuauaaggaaauucucuauccauuauuuacuaagcuacuucaagauuugaagaaaugauugacaaacaaaacauuuaucauaguuucugaucuaguaauaguaaagauuaauguuagcugcuuuucuuauugucaucaucuuccauuccacaguaagauuuguuuugaguagcauuacauaauccggguuuguuaggcaugguggcucaugccucugaucuaguacugaggaggcagggcaagaggaucagcacaaacucaaggcuucuuugguguacauagcaagcugagggagaauaagacuacagaauaagacccuguuucaaaaaacaaacaaaccucucagaccuuguauuucauuacaggcugauuucuacaacuguccacagauuuuuaucauucuacccauagaccccuuaaagucagagaggauuuguuauuuccugucccauugccagccguaccacuuguguacauuugugcuuuauuaauauccacuggcucaguaugcauaguuuuggaaaauugaucauaaaaccaguauuuguaaguaaaaucugguuuuuagcauauagauuuguaaccuuguccugguugaaaacaaacuguaauaauuacauuucaggagaugacgcauucauggccucccccucuaacggcuauucauacaccaugcaaaacagaaccuuccaaauucccuuuuccaacuaagguaaguaaauaagaugugucuuugauguaaaaaaaacucuaaaugacuuaacuacaauuacaugaguucaaaauugucuugccauucccugcugggaaacacgauaaacaaacaaauaaaggaguaauuuuaaguaguaaugauuucuaugaagauauuuuaaaauaauuauagaauugagagcaucuuugacugagaguuacuuaagaaaaauuggaagacacuauggggagaaaguuagaaaaaaggcauuguuguuauuacaaauucauaguauucuagacugaagguggcucagguuguuuucugaggagccucagaaccuagccacaaacauaguuccaucuuaugagaaagagccgucacacaaccauuuucagcccaucuaaacuuugcugauuaauuuuuuaaaacaugaauuuaauauguaaacaauauaaaaaaauacaauauaaaacgcuggguuuggaaacucacacuugugaucccuagaacaauggaagcaaagacaugagaaucaggaguuuaaagccaaccuggcuacauuuucagaauucaaaaucccccuuccccaaaacaaccaggcaaaaauacauucuuauguaaaaguuuguucaggacucuuaauaccaacucuucccauucuuguuuucgaggucauccaaugucaugugucuuugaaaaccuuuucauaccauuugcaugcauguaugugcucacuccauaucaauauguuauuccuauucagauaaacuguucuguagcaguggucugugagcagugcucuuggagcccuugccaugguguuuccuuagaaggauuuaauaccuuuugaauucaucuaaaguauaaaugaucugacuuuacuuagccauuucucuuuaguguguaaguuaccaucaauuuucaguacuauaaacauuuuuuagugugugugugcgugugagugagacgugugguacgugcuaugaacugguuucuuccaccaucuggugucagggauggaacuuagaucgucaggcuuggccacaagcaccuuuuccauugagccaucucacaagcccucuuuuuuuuuuuuuuuuuuuuucaaaaaaaggggcaaaaacuaguuuugagcauguguauauguguguaugagaagggugcacauccugugcuuuuggguguggaaacuggggucuacaucagugucuuucucuauuguccuucucccacccccaaccccccucccauugaguuucucuguguaggcucagcucuccuggaacuugcucuguagaccugacuggucuuaaauucagauauaacugccucugccucccaagugcuggggugugugccaccacugcccagcuguuguuuacuuuuugacacagaauuucauguaguccagacugucuaugaacucuguauagcuuaugaugaucuugaacucuuuuuuuaaauguauguuuguguguauauacauuuauggguagauacacacacccauucauguguguagagaguagagagagacagcuaaugucuucuuccucuauggcuuucugaauuacucccggauguaggcuuucucugaaucucaaacucacucuuuuucugagaggcuaguaggcagcaagccucagugaucuguugucaucacagccauccuccuguguguguguguguguguguguguguguguguguguguguguguguauguguguguguguguguguguuugugugugugugugugugugugugugcacgcgugcacucgcgcacaauggagacagaacucaggcccaugaaaacaagcugucuuuucuguucuugaguauaucaguaaguuuuuuuuuucuccuaggaagcuuuuaaugaaaaugccaaaauuucuuuauuuaguuguugaugauuauguaaguuauuuccacuuuuaggcuguuaaauaucuauaaauauuauuguauauauuguagacuuauuuuuuuuuucucccggguaaaugcuagugauggugaaaagaauugcugaauugugugguaaauauauauuacacuuggaagauacuaagcacuguucuuuagaguaauuguaacacucuugcuuuaccccuuccuaccacucaacagugugugguagucaguccacuuguucugucugugccuccagcuuagaauuguugaucuauuuguuuuuacucauuuuagcagguguauuagagguauguuauucuuaucuuaauuuauacuuccuuuaagacuggucauauugaacuaucuuuuuucuuguguuuauugggcauuccucuauggguuacauaauuccauauguuuggagucagaaguguuucagacuuuaaauuuuaaaggugcuuuaaaaauuuugaaagacuuccauauaggauaugggcuucuugaacugaaguaugaacauaacauugauuaauguuuuguauagaccuuauacauauaucuugaagguaauuuugugcaucuuuauuuuauuggcauuuugacuguauccaucacauaagguuagguaacuguauaugucauauaaggucaguuaacuauaaacaucauauaagguuagauaacucuauccaucauauauagguauguaauuuuucuuaaguugcuuuggucagagauuuugacacagaaaaaaaaaaucaccaaugccagguuguggcagcacaugacuuuaauuucagcacuugggauacagagacagguagauuccugugaguuucaggccagccuagucucuagacugaguuccaggacagucagggagagcuacacagagaaauccugucuagaaaaacauaaaaacaaaacagaaaaaaaaaaaaagucaccaaugugauuaauaacaugagacuaugaaaacaaggacugaggccagugaaauggcuuauuagguuaagguguuugcuaccaaguuugauaaccugaguuugauuccugggaccuauaugguggaagaagaaaacugacucccaaagguuguccuuuuuuuagcccugccugucguggaucuuacuauguaaucuggcuuugaacucagagaucugcuugcuucugccucccaagcacugggauuaaaagugugcgccaccacugccuggcucacaaaucauccuuuuuuuuuuuuuaagauuuauuuauuauuuauuuguaaguacacuguagcugucuucagacaccaguagagggugcuuggcuguuuuguuuguuuaaauagggccucacuacagagcccaggcugaccuggaccacaauguccuccugcuucugcuaccucugggauucaaguauuaccaugccucccuccccacccccuguuauagaacucuuaacuuauagauguuuuggcuugaauaaucuauauguauguuauucuuuucuuguacuugacauuuauugagcuuggaauuugauuuauaguuucuaccaaguuaguaaaaccuuugcaguuauuugcagcgcucauauucuuuucuguuuucuuccuucuuccugcuucaaggacugguauuacauaaugcagucuuuucuuuuguugccccauuuuauauuguuuuauugcuauacuguaagguucugcaguaucuuauaugcucuuggucucaguuaauguaauaugaucucagauaugguucacacuucuaaauuucuguuuuuauuuguuuaacauagucaaguucuauuccaagcauuaaauuugacagccauucuuguugaugacaaccuuuuucaaaaaguuuuuaguuuguuugcuugcguuuuagacagggucuucuuacuauguaagaaauacaccugcaucugcgucccaagugcuaggauuagagaugauaccacaccuauccauaaaccuuuuuaauagagagcuauagcaaaaugauuacagagcuacugggagaugguggauauauaaaagaugauugcuuuuugaagcacauuucuauaaauaauacuagacaaauaugguagaagcgacauguuacauagagagugauuuuacaagauaaaauauugucauauuuauaugaugagcaugauguguuaaaaaagagaaaucaacugauacauggaaaggagauggcaaccuuggaaaguuuuacauuuuuuuuuuuuuuuuaagauuuauuuauuauauguaaguacacuguagcugucuucagacacuccagaagagggcaucagaucuuguuacagaugguugugagccaccaugugguugcugggauuugaacuccggaccuucggaagagcagucgggugcucuuacccacugagccaucucaccagcccaaguuuuacauuuuuaaaaaauaagauuuggucagaauuagacaguagccuuugaaucugagcacaacuagcauccuuugucacaugaaagaggcaggauacuugagugcaguugggauaaaauguuagguuuucucguuuuagucuagaggccauagaaacuugcuuuuuggcaauagccucugggcaguuuucugggugcuguaggcaaaacacuggcuuagaugguuuagauacuguuucucucuauaacuaaaagagauauuuaaauacaaaggaaaggguuggagagaugacucguuuaagagcacuggcuuauuaucccagaggacuagauaacagcuuccuauaauaauuccagaucugggggaucuuacauccuuuucuggccuccauggcuccuaggcauucaaauggucuauaaauauacaugcaggcaaaacacuuauaaacauaaaaguauuaacuuucuuuccugguugcuuuuggucaauguuuuaucauggcaacugucuuaguuaggguuuuacugcugugaacagacacuaugaccaaggcaacucuuauaaaggacaaaauuuaauugggauuggcuuacagguuuagagguucaguccauuaucaucaaggugggcgcauggcagcgucugggcaggcauggugcaggaggagcugagaguucuacaucuuaaucuaaaggcugacugacuuccaggcaacuaggaugaggguauuaaagcccauacccacagugacacaccuauuccaaaaaggccacaccuccuaauagugccacucccuggcuccuauaaauuugcucaaacacaugagucuaugggggccauaccuaucgauagcauaauaaaaguauauuuaguuuaacugcaaaaguccccauagucuauagcagucucaacaguguuauaagucuaaaauucaaagucucuucugagauugauccuaucacuuaacugcaaucccccaaagcaagacaggauaucagcugggcaaacuuccaacucugcaucuucauguucugaugucaaagugguuuucacaucuccacuccuuuuucaucuuugaugacuguaauaaaguucuuucuucuggucuaguuccacucccugcuagcagccuuccuaggcaaguaucccaugguucuggcacuuuuaacaucuuugagucuccaaggcaacuucaacuucagcuuccuguuccaauauauggacucuacacaugaucuucugggcuccucaaaagggcuugggucgcaucuccagcucugcccucuguaguauucuaggcucugguugacuccacuccauugcugcugcuguucuuggugaccauccuaugguaugggcaucuuguauacucugggguuuuccaccacaacuaggcuucaccaaucgucucuacuaggcucucuuauggugccaagccucaacuucuuuacaugaccccugcaauccugggucgucaacuacaacugaggcugcaccuucaccaauggccuuccauggccucucauauugcuacuccuuaacuguucuuucugacucuucaugccuuuaaaaccaguaccaccugggugauucuuacacauuaccaaguacagcugcagcaugagguacaaccuuggcuaucucuggaacauacauucuuuguguucucagaaaacacuucccagauuucacaucagugauauuggucucuucugcuaauuucuuagcuccagcuaacuagcaucaauugucccaguagucucuuccacuugacuauaaaaccagagccaaaugcauuaagcugcugaguucugcugcuucauaggguugcaacaugcccccuuuguucuauuauauuaucaucagcuuucuguuuuugaugaauuuauucucugccuaagcuuaguuaucuuggaacuugcucuguagacuaacuuugaacuuagagaucuacaugucuaucuccuaaacucuggucuaccaugccuggauuuagguuuuucucuacuuggaacuugguuuguaccaggcuccccaugaacuuagaaaucugcuugccuuugccuccugagauuaaaggcuuguacuacuaugccaggaccugaauuuagcugggugggaucuugucccaagaucaccauucccuuaauucaauuuaauauccuuaaacacaggauuuagcuucauuucauuuccuggugccccuuuaauacucaaaagauacaguuuauauuuuuccuuucuaagcuugcuaugcuuguucaaaacacucuucacaaaacucaaccagagaaaaaaaucucugcugagcuuuuuugagacuuccuuugucaaugcaauuaauauaaaucucuuuaccuuagcuucauguagaucuucagacaagggaaaaaagcagccacauucuucauaaaagugccacaaaaagagucucgaggccacauacugaaauucuucuucacgaaaaccucuugggccaagucuaaaucauucuuagcaacaaagucuuccauauuccuacuaggauagcccauuaaguucaauuuaaagcauuccacugcuguccaaauccaaaguccuacaaucuuuuuuuuuuuuuuuuuuuuuuuuugguuuuucaagacaggguuucucuguguagcccuggcuguccuggaacucacuuuguagaccaggcuggccucgaacucagaaauccgccugccucugccucccgagugcuggaauuaaaggcgugcgccaccacgcccggcaaguccuacaaucuuuauucuuccaaauaaaagcauggucaggccuaucacagcagcaccccacuucugguaugaucuucugucugaguuaggguuuuccugcugugaauagccaccaugaccaagacaagaauucuaugcuaaaugcaaagucauuaagauuugacacuauuuucuuuagccuuuacacuaacuuuauucuuuuggcugugucucuuugguuaucuugacacaauuuguugaaaagguuauuucuucauugaaugauccuggcauccuuuuugaaaauuaguugacuucuuuuuaacagcaaauauauauuuaguuuucuuauuauuuugguugcucuuucccagaaaauucugucauuaaaaagaagaauuuguuugcuuuuuguuuuguuuuguuuuguuuuguuuuuugaaacagaguuucucuguguagcccuggcuguccuggaacucacucuguagaucaggcuggccuugaacucagaaaucugccugccucugccuuccaagugcugggauuaaaggcaugcgccaucacugccuggcugaaagaauauauuuaaguaggcuuuuuaaauggaucugucuauaaguuuggcauuauaucuuacagcguacauuuuguauaugaaguuauguuucuguuuuacuaaagcuucucuaguaccagguucuguacuaucauagggcuuuuuuuuuuuuuuuuuuuaaguaugcacucuccgggcggugguggcguacaccuuuaaucccagcauuugggaggcagaggcaggcugauuucugaguucgaggccagccuggucuacaaaaugaguuccagggcagccagggcuacacagagaaacccugucucaaaaaaccaaaaaaaaaaaaaaaaaaagcaggauaaucucugaauuugaggguauccuggucuauauagaguuucagaccaccccaaacuucauauugagacccuaucugaaaagcaaauaaauaauaaaaagaaguauguaaguucuuuacaaugcuauuggauuauaggaaaccagggacagaaaguaggaagggauaggaagggaauagagaggcauggcaugggacacccaugugggagcuguguuuucuuuguagagauguaguauauuuuuaauguauuauagaugacacaguuauguuauuuaggguuuuuuguuuuguuuuguuuuguuuuuugagacaggcuaguagguagcacaggcuauccuugaauucacaauguggcucagaguaaacuucaguuccaaguuuuucagccuccaccuaccaaguacuggcauuauaguuauaaaccacaacauuuagauuauagggcuuuggguauugaacccaggguucaugcaugcuagacaaguacuguaucaacugaguuaaauucucuagcucucucuuuuuuuuuuuuaaauuaagucuuuaaucugggauugaacccaggaccuugaguauaguaagcaaaugcugucuccuacuuauucacauuuguaguccaagcacuuucucaagaacaagaauuaaagauauaguuuuguaaguaugugugugugcguggucuaugccagaagacucagguacccaagagggcuaugagaggaugucuuaucuuuugaagcugaaauuacaguggguugugaccuguccaacauggaugccacccaaguacugaacucaauccuaaagaagaggagcuuaacacuggaacaucuuucuacccccaagaccaaaaaaucuucaaauuauaugaacuugcuagaucucuguauuagauuaugaguaucauggaugcugcugaaaagaaauggagacuuuuggguggccuuguacuauuuccgaagcucugauagucuauguagaugggaucaucacauuccuccaguauuuucucuuucguauauguugaagcauuuuuaucacuuggagcuuuccucaggaauagaucuuucucuuauaccaucacuuuguauaacuucauguuccuuucucuuaggagucgcaacagucuaacuuuggcccuggagaacaaaguaaguauuucuuuucuuguugauuuucuuuuuuuuuuuuuuuuuuuuuuuaaagauuuauuuauuuauuauauguaaguacacuguagcugucuucagacacuccagaagagggagucagaucuuguuacggaugguugugagccaccaugugguugcugggauuugaacuccugaccuucggaggagcagucgggugcucuuacccacugagccaucucaccagcccucuuguugauuuucaaaucaaccuauuuaucggguauuuuauucauauagccauaccuuauagugcuuccuaauaauuuuuauauguguuuuacccugauuuuaugaucugguaaauaacaaacaaucugagcucaguccuuuuuuuuuuuuuuuuuaaauacugauugauugauugugaauacacuguugcugucuucagauacaccagaagagggcaucaaaucccauuauagaugguugugagucaccaugugguugcugggaauugaacucaggaccucuggaagaacagucagugcucuuaaccucugagccaucucuccagcccuuaagcucagucuuaagaaaacuuaaaaacugucauuaaaaaugaaaauaagugcuugcuucggcagcacauauacuacaauuggaaagauacagagaagauuagcauggccccugcgcaagaaugacacacaaauucaugaagcguuccauauuaaaaaaaaaaaagaaaauaagcugggcauaguagugcuuaccuuuaaucccuccuuguacuuaggagccagaggcaggcaauuaucuccaggcuagccagggcuguguagaaagacccugucucaagaacaaaauaaauuuauuuauuugaacuaacagaauuucauaaaaucaauuugguggguaccaaaugaaguaagaaccauucuucugccuucccacuuuguuuaugguauugguuuuguggugauaaaacuguagguaggaauggucguguuagcuaggguuucuauguauuccuuacuuuguuuguuuguuuguuuguuuguuuguuuguuuuugagacaggguuucucuguauagcucuggcuguccuggaacucacuuuguagaccaggcugaccucgaacucagaaauccgccugccucugccucccgagugcugggauuaaaggcaugcaccaccacuguccggcucuuacuuauucuuccugagucuucuguucuggauaaagagaaagccugggguucucugcagccuccuuguuaccuccacucuucacuucucagucucuuggggaagauggcuguagagaauaugugcacuaagaaguguagguuaacacuggugaggucagccauugcagaugucugaguguuaaccggcguguguguguucuuaaugcaagagacgaaacaagaauuuaucuauguuuacuuauuuaccauguuuauaggaggcauaggaaagcuauaguacgcauguggaggucacaagacaacuuacagcagucaaaccuuacaucuguauggcuauuuaguucuaccuuauagcuguagcuacagauaaauaaaaggaacaugacagugagguuugguugguuuuuguuuuugagauuggauuucucuguguagcccugacuguccuggaacuuaugcuauagaccaggcuggucuugaacucagagagaucugccugccccugcuuccuucaugcugagauuaaaggcauucaccacuacuaccugguucugacagugguuuuugaagcaggcucucaauauguagcccaaacuggcuugguacucagagauccuccugucucugucucuguccucuagaguuauaggagugcaucaccacacccaguuuugagaugcuuacaugccccaaaauagcuggcuagaaacccuaaucuuuucauuuucucucaagauugccuccuccuuacuuuguccccacccucauuuacuuccccaguguuuaauuauggcaaaugggaucauacauuucuucucauuuguuaaaacuugguacuuuucacuggaucuacucuaaguguuuaucaauauguaauucuaguuuacucuuuguuuguuuuuuguuuuuuuguuuuucgagacaggguuucucuguauagcccuggcugucguggaacucacucuguagaccaggcuggccucgaacucagaaauccaccugccucugccucccaagugcuaggauuaaaggcauaugucaccacugccuggcucacucuuuuauaauauuaaaccauguuacaugaaauaauuacaguuaauuagucuuuuacuaguggacauauauuuuauuuccuagcuuuuguuguuaaagcugugcauuuuuuuuuuuuuuuuuuuuuuuugguuuuucgagacaggguuucucuguauagcucuggcuguccuggagcucacuuuguagaccaggcugguuucaaacucagaaauccgccugccucugccucccaagugcugggauuaaaggcgugugccaccacgcccggugacaaagcugugcaauuauaaugcuggauguggugacacauacuuguaacccugacucuggggcagccgagccagaaagauugcaaguucagggccaguucaaacucugcauugugaauuugggccagccuagacuguguaguaagacccugucuccagaaaauaugcauaaagucauauuauuauuaauaucaugucuauauguauuucuccaguaaucuggguagauuccuuucauugaacuagaucaauagcagcauaguuacaguauugauaggguaaugugagcauauugccuucuaaaauggcuguggaagaucauugcuugaggaugccugugucuuuuguccaucuugugcaauguauuauauauauuugaagauugacauuuuguauagauauuuuauaauguaaauaaacaacucaguugcccacuucuauauuuuuuuuguuucagaaagauacaguacugcuaaaacaucaaauggacaccagucaaaaucguaaguuuauugcuuaauggaugucuucuuuuccuaggagguaucuguaauagcuggauauuuaugcuagaaauauuacucuuuuguuuuuuaauauuuaaauuaccaugaauuuuguauguguguguguguggagcgguauguggaagucauaggacaacuugugggagucaguucagguugguggguauaguggcaagaccccuuacccucugagccaucucuuuggacucugguuucauugugaaaccagaggccuugugcaugcugaacucauauuucacuguugagcuacauacauuuccaugcagaaacacuaauguuucaagauagacauaagcuaacuuugccuauaaagagcuagagauuauagauuuuaaagaccauauagccucuguccuaaauacucacuucuaucauauaauauaaaagcuguauagacuaaaaacacuaauuuuauuguuuuuuucuuuugaaacugugacugagucucauguagucugggcuguccucaaacucaccacuuguagucaaagaugaguugagcuugauccucuugcuucugccucccaaguguucagauuauauauaggcaccuguuguuauuccucaguuuucucuccuuuuugauggugauagagauugaacacaggaucuuguacauguuaggcaaguaucauacuacugaacaauaucuccagucugcuaauauuuucuuuacaaaacagcaguagaauacuggcuauggaaauaaaugucuuuaauccuagcacucagaaggcugagucaggaggauuacuauuaguuuaaagccagccagagcuacauacaaagcaaguuggaccaaucugggcuauguauaguaauacucuuuuuccaaaacaacaagccucucaaaaaacaaaaggaaaagaaaaaacauuaguggccuagguucacccacccuuuugaguucacaguuuacauuuaauaaagaaaccguguuaaacauaguauucuucuuaguaauccuuccauuuaguuacugagugcuguacacuaaacaacauuguuuauacuaucuuuaagauuuccuauuuuuauuauauuuuguagguagaaucagaaacguuucauaguugggguaggcuguuagauguuaauaaauuacaucuggagagugagcacaugaccuccuaagaucacagguuaacacagugguuagagcaagugccaaaggaguagccacuguguggcuuccugugccauagccacagaccacagaguuaaccccagucuaauagccucuucauguaacaaaaggaggacugagaaagaaauacacuacuucugagaaacucauauauuccuuuuaucauaucugugugcaaaaacuaauaauacaugucuucuguauauaccaaguauaccauggacauaccacuucaguugcugaggaaacuagaacauaugcuggaccuggaacagugugguaaaggcuuugacauacucacauauguaaacagguucauugagccgccauuauuaaaucauaagggcugagagaauucagaguaaguacauuuuccuuacugaaaaucaguuaugccgggcgugguggcgcacgccuuuaaucccagcacucgggagccagagucaggcggauuucugaguuggaggccagccuggucuacaaagugaguuccagggcuacacagagaaacccuguuucgaaaaaaccaaaaagaaaaaaagaaaaaaagaaaaaaaaaagaaaaucaguuauagagauacacuuaagcccuuguacaaaaggaaacuuucuaaaauguucauuuacugaacugauuuuaaaacacuucucauauucuauagucaucugguugcuuuauuuccagguaauuuuuguguauguuuugaauugauagccagauuuagaaaugcagauuagucuuugaggggagagugcagguaguuacugcagugacagaagacuucuuccaaugcggggggggacucaaaacccuuucaaaagaaagguaaccgagcgccugcugacgagaacggaagcacugucuaguacagcucucccagacaucuuguuaaagaguuacucauguaaaaccacacuguuuuguguuacucugauuuuaaguuuacugauuuuagacuuagaaaaaacuucacucuuugacauuacuuugaaaacaaauugcagaaauugucagcuuacucuauuuauauacuuuaaauucaauuugaauuuuguuaaagggagacuuagaaguugaaguuugaaaauuuguacaugguccuuucuuaccccaaacucuccugcuggugucuacuuguauccuuagccaggcaauuauaaaccagaacuuugacucuggaaauuguguugugguuuucaaaguuauccaacagcuagaaguuacccaggucucucucuuuguggauuauuggaaacaaagaagaaauugcuugaugcuuugacuuuaucuugcuucucuuuaggagucuuaucuaguagaccaaagcucuauuaacauauauguguacaauuuuguaacaggaauguauaugaguuuaacuagaaaacaaaaucaaauguuuuacuuguggagccagcaguucuucuguuccuaacaugcccacugcuaucuuuacagaacacuaaauucuguuuucuuuaaaaguauuuuuuugggcuagagagauagcucaguuaagaacaucgacugcucuucuagagguccuaaguuaauucccagcaaccacaugguggcucacaaccaucuguaauggggucuggugcccucuucuggugugugucugaagagagcaauggugguguauucauaugcauauaacaaauaaaaauacuuuuuucaaaaaaaaauuuuuuuugcugggcgugguggugcacgccuuuaaucccagcacuugggaggcagaggcagguggguuucugaguucaaggccagccuggucuacagagugaguuccaggacagccagagcuacacagagaaacccugucucgaaaaaccaaaaaaaaaaaaaaaaaaauuuuuaggcuaggcagucauggcacaugccuuuuacacaugcacaugcauuuaggcggcagaggcaggcagaucuccaaguuugaggacagccugguauaaagaguuacagaauagccagggcuacacagagaaacccugucuaaauaaauaaauaaauaaauaaauaaauuuccucccgagacaggcuuuuccagggcuacacagagaaacccugucuuaauaaauaaauaaauaaauaaauaaauaaauaaauaaauaaauaaauaaauuuccucccgagacaggcuuuuccagggcuacacagagaaacccugucuuaauaaauaaauaaauaaauaaauaaauaaauaaauaaauaaauaaauuuccucccgagacaggcuuuuccuguguaaggcuuggcuguccuagaacuaguucuguucuguacacuaggcugaccuaaaaauuuuuuuuuaaugcauggaaaguuuaaggcuuacaaaaauggcugauuuccuuuaaaauguauugguauaaugugaacaauuccaaacuuaaagaguauguguauguguguuucaauuaaauuuuuggcuaacacaaugauuauuccuagaauuauugauacauauuuaguauucuggccuggugugacuaauuaaugcuacuuucuguauuuucccucuaguauguuaaaagaugacuuaaaacuaagcagcagugaagacagugauggggaacagguaugccaguccuucacguuacaguuccauugugucuuggucaguaccuuuucuuucuuuuuuuuuuuuuuuuuuggaggggagggugugugguuuuuuuccgagacaggguuccucucugugaagcccugacugucuuggaacucacucuguagaccaggcuggccuugaacucagaaacccgccugccucugucucccaagugcugggauuaaaggcaugcaccaccacugccuggaaccuuuucuguuuauaagcuuucugacacuggaugauuguuaccuucuguaaugucuuugagcugcugcuugcuguugcuguuucucuuaaauugauguuucacuaacacuuauugaggaucaaaauguauuuuugaagcaggaauuacuuacaagaaauauuuacgaaguuauuuauuuauuguaugugaauacauuguagcugucuucagacacaccagaagagggcaugggaucccaguacagaugguugugagccaccaugugguugugggaauugaacucaggaccucuggaagaauagucaguguucuuaacuacugaaccgacucuccagccccucccucccucccucccucccucccucccucccucccucccucccuuccucccucccucucucccuccuucccuuccuuccuuccuuccuuuuucuuuuuuucuuuuuuuuaaaaacaaacauuuuuuuuauaugcauggcccccuggaacuggaauuacagaugguugugagcacuauguggguauucucuguuagagcagccucugcucuuaacugauaagccauuuuuccuaccuuaauuuuuuuuuaaagaauuaucuuagaaauuauuuuuuuuccucuuguuaguagugguacugagcauugaacuaggcaaacucugcuucuuuaagugaaaacaggguccuggcuuguuauuguuugugguguuuugguuauugguuuuguuuuggggcaguuucacuaaggcccagguagccucagauucauaauccugcugccucugcuuucugagugcugugguauacuguacuguuuuuuuuuuguuuuuguuuuuguuuuuaaucacuguauuaaguaacuauuaauuuauaugcuaaaggaaccaaccuuuguuuuuuuuuuguuuuguuuuguuuuuuguuuuuuuuaguucagacauuuguauuauguaaauagaguauuauucauucauaauuucuuaugcuuuauuuuuaggauugugauaagacaaugccaaggaguacaccaggaagguggggaauccuuuuauuuugugguuuuguuguuguugguuugauggcugagguuagucugauuuaacauuguggugguaucauuagcagccuuauaaauaaugucaguugugauggugauuguaucauucuggaaauuaacaaaaauugauuauuuauucaaacugggugaauuuuaaaauaugcuaaaagugaguauuauuaucagaaugguacaccagagacuuuugggggauguguacuucauuuguaaggaaguuuuggguuucuuaucucacaucauuaauaaaguugguugucagauuugcguggggucuuguugccaucauaaaggaaacauuugccauuucuguuuuaucuccuucaguaacucugaaccuucacaccauaacagugagggagcagacaacuccagggaugacucgagcagccacaguggaucugagagcagcucugggucugacucggagagugagagcagcuccagugacagugaggcuaaugagccgucgcagagcgcaucuccugaggugagagggggcugcugccacucaagcucuccugacagccgcuucagccguggaugucaucaaagagacacgaaccacaugucuuauagaaaaccuagauuggguuuacuuauuauuugaaaaacucuuuuuuaaaauuaggauuugcccauugcauacacuagcaagauuuuauugaaaggacccagaaguagcugucucuugugagacuaugccggggccuagcaaacacagaaguggaugcucacagucagcuaauggauggaucacagggcucccaauggaggagcuagagaaaguagccaaggagcuaaagggaucugcaacccuauagguggaacaacauuaugaacuaaccaguaccccggagcucuugacucuagcugcauauguaucaaaagauggccuagucggccaucacuggaaagagaggcccauuggacuugcaaacuuuauaugccccaguacaggggaacgccagggccaaaaagggggaguggguggguaggggagugggggguggguggguaugggggacuuuugguauagcauuggaaauguaaaugagcuaaauaccuaauaaaaaauggaaaaaaaauuaggauuugccucuuauuagaagauuuauauuauauugucacugugacuaaagugagucuuccguuguguaauuguauuguagauugauacagugcaacugaaaaucucuccuaacaccuacaucauauguuuacuuucuagcuuuaaauaauuugcaguagugccuuucaaguugaacuccuaacuggaauuuuuuuuuuuuuuuuuuuuaaagacaggguuucuuuguguagcccuggcugucuuggaacucacucuguagaccaggcuggccucgaacucagaaauccgccugccucugccuccccagugcugggauuaaaggugugcgccaccacugcccggccuuaaaggccauuuguaauaagcucuucuuguugguucuaccuguauacuccagcacucaggaagccaagugacuagagcuaauaauauuuugucuguguuuugauccuggcauaaacaugacauaugcuugucaucuuaagcauuuuuuucuuuuuucucuugcuugacucuauaaagagggggaaagcuucacuauugagaaaacucuauaucuauauauuuuaucuguuuuucuuuucagccugaaccaccaccaacaaacaaguggcaacuugauaauugguugaauaaagugaacccacauaaaguauccccagcuuccucuguagacagcaacaucccaucuucucaagccuacaagaaagaaggccgggagcagggcacugccaguaacuacacagauccaggggggacaaaagaaacgagcucugccaccccaggacgagacucuaaaaccauccaaaagggaucagaaaguggccgugggaggcagaagucuccugcacagagcgacaguaccacucagaggagaacugucggcaaaaaacaacccaaaaaaccugagaagucagcugcugaagagccucguggaggccugaagauagaaagugagaccccuguggacauggcugccagcaugcccuccagcaggcacaaagcagccaccaagggcucgaggaaacccaacaucaaaaaggaaucaaaaucuucuccucgaccuacggcagagaagaagaaguacaagucagccaguaaaccgucccagaagucucgggagaucauagagacugacaccucguccucagacucggacggcagcgagagccugccucccuccucacagacuccuaaguacccugaaagcaacaggacuccugucaaacccuccucaguggaggaagaagauagcuuuuuucggcaacgaauguucucuccuauggaagagaaggagcuccuuuccccacucagugagccugaugacagguauccacucauugugaagauugaccucaaucuucugacucgaauacccgggaagccuuacaaagaaacagagccacccaagggggaaaagaaaaauguuccagagaaacacucgagagaggugcagaagcaagccucagaaaaggcuuccaacaaaggcaagaggaaacacaaggucuguaacaggcugguggcuuucuuacuuuuauagaaauauuuuuuucuaccuuccauauccuuaagcaucuuaauauuaaaauauuagcuauuuuuaaaauaauuuuauuuauaugucuaugaguauauguucuguaugucugucugucucucugccuguugucuguuuaccugucugugucuguguguaucugugucuguguaugcacucaggcuuuuguaugcuccuauggaggccaggggaggauaucaaauucccuggagccaguuccagccaguugugagcugucugacauuguuacuaguacuuaacuuugguccugcuugaagaauagcaaguguccuuaacuacagagccaucuuauccccaaauacuugcuauuuugacuuuacauagucacuguugauuuugaauuauauuuuauugauuugugugugugugcacauguguacacuauagugcauaacuggaaaccagagaacaacuugggggaguugaucuuuccuucugccauguggaucccagggacugagcucaaguugccagucuuuacccacugagacuucuugccagccccuuuuguuguucauguuuagauaccagcaucugaaaugccauggaaauagaguuuuuggauuaugagcuguaagggaaaauagugacugagcacaaggccuuaaugagacuacauauggaacaguuucucuguguucugucuccuuaaauaaagcuggauaguuucuucuuaaauaggaucucugagcagaguguauaguggccagguuaaaaguagaguuugaaugucaaccauacaucuuuuuuugucuuagcuucaggucaagucauacuuuuuauuacuguccuaaugugagaccaacugacugacuaauuuugugacagauauauccauaagaauuucacucauccaauauuuaccuugugccuagcuuuuuuccauuaacacaggucagaacugagaaaaguuccccagggcuaaguguguagcuuaauaggagagcucuugcugagcaugugugaaacacugggugcaguuccaacauggaggaaaaguuuguggguucauagccugcucucaucuuaaauaguuccaagauaaagacacagcuugguauaagaucagcuuuauacagagcuggcauauguguauauaagaucagcuuuaaacagggucugcauauaugugugugcaccaucuugugccaagagaucaaaaaaauguauuggaugcccuggaauuugaguuacagaugguugugagcuaccaugugggugcuuagaacuccuagauguucucucuacaagagcagccaguggcuuuuaaucauuaauauaucuuuccagcccuccccuagaauuauaauuuugguaaaguaucaggggcaauuccuggacuuagucacugguaagauuaggagucuguaggugacuuuuucucauguuuucauuuaucugauuuuaaucaucauuuaauggcaaauggacucuucuguuacauuagaaguagaauauguuuguauucuuauugcuuauuacuugaagcaauaggaaaacuuagcuucaccuauggaaguaacaucaacaguagauagguuugccacuuguaauucagcuaagaaguuuuucagagauaaugaggcuuaccuguuagcaaguagcaguuuguucaagugcugaugaaacuacagagguggaacuucuaugcagugcuagcagaacugugagaugcaguugcuuuggauuauaguuuggcaguuucucaaaaaagcugacuauacaguugccuuaggauccaccaauuauagucccagguauauauccaagaaagaaauagaaauacaugucuacacaaaacuauuacagugcucacggccacaucauuucacacuguggaucuaacguaggacacccuuguuaugcuuaagaccuucuguuucuguuuuuguccagaaugaugaugauacccgagccagugagagcaaaaaacccaaaacagaggacaagaacucaucaggccacaagccauccagcagcagagaguauguucccaagucauguugcauguccauauuggcuauguuuaucauuggcuguuugguacuuuucgauugcuucagaauauucuuuuuaguugauugaaugucauacaccuguaugcacagguagauaguaguaagagcugugcauuuagcuaauagagaugggaagcuauuacuuuuuguuuguuuguuugugagauaagaauaucuccuaguuaggguuauuauugcugugaugcagcaccaggaccaaaagcaacuuggggaggaaaggguuuauuugacuuauucuuccauaucacuucaacuguucaucauugaaggaagccaggauagggacucaaacaaggcaggaaccuggagguagaaguugaugcaaaggccacagaggagugcugccuauuggcuggcuccucauggcuugcucagacugauuucuuuauuuuuuuuucugucaaacuuuuuuuuauuagauauuuucaucauuuacauuucaaaugcuauccugaaaguucccuauacccuccccccugcccugcuccccuaccuaccuacucccacuuuuuggcucuggcauuccccuguacugggguauauaguuugcaagaccaagaggccucucuucccagugauggcugacuaggccaucuucugcuacauaugcagcuagagacacaagcucuggggcuacugauuaguuaauauuguuguuccaccuauaggguugcagaccccuucagcuccuugggugcuuucucuaguuucuccauuggggacccuguguuccaucuuauagaugacugugagcauccacuucuguauuugccaggcacugacauaaccucauacaagacagcuauaccaggguccuuucagcaaaaucuugcugacauaugcaauagugucuugucuggguuugguggcugacuaugggauggauccccuggugggguagucucuggauaguucauccuuucauauuagcuccaaacuuuggauaguucauccuuucauauuagcuccaaacuuccagacugauaucuuaauaaaacccagggccaccagcccagggauggaaccauccacaaugggcuagguccucuccaguaucaaccacuaacuaagaaaaugcucugcaggcuuuccugcagcccaaucuuaugggagcauuuuuucacuugagguucccaucucucaaaugauucuagucugugucaaguuguuauaaaacuagccagcacagaauaugagauaagaguuucuggguagcuuaucugcaacuugaaagagacuaguaacuuguaagcaacuuguaagcauuacucuuuucacaauuuaucuauuuauucaacugauucaaccaauuuuuuuuuuuuuuucgagacaggguuucucuguguagcccuggcuguccuggaacucacuuuguagaccaggcuggccuugaacucagaaauccaccugccucugccucccaagugcugggauuaaaggcaugcgccaccacugccuggcucaaccaauauuuuauuaagcauuuauuuuguggcagauuguucuaggcacugggcaugauuguggaaaagagaaagcagauaaauggggaaggcagagaaagcaacagaugccuacuugaugggauuuacagucuuuucuuuuguaaucagcauauggagaauaucuuugcaaauuuguccuuaaaguaggugaaagagauggaaaaauccuucacuccuguaucacucugugcagaaauaagagcaccugggauuuuuuuuuuucuuggcaggucaucuaagcagaguaguacaaaagaaaaggacuugcuaccuucaccugcugggcccauucuuucaaaagauucaaaaacagagcaugguucucggaagaggacugucagucagucgucguccuuaaaguccagugggaccagcagcaaagagaacaguggcagcagcagcaagagcagcuccuccuccacagcgaagcagaagaagacugaaggcaagggucccagcagcuccaaggaggccaagguaugugcuggggcuggagccuuggaaagucacccuugugucuucccgacagacacugcuguuuguaaacagcucacuaagauuguaggccugugcaguguuuaaacugaauauaugagggagagacugauuaaccuugucugucugucugucuguuugucugucugucugaaaggacaacuuucaggaguuaguucuuaccuuucaucuuguuggggcaggaucucccuacuguugcuguaccgugcacccuggguuagcugggcgguuuuccucuauaggagaccuggggcuggagagugugccaucacaucuggcuuuuuaaauuuuauuuauuuauuuauuuacuuacuuacuuacuuaauuuugagguagagucuuacaauguagcuuuggcuggccuggaacucacagagauccauuugucucugccucuugaguauuuggacuaaaagugugugcuauaaaacccagcuucaaauaauugcccuuaacauaguaaugauacaguugaauagucuugguguuuauagacugaaauuugggucuaagaauguuuuucaagggucuguuuuauuguuuguuuguuuguuuuuugagacagaguuucucuguguagucuuggcuggccuggaaccugcucuguagaucaguccagccuugaauucacagagauccaccucucucugucuccugagugcugggauuuaaggugugaaccaccacugccuggcaauuguuuuuuuguuuuuugcuuuuguuuuuuuguuuuuuuaagacaggaucucaagcugcgcagugguggcgcaugccuuuaaucccagcacucaggaggcagaggaaggcggauuucugaguucaaggccaaccuggucuacagagugaguuccaggacagccagggcuacacagagaaacccuaucucaaaaaaccaaaaaaaaaaaaaaaccaaaaaacccaaaaaaacccuccuuuugaguguugaaauuaagggcaugugccaccacacccagcaucuauuuuccugagugguacugugguacagcccuuuacuucucugugugugcgaggugugugugugugugugugugugcaugugugagugcacgcgugcaggcacuuaugaugcagcaccacccccacuuguauggccaugcguguaugcagaggcuaaggagggccuuugguauuguuuucuauugaacuuugucucguuuuuuuuaguuuuuaaauuuuuuguuuuguaugugugaguguuuugcauguguguaugugugauauguaccacuugugugccuggugccaggggucaaaaaaggguauuugaucccuugaacuagaguuacagguggucaugagacaugauaugggugcuugggaccaaacccagguacugugcaauagcaaccagugcucuuaauugcugagcccucuccagcuguuugucuuauugagauagagucuuucuuugaaccugaagcucacaauuucagcacugcugcucccugaguguuugauccucacaacccuaguguugucagaacaugcagccauguccagcucuuaugcagauacuggggauuugaacucagguucucuugcuucaaagcacgugugcuuacccacucagccaucuccccaaucaguacugucauuuugacacucaguucguaucuucaguucguaucuuccuuauguuuuaacaaguaccuacccuaagugccuugcacgcaauagacucuuaauaaguauaaaaauacauauuuugguuauauaaaaugaacccuuuugguucuuuuugguuauuuaaaaugaacucaaucuucuguugaguagaaguaguauaaaauccaaaacaaagaaauuugaagauuguggaauuuugcuucugcuuuagcaguggcugaagaagugcaauuagcuucauuuuuaaucuucugacaguuuucaacuuaguuauaucuauccuuuugaucaggagaaggcuccaaauagcuccucuaauuguccuccgucuacaccaacuucugagucuucgaagccucggagaacaaagcuugccuuugaugacagguaagauaaacuuuguggguuuuguuuuuuguuuuguuuuguuuuuuugagacaugauuuucuauguagucuugaguggccuggagccacuguguagaccaggcuggccucaaacucuuagagguugacuugcuuuagccucccagugucuggauuaaaggcaugugccaccauaccagcuuuaaagaguaaauacacuuccgugcauuuuagaaauucuagucaguguauaauaaacucacuuaaguaugucagauccuauaugauuaauacuuguaucugaccuacagaauauucagauuuuuaacaugaaaggcaucuuuaaucuugcuacucuuuuaacaaccagugacucuccagagugacaggaaagauguucuuccuagagcuaauccugcugugaguacuacugcugagaauaguggucucagagaagcaaugucacuuucucuuucuugccuucugucagaagguacuucuucuaucugcauaacauuuauucaugguuuuuaaaacaaaacaaaacaaaaaacuugauuaagcuaauguuuaacacuagggaacgugaucuguguacuugaguagaagauuugccauaguagcccauaauuuauguucuuaaucuauacacauuuguugggaaguugaaauguuuauuaauaauuuauuauuguuuuguuuuuuuguuuuuuguuuuuguuuguuuguuuguuuuucaagacaggauuucucuuuauagcucuggcuguccuggagcucacuuuguagaccaggcuugccucgaacucagaaauccaccugccucugccucccgagugcuggaauuaaaggcgugagccaccacuccuggcaauaauuuauuauuguuguaaaauauuuaaaacucauucaccuccugagaaugugaaaguuguaagauacuagacacuaaaacaacuuuguaauuuucuuaggaaauuuugaccauuuuuauuuauaaaaauaaaagcugggcuugguggcgcacgccuuuaaucccagcacucgggaggcagagguagguggauuucugaauucgaggccagccuggucuacaaagugaguuccaggauagccagggcaauacagagaaacccugucucaaaaaaaccaaaauaaauaaauaauaaauaaauaaauaaauaaauaaauaaauaaaauuuauuuaaaaaauuguuuuuugcagaaauuauucagcagaccauuauuuacaagaagcaaaaaaacucaaacacaaugcagaugcuuugguauguaaauauuccugaugugcuucauuaaacuuauauucagguuuugacauguguacccuucuguuguguguauuugcagugggucauuaaucagcacuguuuuccuuuagucugacagguuugagaaagccguguacuaccuugaugcuguagugucuuucauugagugugggaaugcauuagagaagaacgcucaggaauccaaguccccauucccuauguacucagacacgguggagcucauuaaguaaguggggacuaucuuuaucaguuauuacuguuacuuaguuauugacauacugauaugguaaacugagaagauacuuaguguuccauuuuucuuagggacgauuuuaguggguguuuuauuuaggguugauucugauauuuuuauaauauaaguucuaagaucaaggugaaauauucuguucuuuuuuuaucucaacucauagguacacuaugaaacuaaagaauuauuuggcaccagaugcuacagcugcagacaagagacucacaguacuuugguaaguguuuugucuucuagccuuugcuugggaaacaggcaguuucuugaugaauugugcugugugugcuuuuaugaguauuacccaugaaucagucuuccacaaccucuucacaaaccuuaacagucaaacaggaaauagcucaaaccccuacugaaagguuuuagcuccugucucuaauccagugcccucuugaugaaugugcuggaguaggaccaaugcuggaccccuccauugaauuaagugaccaguuuuuaaagcucuuuuuauacaugccccuugucuuaguuaggguuuccauugcugugaagagacaccaugaccaagacaacuuguauaaaggaagacauuuaguuggggcuggcuuacacuuauagagguacaguucauuaucaucauggcaggaagcaaaguggccuuugcugggguugugagcaggaauaacaauuguguggacugaacugugugagcugggugaauguugcuguauuccaucucacucaauguucaguuuccaacuuuuaguuuuuaacuuuuaaaagauauuugaauuauaguauguugguauagucuuaauuuugaaugucaguaauaaugggauauuaagaguuucuuagcuacuuuucuuucccuaugguguguucuauauuaagcugaccucuugguuuuguuugagagguaacauugacccugggccaugguugcucaaaugaagccagcccuauauuccuacacaauggaaagacugcuuguagauggcgccaugucuauauacacugcccuuuuccauugccuagccugagaugccagucauuauuguaccugaggcuguucaaacugaagaaggagaacgcucucaaguacuccaagacgcuaacugagcaccugaaggucaguauguauaacacaguccauugcuuaugagacaaaauguggaaaccuuucccucccugucccagagauacucucauauuuaggcacaacaugccaagagaggaacaaacuacugcuuagaaguucucagauguguuuguacuuucuugggaaagccuucaaguacggauauuggauuacauuuuuauagccguaaaugguagccauaucuguccuagaaaauagucuuuguauuuuucauaccaccugucuucaaacuguuaccuuguuuuguuuugucccuuacacuacuagugauggaacucagggcauucuaagcaagugccaaccacugaaguauaccccagacaggagacaggauuauugcagugcccuacauaccuuccuuuuuauuucaagcuaguaccauauaauucuccucaaauucuguuguaguuaggacuuuaaacuccuccauaacucauuguugccuauaagcucaaggucuggccuauaagguccugaaguguuucuuauuucuugucuaaaccucucuuuauacaaccuacauggguuauggguauuuucuuuucugucugguuuuguauauaauaugacuuguucccaugugucuuuuuuuuucuuccuccuccuuucauuuaucucuguuauucauuggguuuuuuccccccuuuuccuuccccacccuacucccacccccucaguuuuucaagacaggguucucuguguaaaagcccuggcuauccugaacucucuuuguagacugggcuagccucgagcucagagacccaccugccucugucuuccaagugcugggauuaaggaugugcaccaagcccagcuacucgucuuugaagucuucuagaacaaucuagcuuuucacuuaguaauuucuuucuguuguacauucauacauccuuugcuguuguuuuuaaagauuuauuggccugccgaaauggcuuagugcuuaagagcacugacugcuguuccaaaagacccagauucaauucccaguuuucacauggccacuuacaacucuguguguuccacaggaucugacauccucuggccucugauggcaucaggaaugcaugugauacacagauauacauguaggcaaaauaccuguacauaaaaaaaauacuaaaacauauaaagaucucucucucucucucucucucucucucucuguguguguguguguguguguguguguguguguguguguguguguucguguucguguucucagaggccagaggaagauccagaucucuuggaguagagugagcugcccagcuugggugcugggaucuaaaggcagaaccucuggaagagcaacaguugcucuuaaccacugagccaucucuaccgucauguuacuuuucugugauagugucucaucuagucuaagcugaccucaaacucccuauggagccaguuuuuucaauaaaguucucaagaucaacccuagcccaaacacuuuggaagauacugaaugccuuaaaaguuauauauauugcuguuaaauauuuuuuuuuucccaugcagaauucuuacaguaauucucaagcaccuucacccggcuuggggagguagguacaguuuuguucucugauauauuuuugauuagcuuauuuguggaucagaguagaaauggacagcagaaugguugcuaauuuuaaaguauuacaaucucuaguaagguguuuuaaacuuuauuuuuuugauguuuggaauugaauccagggccuuuggagcgcuuuccuacuacguuuugccucuagaaaaguacuuucuuuuuaaauuauucuuuccaauuuaauaauuuuaaauauaaagaauuuuaagagagguuagaaaugagauaugucaacagcucagacaucugaguuggcuuuugguuugguuuucuuucucucuccucccauauaaguucauaaauguucuuauguugucaggcuugguggcaagcacccuuaccccugagccaucucacuagccccccaguuaaguuuuuaacaguaccuugagucuucucagguugauuuucaugucacuuagguuuguuacaaugguuuaaacuucacucagaccuuucauugcuagaauacaguggcuugguuuugauauaucuuccauuccacauuaaccccuucuugccuacacccgaaaggggaacaaacauccugcaaacuuagauuuacuuuuucauuuucucaguucaucuauggagucuuuguuuuaaugugaguugacaguccaucuuauuuucccuugucuacauacccagggcugauguaaaacccagagccuuuugcaugguaacaagugcucucucacugagcuguguccuuuuuaauuuguucuuuugagacaggagcccaggugacuuccauucuacaguaugcuaauuucauaguauucacuaugugugugugaauaaguauccuguuucucuuuguguguagcaaagcuguugggaugcccuccccuguuucuccaaaacugucaccaggcaauucuggaaguuacucuucugggggaaguagugcuucagcaagugguucuucagugaccauuccacagaaaauccaccagauggcagcaagcuauguccagguuacaucuaacuuccucuaugccacagaaauuugggaccaagcugaacagcuuuccaaagaacaaaaagguuuguugggcacuggauaaacuuugauaauagaauaguuaaaagaaacauuuguaauuuaguuaaguauguggagaccacuuacuuuauuuugugguuuaaagacaaucauaaucaauuugcuaauaacauucuuugcuuagcugcauacuaacuaugacuagaugugguuaaaauucccuugggcugugcaugccucccuguuagauuacuuucacagcaugcauaagacccugguuugacccccuaacgugaaggauggggaacagaugaacugaugugggggaagggacauagacaaacggcuuuugugguaaugcugacacaaacuaaacuagaaguaguucuugguauaagacagauaccucucuauucuggcauauuggaaguagcucacgggguaguaccuugucuaugaucaacuuucugcuguagucucaaauacaccuuaaacaauauagcaguuggaucugcaagaugacucaguagguaaagaugcuuaccacaaagccugaguucaagccucaggaccuacuugguggaaggugagaagaaacuccacaguuuuccucugacucaacacaaguacacugugacacauccacagacagauaaauguaagagagagagaaccauuaagaaaauagaugaguuggauuuguuuuauauaguauucaagcaaggucuaaaugcugcauuuuguaaguagcucucccccuuauuuggccaugccauugauguuugaagaaacugaaucauagacgauaucauucugcauaugaccauuucuuccucaugcugccauuacacuuguuauuuuaucuuucuuaguuccuuucuauugauuagauucaaguuuaguauuagauauaauacucuaggugguucaucuuauuaaaauauaccuaguuaccuaagguauuguguuaggauucuguugcugugaacagacaccaugacugcugcaacucuuacuaaugaaaccacuugauuggggcuggcuuacaguucagagguucagcaauuuaucaugacaggaagcaugguggcacacaagcagacaugguguuggagaagucgcugagagugcuacaucuggcucuguaggcaacagaaagaagcagugaugccacuaggccugacuugaccuucugagaccuccaagccuggccauaggaacaacuuccuccaacaaggccacaccuccuaacucacucauuauaggcuuauaggacccauuguuuuucaaaccaccacagguuugaaauuaauacccaauauugauauuaagauuuaucagaccuaagccaguuggugguaguacaugccuuuagucccagaacuugggaggccaaaggcaggugggucucugaguucagggccauccuggucuaagagcaaguuccaggauagccaaggccauuacauugagaaacccuaucucaaaaaacccaaauaaauaaguauguaaguaaguaaauaaauacauagauaaauaaucaucagacugagcaaggugaaguaggccuaucgucucagaagcauugcaaguuggaaaccagucugaugcaagacccugucuuuaaaaaaaauuuuuuuuuaaaucaauagguuauuauguggugucacuuugauaagcaugauauaacauuuccuuuuaaacuuuaacucacacuuuugacauccaugaugacuacugccuggguccauuauuaggaaagaaaaaauucauuauguuccaggcacaguggugccugccuguaggcuuagauuuuucaaaaccuucuuuaguaggguucucaaacauuuugaucccucuucuagcccacugucuaaagguaggggagaaaagaugguaaauagaacaaggggaugggaaccuguuuggaagugauucuuuggggcaauuccaaucuccguugucaguucaguagugucaggauaccaacaguccaguucaaaagugucaccaaacagcaguguuggcacgauccagcagaaaccaccaggucuuugccaaaucagcacgagucagcuggagugacccggacccacuggaauaccaggaguucucugccaugucucucuaguuagagugaagaucagcaaagaugagagaccaacaaagaguuacacagcuaucuauguaugcaagcucccccaucauugucuguugaaucuuacuuauguucucuccaaacauccugugaaucugcaucacaugacacaaccagaaacuugcacuucauccgccuguaauuccaggaauugggagcagaagcuguaaggaugaagaguuugagguuaucauugggaguucagggcagccugagcuaugugaauuccuauucaggagagugagcaaauaauggaaauggagugagcaaagaaaaaucagcaccaauauugugucuggcauuccuuucacauuuauuaguuggaaucuguacagacguuuaaccuuaagugucucaucauuucuugccuuacuugauuauuagguagucuuuaacaguccuuuuucucugcauggcuaaaagcuuucuuuucagagaaauauccaaguacugcaucccugucugcucccaaaacuacauuggagucaaauccuaggacaucguucacucuucccauuuaugccauucugauguagagccuccguugcucacugaggaagagucuuuuuguuucuguccuuucagauuuuaaacaucuggcugaacagaagggauuuguuggugguucagggaaucugauaguaauuagauaguagcagaaugguuuguuacagacuuucauggaguuacacuggggcuagugugggaacacacgaacacuauuuucuguuuucuacuuuuuuaaugauuuauuuauucuguuuuaugugcauugguguuuuugccugcaugucuugucugaggguguuauauccccugguacuggaguuaguuccauucaacugugagcugccaugugggugcugggaauugaacccagguccccuggaagagcagccagugcucuuaaccccuuagccuucucucuagccuuacuaguucuuacacagaaauaacauguagagagagagugcuuuugaguaauccaguggggugcugcacaugugccauugugacucuauuuuuaauguguaguagcaguugaccauuuucaucagugguauucaccuggaauucauuaucaugcauucuguuuaaaauguauuacuuccugaaccugagacuuuguagcggccuuuagugugggagacugcuauuuuacaguaaaucagugaagaaugugugauacuuaaugaauguuuuuaauuuucuagaauucuuugcugaacuggacaaagugaugggcccucucaucuuuaaugcaagcaucaugacagaucuggcucguuacacccggcagggacugcauuggcuucggcaggaugccaagcugauaucuugaacugaacauacucucguugccucugauuuuuuuccacaacacugugucacaucacaaaggaaaacugccauaacacaccaccuagucgacacuaagaaugaggaaugguuuucuccucuuugguuuauguuguuguuucuauaacccaaagcuaucauaucaauugacccuuugaagagucccaaugugacaaguauuuaaaugcuucuaaaccuucaguacaucagcaagaugguuuuaguaauuggaauuccaguugcaauucauaaauaaucaaguaaaauucuauuuauuuucauuuuuuuucaaguucccagauuggagcuuguuuaaagcuuaguauuucugccuauaaauuuauucuguuaauauuuagcauaaacuuaauguaggcauuuuauuuauauauuuugggagcuguguuacuuaaugucuucuaagauaagaguuggcuuguccaagacaggacuuguucucucuacagcuacucaccuauguucuuucaagucuuacuacaguuuuauuauuguaggauuuaugcuugguauuaaggaugcucuuccacaugugaaaagucauuuaaacaugagaagacggcauucugcaugggugcagaaauggagugggucugguuuaguaugcauuauuucaaaacugugaauguguguuaguaacacuagcaaucacaaggugacuacauugcaucuaaugcauuacaaaaaagcagauagauuugcuggggaagcacugaauggcuucauaaaggacaaucuuaaacuaugaguuuguuaaaaccuuauauucuuuuuuguuuuacucauuugacacuugauugaaacagaguaaauuacuccuaaaaacagugauccaguuucugaaggcugcagccuguauucauugcuaauguuugaagguuaaagucuguggauuuccccuaugguggagagauugugaugcucagaucugacaguucaggaacuggagcuugaaaggaggugucccaaugucuaauguggagaaaauuaauuucucuuuccaaagauccucaucaaugauguaugcuuuugacaggaucagaaaacucacaguagcagcugagcaugguuuuguauaucuguaaucccaacacuggggagggauaucaggagggucaggaggucagaaucauccucaagcuacagaaagcuagacagugaguuuggggcuagccugagcuacacaaucccuugucacauuaaagaaagaaaauguauacuaggaaaguaccaaacuuggcucauugugagcuuucuuggaaagggggagaugauagagacagggcuuaggaagccagcucuguaacaguuccuuaucaaacuacuguucccgcaaggugcgcauagcagugaagggcgaggaugucucucuuccucuauacuucuuuuuagugaccccgucaugucuggugugccuuaaaucuuaacuuuaaaugauaacucuauggauuguuuacagauaaaguuuuaugcugggaccagauuagccaugcaugguugguccucuacaauaauaauuucaaauccucuuugauuuuaaaucuucuuuuagagucacauuaagacuccuucagaaaagcuaguacuuugguaccugauuuaguguaaucaauuggguauaaugcugcuucaaaaaauggcuuuuccuucucauuccaaaaauccauccaauuagggagaaaaauccccuguuagcagaugauuguugagacuugaauggaaaggaggaagaggggauagcaaccuucacgcagcagugucgcaaauccucucugacuccuucaccaccuguuucugaagauagugaacuuuguccugcagucucauaucuacagagcuuaacugcuuugugucucauuauuuuuacauaguguugaggguugauaccuauagcuuaugcugaauugaacauuuuucccuuggagaaauugccucuguaccuuccuacuuuaaucguaguguauuuacggaaugcuucuucagaggccaucgguuccucucuugugcuaguaaccuccauggucuaacagcuguguguccuguccuugccucuucucucucacucuggcuucuccauuucagggaggccuuagaaguagagcaagcacccucucccugugcuuucagccccgcugcugcaguucggggcucugcuuuccagcucugggcugugugcagcgcauucuagugcgccucugacgucaugcuaaagcagaguuuccuacguguucauggugcugcuuuaagauguuuucccuuuaaaacugucaguucuuggagaaugaaaugguugaaccuuucauuguggaggauuuuccucaccacauagaaaugggcaauggaucaaaaucugauccuaagcgauugcauuuuugaugucauagugugugagaauacacucugugucucuucucagauguuuugucucagucauguccagcacauaccuuggacuccuuuacaagugaccaucccucccucucgguaggugcccucaguguuuuuuagccauuuaaagcugauuugacaaguggcuacaaacuuagucugaaacuuguauucacucuauaguuaguaauagaaauagcaacuauuguuaaugcucaguucacugcucuuaagaucacauuucuauggcaggaggcagcagcaugcaccauuggacucuggacaggugaucacaggaucacagugaugcagcugucacaguaguccugccugggagaggcugggcugugggagcacuccccuccaugcauucaagauuacacagccuagcccaugucccauucuggcuggagaacacccagcccuuuccuugcucagugacaccuuuuucugggcaagaaguuaugaagucacuuuauuaucuguaagugcuucaaauaaagucacagagcugcugaagggagaagguugaccacuacugauuuaauucuccacugucaaagcaauucagaguaaugugugcaugcguccacaguugcuguuuuuucugggaagcucuugcacuagggauuuacaggcaccugggcugcacuuugaaugacacacuuguggcuuuagaguagcuguuauuguuuuguuuuaaaauuguucuucguuucuuuucauuaaugguuuaaucagcuagauuagaaagcaucauuuguauuuaacagcugaaacuuugguacguugacgguuaucgagugagcuugcauuguguagccagggccuacagaggcucuugucaggaauacaagcacugccuggagcuggugcucagaggagcuucuagugcaaccaggaauagcuccguggggugaugccuagcucaauugagaagggggaugcuguacacucuucuagguaugaggguaugcgacuuuggaucuuaaaauuauguacacauacacacuuuauauauauguacguauguauguaugaaaacauggaauuaguuugucaaaaauguguguguuuaguauuuuagcuuagugcaacuauuuccacauuauuuauuaaauugaucuaagacacuuuguucuuggcaccuugaauauuaacauucaaggaugcaauguguauuccuuuagauuguuaaagcuuaauuacuaugauuuguaguaaauuaacuuuugaaauauauuugagcccuucuguaguauaauagggcucuuacagggugggaaagauuuuaauuuuccaauagcuaauugaacaaaauggcuucauuguauauuuugauuuauaggagucuguaaggugucugggucccaaggacaucuacugaggaugacuguuuuagguggguggaaugguguuuagacuauaccuuagugacuuggaaagccagagcaccuaguucaaauccggacuccuauaacucauuccucuaggauguggaauacaaaucccauccagcuucacauuucaauuagagaggcagacuucuuuuccaguaauauuguacaccuaguguugcuaugaguaaaaucaguaggaaaaauacugagaaggucugggaagacgcacugacuaggccagcggucacauuuguaaauguaccuuucccauaccuuccaguggaggcauucagcugcgacuuuucagacccuaaaaccaagccagggaggaggaacacauguuuaagguuagagaaggccaggagugcgggugcauacccugaggcaaaggccauccuuugcuagauagagaaccugagaugcugagacccauuggugaaccagugugguagugcaugcuuuaauucuagcacuuggacugucaguuugagaccagcaugcucuacacagagagacccugggagaaagcaaaguguaguaagaggaugccauucugcagaacucguguuaauuacaugaaccccaugguuaacuaaaaagaacuuacuguucccagagccagggaauagaaaagaagcuacacuucucuuguaaaugguauuuagaacaagguguucggguaaagucucaacuagucagagguuucagcagcuuaaauugcuaauauuuaagaaguugauuuucaggaaugucugccugugccucucuccuugcugccauugaucagcucagcaggaaucaucaucuuuaaacguggagaaagcucucagaugagcguggacaagcucccacccagaaguccuaaugauacuugguuuugacugugcugcuucuguguuagguuucuucucagcuuuuagccacugggguuuucugccuguucuguaccucucuagaagaugucgacuuggaagugcugccuuucacaccagugccaugguguccauauaguugagcuuguugcugauccagagguguccccuuuaugcucacaccuggcacaucacugacaugagcauucaacaguacaugggugaggguagagguggggcuagccaacagcccuggcucaauuggcagggccugcaaaggccccacuugagggccagacacuagguugguaagcacaguuagggaaauuucuaccuaaccuccguuuugaaugauucugagaaauuuuauauauggaggauggaaaugcuuauauauuuauugaagaucuuuuuauuugaaauuaaaaucauuugguaaauaaugguuugauauuuggggaggguuuuggagggaaguaacaugguugauaaauuacaggccugaugacuccccugaagggcgcuguugcugauggagagagaggccuuuaucuuguacaugauccaaucuuugucuuagguuucuuuuauccaaaauaucuaggcaucugacacuuucaaccaaaauuucaauuauauacugugauuuuuauuuguugcaauacguuaaauuucagagguacuuuggggcucaagagcuaggauuucuaagucaguaugugcauuucacauaauaagcuguuaauggugagcaaaguauuauauacuaacuagauuuuccacaucuguauaguauauuauauguauuuugugguauugagauuauagaaaguuuagagugucaaacaugcguuuaauguguauuuuuaaacaaauuuauggcaauuaaaauauuuggagacaaggguaucacauuucaauuuguaaaacucuuuuuaacucuacugugucauuacaaugcuuuguauaaugccaaaccauagcuggagaaacuaaguuuaauaaauaucagcuagcuuuucuguacuacguuugcaugcacugugcucucgcuucuucagcugcugcugugaucucuuguguaguugcucuuugugucuuaggguucagucugacucugcaaaggucuggccccgccagcacagaucucaguuuuugguuacagaaauuuuggauucuggacugaauagaugacuuagaaguuaagggccacugccugcacuuccagaugacccagguucaagucucagcaaccauaugguggcucacagcugucugugacuacaguugcccggguucuaacacccuuacacagacaugaauacagacaaagcacauaaaguaaauuuuuaaaaaaaauuuugggugcauggccauggguccguguccgugagucucaguuauccugcaccaacagacaucuuuaaucuuuucuugaugcucuuaagacauacacuauuaaagaaaaaaaaaagaauguacacuauuauuuauuuuuacuauuuauguauugguucuuuuuauucuuguuuuucugagacaggguuucauuauguagcccuggcuagucuggaacucacuguauauaccugguuguccuugaacuuacagagauuggccu

SEQ ID NO: 5992 - RNA, 1112 nt, Mus musculus
ugucggucuauaaaaggaaacgggaacugcccccuggcuuucagacuccaacaucauucuuuugccaagaugcuacagcuaaaacucuuugcagugcuccugacuugccugcugcugcugggucagguaaggaaggaaacaguaguggcguggaauuccaagucagacucaguccuuagaaaugcaguucgaucuccugcaaccugcaaagggcccuucuucugaggcugugcagcagagggugggugcuuccucagcuaaagugaguaugccuuugcucuacaggucaauaguuccccaguaccagaagugaguucagcaaagagaucccggagaaugaccccauuuuggagagggguuucccucaggcccauuggugccucgugccgggaugacucugaguguaucacaagacuaugcagguauuugaugaucccagguacaggguggaccagagagcacugggaaagcugggagagaugagaucagaaaacagagacccaaggguaaagcugaaauuaguggugugggguggggguggggguggggggaauauaugaagcugugaacuccauggaggggauuccgugacagucaagaaccauucagauuccuaacacugaacgacagaugaaacaaggaauaauggaggcagcagaggugucccagggcuccuuaggucuacauccaaucuuaaucacuucuuuucuuccccccacuagaaaaagacgcuguucccuaaguguggcccaggagugauguccauacuggggaagagucaccuccaacagugaucuguucuggggaauauuguuaacgacauuuugguuggagauagauaagugaaguagucuuuguuuuuaauauuuaaagacggauacuugcuuuaaacuggucuccauuucuuauuagaauguuguugauuuguacauagacauaacuuugucagaguuuauuuuucuauaaauacuauuaaaugucucaaaucuaaguucuggcagucuggaauugacacuucacugagucacuucauccauuauagggaguaguaguggcucccuaaccaguggugcugcuccaccugggaguguggugagcacccacuccucaaa

SEQ ID NO: 5993 - RNA, 2919 nt, Mus musculus
ugaaguagcaaccaaaauaauuuuaugguuggggucaccaccacaugaagaacuguauuaaaggcuugaauuagggagguugagaaccaguguucuaaggguguggguguaugacugucagacauagcuauuucccauuugccucacagucuaagcaacuauuguuggaagucauuugcucucuucugagaacuuuuaguacuagcuagcgaucaucaggcaaaaaagucucagaguccgacuggacuguaaauugcuacaguccuuaaccaaaugacagggccagcucaggauugccaaccacacccacccuaucaucucuaggugaggagaaacuaaagacacccaaagguguauaucuagagcaggugguauaucuuuuccacaaagugauagaucuuuucagccucugugguccacauaugacuaaaagccacuguuggauuggcaacaugacagauaaccaaccaugguugccugaccuuggcuguagcagucaagggaaugucucaugcuuuccuuucaaagaugaaaucccuuaggcuaaggaaggccuucccuaccuaaggaaggcagcauggcuugcuuuuaagaucacacacugguaccuggcucuaccaacucagucauaugauucugggcaaaguacuuaaacucugauuccucaucagcaaagggauuagaaugcuuacuucaaaggcugccgaguuaaaaguucaucugugucuagcaaguccaccugacacccugauuacaguguugucccuagaccuuaaggaugugaugggagcagaggguugggacccugcacuccagguuccacgcuaugcauagcuaccacagccccugcagggcuugugcugagaaagggauugucaugaacuugcauauugccaaaacaacguugugcugggcaugguggugaucgccaugacauagcaggcagaggcaggcagauuucucaggagacgcaggccagucagggacacacagugagaccuugucucaaacuaagcacacaaagucacaaagggaaguccauaaguaguuuauugucuucaagacuacaguguggauuccucucccagagaagggucuuucagaggcaggggacugucacccaggugcaggccgucuacuugucauuuucauacauggcuggauucuuccuuuucgacugcucaaacuccugguugccccauguguagaucagguagaccacuacaaacgcuguagggaucaagagaggaagccaugaguacagacauuuuaaaaaguuucuauuuuauuauuauugugugugugggggggggagggguuuacaugcaugucugaucauacauaugcauguagcucccugggggcaagaagauguuaggugcccuggaacuggaguuauauagauggcugugagccaccaugugggugcugggaggaaccacacugggucauuuacaugaacaggcaccuguaccacaaccaccagugccccagcucucuggcuuuuuuuuuuuuuuuuccuuuuuugauauggccuccuugaguggacagacagaccucaaacaagagauccacccaccucugucaguccauguccuccuuucugacuuucaaccaauucugccuguccuucuacugucccuagcuucaacuguuuguuugguuuuggagaaaggguuucuuucucuguguaagccuggcuguccaugaacucagggaucugccugccucugccuccuaagcacugggauuaaaggcaugcgugcgugcuguggcucagggcauaccgaggugacuaagggaguaagagaauggcaaaucccucaggacuuaagucacagaugauuguaagccaccauaugggugcuaggaauggaaucuggaucuucugaaagagcaggaaagauguugaaccauccccagcccuaaguuucuguugcuguauuaagacaagcucacaguauaaggcccuugcuggucuagaacucccucaaaacuacauagauccaccugcuucugucucaggauugcuggggauuaaauguagacaccauuaugaccagaaacuacuuuuaauaagagguucaaaaugguuauaguacacaaccauuuuauaagcaaccaaaacaaagauaucagcccaggaagauguggccuucgcuuuccuaguuaacaccaaauuaaaaaaaaaaaaaucacggaauuuaccuaacauaaucuucaccauuuuaaaaaguacuguugugcuggcgcaugccuacaauuccagccaacagucccgaggagagggcaguaaaaucucaaguuuaaggccagccuggcuucuacagcaagaucgggccucaaccucuccaucaaauuuaagugcaccuucacggauauucacaaugccaugaaaccgacagcaaaaucggccgcacaucuaacacaagacacugauugcaucagccuuucaucacagauaguggccagcgaugaccucagagggagccguuggagucacccaagugaccuuaggccagucauuucgauaugauaagaacuccuccacgucugccccgcgagggcgucggaaggagaggugcgcggcuguaccccgcccgccccgcacucacgcggcgccacgcgcaggaugcgcucgcgagugcggcgcagcacguuggggaugccuuugcugaaauagcuugggaaggcgcgcugcucaaagggcgacaagcuguaggagaucacgugccguauccgcgccagguucccaaacucgcggcccauggugacggcggcccugggacagaagauagacgcguggcucagucucgcgaaaaaccucccacggccuaacaccgacccccaggaucggucaccucuaccuccagagcucugagccggcuuucgcccgucacuuccgggaggagcggaagc

SEQ ID NO: 5994 - RNA, 934 nt, Mus musculus
ugccacuggaggugcggagggaaugggaaagcggaaccucucugcacugcccccaccaauuaaaggcggaauuaaaggcgcagcguugcucuucagcuccacucccgguugcuagguggguguguucccuggggauguugcagcguaugggcgaggcguggguauuuauuaccuucagcacuauuuaccacaaaauaaaagcaauauuuuacauauauauguccuugcacugcauauauugcaucaauaccucuccaaugucugaugcuuuuuauauagggggaaaaaaaccaaccagauuuacaaaauucauagcaagaacaguucccugugugguauugagugcaggguacuggaggcucacaagagguuuaggaagcaguuuucucaugauagauaauacuuuuugaaauguggagcuuugcgaucuacauauuuuauuauucguugacuuucugucucucugucucucucugucuaucuguuucucucucucucucucucucucucucucucucucucucucucucucuguguguguguguguguguguuuuguaggucagaaagaagauaacuugagacauugguucggcuuuccaucauuacaugggcucuggagugcaaauucacaucaucugguuugguggcaggcaccuuuacucacugagccauuccaaaaauacccccuuuauuuuugucucuauaugaaguucaaguuggucuggaacuugugcugucaccgccucaguccugagugcuaggauuauaggugugugccaccaugcuugcccaaaauaacccauuucauauaggauuucaggaauaaacccacaggaaaaaacaaagaaggaaaaaauaucagcagcagaaaugaccauuaacauuuugacauacuuucuucuacuaugaauucaugugucuuuuauacuuua

SEQ ID NO: 5995 - RNA, 4967 nt, Mus musculus
uggagaacgggccccaccucucaccgcggcagccuucccggauagcagguccugcgacauacccaggcaucacaguggagcuggccuggaggcagggguauguaugagagaacaguccccaaggucaugaguuuaggacagcugaccccacacucugacguggaauggcagggggcgcagagaugauacccuccuugccccaaccccucaucacaucgggcaguuggaaaaacagcccacagggucgugaucucgggaaagcuagcccugccucucaccagcugcaacacucagauugcacauccuguuucucucccgaacaacacagcagagcugacccuggagugugugugugugguggggaggggacaggugauccagcccccgagagcgcaggagagcugaguccaccacucuucugcugugagcuagcauaggugcggggcugaugucuuccccgccuugccccucaccgccagcaguagucaggaaagcuggccuuggggucauuagagagggagagaaagcccugccuccucgcugguuguagcauucgggagauuaagcccugcaccucaccugggcaauacaguggagcuggcccugaugacaaaucacgggcaaaccagaccccaggguaugagagcaggagagcugucccagccccccaccccacccccaggcugcagcacuuggaagugguuccccccaccccaccucacucaccaccuccacccccgcaccuugacuggacaacacaguggagcuggcucugguucugauguacccgcccugagggcaugggagcaggagagcuggcccugccuccugcagauggauuggguggcccagucagagcaguguuagagaacaugcccuggugguacagacaagggaaagccggcaggcuggcuggcucaguuuccacucaggcccagacccaggggucugaauuggcccaucucaaaaucuauguaaucugggaaugguuaaauugcaugaaaggaccaguccugcugauccaaagcugcaggaccuucaugacacaaggcaaugggauaaccagaaggaguccugaggaggaucugauauugaugauaucacaaaagccagagauuucaaaccagaccaaugacgcauugcaaagaacauuugcaaaugaagauguguggacagagggauacacggugggacacacugugacacaguacagagaccacgaugagauuucuaugcuuuuguguguguguguguguguguguguguguguuuuauuuggggagggaggcuauaagggcaaagggcagauuugaggagacagggacaugagugggacugaagugcaugaugugaaagucauaaguuuaaauaaauaaauaacaauaugagcuggagagaugacucagcggauaagagcacugcucuucuacagguccugaguucaauccucagcaaccacgugguggcucacaaccgucuguaaugggaucugaugcccucuucuggcaggcagguguacaugcagacagagcacucauaaucaaauaaauuagaaaagcauaagcaagcaagaaaaaaaaugugguuuaauccagucugcauaguauuucuaaaugagguguggcucagcagcagaacacuugcuuugagugugcacagccuugaguuugagaccuaguaucaccaaaacgaauaaaugagugaaugaaugcaugaaugaaugaaugaauaaaugaaugaauacauaaguaggggccuggcucaguuaugaauguaacccuaacccuugggaaauuggagggauaucaggagacugggaguucaaggugaucacuggcuauucuguaugugugugugugucucagggguuugagacugucucuccaaguaguccuaguugucuucauugguuaucaaguucaaggcuaagcuggguuauaugagacccagucccccaaauuguaaauaaauaaaucucacuggaaugcaguagcaaaauucugaguggcucucuaacaaaucguaguucuuuuuguauuuuggaaacucuuacaaauuggaaaaccauaaaugcugaauuucugaucugaucagaaaauaaauaagcuggugugguggcucacacuugaaguuaaaauugaggaucuucaugaguucaaggacagccugaguuauggaguaaauuuuagaucaguuugggcaauagugagacccuaauaaaaaaaaaaacaauaaauaaacaaagaagcaaacagggauggcaacaaugugcaagagguaaaggcucuuucugugaagccuggaacccacaggguggaaggaaaaaacugaccacugcagauuaucuucugaccuuugcucacaugccguggcuuuuacacacacacacacacaccacaaagagagagaguaaauaaaugugauuaaaaaccaaaacaauagggcuggagagauggcucagugguuaagagcacugacugcuguuccaaagguccugaguucaauuccagcauccacaugguggcucacagccaucgguaaaggggucuucugguaugucuucugguaugucugaagacagcuacaguguacucauauacauaaaauaaacaaaucuuuaaaaaaaaaaccaaaacaauaagaguaaaauauaaauauuuuccuuuuuuaauuuaaaaaguguuuauuuuagcugggugguaguggugcaugccuuugaucccaguacuugagaggcagaggcaggaggaucgcugugaguucaaggacggccuggucuacaauguaaguuccagaacagccagggcuacacagagaaacacugucucaaaaaaccaauuauuuuauauuuggguuugaguauuuugccuauaugcauguauguguaccacaugugugccugguggucacagaggucacagaggucagcaucagaucccuuggaacaggaguuaugaauaauucugagaugccaugugggugcuggaaaccucuguaugagcaaccagugcucuuaaccacugagcuaucucuccagccccuuauuuuaauuaaaauuuuauuuauuuauuuauuuauucauucauuuauuauauacacacuauccugucugcauaaaugccuacacaccagaagagggcaucagauucuauuacagacgauugugagccaccaugugguugcugggaauugaacuuaggaccucuggaagaucagucaguacuuucaaccucugagccaucucuccaacccagcccaaccucauagauuaauuuuuaauuauauguauauguaugugggugcaugacagugugugccauguuuguggaggccagaggugucagguccccuggaacaggaauuccuggcaguugugaacugccuuauauaguugcugggagccaaauucaggugcucugugagagcaguguguacucuuagccacugagccaucucucuaaccuaguaaacuaagagaaagaggguucucuggaauuccauuccagacaggauagaguccaaacuggcacccagggccucucacccacggcaagagugcuaacccgguguuaucuucuagaguugugggacagacacacccuaaacugcuaacaagcuugguaugccuugcccugaacuuagcuuucugucuccucccuagccuucagcuggccgugaggacuuuccccaccugcugcccuugaaccacccuucuggcaagcacccggagauccuguuuucugugccaaggagcaaaauugcuuggcagcuuuucucugauacauugaguggugagcuccucaaagacuggugcuaucuucuucacaggggccuuggcucacuguuuacaccccaaauaggcaauguaugcuucuggagucagcuguagacaaaggcaguguccuagacuuggggacggugaggcagguuuuauuagggugugaguugggguagauuucaagaaaaaguaauauggaccgggcuagcaagauggccugauagauaaaggugcuugucaacaagcccacaaagauaagaagagggcaucagauucccuggccuuggagcuacagaugguucugagucaccacguggguauuuggaaucaaacauggguccuuugaaaaagcagccaguaacuucugagacuucagugcgguggcaggagaaacugguuucugagaguuucaccggaagaggauuccugacuccugagacuuguccccugacagagacacucaugcauauauacagacaaaauagauaaaaaauaaauuaguauguugaaauacacaaaauuuucucucaaguauguugguuucacucuuuauguugauugauuaauacaggagacguuuguccuaaauguucuuuuacaugguaaagauacuuucucuuuauugauuuauuuuucuuuuuauuuaaugauuuauuuauuuauuuauuuauuuauuuuauguauaugaguacacacugcagcugccuucagacacaccagaagagggcaucggaucccaugacagaugguugugagccaccauguggguugcagggaauugaacucaggaucuuuagaagagcagccuguguucuuaaccgcugagcuauuucuucagcgcagagauaccuucuuguuuuacauuuauaacuuucagugaaaaagacuuacaaagaagaccaguuuucuaaaaugagugucaacagaaaacaaaauuaaaagacaaaugacaacuggaaaaacauugauaacauaaaauaaggagcuaauggggcuggaaaggaggcucagugguuaggaacauuggcugaccuuccggaggaccucaguccaguucccagcuacuguggcagcuccuaaccuuucauagcuccugcuucugggaucugaagcccucuucuggccucuguuggcacgaggcaugcauguagcgcaagacauaacacacaaaauuaaaugaaaauuuuua

SEQ ID NO: 5996 - RNA, 499 nt, Mus musculus
uuuuauuucuuuuuuauuuuuuugaaaauguuagcauuuaauuaaccuccgucguggcuuuuaagccaccagaacacaggcaccuccaacaccuuuaaucuucuccaacucuucugcugaagaauuuggccuucacgaugacagguugcuuagggagcuuucccuugcccagaacuuuguaguagccugaucgaacaacaucaaugaugggagcagcuccaguuuuguuuuaugcugcauugacccgcgucugcucgcugaccaagguccacaauuuauccggguugacaguugggcagaagcucugguuccucuuugagugguagugccaacuuucccaaaguaagcuagaugauauuugucagaguugauccugcggugaugcauggauccagccuucccgcagccuccugggugcuugcagugcuuaccgaugcgguccuggccguggcucacgugaccccggagcuuccgggucuuccucagucuggauggcaug

SEQ ID NO: 5997 - RNA, 32787 nt, Mus musculus
cucuugcucuugcuccuucgccugcuugcugcgugagacugaguaacugcuagauccuuggacuuccauucacagcugcgacugaaccauuguugggaauugggcugccgacuguaagucaucaauaaauuccuuuacuaucuagagacuauccauaaguucugugacucuagagaacccugacuaauacaccaucccauggucaaaagcucugacccagaauuauuccugucuaaaagaacugcagggacaaaacuggagaaaagacugagggaaaggcuggcuaguaacagguccaaauugggacagaucucaaggggaggcugacacuauuacugaugcuauguuguacuuauagacaggagccuagcauggcuauccucugagaggcccaacaaacagcugacuaagaagcagauacacccaaccaauggucugaaguuugggaccccugugguuuaauuagggaaaggcuggaagaaguugaggaggagggcaaccccauaggaagaccagcagucucaacaaaccuggucuccugagaucucacaggcacuauccagucagcacagacuagcgggucugaggccccugacacauauucagcagagccuggucuggccuuaguagacacaccuaacucuugaggagacuugaggccccagggaaugggaggccugguggagugugggguuguguggggguguggggacauccucuuggagacaggggacaagaaaugggaugaggaacuguuggcggugagaauggaugggggauaacaacuggacuguaaaaaaaaaaaagauuaaagauaauuuaaaaaaaaauaaaaaagagcauacaccauguaagggugauuuaacaacgguaaagcaauaaacauaauacaguaacuguugggggcuguuguggagcuagaaggucugagagauaggccaagaagauggacuuugcuugcuugguuggccaaggagagaugcacagugggugguagaguggggugaggguuauguuuccauagccauggauugaagguauuuauaggccaaugggaaagauccuguggagagggggaggaggaggaggaggaggaggaggaggaggaggaggaggaggaggaggaggaggaggaccacuccggacagagaagugggcgggcauggggaggaucugaggaucugggcaaacuguacuuucuguggcauagcagaugcagaaagguuugugcaugguuucaacugggcucuuggcugguagcugccacagacacggacaaguggccagguaguauuuucugaguuguuucugugugucugucuuuccuagucugggccgucugccugguccaugccauuauagggaaauccacaccaaacuccaggcacagucccacaggccgggcaucuccguucugggcucugcucccugaugagauucucagacugcuuccccucauucauggagaagcaagcuuacagggcaggcgugggaaccugcucagcugccagagcauccuucaguucagaucgaggucgguugcuucccugucuucuugacugugugugucucagacagagcugguugagguguccaaucucauuggccuguguuauaagccauagguuggcccuaggaugagaugcuccaggcuacgccaacuucucacauuuacagaagagccgaagccuggcuagccugagccccucagagaagcaguuaggcuuuggagaugggucaucuggagagaugaggugcgcugacaucucagacccuugucuuuucccucccuccacuccccucccaggauacucaauucccgaucuuagugacgccagccuccugcaauuugccggugguaauggauguggggguggugggaccacagagggcuggagcaggcugggaugggggcgccgccccuggugccggucccacgcggcgcaaggaggugugcaucgcauacgugcagcgcguggcggcucgggccuucccgaaggcuccaguggcucggagccaggcccgggcgggcccggggggcgggagguggggacguggcggaggcucaagcgggcggagacugugacgagggcggagccgagagcgccggggcgacgccgcgggagguucuggaaacgccggcuucugcgcguguucaggugagcgcggguccgcagggucgucgccgggcugggcucgggucccgguggccgggcggugcguucugcucugcgcggagccgggagcuggauccggggucccucagccccgugccccgcguccggcgcccugauucugcacccgccuggguuccugucccgcccgcgucccuucccaggguuagggcggugaggucagcggugcccuuccugccgguacuguuaggccgggccggacaggacacuuggcgggcucccgggaaggggcgaccugaccccggggucgccccccgaucuaaggcggaggcgcccgccuggccccgaaggcggcgcugcuuaggaugaggaagaccccuggcucccaacccuggcaaggaccagcuuggucgcugccaguuuuaugggcucuuaaaucagaaacucuccuccuaucugucagaagacauccuugucgaaccucugauguuuucccugagcaguuucagagaccgguggcgauuggcugacugauucaacaaauagagcauucucugugccuggagacuuucaaggacugaggcaggcagaagggaagacucagaaaguucagguccagagcaucagcaagguaaguacugaguuaguguggaguuugggcuguguggacuugguagaugucuggaugcuuccgggcaggagacaugggcuggggugggaggcuccgguaaacuggauuggucacuuaggaaccuggacugaggaaucacccugaguggccgcaagcuugggccaguaucacgucugugguacaguaguggaaucaagguaacggaaaagggccgcuuuagggaauagcuguccaagggccccacccacaagcagugagagaucugcaugaggaaaguccacugagcccuugcaaggugagcaugggucuggguacuucugucgcaggauuuuacugggaaguacaggugggucuuccugucaucuguauucuaaugugucauuuacuaugcugaaggagaucauugaauugcccccuacagcaacucugcugugcucucaacgcgcuaaggagucucaguacaagagaaucauuggggaaaggccuccagccaacucacuccauccuugcgacguggcuucccugacugggccacacaguggauccuuacccugaagaaugacacuuuaaggauuuugcuucuuaaugcaggccaucucguuacugacaccuuaucccuccugauggaagagcuuccuggaacuaagagcagggucccagugcaccacuuuguagcuucugacauccucaaacguucucagcuuugcagaggucuauugucuagcucaaaauuuauagggugauuuugcaaguuguugcuuguucugaauuuauaucacauccaagucagcccaugguugagugcccuguuaaauugaccaggcuuuccucuggcguguaucuccacugccucugaaguguccaggguguagucucucgauaugguucugugugugccucaaggccagccucucggcuccucuccauguacagaauguuugaccuugggauucuuuucuucuugggccuucuuguccucacacgagcuuguccacuguguggcccagccagugaagccacauugcuugauggagugaguuggcuggaggcccuagccugaagauucugucauauugauccuccuuauuaccgucagagcucagcaggcagauauggugacaacucaacugaagcauugugugugaccuuugggagucccuccacauugucacaggcucugcagagagacuuacuuaucuauagauuggacugcguacaauggacuguggguuguuccuugaauugcaugugcuucauaucugacuagacugggccuggggcuugaaugagggagaagacaggcggugggggaggagcucuuuuugcccacaggcagcucauaaucucucugagaucgcuguuuagcccuggcagcugccuagagccuagggaggagcccuagugugggugcucaucagagggagacugaggcccugcagcucuggggacugcguggagugagggaauugagggcuuccuugucugcugagaaagcuuccauuuuugacugcauucucccacauccuugggaggguuugaggcuggaccgaaggccuuggcugacuuagggccacguuggccgauagugugcagaggccuggggggugugucccuggcuucugggaucugucaagagcuuaauuuuaugcagauggagguugacagcaaaugcugcaaugcaggcacgggaaagaccagcagaguccuggaaagaggcuucaacuuugaaaaccaucauucaaaucuagucauuuagaccuuugaaguaccugagggugggacaccagcguaucccagagcaaagggaauuacugaguccuguggucugugggguuugugcuggggauguggagugaaggauagacagacaguuuuccuucucagcgagagcagagcaggaugagaaggucagacuaggcuuuuuugagaagcgggguuuuguuccgcuggugccacugcagggcagagacuuucguguuuggauagugauuuuccugacccugauaggaucuguuugagccugguacaggucagccucugcuccagacuucuugguaagugcuugcuagagauugcuugcucuguaccuggcauuccugggagccagggagugguggagaucccaaggccugguacucuugggagacuggaaugaguaggucagaagcauagaacuauaagagauuuuggaguauugguucugcucccugucuuuugccagggaaccauuuuugugugugugugugagcuuuggggccugugauuggucaauuccagggucaccuccaaguguugcauacuuuggugacaccuguuuccagucuccccugaauugaauaugucaucucuccuggcauuccugggacccagacaucacucaccuucugacgucuucuuguuucuucacuaccucuuuguaugggccuuccucacuccaagagccacuaacuugggcugagcaacuguccacuucagauccccuugaguuccugugauucucuugguugguucugaugauuggucaaaaucagcucaaugauugacagcuugcuggcgugugucgucuaauucaguucacagaacuaucaaguauagguccuaaggauggucuccguuguauaaaugaaaaaaacuaaggaucaaaaaguccaggacuccaagguuacaacgccaggaaaugacaguuggagcuaggguuuaacucugggucuuucugacuccauggcaggcaugccugcucccggggugauaaugugugacauguccaguagacaugacucuggcuugaauucagggaaugguguccuuacuuuuccuccaugaacucuccuuuuccugguggccuccaaguacgggugucaugggcuucuuaaucugcgaaccuuugagacaucugugaccaaguuuucaaucugagugcaguguggauucgcagucuugggaaggcacaggugcuaugacaguuacugaguaagauaggaugguguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacagaugguaucagugugucuugcaggaggggccuuagcuggggaagcuuagcuugcugacgugccuucagcagccucggugguucuucuuaugugguuuacaguaccguuuccuccucauuccugcuuuguguaguuuucaucauucauggucaaccacacugugaaauagucauuggaaaauagaagacauaacaacucuaggcucuccuaaguucugugacggagucugugucacucuacgcuggccuucccaguguaucauuccuuccuuaguguauccaugugguauacacuauccauuguuaguccuuccauccuucauagccaguuaucaggugggcuguacaguauuaacagugagagugcucaaguaaccuauucagcacugggcauuucauaucaguccauuguuauaauuacuccaccuuguuccguugguaaucucuccuugugucuaauuccuaaauuaagcuuuaucauagguguguacuuaccgagaaaggcagcaucucaggguuuugauacuaucugugguuuuaggcaugcacugggcuucuuggaaucuauucuccguggacaaggcaggaguauuguaucuggagcagagauguuaucuggcuuacaagguuuuugugagaauuagaugguagaaaugaaagaucuuuggaaacauaaaccgugguuaucuuagccuagguucccagaaaacagagcccgaggcagagcuuaagugcuuaauacuuauuggagaaguguauugcagggcagcuggggugagaggaaaggagagaagaaugggaaacaaccaggggguaccuuagccagcuggccccucuguguggagauuguuggcucuucagccaugucgggucuaucuacuucugugugcaagcucuguggggacuccaugacuguagaugauuucuuacaggaggaguuuggaggaagugucgacucccacugauacgucacccuucaucagcugggguucccucauucccuagucuguagccauugccccucuguagccauuggagaggcaagucaagagugacugggaggagucugagaaucaccuugggucagcagugucuucucccuggcuaagcgagaauagaugguuuggagcccagggcauggcuguagcguggcagggaugccuuuuaucuuuuggugaaguuuauuuuugguaaguuaaguucaacuuguccguuuguggagguccugaugagaaccccgcucaguguuggcuuguggacuuccgacagcuucucugcuguaaguacacugcccuguuauugaagcaggaggcuuccagcauucacguauugaacagagagaugaugucaggacagauguacuuuacgggacacaugcauucuugucaagcccauucaguucccguuuccucuucugacagccauggggcugcaagucuaaggccagagagucccuuaacugaucuuuuaugugcuuccuuaaauggacacugagagaugagacucaggaggacucuugggagaggggagaucauuuggcuucacugagcagagaucuugcucucacaaggaaggcucuuggugaagguaaauauuuuugacaugaagucauugaaaguuugaggucugggguggugcaauggggcuggagaggguagcagggccaggucacagagcuacaagggcucuuugggcuaagguauuuggaccaugucuugcuagucauggggagccaaagggagggcuuuggcaagccuuguuggcuacuugguagaacaguguuggagggaagccaguccagagguggagaggucagagcagguggggccugcauggcugaagggugugcuacagguagaccagggugaugacugaggcacaauguucuguaauuggacguggguguacuucuggggcuguacggacauccguguucuucaguagugggagcacuugggaccugugcacaacugggagaguaccugguuccucucagcucugccagccucgaguuagccaugaugcagcaggcagggccgugguggaaaaggagguugaagagucaguccuguugggggcaguuaucccuccccugaaggcaaacagcauuuuugcccagugccaggcaagaccuauuuacaaacucauguucagucucuaggcuguuaaaugcuuugugaaagagcaagcuguaguguuugggcugcagcugggagcuuggcagagggucuuuccccgaugagguaaggggagaagcugaggacgcugcugguuugcagcuggaaacaucuuuucauggcuacuuggccagguuauaaauguacuuuccaaagagcaggcucgcugcgggaccucugcuugugugucuuggaaucgccgugcugaaaaauggugccaguugccuggugggugaauuacugucacugggacauuggcaagcuuugcaagaccuccccacagggguccagacacugcgauugccaaggccccuuuggaguucaguugagaauguccuacuuuguuuccuuuacauauuaaacauauuacaaaauuauauauuuuuaagaaauucuaauagaaugucuuauagaaagaucaagaaaacaaagauaaaaagacaaauaaaaucaugccaccaagauacaguuaaagcauaauucuuucuuacaugcauuccuacauaauuuuuuccucucaaaacauggagcauaauguauuauuggggggcuggccuuugccaggcugcuuugaucuuucuauguugauauucauacaguguuuauuguuauuuagcuuauauuaagcuacuguacaauguguaaacucuuuaguuguauuuugucuggacaaaucugaugaagaauacuucccugggugcuugcugcuagauagacuuuauucuaaacccugaggugcagcucaaugcucagccguguucuuauuuggugcuguuucauaaaaugagauuugaccaugaccaccuccuggauuguucuucauggauuccugggggcuccugggaaggcuuuuggcagcacuggcccuggccagacacgugaauucucacuuuuucuguccugggugaguacuggguguagcucugaugaagggcugacauucuccaaacuguagagagccgcuguacucaggcuaagcaccuccucucaccugacccaaguuaggugacuuuuuauaugaaaccuuucgaguucaggggcccuggggucagaagagaugaucagaugucccugcuuggaauggaagugucaguguggcagccugagaacaguuugccugggggugcccaguucucuggaccaacagggcuuucaaacccaucuccccugccaggacagggcuuugaaggcacuugguaaguugcuuccuaaagcccaugugugcuuuuuugaggcuguggauggacucaucuaagccaggcagcacauuccagagaaaggacagcuggcauucguguaguaaagaaaccugguugcucucagguauggacugugggugguauuugaaaggcaugaagaggcuuucugguuuccugacuaugcugccugauuucugacuagguagaguuguaacuggccacacagcagggagcuccaugcagcccccaauucauccagaucuggucuggucuccugcuugggcagagaaucaccccuacucugaggggcaguuggcuggcccuccacaucagagagccucccaacucuaagauuuuccuacuuuuuguguguggcauuuuugccuucucuauuuucuuugcuuuccaucugauaguaaauuuccaucugagccauuccgagacuuggcuuaguuggaacaagaagaggaagaacaggcaagguucagcugggugguggcuuuuccgcacguucugggcugcauggcuggaugggagacaugucugaaggccccacuguggacuuaggcuggcugccagugaagcuugucccagguugcugcugcgucccucagaacugugccuauuucuagucgggugagaaggcagugguuggcuucauccucaugucagcagcccagccccaguguuuugacugugugagacugagucaccuuuguauccugagcaccuagcuugcugccuggaaucucuggguuguaaguaaaugcuugugaaugaguagggaguagcuagagaaggugucucaguacagagagagccgugucugcucagaauugccacucggaggcaggugcaggcuggcagaggucaguuuuccucuucugcugucugucuacucuguacagucagcuugcuugguuacccuggccauguuaucucagguuguuuuguuuugguuugguuuugucacugucucuucucuauuaucacuuccuuauggucggaauccagguucuugaauccuuugccucuauugauauguggcaacgggaccuuucucugugugggcaacccucaguccauguacaaagggagucuccugccggaggccacuuucacguugggauaccauggccuccaucacugguuuggggagaguggagcuugcagaggugcuuccuccccuccugagaucccgaugaucuuggcaucuugggaaccaacucugugaauuggcuccuccuccauguggcucuugacgcuaaccuggcauauguauuagaaaguaagaaacacggguaggcgggaagucagguguauacauuuauaaucuuagcaacugggaggcugaggcaggaagauugugacuuccaggccauccugggcuccaaaaugagaccuugucuccaaaaagaaaaacagaauaaaacaaaaccggggcaggggccauaagugaacacaugucucugguuccauguucuggcccauccccugggugauccugaaugcuuuauuuagugacaucuuugaguguguguuuauguaugugcacggcguguauggauuugucuucucgcagggucuugguaugcaguucaggcggccuugaacuuugucccuccuaacccagucugaguuuccaggcaugcaccccccccacgucuuuccaccgugcccaccugaugacugcuccugaaugccuugcagguacugcccuuuccaguuaugaagcuccagguguugguguugguguugcugauguccugguucgguguccugagcugggugcaggcagaauucuucaccuccauugguauguggcaacagaacucuagucuaccuaagcagcccucagcuaagugcaaggggcuguugccugagguucguucagggugggauaguuuagucagugauuuugaccaguccagggagaauggaacuuacaaaggcucccccuaucccugaccccugcacccccaggagauccugaugaacaugcaucuugggaggcagcuuucugaauuggacucuccucucuggaagugcagacugcaaguagcuuucaggucuuuuucaguccuuggcaagaggccagucuaugcaaugaacauucucaguuccaaggaccagauucucuccuuuucaacugaagguuaagagcugauuuccaugugaugcgcccuuagauauccaugccccuuugacaggaccagccggcugacaaggggacaaagagauuuagaacuucuccuaaagucguucccagugcacgugcgcuuugcccaggcaucuucuugacacauugcuucuaucuuccugaagucgggggucacggcgugugaaugaauaggccccuuuaacuaccagucccugugauuccucguuuacuggcauauacugggcaggagcacucacuucuguacugguaauuuccauaagccauuccucauccauuucucacuggcccaugcuucucuccuguagggcacaugaccgaucugauuuacgcagagaaggaccugguacagucucugaaggaguacauccuuguggaggaagccaagcucgccaagauuaagagguguccaauguccuaagaccccacacuaagucaucccugcugcuccucuuccccagcccauccaagguguaagaggaagucauugagaggugaccuggggaguugaccuacaguuaacuuaugcugaguaugggggguuaggaagcuacggucuuuuaugccuucuuuuuaauuuacaugagaguucccagcucuuaccuagauuaagggcuagaaguaucuaggaaguuacuauauucauguuuuaucaucucuugaugaaagagcccuggaccucacgagggaaaugagcacccuguguggguggguguggcagucucuuuuuccuuugguuccgcagcugggccagcaagauggaagcccugaccagcagaucagcugccgaccccgagggcuaccuggcucauccugugaaugccuacaagcuggugaagcgguugaacacagacuggccugcacugggggaccuuguccuucaggaugcuucggcaggugagggacggugaacagccuggagcuguccuuguuuuguuuuaaaaguauaguaacaaucacuuccuguccuuuugucauguuucccaguaguaacauuuucuaauuauacuucaguaauacauauuuuauaacagacuucagguacguaaaauaucacauaaaaucacgauguuuaauccaauaacuccaugauaagcaccauuaaaacuauaaucucggggaauggagagauugcacagugguuaagagagcugguugcucuugccgaggauccagauuuggcucccagaaccuauauguuggcucacaaccaucuguauuuacaguucccgguaauaugaccucuuccucucaccccuggugcagacacacaugcaggcagaacucucauucauacacaaaaaauaaaccuuuaaaaucauuuuuaaaaacucuaaccuugggcuggugagguggcccagugggugaagcccuuaucauccaagugugagaacugaaguuugcauacccacaagccauguagagccaggcgagugcgucuggcaucaucccagcuccaggcaagugagucuggcaucaucccagcccucaggaggcagagaugagauuucccaggcaagcuggcuagcuagacucgcugacccaugagcucugggaucaugugggcgcuccugccucaguaaauaaauagagggugauugacgaagacaagugacuucaaauuugagcuuccauauacauucgcaugcauccguaugcacccauccacaagaaaacacacguacgcauacacguuuauaaacguucauacacaccaaaagaauccgcuuauguguacaaacauguuauuaaaaacuggagcuaugcauggccuaaaggauuaaaacucacuugcuuuaaaggaugaaugaauuaaaaauaagccaagugggcggaggcaagcuggguaacagaggcuucaucugaauauguccuacaugugucucuuacgcacaacgcaugucuguguggaauugacacaaacgugcgcucaguccugcguuucccagguucuguagaugcagcuuaagugugccugugccgugacuguaaugacgguauggucaucucguagugcaccuggaguuguuuccaauuuuucagcccucuuuuacaugcauuuugggucugccucugauuauuuuucuaagcuaaaugaccuagaaaugguauuuacagggcagagcauagauuuguuuuucugggguaguaccuucugcgagugaacacguuccuguuacccagaggagaggauaucgguaauggaagggugggcuggaggugggccacgggcuucccagccucaggcugggccgggccucuucacuucgcugagugcugauuaacuucagacuagcugucucucuggcugagacugguuacagccacgugacccgccuggguugggguuggcugggggcuggguagucucuggggagggauuggugagcucagagcggcuggagcugugccugugagcucacagccuccagaagccacugccuuucccagaccccaccccccuucacccucccuuccugggcugggccugcugcacagaacagcucagaacaggcuguucugccugcuuucuggagagguaggcaaggaagcccgcacagaugcagacaauagaucuccacgcuccgacgucugaucuugucguccccacucccuccauugccauguggaaaugcugugauuaccuggaaggugauuacacgucccgagagcaaucgcuuauuuucaucucugauguuggcugcuugccccugagauaagggggaacccugacaguaccguguggcuauuucuaggggguuuucuuuuuuccuguauacuaaagucuuccaaguuucugaccacauaucugugaaggagacgauguagcagcucuuugacacccuggcuuggugugaugagaggggauagcaggggaugcugcuacucuuggaaaggggccagggauagaauguguuggagcgccccucccaguccccaguucuuaggcaaauucaaaggccugaaucauuaguauagcaaggccuggcuucuacuuagagcccuaaaauaacaggagcugugucucuggcuugggaccagggcuuagggcccuggaaaaagccaccuggggccgcuucaggggucaaaucugucuaggcucugggcuguggccuuggguauuaggaagcucauacccugccuacugaacucuuaugugcuaaguugugugcagggcuuuuugguuccaaaugaacagcacagggagggcuaagaaaguucuguagaggagcccccagauaggacuucacaaggaaggggagugaguuauuauuguuguuucgacuauuauuuuggugucgcaccccgaaugugugccagacagguguuucaucacugagcccccagccugcugacagccuuugagggaaggcacagggaaaucucauuagccagaaaccuagguagugacuguccgcugggucaagagugaccuguguucucacugucauuuggaagguuuugucgcuaaccucucaguucagcggcaauucuuccccacugaugaggacgagucuggagcugccagagcccugaugagacuucaggacacguacaaacuggauccggacacgauuuccagaggggaacuuccagguaacacaccuccauuugcuucugucuccccgcugucuggacaggucagacugcuuagaugcgacucacuguugcuguuggugcugaucuuuuggguuuccauucggugccagucucccaugcgucaaccccuaccccaaugucuugauucagauauuagccaggaacuccccccaguguaguagagaauugaggucguagcucaggaaacucccugcgugcgcagcucacucccagaggaauguccaucugcugguggaccugcuuccaucccugagccucucagugcuuucuguccagggcugauguguaggcucacugcucauuccccauugacaucuuagucuccucccuuucauccaacccguacuucucugggcucucuccuugaguucauauacaucccccuucagccccccauuucuuguuuaugucccccuuuuccugaucucugucaucugacuuuuuaugaccucaguuuuugcccaucucuuguauuucuacucuagaucuaauguucucuugagcccaugacuucucuucuuccugcugaggcugcuggguagugauuaauuuucccugguucccacauacucuuguacccacagugcuuuuaucccuucuuucugugauccuguucuucaaacucaccaggagcacugggccaguaaagccagcugucuggcgcggaucgcuucuuucucucugguguucuagauucuggcugcuggucucugacuuuucucuuuugacucaucugauaauucauuccucugcuuuugauuguuuguucuuuaaauuggcuuuuucccccuugcuuacugcuuacugcuaguuguuaugagauuuccuggccuuaggggguggagaccaauacaaccaaggauccaauuggacuucauuaugauuuaaacaccaccucacuccuugggagccuaggggagauacagcagagaggcccacagacugucguaacugccuuccuucucagauguccuaucacugguucaucaugagcuaggcucuugguguggaggacucuccugagcugacagggaggacgcuucucuuuauuccugcuucaucagguguugggccaagcccagccgugagaccagaaugaggagggaauucugggaagcuuuuugacguguagcucugaggcauaguuggugguagaagggaacuauauccugacuguauccugccacagugaacaggccccugggugucccgaacggggccagagggcacggggaguuacuguccggaacuacucccacuggucacucugauccccuccccagcuguggugccauacacgcaugaugugcagaucugugucccuugucaaggcaugucuccugggcuuccagccaggauaagccagugccuguagacaucucuacuuggacauucuauaguuugcacaaacguuaucuguuucagauugacguucccaucugguguugcacuguuuaccaucagccuuuagcuauuaucuuaggugcaauucccaucggcagccuaagccauaaucaucuguggauucugucucuuuaaugcccucugaccuuucucauauuuccagcucacucaggauaauuuucuguguuauccacuugcguuagaugcucaggagugaccucaaagucucccuauagguggucuuugaggaccccacugccuccuuggcuuccgugccuguucucaguaucgucaucucugcuccaguacccugacccauucugggcuccuccucccugucagaaagccuuucagcacucagcuuagcuguggaggacuccacagggaguucagggagcagacacgugaguuugcuucuagggaggaugcugaguucuggaagucauucuucacauucuuggcauucacaggacauguugauuauggcugcuggucuuugacauccugaggcaacauggucauaugucaucucauugaguuuuuuggcacaagcccuuuaagacugaugcuggugucucuauuuagguagauauuauuauaucuguuuagauaggggacugagucugaggcuggaaaaauuguccagagucacacaaaugguagguauucaguaagaucuguacauccaggcuccauacaaguccagaccacagcuuguuuaucuguguuacacauccugcccauaauagauuccugagcccaaagagucaggggagauucauagagacuuguggagagaguaaaggggucccauaaguccucuaauccuuggccugccuaugacuccaucuuguauuuacucucuugacauucuaucccauguucccugagccaccgggaugaacagagcccggucucugcagcagcugccacugugcagcagggcucccuucugggaagaugccagccacacccgauagcauguaauagggagguuccuguggucugcagggagguccuaacccccuuguucugugggaucuguuauucucugagaaacauauagucuuuaccaucacaagcuucucuuaagcuccacgucucccuagagcuguugcuguuucucaaauuggaacugucucuguggucacucucuccagcagaugccccguuaggcacaaggcccgcugagcugaugcuccagugucccugucauuggugucugucaccuguccccauucccuguaucuucuuccucuuggucgcugcucaugcuacuccaucugugcccccugagguccggccucgagccuucucuuuucguuccuucuucagacucucccugcaagucacugcccucaccuguaguucucaagucaccugaauucauccauguucucuacuuucacaguuacauggccggcugccuuccaagcaccuucuuuuguguugacccacgggaccuacaccacugaccucagggcaggauuucuagacucccucucaaagccccuucccaugugagaggaguaugagccuuagacugugaacucuaacuggaacuaagccaaccuguuuauguaugcaucgaugacauuucaugguguacggcaugaaguccagguggcguucugcucggaucaugucccucuuuccgcagcccaggcuuuuucuaaagugagcaucucccuucuucagccaguaucgguucagaaccugacugcugucuuuccugcuucaggcacaaaguaccaggccaugcugaguguggacgacugcuuugggcugggccgcucagcuuacaaugaaggagacuauuaccauacugugcuguggauggagcagguacugaagcagcucgaugcuggggaggaggccacuguuaccaagucccuggugcuggacuaccugagcuaugcugucuuccaacugggugaccugcaccgugcuguggaacucacccgccgccugcucucucuugguaaggagauuaggggcuggggguagcaagggaacuugacacaccugcuugaucaucucuuggaaguguaucaguucgauuguuaaucguuacaaugugacgauugucuuaaaugauuuuuaaucaccgaguagcuucuuauacacacuccucauauuagaugccucugacauccuugugcauucauguguguagcucaugugcaugcauguucauggucaugcgugugcgagugcaugugcacaugugugcgcaccauggcacuuuuaacaauaaggagcaaggguuguggugcuuguaccacuaugcaggguggacccuucacuguguuaaucagagcuugagaagcaagcuguacuacuuccagauugcuacagugacagcagucccagcucucggugaccugaggucuaaaguaggacuuagcaugccauguguacuuuguaugucaggugaugagggacagaacaaggcccaaagcacugagucuuuaaagcuugcuaguugcaccucuuacuaauaccugggaauguuuuugucuuggguuucacggagcagcgagggcuuggcuuugucacuguuuuccaggggcccaaguguggggucagcucacaugugagcauccugcaagaccaacaaggggagagggcuuuauagauccuaucaagugaguuaguaagaggucaggacauccugguucuucuccuguguggucucaccuuacgucacugaacaucucugggacucacucagacuugucuagagagcgacacagaaauccugcuguggugguugcuucagauauugugauguccaccagagcugugacucuucuauuuuuaaauaaagaguuaugaugauauuuaauuaacuaauugugcgugugggucaguaugcaagugccacaguggaacucuagggacuugguucuuucauuucacaguguguggguccuggggaucaaacucagguugucaggcuuggcagcaagcaccuuucccugccaagcuaucuggccugccuugcagcccuucucuuucaccaguaucucagcuuguccccuaacuguagccagugugugguaugguugcuagaccaggcuacgucugaggggcaugacuuuaaauugcuacagcuaauuacagggaggaggcagaauucagaacuugaggggccuccaggagaccugagacggaauucuccccucccccuguccccaguuacuagguaaacaugcucugcuucgaugacauguuucccucaucauuggacaagaugaaggagcuguuggcucuuugguccugaguggcgugccccgguuaggugcugcagccagcaaagcauaggguacccaugggcugcugggcaagaagcagcucgcagaccaguuucuguagaugaucucacagaugucugcuguuuccuuguucccaccuuucaccuuucccagacccaagccacgaacgagcuggagggaaucugcgguacuuugaacgguuguuagaggaagaaagagggaaaucacugucaaaucagacagacgccggacuggccacccaggaaaacuuguacgagaggcccacggacuaccugccugagagggauguguacgagagccugugucgaggggagggcgugaaacuggugagaccugggaaggggcugguggucaggcuggagaucugagcgcuggcucugggcaggcaccauggaaaguuccacugccuauuuguauuuuucuccacaucugcugaggcugguaggugggcauucccugaugcacagggcaggagauugucuccuuggugcuacagggagaaguaccaaguaccauccuguagggcauuauugugugucccacucaccccagugugccuagcuaucauuugacucauugguuugaagaaaacgauggguguagaugaaccucagguccccaagguagucgucguguaaaugacauguaagaugcagugguaaacaaagacaguacuugcugggguuuguuuugagagccacagggucccagugaccuucacagcuccgcaugagggaggcucucaccuuuccuggaccccugacuggcucucaauaguuucuguguggaacggcguccccccaucaauaguccuucagacuuauucuaaucuccauggaaagggucguggagugcucucugccacaggggcuguggaaaugagugaucuucugagagaagggggagcugugugauuggggugaggucacuuccuacugagguuuucuucuguggugaagcugaaaacagucuuggucauagagggugagaccagugcaugcagacagccggucugggaccgagaguaaggacucacucugcucaggcccugugcucugugcuccgcagacaccccggaggcagaagaagcuuuucuguagguaccaucauggaaacagagugccacagcuccucaucgcccccuucaaagaggaagacgagugggacagcccacacaucgucagguacuaugaugugauguccgacgaagaaaucgagaggaucaaggagauugcuaagcccaaaguaggugucucugaggguccugcuggggcacugaauaggguggggugcagucccuccugcuaccucuauggagaaguuugucuguuccccacucucaccaauagcuagcaugaguucuuugacaugcugcagacuuaggcugaccuugaagguucguggccuacuagggaaggaaaaguugggaugcaggaggggcagacauaagcuaugacagcaggucaugcugggagcagggcaucucaguaacaaguaccaauucaccugguugaagggcuggcauauggguuguuuuuggggaaaugcauaguuccagaaaagugggaccucagagcugcagugagggggagggcugcggugagggggagggcugcggugagggggagggcugcagugaggggugaugggggaggacugcagugaugggggaggacugcagugagggggagggcugcagugagggggaggcugcagugaggggggagggcugcagugaggggugauggggaggacugcagugagggagaggauugcagugagcagugacagcugcagugaacugucugacuuggaggaggauauacauccauacaaucuggauaucccucaucuucuccauuuauucauauguuuacuuuuucaguucaaacacacuuuauacauuuuuuacuaagcuuaguaguccuugguuuguuuuugugaauuuucuucucgggaguauuuuaacugguuacauuguuauauuaguuuacuauuauaugcuaaauuauuuacaucuaucuaucuaucuaucuaucuaucuaucuaucuaucuaucuaucuaucuaucuaauguauaugaguacacuuucagacacaccagaagagggaaucagaucccguuacagaagguugugagccaccaugugguugcugggaauugaacucaggaccucuggaagagcagucagugcucuuaacugcugagccaucucuccagccccugcauauuucuuuuuuuuaacauagggucuuauguaauucaggcuggcuucaaucuaucaaucuaucuaucuaccuaucuaucuaucuaucuaucuaucuaucuaucuaucuuucuaucugaauauguggauaaccuugaacuucugacccuucugccuccacuucccaagggcuagaauuacagaauuacagaaguauaauauuauagcauuuucuacaaugcaggcaaucaaacccagggccucauguguuaagcaagcacuccuucagccgcuccaugcuccuagccugcuaugccuaacuauuuguuuugaaauguaccucauggugauaauuagaguuuauuuucccuugagaaaauggagaaaacuggccuguguggaccagaggugguagaaguuaguccuuuuuugggccgacuuucuuggguuaucucaguaggauuguccuuugcaagcaagaagauauuuugccuuccuaauacaacuccuucgccuugacugucuuauugagcugccuggaacuucuacaacauuuuugcagcagacauccuugucuuguuucugaguaucauggaaauccaacugguauuucugcuuuguaugcuuauugacuguugguuuuguauauaugucagguugauacaauuauucuuggaugccuagcccauagaugacuugaucccauuuaaucucuucugaagagaacugugggcugccauuucccccauguucucccaucacaggucauggggagggaggaguuagcuggcuccucuggucuuuguguguaguagaauuguagugacugagauggccaggacuucugcucaugagcagaccucagagguuccuguauuagccuccagaaccuuagcacagccuugguuugaagaccuagcacaucuggagacagggucuugcucaugucacagaugucaccgagagucagucuagucaacguguauagacaacuguaaccgggacucaucucacuuccugggucaguuacaaaguccucgagaaaagaaaacuauuuucuggguuucuaaccgagagaggcacugucaagccgaaaucuccagagauuccuuaccugccuuagucucagacauugaacauuucucugugugcaugugcauacaugagaagcaugaaucaggaagguggcuggcguugggacaauuguguuuugaacaggagccgugugacaagcauacacauuggccgucauucacugaccucuucuuuccggaggcuaggacagacagaugcuauucuggcuuugaaguggggccaaugagcuuagcuuggcuuguggagaaugccuggcagcugucugugaguccccagucugcuuucaaaauagccccgucuguccccagggcagaacacagcugcccaaagucuuuuuucgggcaccaggccaaugcugaggcuccaauguuugcacugucuaguggcgauggaugucaccaggcagggaugacuauccauuaggcucagagaaggaccauagccuggggaacccgucuucgcuggguaugcuggcugccaucuucacauuagaauguuaugacgcaaagugaccagaugggccaauuuacuuccuuaccacauuuccguuauggcucucuucuccaucucucuugucaccuccuguuccaggccacugccaucucuugcccugauccuuguucaagcauucuguuaguuuuuucccccauucuggucucuucugugucaccuuuccauaagguggcacaauaguccuuauauuguagccgucccaucccucccuuacauaaggcugucccuauuucagguugaccauaagauggcagcagaccucaucucuucuuccccccagccuguccucaucucacuacauccuggagccucagccuguguagccagugcccuuucaucccgggccuuccccgcugcuguaauguacaggacuccaggugccugguacccuaaccuguaccaguagaggggcacgguccuaaggaggaaggaccaggggguucagagauaaagaagauagaacaggugggcucaggaggucucgaauaagauaugucuuuugucacacagcuuuuaaagaaguuuggcaccguauauacuguuuucaggguauaagugagacagugccacugaaaagcuauccuacaguaugacaaagucagcaggaagcuaaucaggcaguguugcacaaggggaauacagggcaucagagaggagcacacaaauuugggacugacaacuauaggccccuagggugggaaggguuugguuuuaggauccaaagcuucagcuccccaaggccagggucccaggccauuacuaagcccaccaagacucagacauuccuuccacacaugagagccucagagaauaaugacuuggaucagccuggcucuccaccguacccauccacugcaauccuuuggcugcucucccacgggacauuacagcucacccgugagcuuuuaguaguaugcuacaauuaccugaccgguuuucuacugucuccacuugaccaaguuauaugauggcagacgucaugucucggucacccagcuuagcaccuggcacacaguagguaccaaucaaauaguuauuaaaagcaagagucagcaauauucuguuuggcucaucuguacuucugucuggacaugucuuccuuaccaggcccacaucaucugagcccacuaggacaguccacaccacagauaagguaucuguauccugcuguagacacgucuaucccugcuggcaguacuugcuaagccuuuauacggagacugggaacuaggguaaaggguguguguauguguguuuguguguacgugugcacauguguguauguaugguuugcccauaauggguggcuucugcacccacauacuucagauuccugcuguuuacuuuguugacucuaggagggccccaagagacuggaaacugucuccuugcugaguagugggagcccagcaaggcaggaggcacagcagacaguauuuggauagcuucuuggcagaagggugggaaaacuugaccaagucaagagaagccucagguugagucugaguguuguggaaucaucaaagcccagacuauugugugggccugucaaggaaggccuuguucagggaauauaaaugcaugaaccaagcagaguucauaagcacaacagugccggcagcauagaccugauaggugguggggguggggguggggguggggguagugagcaaggagggugugccaggccucugagcacagaggaaaguggagacuagacuauagcaucaugggaccuuggcuagagucagucucugcagccgucgcccuacugugugcccuccguguucucugggaaaacaccaacaccaagaaggauuccucucuuucucccuuucagcuugcacgagccacugugcgugaccccaagacagguguccucacuguugccagcuacagaguuuccaaaaggugaguggugggauggggugggguagcuggucaagcccaacccuggagcuucccauaggaugcaagagcaugccaaugccaccuuauccagccugcugcucugccucgcucuccguagcauuuagccuguugcccgugagugcuggccuugacugggcucagaggacaucaucuaagccuguccaugccuuucaucuuugcucuuuucuuuugcccagcuccuggcuagaggaggaugacgacccuguuguggcccgggucaaccggcggaugcaacauaucaccgggcuaacggugaagacugcagagcuauugcagguggguuggucccuggggcuggaggacuucuguugggcgagguguuuucccaaagugcuuaggcugcgagagaaggcucacccucugcauuaguuauguuccuaaugaaaggaccugacagaagccaacugacagaggggagauccgcuucggcucacagucucaguccaccauggggaggcuuagcagcgggagcuugcaacagagcuuguucacaucuugcugauucagaaaccagaggccuggccagaaccaacagaagauauaaucuucaugacccccuuaggcuagccagguuccagauuccagccuccccacacaguaccaccaacaggggaacaaaugucugcucguaugagccuugacuucauauuugcagcauccagacaaaaaacugaguguggcuaugcauuuuacugucaccccagcugcuguggagagaacacggacaggaggcuugcuggaugucagcuuaccuucagguucauugucucaagggaauaagguggagcaugauagagugaacacacgacauccuucuuuggccccugcaugcacacaccaccauauccauacaccacauacauaaagaacacacaugcacacacaaagcuuggggguugugcucaggccuagggagauggcaucccuggggagucgggcugccgcggggcuguucagacugauggcaaaugcaacgcuguaaucccucuccaggucgcaaacuacggaauggggggacaguacgaaccacacuuugacuucucaaggguaaggcuccgaucgucuuuggagggcuccucucuggcugguuugagaagguuggagcuucuagaaacauuucagcucccacggcaucccuccuccaccuaccuagugaaaggggaaauucugugcugcuggcaaagcaccugcagagcccaguggagccugguugcauccaauugaugugugggugcuuuggcuugauaauaaagucaaggacuucucuaggucccuguaaaggguuuucuugccucucccugguccccauuguuguauucugagugggguucccuguauuaccuugucccauucuugguuucucaagggaaggcaaacuugccaccuuccccugacccuuuuggucccaguccuuuggguggcgggcaaguuaguuggaaacuuggauaaaaguuguugucuguugcagcgacccuuugacagcggccucaaaacggagggcaauagguuagcgacguuucuuaacuauguaaguacugggcugggcgguuuuguucacucucacuuaauuuuauagagcgaugagcaagaugcuuucaagcguuuagggacugggaaccguguggccacguuucuaaacuacgugaguaugaugcacguaucugaugggccccguggagacccuggggccaccgggcuccguaucccacccccaucagggcucauggcaucagcugcuaauuaguggauccucggugcccuucuugccuagaguagagaggguuggcuuuuguccucaccggugugcuugucucucugcuacucccuggcuccccaccccccaacaucauuauuauuuuuagcugugguaaaaauauacauaacauaaaaauuaccaucguaacaauuuucugguguguucuggugacauuuauuaaauccaucccuaauguggaccauuuaccaucuguuacccuagcucuucucaccucguaaaauggaaacucuguuucuauuaaagaguacuuccagagucccuuacccacccccauccugcuuucugagcccacaugaaccgcaucaaaggggacgccuggaacccucugugcuuuucacugccugaugccaaguccgcucuccuaaacagaugucugugugguggcugcuucugcuucccuuugguggacacaguucuacucugagcuuuggggaugagagcccugguaggcucugucuugguggcaaagugcacgggaagcagggaggggcuuuuaaaagauaacggccucuguuugcuagugugguuggccauuuucccuccugcuaccccgcccaucuguaggcuucugcuucccuuuccccgcuggagcagcucagucuaaggaagccgagucaaggggcuuagaaaggaagcuugcuuauuccucuuuacguuuuaauuaugugcuggaggucugcccugcacacacacugcugacaagguccuauguggucuccacugcaacaucugcgauccgacuugggagacucgauagaagcaugggagagaguguuacuugguucccauggagacaaacacugacgaauuugcccaggcaugggguuuaguaaaggccucauuuaggaaauaacaugucaguuaugacuugaaagucaaauggaaauuuguggaacuuuuuuuuuuauggcaaagaggagagugugggggccuggaagagaaaaugucugagauguugggaaauggacaaagguuagugugucuggagagagaggcaggggagacugacuuggagacucucuggauuggaacccuagcacuggggaagccacuggguguugucaucuuucuuaucgugagccugcugagugccugccucuucugucagacuggugugcgccauacuggggaauuuuuagcucuagggguuucccucuuuuuuuucuuagcacuaauuuuuguuaccuuacaggccauauuuuauuauaguauaaccaaacaaaacagaaaacuaaaacaaaccaaaagcaagauaaaacaaaacaaaacccacuucaaguaaaaguguaauuuaguaccauaggagaggcagaguggcauucugggaaggugaaagucugaugagagcagcgagagccaggaaaacagccacacagggaaagggaugcuccugagguugggagccauggggagcuccugcccagagcaguggcuaagcacaguggcguaagcaaggcacggcugggugaggguucaagauggagucaaggugggcauuuauucucucuuucucccuuccuuccuuccuuccuuccuuccuuccuuccuucccccccccucucucucucugccucccucccucuccucucucucuuuucucucucuuucuuucuuucuuccuuccucccuuucuuucuuucuuucuuucuuucuuucuuucuuucuuucuuucuuucuuucuucucucucuuuucccucucucuuucucucucuuucuuuuucucucucucccucccuccccucccucccuuccuuccuuaguuucuuucuuuuucagauguauuuauaucguaugaguauuugccugcauauguguguguauguauguguguauauauauauguauguauauauauugcauguaccacgugcaugcauggugcccacaggccagaagaggacaucagaucccuugguauuggaguuacggaugguugugagccuccacaagugcucuuacauuggguuauguguaauagcagcaaacgcuguuuuuuuuuuucuuuuccaacuuuauuagguauuuucuucauuuauauuucaaaugcuaucccgaaaguccccuauacccuccucccacccugcuccccuacccacccacucccacuucuuggccaugguguuccccuguacuggggcauauaaaguuugcaaggccaaggggccucucuucccagugauggccgacuaggccaucuucuguuacauaugcagcaaaugcucuuaaccacugagaugucucucuagacgaagauagucauuuuuaaaauaggcuuggauuguucccauucaaggacagccugacuguggggcuucuggggccuuuagcucuuggacauccaaccauagagacuguccugaugaaccccacagauuuuguggugugugggaagucucucuuggcugaggauagccauagagcagagccuccaggcagagccccucagggucgccugccauccuugaccagagggaccaagcucuuugccuuauguucccagaugagcgaugucgaagcugguggugccaccgucuuuccugacuugggagcugcuauuuggcccaagaagguaagugugacucuucagggucacacguugaugcaggccucagaccuugucccugucccccagugcuauugacugucaaugugauguaccuuaauuccuucccaccugcacccugaacuucuacccagggagaagggaugguaaggaagacccuucagggcagguaguuucuaaacuuccuuccauuugaaggauagguacuuuuuaagaacuuaguuuucggagucccagagccccaucucccaaacacaggaaaggagggacauucugucaaagggugagggguucuuggagcauguccuugugaguaaucuuuagggugugcucugacagcucaucucuuucgcagggcacagcuguauucugguacaaccuucuucgcaguggggaaggugauuaucggacgagacaugcagccugcccugugcuugugggcugcaaguggggugaguggcuugagggguaguguggauagugccucaaccugguauuugaugguuggccuuaggcgcagaagcggagacgacagcuaacugcguucaguucuguucaucacaaaagguuuucucuggcuuguaccacccagccagagcuccugcaguugucugcugacacucagagaugcucagagagcugaggcagcccgggcugcaugagcaccauagguccaguguagucucuggcaaggguuuuaggggagcguagcugggaggugucuguccagggcaagcaagacuuguguggcuauaaccagcaucuuagguagcagggugggagacugacuguccuugucaccugaagaaggacaggucugagaugagacuggagccaagaggugagacuggagguugggaccagaccagagaagaugaauauuagccucauccuuuaaguugcuguggagaacuagaaacggccuagaacgugacaggaagggaccacaugcguuuagaacucuuggaguuugggcgauaaauagugauuggcucacagaaaagguaaaauaaacaaaugaaaauuuggucguugccgauucaggaggagaaagaccaguguaagucuaaucuacuaggugucgaaagcauagcacagauagucuacaugugagcacugugaguuaauaagaacuaaaguuuaucauuucgcuacauaugcuauuagucuuaagucuucuagacaguuuguuuaguuaaguacagguauuaaauuguauuuuaaaaucugucuuuaguagugcauuacuuuuaaaaauguguguguguguguguguguguguguguguguguuuguguguguguguguuuguguaagugccauggcaugugugugagggacagaggacaauuugaaacacugguuucccuccuuccaugaugugggcucugggguuuaagcucagauggagcuuauaacaggagcuauaucaucugcucugcauuacuuuuguaucccuugagagagcccauguuugaggaacacucaugguccaugccugugacauggcagggacaguguuucagcuggggugcccacagcacuaagauucugucuuguggcucacagggccugaggcucauggccaaacccugcccagugcugacagguuccugucccucaccucucaguuucuacuugucccugucccagcuucuugagguccuucacacuuaccagaguggcuccugccuuuggagacuuucucagcucacuuucugcguuuacuccacuuggaguggcagccguaugguauacccgccuucuuucugggauaacuucuguuggcuuccuguucuguuucaguacugcucucaucccuaacaucaugagaugcucuuuggcuuuguucccaugguaacuuacauacacccaccgaaucacugguuggcuucugcaccauuaucugugugcucauguauuuucaucagcacgugagcagcuugaagccugaggccguguggcacuggaguguuacccacagagcacagggcaguggucaucauggaggaagcauucguuuuggcugcuugcugaacugauaggugggauggucauguacuugcuuucuguucacagucuccaacaagugguuccaugagcgaggacaggaguucuuaagaccuuguggaacaacggaaguugauugacguccuuuucucuccgcuccucccuggcccauaguccaaaucaucuucaaguucaacaugacagcuuccuuuuuaugucccagcuccugucaggcaggucauuggaggagccaguguuugacugaauugagagaguauauccugagccuaguccugggugaccugggccccagacucugaccagcuuacaccugcccuggcucugggggugucuuggcauggcugcgguagagccagacuauagcacccggcacggugccuuuguaccucagauauuucagguagaagaugucucagugaaaccaaaguucugaugcuguuuacauguguguuuuuaucacauuucuauuuguuguggcuuuaaccaaaaaauaaaaauguuccugccagaagccuuaaauagccuua

SEQ ID NO: 5998 - RNA, 2225 nt, Mus musculus
ccauuuguucaaaguuauuuauuuccacaagggacaaaugaacauggccccagucuuccuuggaauuuucuuuggagaaacuccuccucagcuaaaacagauauacucacaucacagaaggcaauaaauaaauaaauacauaaauacauaaauaaauagccuuaauggaauaaaauaggaacauaauuagguaaagccaaaggagaguuguaaauuucagaaaguagauaaauugauaagacauuugauggcauaaaggaauguaaaauccuuuugaccaugggccaugaggaacauucagacuuuaggugcucugccugcuguuuuaacauuccacgguuccacgguuaggagagacggagccagaugcgggcugagguggucuagagguuagcacugucuccagaucguuaagguggaccauguagaaucucaguuucuuccgaaagucauccagaucucgaaugaagaccccuggcagcugugaggaaccagaaaagaaggcauuagaugugaacauguugcugcgggccacagcaaacuauaagucuggucaugggcaagggcacagccugcuaaacacgugggggaagggcagcuuaccgcagagucauucgcagauguaggcaggcaacaguuaaguuucuguggagagacaccaaggcauagucagaucccuccuaaaguggagaaggcccuacuuuccucuccaaaaaugcugggaaagguaaaggcacggagccccaccccccacccccaacccucugcagcuccacacaccugaagauuggacuugauaacguaucuguccucaggauccacuucuccuuggcuuuccacgaauuuggacagguuuacucuccgaaagcucuuauucuaagagggcaagaaaucuuuauguaaggcccagggaugugagagcugggaggugagaacuggaaaugaaagagcuugggaguugagagccagggagaugagauccagagaggugagagccagggaggugagaacuggaaaggaaagagcuggggaggugagaguugggaagugagagcuggagagaucagagcuagggaagugugccugcuauuugagauuucuuugaacagccuuauuccugucccuucauuauccuggggcuaaaagcuaguguauaucucagacaagggccuguuucucccaagcaccaggucuuaacuccuggcagccugugagcugugugaaggaucuaagcagauuugucuguacuugaggaaaacacaucccuccagaaaagcucuagaaaaggcagaagguuggccaaggaaaauaccaagaugccaaaaacccaggccaaugcuuuaauuuaauuaagaauuucucgauaccuagaagaaaauccuauaggcuccaacauguuccuagggaggggaaauauagacauucagcacucuugcaaagaacuucauguuagguccaaacaaauaaaaacaagacauaacuauuguaucaaacuaggaaaauaacuacaaauaguaaugucuggggcuggcggaaguagaaaacacaaacuucaguuuuggaggaggaagaaaagcaaaagacacaaaagucacagagggcaauggcauccccacugaaaguggagccagaggccugcagcaggcaggguucacccacagcugucuucauuguauauccuaaaagguaacuuucauuauugcagcugacugagguauauacugaggcuugagagucaucugaugauuuccuuaauaaccccacugagauagaugcaaaaauggaagcaaggcaucguggagugauggcugaagucacccaggcaggagauagauggaacccaagaauaucccaaagcagggcucuuacccucagagaggguccuucaucaucaguuuugaguucagguuccugugaggacauagaaagaaagaaucaugaggcucacuggcuugaggcaccuguuggagccggccugcaccaggccaaccucagccaguuacucacugggagcuucccuauaaucuccuugacaauagagcugcaauucaacguucugguuaaacgguggguaucccggccacugauugaagcuuggagucccagguggaagagcaucaggagcaggagcagcaugguguggaugcuggugguagagcuggcaagaaccauugucucguucugguccuccaagggguucugaagaagccacaggagccuucacc

SEQ ID NO: 5999 - RNA, 80065 nt, Mus musculus
ugaagugacuaauuucugucauaugacugaggcgcccauggggguggcgggguggcgguaggagcggggggccuccugcgagcucccagccgagcgaccccagucuugcggcggccagcauggcccccacccuguuccagaagcucuucagcaagcggagcggauuaggcgcgccgggacgagacgcccgcgacccggacugcgcguucaggugaggcgucgcgggcccccgaggggucgcggccucgggcggggcgugcgguccccugcccucuucgcuaggcuguuuaugccccgcccgcgccacgcgccgcguccccagccccagcacggcggccucgggaggcugucgguccgcacgcugcccgggcugcgaccucaccgcaggccuccggggcccggccgggagcugcugucucccugugauccgcagcccucggguggcuuugugcagacugucgcgcguucggccaaccugcggagcacugaggaggcuggaggagcgagugggcaggcuggcggucugucaggcuucuuggaaacuaaaauuggagcugugcaguucucuugccgagcgaccuuaguguuaucgaaggagaaaugcgaaaccgaagugguuaggguuacuacugaccagacucgaggaggacuugcgguagaacuuacugucgaauuuucuuucccuucuuacaccuguuacugaaaaggaguuucuugcaaauggaaaacgguagcuguguguguguguguguguguguguguguguguuuguuugugauugcaugcuuuguuucuuucugauugcaguaccuguugcugguacaguaacuuuuuagaauugucagauauauagaagcuuagcucaaugguuaaauucagccguggaauuguauuugaagaagauauuguuuugucuuccauaaugcgcuauggaaacuuucgcauguaacuaggccaaaugucacauaucagacaaacuuggcuguauggccgagaacucaguuguacaguaauaguaaaagggaaacagugucaaauuuugcagcaagcccaaguaucagaugacugcacuacauaagucuuagaggcuuuaauauuuuucaaauuauccacgcugucaauaauacagaucccaucaggaaacaaugugugagauugaauaucaaauggcaaguaauuuaacugauauuuaaugggagaaaaaggucaguuaccguuuuggaaacaagcuuaacaaaagaauuuucauggcaguggcuuuucuucguaaugggaaguaaaugucuugugccguagucaucugacaguuguuuuuccuuugaaaagcgaaagugcagauaacaccagauaauacaccgggacaccuaggaaaaccagagacccgggaagcagccucuggagagagauuuaaaagauaacauuugaauagaccacuguuucuauuucugugcagagacugacuuuggguaaccaagauuacaagagucucaauuuguuaaugugaccaaaaucuacuuuuugaguaaguguucuauaugguuguguaagacuuuacugcugccaaagaacuuucccaucaguuaucucauuucacaguaaccuugugagauagagcaaguagcaauguagagaugacuuuauaauccuuuuuccagcguggaagcccaauaccugcaguucaucgugaaaacuugcuuugaaaacaagauguguacaaguguaaugugagaaaaugagaauucuggaucacauaccuagugacuugagaucuaauuaauccagcuuuuaaaauuuccuugauauauaauuaaaauacaauaaaagaugaauacacggggaagguuacugucccaugagggcugacagacaaacacaguuuauacucagcacuccacugaaccuucacaaccauucguucugucagcuugugcucccuccuuuuccacaguccuuaacccccuuucacccaagaacaauuuggucugcuuucuuuuguuauauuuuggcuuuuugaacauuucauauaaaugugauuuuaugacuuccauagccacaugucuggcuucuuuuuacccacaauaauguuuauugagauguaucuacgauguugccuuuuuaguaguuccauucaucuuuuaaguaggugauuuauuguacagauauagcauaccuuuuguuuuugcucuugggcucucucgcucucucucucucccucucucucauguguauuuauucuuuugcgugugugcacgcgugugcucgcugaauuugauguuacuuggacugaccuuccaucuuacuuauugagucagggucuuguagucaaacccagagguuccuaugauucugaucuugcuacccagcuugcucuggcaaaccaucuugcuuugccuuaauggaccuggacugacaagugacagggaaugcccuccuggcauuucuggauuucuggggaucugaacucccaguccucacacuugcugggcgagcacuuuaaccauuuggucaucuguccaacucacaauuuguuuauucacuccucagauaaaagauacuugagcaauucuucugugaauauuuguguauagaucuuuaauuagaaauaauuuuuguuucuucuggguauagauacugagcaguagagcugcuggcucaugugcagaguuuuauuuaauuuuuuaaaaaguucccaaacuucuucaaacauacuuguuuuauaguugcaguagcaauauauuaagguuacuuuuauaacagaucucuucaguauuuuagauuacccuuuaaaaaguuaauacauuuuuauugugauaagaaacauaacuaucuuaaccaauuagacauuuaauuuaaauguuauuucuugcucucucucucucucucucucucucucucucucucucucuguguguguguguguguguguguguguaggaugugugaggggcguacaugagccacaguguauuugugaagguccgagggcaacccugugaaugaauucaaccuuuccaugaauucugggaaugaucacuaagcuuguguggcaaguaccuuuaaccucugagccaucucacuagccccuaauaauuuuuuuagucuuuauuuauaacuauuaugggguauauaguaauauugcauuguuuucauuuuugccuuagguguuggccaaaauuuuuuuuuuuaaugugaccggaguuuggagugauugaaauuguauguguguaugcaguagucaguuugacugaccaaaauuuauguguguuugugcaugugagcauaaguucacaugcuagucagcuuauauuguuaagucacuuuuuggaaaaauauuuauuuuaugugcauguguguuuugccuucauauguaugcagugccuucugaaaaggacaugaauuucacagaacuggaguuacagauaguuguuaguuguuguguaggugauagaaaucaaaccugaguccucuggaagagcugcuagagcucuuaaccucugagccaucucuccagcuccuuaaauuguuaaaucacacaaaggcacagacauuggcaacuaccuauuuccaagaggcaguuuuuagagcaaucaguguacaaggcccaguagugguuagccauagaggcacuuuguuauaggagauacauuugacaaagaagccauaaauauguuucuauauugucuuuuauggcuaacccauuagaaaagauagccaggaacugcugccuuucugcuauuuuucaaucuuaggauggucccuacuaaacagaguccugugggcuugcuucaucuguuucuugaacuggagaugagcuuaggauauuuuucagacacuuguagaacgauauuuuuuucuuuugagaggaggcuuuacuauuuuguucaagcuggccucaguugaacugacuucaaagucagucuuccugccuucguccagaggaagggauuacagaccuaugccaccaugcccagagucauuauagaauggaaauggcaauuuauuuaggucaucuaaagaauuugagaaugaaggcacuguuuagaagauuuugcuuuguauucuuuccauuaagcauuuuaaaauggaaguaaaaaauugcauguaaauccaguaacuguauucaugugaaaaggguugcuuuaacuauuuuugucuuaaaaaacuaacuuggugaagaagguuauuuuaaguguuuauaagaaauaauuauucaaaagagaguuuucuguguuuuuguuauuuuugcuguuacugugaugaaacaccaugaccaaagcuacuuggggaggaaaggguuuauucagugcaugcuuccacaugacaguucaucaucaaaggaaaucagagcaggaaccuggaggcaggagccacugaggaguacugcuugcuggcuugcuccaugaggaguacugcuugcuggcuugcuccaugaggaguacugcuugcuccaugaggaguacugcuugcuggcuugcuccaugaggaguacugcuugcuggcuugcuccaugaggaguacugcuugcuggcuugcuccaugaggaguacugcuugcuggcuugcuccaugaggaguacugcuugcucagccuacuuucuuauagaacccaggaccaccagucuggggauggcaucacacacagugggcuggguuucccccaucaaucacuaagaaaaggcucuacaggcuugccuacagccugaucuuauggaggcauuuucuuaauugacguuccuucucucagaugacuuuagcuugugucaaguugacauaaaacuaucuagcacaguuagaaacauuuaccccuauugucuguagcaggaauuuuguugcuaacucccucuucauggaucuuucugcauguccuucuugacuuucuccaagcuaaauuaaucucagcacuuuauaguuuaaaaaaagaagguaggggaguugaguuguaggugauguauuugaccugcauuuagagucuuaucccagugauauuuguugguauagauagcuuugggaaauaucaugcaaugauuaaagguuucuuuguucugcuugauuuucaaauugaguucuaaguguucaauugcaaaguccucaggcuucauucuuuuuaucaucaugaagucuuagaugcagugcugcuagcucuuucugacaucacuucuuggagcagacagacuguaguccaaauuuucuagcaaaaguuuuagagaaucugugcuguuaauauaaccagugaaauuacccaugauuggcccaguugccuuagaccuuaagcagugccgaggcugguggaguuuuccugauugugguaguauacccgcagcuaguauacuagcaggucucacaccaaguguagcugagauaccaccuuuuacccccaaacccuuguuccccagauuccucccucccucuccuccuacuccucuucccucuuccauguuucucuuuuuguuauuugauuuuggaguuuucaagguucgacugagaaauguccuccauaggcucaggcauuugaacgugugauccccaggugcuggugcuguuuggggagguuuaagaggguaagccugcuggaggagguacaucccugagggugcccacuaacaguucucucucugcuuugugcuuguuaaagaggugauaguugagcuuccugcugcugcugcuguaccugcugcuuauugacuugcuuaccugccaugauggccucuuuacucucuggaacaguaaauacaaacucuucuauaaguguaugucuugugguauuuuaucagagcaacagcagaagaacuaauauaaguuugcuucuuuauuuuguuuguuuuuagacaggcuagccuggaacauguauuacuaaucaauccuuuugucucugaauauuuccaacucuccccucucccaaagcacugagguuacaagugaaugcugcagcuuccagcuuuuuaccugagugguagggguugaacugagggccauaugugugcacaacaggcacuuacccaacugagucaucuccucgccuucauacuuuccuuuaaagcuuuagaacagggaauagcgauccauaccuauaaucacaucauucaagaggcagaggcaaaggcaagaggauuccugcagauuugaggcccagcugaucuacauugugaauucuaggccagccagggcuacauaguaagacccaguuucagaauauaaaacaaaaaguguaauagaauuuguguuucuccuuuucccuucuucuccuuuucuucuucucaagcuggagauggguuccuaguccucacacauauuaggacagagccacaucccuaguccucugcuguucccuucuugugauguaauugcauucccugguguccauauccucacuagauuucaaguuguauaagggcauagccucuaauugguuuacuuuuggugccuggcuuaagaagauagucacuaaauaaugaaugaaaaaaaguaacuguugaaauauauugcauguaugaaugaaauucucaaacuauaaaaaauuaagaaauaaaaacauuuuaaauuauggaauuaaaaaaguuuucauuuaguuaaaauuauuccuacuuauuugcuugauaauauuggauaaaugauuuaagcaaguuuuucuuugauauuguuuacuaauuuaaagaaaauuuucauuauuuuucuuuuuuaggauaaggauagccccauuuguuggaauugauugugcuaccuucuacuaugccucccauaacaauuagaguaguauaauaguguauuuccugaugucaucccugacauccgguauugaugacugaguaaaagaaugcuaauuuagaguuuaaaaacacauaagguuuuuacaaacauucccccccccccuuuuaaacauucuugacccuuaggccuaguaugguugucaagugaaccuuuuggggagcuggagcagaaccuggcuuuggaaggacaccuccagagcuccagggaccuguuuccuuguaugcucacugccugauacagaguguccucugacacaguagcauucuauuccaagccauuccaaaugugguuggcugugucaugugcuucuccuaccucucuaauuguagagguuggagugacagcauugaaucaaaauuuguagaugagaugaugaacucagauuauacaauugaugcuguauuuggaggauaggacuuugagguuguuggccuuuuuuuuuuuaacauaaguuucuuuauaaucuguauauaauuuuuaaagguuuccauuuuuaucaggaaaaugcaccuugugaaguuaaugagguaaaucaaauguagccucuucacacaagccucauggauaugcuauuaguuuuuauauuuuggguuuauccuuaguuuagauguguaguuuuagaagccacaacuacauaacuauaagaaugcagaauagaauagaaauuguuuuuugucaaagaaacaagauuuugcaaaccuaaaaauuaauucuuuuauguuugcuuggcagucugaugguuauaggauucuaaagugaaggaagggccagagagaugauucagucaguaaagugcuugucaccuaaucaugaggaccugaguucauguacacucaagacucauguaaaaaccuggccucagugccauuugcuuguaauaccaucauuggugagauggagacaggaaggccccgcaggauaguggaauaaucagugagccuccgguucagaagaccguuaucucaaaaacucagguagaacucuauugaggaagacacccagugccaaccucuggccaaccacauaucacaugcacaaaacucuaaaucuaaauaaaaaucauuuuaauuuagaaauuugaagauauuacucuugucuuauggcuuccaauauuguagcugagaaaucacaaaagauacaggauuuuuauaaauuuucuuucuaauaauucagaauaaucuaauuugaguuuuguuuggagauuucuacagauuaauacugauacucaucuuuucugucuggaggcaucucauucuagggaauguucuuacaugauuuucacaauuucaucacuuuuuuggauuugguuguucauaagauuuucaaggggagcuuccuuuauggaaacccuauuggguuucucguuuuguuuuguuuucccccaauuucuuccccuaccccuucucucucucagcuuuuggagacaagauuucucuguguaaccuuaacuguccuggagcucuguagaacagguuggccuugauccaccugccuuagccuuacaguacugacugggauuaaaggccugcaccaccacugcccagccuucuuccugauuucugucagaucaccuuuacauuguacuucuagaauuuuucguaaauauuauuuguagugaauuaugcaaguguuuuaaauucaacuaucaaauuuuuaauuuccaaggaccugcuuuuacaagcuucuuucucuccuuaaugaccucgaaugugauguuugacauuuucuaaagcaaagacauaucuguucugugugaaggcugaugcuaacacagaauaaagaagucaaacuugacaguagauacccaccacccaugcauuuucuuuuuaccuaguuugcuaauguagaguccuugcauugcuaaaccauaccugaaaauccaaagagaggauuuuauuuaagcuuguuuauuuugccgugcuggggauugaccucaauauagaguaggcagccacuguaacauugcuacacccccagcccaguuugugaacauuuugauaaagucauagucuuuuuuuuuuuuuaagguuauauuggacaugguaaugucuauuaucucagcacucaggagccccugucuccacaagaaagcuguaaccuguaacagaguuguaauuuaaagcuucuacaacaguaugcuauuuacuauaaauuguaaugugggauacuuaaaaaaaauuuuuuuucaagauacauuaaguucugaaagauuagaaacaaaggguuaagaaaagauaucuaaacacacacacacaaaaaagaaaguagauuuaguuauagcauauaaagcagaaaaaacaaaaacauuaguuaugguaaauacaguuuuauuugcuagucaguuacagcauguuuuagaacuacacaaaacagccuaguguggaggcccaugucuuaaucacaacacuuccauuacucuggagucagaggcgagaugauuucucucaguucuaggacuaccagagguacauagagaaaauucaucugaaaacaaaaagaaccaaaauaaauaaaauaaaaacacauaaaacaaaauggauaaaaaugacauguuuauuauuaugauaggugauuuugacauauuucuucuacuuauugaagaucaaguagcagaaaaguggagacuacaaauuacuucagagcugggcaugguaaugcucaggcucaaaaaccaacaaguaacaaaacucuuaaaaacuaaaaaccauuuauuugauguaauauacaugcaugaguugaguguucuacuuaauguuagaaaaacaaauccaaagaaaauagaauuaguaaagcuguaagagucaaauuaaugaacuaggaaugauugcauaggagagaauuaaaagaacaaaaaaagaaacuaaaaauuauuuguuuaaaauagaugaaccuguccccuucccccagagaucaagcuuagguauaaauaaucacaauuuuaaauguaaccuuuuuacaaaucugaaagguaagagaacauuguuaacauuuaaauuucuaaauuaaguauauugggaaugggguaugucuaccagagugcaggugccaaggaaaaugggaacuggagcuccaauuacaggugguugugagcugcuuaauguggguucugggauacaaauucaggucucuugcagaacaguugugcucugaacugccgagccaucuuuccagccucuguuguuaauauuugucauaucaguuaguauauaugugccaagcagaauuuuaaggauuguagagaauuguacucauuuacuuacuacucaagacaacuaaacaaacuaaauaauagcuccucauguuauagaugaaggagcucaucagagacauuucagaaauuauauaaucuucccagugccuaagacaguguuuuucaaccuggcuaaugcugugacuguuuaauacaguuccucauguuguagugaucccaaccauaaaauuauuuucauugcuacuuuauaacuuuauuuuugccacuguuaugaaucauaauguuuuaagaccaucauaaucuguuuucugauggucuuagguuacccccccccccgaaagggucacuuuacccuuccaacaaaagagucaugacccacagguugagaacuguuggccuaacaggugucuggagagagggggugagggagggaaagggaacagaggagaggagaggagggguggacagagaaagcacaugcacacuacauaguuggaacauggcuuguccuuucugaaaugccugcuggaguuuaaucaguauuuuggcauauuguaaggauagaauuuaacccaacuaugguuuuagaggcguggccuuaagaaggugauuagaauauuagauaagaucaucagucuggaggcuacaugauuaaacuuuuuuuuuuuuuuuuuuuuuuuugguuuuucaagacaggguuucucuguauagccccuggcuguccuggaacucacuuuguagaccaggcuggccucgaacucagaaauccgccugccucugccuccgccucccgagugcugggauuaaaggcgugcgccaccacgcccggcuaugauuaaacuuuuaagaagagaaagaaaauaucaaaggagauacauucugucuauuguccuguacugccuuggggcucugcccacaagaacccuauuauuaccugaacugugaacuuaaauaagccuuuuucuuuauaguuuacccaguaaaauuucgauguuuuuuucuuucucuguaaagugaaauaaaacuuauuuguuagaaggauuuuuagucuaacauucuuucauuuugaacuguauguuaccguuauuuauuaaaggagaaagacuauaugauuauuugaaaaaagauuuauuugauaaaacucagcuuuuguuuguuguaaaaagaaaaaaguuuuuagcaaauuuagaaggauguuuucuuaacauuggauagauuaaaugugucugccaauacuacagccaacuuaauuugggaaagagugcugcauacauugacauuagcucgcaaagaccaaaauuuuggacuaguaccagauauuagcaagaauguggagugacgagaacacuugcauauuccuuaugggaguauaaauugguacaaggacuuuaggaaguaaguuaucuaucuggccuuuuuagugaaguagaaaaaguucauauccuuuggcuagauguuccaagacaauuauuucuugcaggauuuucauauacauuucuguuauuucccaacucugggauacugucacaguaugacuguggcuauaaauaccauucacuuguuuugugucuagaccuaagaugggaaggguagugugaguucuucaugccaucaccucuggaaacaguccaaucccuaacaccuuugugaaggaaguugccuuagagggcaacagagccuacaguagaccuuaaaucagaaggaaaccuuguauuaagcucuuguuuaguuucuuuuccucuucaucccuuucuuccucugguccugucuuuugucauguucuggcuaguuuauuucaauacacacuccccuguguguauuguaguaaagaaacuuucauucagugaucaggagguauaugugaagaauguugacaagaacgcauaugaugugguuucuagguuguagaguaguucuuucagaaaaggagggagagucauugucucuagagucuuagaaaccagcuaaauggcucuaaugacuuggggguauuaaguauuuucuucuuuucugauaaauuggucaggaaaugcuuuggauuuauauacuuuucccuuauggaauagaaauuuggcuucucauuuuuaugacugcuaccuuauuuuggucuuguuuuacuuuugcacuauaguaggucucugggaaucauuguaucuuacaaauacacccagggacugaugcuauacuucagugguaaagugaaaaacuaaacaauaacaacuucccccuccaaauaugcaaaccagucgaccuuaauccccaacuccuccuuuuauccugccuguauccugcuguaauuaccccagagccaggaauaauacaacuuaggaucuucagccauacucuagagacugcugaaguuacucaagcuagccagccuugccuuacuuuacuuaguccauucucccccauugaagccauuaaagggacuggccacuuuucuucucugugucuuaccuucuaacccacccuggcacuuuauuugccaaauguggaaagugauauaccucuuuuuuuuuuuuuuuuuuuuuuugagaauuccugaguauaaaccuuuuccuuuauuauagucaguuuugugucuacaucgccauccuaacuuuacuuaaguugaaacaauuucccaguauauuuuacaguaguauacauuggggcuucagagauggcccagucuguaauuugcuugccucacaaacgugaggauugagauugacccucagcaaccuugaaaauguuuggaacuguggugcguuuguauuccuagugccaggacagccaggugggugccaggacagccaggugggugccaggacagccaggugggugccaggacagccaggugggugccaggacagccaggugggugccaggacagccaggugggugccaggacagccaggugggcggauggaucccugggcuggauggugaucucuaagccagugagagaccugucucaaagaaggcaaacaguauuacugaggaugacacagguuguccuuuguccuccacaugcaucacacauguguucaugcaugccaggaaacacaaccccacauacaagugaacaaacacacacauaugcauuuuaaaaauguguaacaacuacugcagucauaacaggauugauuuacuuccaaagugccccauacuccuuuguaguuaauaaucacuucugauuuucccccaagaaaaucucuggucugcuuucucagucacuguagauuaauuuuaucuaucuaaaauuucauguaauaaaauuuuauguauucuuuguguauguuucuuuuacuuuuaauagucaugaaaaaauacucagucuuucuugcacuuccuauuauaaaauuuaauucuuccuguucauccagcaccauuucuuugaaagaugucaucuauuucuuagcccuuuaaccgcaugucuuauauugauaugucacaguuuagagggaguuuucuggggccuuuacagaggaaauaaugaguugucacguuaucauuagguaauaauuaugcauaauuuuaaaauggagaaauugagagauuuuugcuuuucuaguuaaagcacaauauaugauguauauaagauguuuaguaguaagauugcuugcuuuagaacuuaaccucaauccaaaacaagaucuuuagccccaaggaaccuagcaucuaauggcugagauucuguggauauuuuaaaagaguacauagugcuuuucuuccuagagugaaucacgguggcccucuuuacaaauccuuuggauuauccucucugaauucaucucagucuucuaggguagucuuuuggcaugugacugauuuggucuguaggucuuuaaggugguuuugaggugccacucuaguaacaugggcauaucuguugaaauaguuagcucagauugaauuuauaggucauaagguagguauaaguccaggacuuuaucagcuccugcuacaucauuaucauuaucgucauuauuauuauuauuauuauuauuauuauuauuauuauuauuauuugagaccaguuuaggcuauacaggcauggcucaccugaaauucagugucuaguucaggcuagucccaaaccuggggaaauccccugccuauucuccuaaguuaacugcaauaaacuaaacaguucaguagcauuugguauauucacaauguaaaguaacuguccucuuaucuaguuacaaacauuuuuguuagugcaaaguaaaacuucaagugcauccagggguuucucuuuuucuuccccucaaagcacccugguaacuaccaaucuccauucucuggauuuacccauuuuggauauuauauaaacauggaaucuugugaccuuuuaugucuugacuuuccuuugaaugacuucacuguucauucguguuguagcauguaucagugcuuuacuucuguaguugaauguucuauuauguucuguauaagucuguauauacccagucacuggugaauauugggacaacuuucuuucuaccuucugguuuuugugacuggugcuacuaugaacaugcauguacauacuuugacuagaguugugugaauguugcacaugaccagaugcauagaguuacuaacuaucaccagugauguugaacaacuccagugccauaaauaaaucucugaugcuaccauccaucuuuuaaauagauuucuugcuuaccucuagcuguuguaacuacuggccucuucucuggcuucauagcagcagacaaguuuagauaguauuuucucuagagcuuggguuuccuuaaguauuauagcaggugucucagaaguuacauuuuuggauugguaauaauguccuacaaauaaguuagacauuuuuauaauuaaguauuuacugaauuuaguuuuuucacauuaauuuuaaauauauauacaacuaaaauuacuggcauauguuguagaaauuuuuaaucccaaucuggggcuucuacccugccuuugaucauucauuucccagguaaaagacacacaacuuuuauuauuuacaauaagccuuaaucaguacuagagcugggcagauaucuacccucuauacuauuagaauuuacuuuccuauggauagcccugaguuauuaucuauuucguuucaucugggcugcucuucaauuggugagcugucagggccaugcuuucuggauuccuaauccauggugucuuuucuccuccucugucuucuucucucucccuucguggucuucuucacaucaaggccaggaacaucaagucuugucuaucucaaaucugcucaacuauaggcuguaggcaucuuuauuuaccaaucagaaauaacuugggggcaaggucacaaagugucacuugggucuacauguggacucuucucucaucucuggggcaaccaggucucaggaguccacauuacaauauguagcaacagaccaaaugucaucaugcauaaaaauucagauuuaacuaaaaaacagaaauaacuagcaauaauauuauccucaggcauuuuacaaguccagcauaaaaauguuaugauuaacuaauuagguuggauuuuuuuaauuaauuauuucuuagccuuacuauuuuguuacauguggguaagauccuuugagaguuuauauuuucuuucugcugaauucuccaguugaauaccuggucaugucuucacauuuuaacuuaaaauuucagaggaaagauuguuuagcuuucugaaggcauagcaugaacaaucaaauaacuguuugcaggaaaacagccucguugucuucugguaccaguuggucuuaugucgacuugucuucugucuccuaucuuauuuguaguaguuuggaaugagaaacacacacuaauaauguuuuacugcagcuuagcuaugcauuagaaucuuucuugcuuuuuuaacuugggcuucugagaaacugauaguuuacauaggucaaauccauuguaauucuuuaauauagaaaucauagauccuguauggaaauguucuuguuuguucugauacugauaauauaugugauauucuaaauuaugacuuaguugaauauaguuugugauccucagagguuacugagugcauaaguaaauguuuauuauuaucacauauuuggcucucuagaucccuuccucaagaaaagugcuucccuuaggcgaaugcuuaauucagguggcuguuccuuaaaauauuucugauuuauacuaaaaauuauuggucucgaagaaauuugcaaguccuuaaaauuauauugacaauuucaguuguauaccaauucuuguuuugguguucaguagcuguuuaacucaucagcaugcagaaccaaguguuggggcacuauauuucauacaaggaggaaaugaccuucgugaugugaaucgaguacucuuguaguaacagaaagccaugugaguuuucaaaaagaaaaucuuaacaaaauguaauagaaaaauaugaaaugagucagaugaguaacucuaagauguaugguuuucaaguuagccuguucuucaaagucucaccccuaagacuugcuuggugguguuagcaccaaggagaaaccacagcuggcauauugccuuuaugcuguuugaaaaaugacucuuuguuuucaagaauguaaaggagugguagaucuauuuuaaaaacugaugucuaggaaaggguuuugcuugcuuuuacacuaaaauauuuucuuaaguauuauacaguuuuuacccaaauguaaacaguuaaauuaugaagaggaaaaaagcaucaucccaacauagaaauuauaacuaggacaaaaacggcauuacagaaagaaggaaagcccauuucuuagagcagaggacauuccauuguuacauuuuaagaaaugacuuacaguuauuaugcuuuacaguuuauuaacauagauucauguuugaagaauuugauaugaaauaguaauauagagaaggaaaaugagagaauggaagggaaaaaaaagcuaaucugaaagaaaaacagaaauggcacaccugaaaaaggaggauaucuuucugucugucugucugucugucugucugucugucugucugucuguuuaagcauggucucuuuccgugccauuggcugaccuggaacucacagagauuauucugucucuaucucccgaaguugggaugaaagaccugugaaccacaauggcugagaauaccuuuuuuauuuauuuauuuuuuuaauuauauaaccuuacugaaaaccauguuuguaaagcaagcuaaaaucuauuugaauuaccugugaagacagcaggaaaucuuuuguuucaaacaaauuuuuuguuuauucagaaguaguuuuaacauagaucuaaaugccagugguacagagaaaggugggggaggaucagaaaggaggaagggaaaaagauauagaucagaaucauuugaauuuacuuuucuuuuuacuagcuuaaauuuccaaacuaccauuaagaaucaguguugagccaaggguauauauauggauuauuggagggcauuugccuaucguguuuaaggaucucugagauuaauuuccaguaccacaaaauuaauuacucaauuuaaaaauuaagcuuuuuuuuuuuuuuuuuuuuugcaaccaucccaaauuuauagucuuccuucacacugugucucuagcuugucucuuggcuagacacauauuuucucuguggaauccuaucagagaauggcauucuuaauugguuucccuauaaacuauuuuuuugguguccugguaaacccauacugcuucucagauaaaagcauuuaaauauuuuuaaauuaagacuauuaguagugugauuauuuuauucuauacauggaaguguuuuaccuguauguauguauguuaugucugggcaccauauccuggugccauugaaguucaggagagaaugugcagacccacuaagacuggaguaacagaugauugugagccaccauguagguacuaggaaucuagugcuuuuaacccuugaaccauaucuccaaccccuguuuuauaaauucuuagaauauacaaaggauuaugagaaaaacacauuguauugaaaauauaugaucauuuucuagguagcugcgucuaauaucacagucagucaguauguggcagagaagauuuaaaucuaauuucugcugauccagaacccauucuuaaguuucugccauguuagguguggauaaucauuuuuggucucagcauauugucucuuacuuagauuguaaguaaauagucuguuguauuaggcacuuguguugcuauauuagucuuauuagcguacacauauacagagauauccuuuggcuuguggaagaacaugccaauaaauguuaaaacauaacccuacugaaaaaccauguuuguaaaacaagcuaaaagugucucuuuugugaacuagcaagguaauuuaacauggugauuuuauugaaguuuauaguuccauacucagauuuguuuguuuguuuguuuguuuguuugcuugcuuguuugcuuguuugcuugcuugcuugcuugcuugccugcuuccauuucucccucucuucauauauccccguggaagaacaaucagacugagcuaagguuucauaaaugauaaguggcaguaccacugggcugcgucucuauaaagucaguauuuucugcuagacucgucaucuuagcacugugauuaauagagcuuauuuuucauuugcugguuagcaguauagauagcuucuaagaguuugugcaugggcacacagaaauugaaaagaacuuuuuccauuuuuuuuuguuuguuuacaaaguaaauaugaauuccuuauaaguguugaacuucugaagagcuuuguuguagcuaugguugccugagcccugugcucagggcagcuuuuacugaguggaaagcacuauacauaaagugacccuagaaauuccacuauuaugaggcauggugcccaggugguggcacuauuuuggagguggggccuagcuagaggacacaggcaagaagggugcgcucuccguugguaucuucugccucucaccacccuuuccucucccuuucccccucuccuucccuacuuuuguuuuuuucuccuuuaccucuuuccuagucucuucucuuccuuguucuucccuuuuccucucccuucucucuuuccuucucuuucucccauuuucauucuccucucuucucuccuuuuuacuuaucuuuugucuguuuuuuauuuuucugauuucaugaaguaaagaaccacuucuuuacucuugcacaaacauuaacagcaaacacuaaacauugucggcauucuuggucugcgcccagcugccagguagggcuuaauuuacaaggauguuuagauugauuucuuuuuuucauacacuuugugguagaagagaugaaagaaaguaccaaguuacucugagaaaucccacuuucagugaaacaaaaaagugauguuacuuacaaaacuguagaaauagauagaugaagccauuugcaaaaguggguuuugucguugacaugaaaccccuuaaagacuccuagcgccugccccaugguucuguugcuaggauuuuacuuuuuguauugcugcacacagagucuuuuugaguuaaauucauucuuguuauaucagcugacacuuuuguuguuuuagaugaauauaguucaacguuauuauuaaccuggcuuggaaguuguacauaacuggaguuuuuagugauucugccaaguggaauugccuaagagaaauaagaugccaguaauguacagcuuaauucaagauguuauuuuaaaauauguuaagaaaaaaaucacccuaugucuaguucuaaacuuggugauucaguuguuuuaaaaugcauggagagaaaaauuuaaaugcuggcacucgaucauuaauaauuuuacuugaagaauuuaucuuuuauuuauuggagacaggccuuaauauauggcccuggugagccuggaacugacuauguagcucaggcuggccucaaauuauuaauccucucauguucacuuagggagcacauauacuaauauuggaaagauauagagaaaagauuagugugacccugcacaaagaugacaugccauuuuuugaagcauuccaauauuuuuucuuauugggacuggcuucaucuagaaucaaguuuuuaaaaaggggaacccauauguucuucugagacaaaagcuguucauugugugagaaaugagugaacucagcugauuagagucacacuguggaaguuucuauuuuacuugcaguugguaaccaagaguguagauauuucuucagaggggcaggcuuaaauaacggaguaaauauuugggauauaaagcuuaauucuauaagugcuuaccucuccccaacuuuguggaauugaugauauuucauuugauuuuuuuuugcauuauuuuauaguaccuaaaaguaaagauauuuuuaaaauuuggugaugauggagaguuuugauaaauccugauguugaucuaacugaaguuggcaaauguguuuuuauauaugcuaagaauuucuaauucugggacacaacgaugaaaugacuauugguugaaaaauucuaaucaugggaaacaggaggaaagaccugagggccagcagaaugaaugaaaauaugcaaucucagggggugggaugcugggggacccucuagaaaguaucagagaccugggagguaagagacucuugggacucaaagggagggaccuuaauuaaaaugccuaaaaguggggagagggaacuuguagaguccaccuccaguagaaagacagggcaucaaguggagggaugggguugucauuccacagucaaaaacucugacccagaauuauuccugucuaaaagaacugcagggacuaaaaaggagaagagacugagggaaaggcgguccagugaauggcccaacuugggauccacuucaaggagaggcuucaagaugugacacuauuacugaugcuauggugugcuuacagacaggagccuagcauggcugaccucugugaggcccaacaaguagcugacugaaacagaugcagauacuuaacacccagucaauugucugaagucggggaccccugugguugaauuagggaaagacuagaagcagcugaggagaugggugacccccauagggaagaccagcaguuucaacuaacccagaccccugagaucucucagacacugagccaccaaucaggcagcauacaugaguugguaugagcaccccaagggccccccacaccucucacacucauauacaucagaggacugccuggucugaccucaguaggagaagacauaccuaacccuugagagacuugaagccccagggaguggggaggccuggugggucugggguugggguggggugggaaugcccucuuggagaccgggguaaggaagaaugagcugaggaacugaaggagggcacacagggaaggguauaaugguuggauuauacaagauaaaagcaauuaaaaauuauuuaaaaaaauaaaaauucuaaucauuucaaaaguuauuuguagauaaauucugacucauuuuaguuaauguuaagagugcuagguaaaauacauauauuggggcaaaucaugcuuuguaaauguauuaauuuucuguagcaauuuuuggccuaacagaacucuuucuuuuuggguaguaacuugaauccaauagccccuuuccuguuuuuguaucucugguaugcauucaaggagcaaaaggccagcccaauaagugugcucuguuaguuguaaaaugcuuauaugaccuuucucuaguauuaggacaacuaucaggaagaaauggacuuuaguagauauguaauuauaguuuugggauugccuuugugcugggauuuucacuuauauuccaauuuuaaucauuaucuuuauaggauaaaacaucagaaugaucucucuccccagcauaaaaaccacuugauuuuuggcggaagcuauuuucauuuaauucuugaucuauuuaaaaguaacugguuucacaaaaagcuuccauugcuaaaugauaaaaugguauucuuaugccauuuauccaaaguuguauguuuuuucacuuguuggugaaauuguuuuuugauugacaaaguauuuauugaagacucauucugugccaucaaucacaauaugucauauaaugaaauguuggauaaauauugauaaaauagauuauuuuggaauuugagccuagugagcuuagaaguuaaaaaguguaaaagcuagaauguaugaucggaucaaaugaaugcaguuuugcugaacucaacauguuaaacugcuuugaguaguuaaaaagaugaaugccaaugugcaaggcaaucuaggccaccuaguuuuuaugcagaauauuuuucuuaagauuauuuguagaugguaauaaauuaguguuuuuauuaagccaagucugauuuucaguuuaauuuuuuuaagguacuacuuuauacagaaguuaaauccacacuguagaaauuccccuaaagggcuuaaaauaucuuuaggaagauaauauauuuagaaauucugguugcccaugcuuuaccucagacuuauucauaugugccauuaacugguaccuugcucuguggcauugcucagaggcugcauuaggauagguauuaacuuuacuuacgaugcuccacgugcaaucuaccucugcuuuauggcaggcagggauuuauuuguaauaaaugaauggcaaaggauguuagaguaucgaaacauuuuuugaauggguuaucuuuuaaugaccacuauauacaaaacuaauuaaaucauuguuaaaaaauucuaaauccucucugcuucagccuccugaaugcugagauagaugugaaauaugcuaccuuucugagcuugaagaauguugacaauguuuuagacagguguauuuaaaauauguaauuuguaaauauuacaaauuaguucuagguucaugaguguuuuacuaauuuucugcuguucauuguuuuccuuucucauuauauuuguacgggaagacugcauauauuuggaaagucauguguuuguauauauaacauaugaauguauuuauaaguaacuuuaaauaacacauuaugcuaguauauugguuacaauccaguuauuuacauaccaaauguuguuuuuuaaauuuuauugcuguggaccugaauuuaucugauuuuaauuaagguucuauuguauuccuuaucacauccauuuuucuuaguaguacuugggcauuugugucacugugguaaggauuucuacuguuaacaaaaucaccuuguuaaguacuucuuuugaugcuuuugcuucuuugucuucauuuucucaucauuaucuggaucuuuuguaucccaggcuggccuugaacccagggaaaaugaccuuuaguuuccaaucuuuugccuccagagaacuaugauuacagguauaggcuacuuuacugggcuuauaaaguacuuuaugcaagcagccagacaaacaagauauauaguccauuuauuuguugguugguuuguuuuucugagacaggaucucauuuuguaacaggcuggccuugaacucacuagguagcccagguuggcuucaaacucuaggcaauccacaugucucagucuccuaaaugcuacaaucauacauguggucuacuauaccgugcuaaucauuuguuugaugcaaggauggucaguaagaauuaggaaaccaagcagcuuuuccauguuauauugcuaccauuugagaaagcuguagacucaccuuuuucaccauuuaaaaagcuccuggccaaaaguaacacucaauaggcauuaugguugaucugucuguguuccaggaauuggauucucauguacuuuauuuguucagccuaguguuucagugagugugguagagcuucuaaacugauaaucagcugcugcuuugcuaaagaacuuuggagaucuaauuggggcugaaaauuaaguccuugucaacuguaaaaaggaacagggcuacaaaacaaacaagcaaacaaaaaaagguacagaucauuaaaguauagucucagagaaguauuugauuucugaaacuaaucuggagaaaucaaaacuuuuuuuuuuuuuuuuuuuugguuuuucgagacaggguuucucuguauagucuuggcuguccugaaacucacuuuguagaccaggcuggcuucgaacucagaaauccgccugucucugccucccaagugcgggauuaaaggcaugugccaccaccggcaaaacauuuuuuuuuuuaugaaguuugcuuucucaacaaggugcaggggcuaguagauugaugguuuuuacagauguuauuuuauuuuauacuauguucuaguauguuuuaaauauaauuagucagauguuuuguuuaggguuuacugcugugaagagauaccaugaccaaggcaacuuuuuucucuucucuuucucuuucucuuucucuuucucuuucucuuucucuuucucuuucucuuucucuuucucuuucucuuucucuuucucuuucucuuucucuuucucuuucucucucucucucucucucucucucucucucucuuucucuuucucuucuuuucuuuuuugguuuuucgagacaggguuugucugucuagucuuggcuguccuggaacucacucuguagaucucaaacucagaaauccgccugccucugccucccaagugcugggauuaaaggcgugcaccaccaccgccccgcccaagacaacucuuauaaggacaacauuuaaauggggcugacuuacagcuccauuaucaucaaggugggaagcauggugguauacagguagacacguuguugguaaaugagcugagaguucuauacaucuucaucugaaggcugcuaagagaauacugacuuccaggcagcuaggaugagggccuuaaagcccaugcccacagugacacacuuccucuaacaaggccacaccuauucuaacaaggccacaccuccuaauagugccacucccugggccaagcauauucaaaccaccacaucaggcaucucuuugauguuuuuuguuugguugguuuuuguuuguuuguuuguuuugguaaaauucuguauuuacagauuucacaauuuauaccaacuuccauuacaguaaagaggauugggagcuacagagacagugucugcgcaaucaaaggaaaccgcuggcauugcuuucuuugcuucagucagggccaucuggccacaguuccucagauagugaaguccucuuuuuacuugcugucacuuuuguuauccuuuaaauuuugggucucauuuuguagcccaagcuggacacaaauuugcgacucagcuuggucuucaaucuaauugucccuuugcuuucucacuuuuuaaguccuauaccuuaguucagacaacccaccucauauaugcuucuugcuuuucagauaaaacaaaaaugaccaccuucaaauaacuauuuuguuccuucaaccauguacaucuguaguaauuuuccuuuguaggucauuuuccuugaccucauuaaauauauuauauaguucauuaggaacuuuccugcuuagaaugcuuuguugugacuuuucuggaacauugauuugccaguuucucuagcuacauuuaaguuauuuuucuauucuuucucuuaauuuagaaauguaaaccuuaaaaauguuuguuuccccuuuauauauuccugcacauuucauaucugcauaccuuugucuuuuaagagaaaagccucauaaucuuaccuguucuggcugccuaggugaccauaggucuuaguucaagauaaucccaguuucuuccugacuacauagauacacauacauacauacauaccuuuuaauuccaaaccaugccguuuaaauggugaguuaaaucacccaugguucuugggucaucaucuuucacagaggaucugcuuagaauccuaaauacuuggugcccuucuucuuagcccuuuuuguucacuguuacuugacuauccccccuauccacugauaaccccaccaaauggcugaguuggucuuuauaaaauuuagccuuuguguaacacuugguucugugcacugcugccuuccuugucuuccuugacauuugaaagcaauguacugugagguuuucuuccucucugguggccugucuguacugaucguuauccucacugucuuuuuagcaccuugaccauuaugccuccguucuucucuuagcucagagucucacuauuuucuaauuuaggcuccaguaugcauaguuucugcuguauucuugcaguuuucugcuccaucuucagcguuuuucuuuuucucccauuuguuugucaaaauccuuuacccugucucugccugauucaaagucaaacacccugagagcuuucuagaaagagcaaggcaguuuguggccaaucauagucucaauaauugucagcuguguguaggcuuagagcaucgcucaaaagucuuacuguuccuaaucaacacuucuucccagagaacaccaugcuccuuuuuacccuccucucuucccagucuaaugcaagaguuauuuuuauucuucacuugguacuugccaaaggcugagaagccaguucuugagcuaauucuuuaguuuucacuucacuacuuccucaaaggccugcaauuuccucucuaccucgaacugccucagaguguaaacacauccacauauuuccucuuaguaacaaaauacccaucacucuuggcuuucaaugccuuuccuuucuugacaguugacuuuuuccccccuucaguucugugaaaucuuacuccuuaaaacuuuccucacuuugaucaccaaugauguuucugaaaguggugaaugcuuuuuaguuucugagguuauacuccuuccuuagaacauuucagucgguuccaugaaaccacuucuugauuuucaaccuaaguuggucuguucucuauaguuuuauaaguaccuuccuguguuaugcaagucaguguugucuuaaggauagauaucugcuugagcuugguauguagggucacacuucuaucaguuuucaacagcaacauuauucuuuuaaauugugacacuuaaugcacaaauaaaggucuguaaaacaaaugcaguauguuuuuuuccaaauauuuuuugugaacugaaaaauguacuucagcaaugucuugaugagauggaauuagccucgauccacccagcaugccccuuccugguguucuuugaugcauccuuguccuuugagguaagcacuuugcacacuuuagggcugucaguguccuccucuucccuucacugucuuguccacuuuuuccacuuccuuuccugaguacauugagaguaaguagcaggcugggcagugacuagagaguugcuugcagcuuacuauucuuucuuuuucugcaauuuuaaauucuuagacugaaacuugcuagguuuuaacauuuauuuaaaugaaaaugcaguagcuuuuugugugccuguuuuacucauaaucucuguuuugaccuauugcaaaccuguuucuauuuuuguacuuuuguguugaagaaaaaauaaaaugacuuaaucuuaugucaucucuccaugagaccaacauauuuuuauuaguaauuugugcuuauauuuaaccuuuauauauguuagccuuuuauauaaguugacuaucuuauauguugauaguagcuaauuguuuuuuuaaauuguacccuuauuuuuaauuuaaaaaucagaccuauauaauuauuuaaagccuugacccacauaguagcauuuuacauaaagauuaguuguauauucuucuguaauaauacagcuucugggucugucagauaagauuuugguuauaagaauauauguggcauauuuauuaaaauaacucaaaugaauccuuuuuuuuuuucccaaguuggcccuugccagaauuugacccaagucagauucgacugaucguauaucaagacugugaaagacgagggagaaauguauuguuugacuccaguguuaagagaaaaaaugaggacacaucaguaucggugagcaucauugaucauuuguuugaaacuuaaucuugcguauuuuaauaauucaagaaaggauuaguauaauuucaauaugguaacuuuguuaguauaaaacaucuuuagucuguucugaauucagaguccuaauuucgagauuuuuuucuuuuuuauuuccuuuuauugaaaauaaacuuuuuuuuucauauauccugguuaugguuucccauacucuacuccuuucaguuuguccccaccgcccuucucaaccagauccacccuuuuucugccucucauuauaaaagaacaagcuucuaagagauaauuaugauacgauaaauuuauaauuuaaaguaacacauuggaauaggacaaaacaaacgaacagaaggaaaagaacccaaggaaaggcacaagaaacagauauagauguggagauccacuugaucucacacuugggcaucucauaaaaagaguaaacuggaaacacacacaaaggacuucuagggcuaagaggagaaaaaggagagagauuauagaauguauagaauauuauauauacauauauaauaaagauaaaaaaccuuugacauuaugagacagagaaccuccaaagaugccacugaggucauuuuucucuuagcuaucuauccaaugcggggcauuuagccuaucguuaagcuguuuguuucccuagugagacuccuuuggagaaaucuaaauuuucauuugcaagugguuaucaacuggagauaguuucuagauuagggaugggaacauguguccacuucuccuuucagcuuuaggaccccaucuggugcauacccauggagacccuguguaugcuuuuucaguauuugugaguuccuguguguguugacccuguugauuuacagugcuuuguuuucuugguguauuccauccucucuggcuuuuuacauuuuuacaucuccucuucugcagggaucccugaucccugaggggagggcuuugauggggacauccauucguggcuuaguguuccaagaucucuuccucucuauauugucuggcuaucagucucuauuuguucccuuuugcugcaggaagaagguuuucuuaugauggcugagcaaggcaccaaucuaauagagcaaaaugagauuuggagucaaauuuugaauuacugcauucuuucaguagaauaguaguauuugguuuuacucuaggucucugggcugucuagucucagguucuuggucacucaagcaguguuggauauggguaguaugaaaacuuacuauaguagaagcuuccuaaaauaaguacauauauaaugggggagacagagcuccaacuggauaucucuugucaccaaaugaagcuuccaguacuaggaauagguuauauuccauugaguuguuggccaaaagggucccacgggaacucccaaacaacccaggcuguugucagaacuauagguuguucuucacaaacugauggcaaggccccagugcugaagauaacaccuacacaacucacugagcauggagaaguagagcuggugccuauauagagccuucacccaauguacuagaaucugauguguuuauaaaaagagaaagagagagggaauauguucuaucggaggggagggggaugagguauggggaaggggaugucucagcgggcccaugccgaggcaucccuucccccagagggaccagccacacgacaguauaguauagaauagaguuuauucagggcauggggaggggagcuaagaagguaguagaggcaaagagagggaaggaguagagaaacagaggcuggucacauggagagagggggaagagaauaggggaggggggaaagggaagagcccaaagggcaagagaggaacugagagcaagggaacaagagagggaggagggggcaaguugccccuuuuauagugggccaggccuaccuggcuguugcuagguaacugugggguggagcauaccugacuguuaccagauaacuguggagguggaguuuagauagaaugcuaacaguggcuuugauaagggaagggaagauauccuaaaugcuaccaaagaagaaauguaaacaccaacccuaguacaaacccuuugaccuauacugaucccugucugaagauaagcuggagcgaugguggcacaaagcuugagcgaguaaaaaauuucauuuaagguccacuccguggguugguuuuuuuuuuuuguuuuuuguuuucuuuaagacaacuugcauuauuugucaucagucuagccagaaacuguuuuguuucacauuuauauccuuauauuagugauucucaaucugugugucacaaccccuuugggggucaaaugcucuuucacaggggucgccugagaucuucagaaaacacaggcauuuacauuacaauucauaacaguagcaaaauuacaaguaugaaguaaugauaguaauuuuaugguuggggugucaccacaacauaaggaucuguacuaaagggucacagcauuaggaaaguuaagcacuagugccuuacaugaugaugguguuauacaugaccuaggaacuacugggagccuucagagaaucugguuagaccucucauugagcaaucagggaaagugagacuuagagaagagaaaaauuuaucugaugggauaaagcaaauuaagucuauaauccugauaacauacuuuguccuauauuaaaguggaggcaagaaccuguauccauucugcaaaucuguaacacuguguuuuguacauuguuacuaguuuaguagcaauaagauauuuacuugguuggcaaggagagccuaguguuaguuacugccauuagauaguaagagaaaaacaguaugcccugguccuagaauggguuuugccuucucuuuagguuggcacuuucuaccagcauuccaauaaccaacugaaaacaauacuuugggggaaguuuuuccuaucagguggguuuuguuguuuuuguguuuuuuagaauuggguucauuugagauuuuugccuucuugggaaaaaaaaaaaaaacuugaauaggucugucuugguccauugucuuuuuuacaagugucuuuagcaacuacuauaguagcauuuaauaagguauucaucucuuuuuuaauuacuaacuuuuacaguauugcuuuuaaucauuaagauuuucaaccuccuugagauugugcuuuguuuagauuguuuuucucuuuucuuacauuucaucaucugaaaaagauuaaguuacuuaagaguguauaaaauacuaaguaagcacuuggagauuuucugugcccucucaguuuccauaguuagucauccuauuagggcagguagauacugaauaaauaaauauacacauaauucuaaauugugaaaauacugugaagaaagcuuacugaauacuuaauaagcugccaacaggaaagaaccaaguuuccaucaaacugagugacaguccuuuauggagggcuuacugaaaaaguuuaaaauaaaaacugaaaugggaagaaauagcaguugaaaagucugcaggaugaugugggagcuugaccugugaacugaacugccgauuuccuggcagcgcagaugggauuugcuccaaaguaccauuucuaaacagguucacuuccccuguauccuaauaaccuuucuuucucacuaccuuugguggguggugggcuagaagggagguuaaagcguuuaagaacuguuaguaaaaggaggccuuugagaaauauaaaacuaccugggugcuguucccacugaugagaugcuucugcauuaugaccaaaggacauuccagagucuguaacuccuaauaccaucccuucagggacucauauuuuaacauuaauuuaggagagauauaguauucauacuccaugacccuucucuguaucuguucuuugucacuucuuagugucuacuaaugccucucucuguuaggcuauccuuggugucuguuuuuaguguucuaucuccucuuaguuucuucuuuugagugaucuuuccaugaaguaucuuuguuucugucucugaauguuccagaguaaucugucuguuggccuuauuacaauguuauacacuuagugcucaaccuuuuucuuccccucaauagccuugguuaucuccuuuccacuacuacuguauggcucuggcuguccuagaacucacucuguagaccaugcuggccucaaacuaggaucuaccugucucugucucccaagugcuggggauaaaggugugcaccaaacaucuggcuugaaaagauacuuuucugaacaaaacugacagcaucacugcuauaugggcauaagcacaauuuuuugaaaagugguuugaugauacguuuauuuagcaaaacaauaguaguagguuccuagcuagagacagagcuaccagggcaugagcuuucaaccagguuauaguacuagccaugaauucacuucuguggaacagaccucaaaucuaaccagaaagcaguugguuaucccuguaaucuuuaugucacuguuguaccagugaguacauauugcccagcaggucaguauuguagcauucaggguccacugcugaguaagaccacuuccuccacagaagacugcauagcaccuucugcaauaugaaaacuagccaucagggaggaaguuuucaggucaauuuuaaauugauuucucuaugucuugcaaccaaaguguguuauaucuuuaguaauacagucuuacaucuaaguaugguuggcaaccaagaauaauggcaauagcuuuauuguuuugaagaccacuagggccucuuugaccaaacacucagggugguggcccaugccugacacugaaauuuucauuuaauaaacccuguguuagcauuguccaccaauguaagacuuguguucagacacuuucaaguuuuuguuuuguuuuguuuuguuuuaguucuuugagagugucauacaacauauuuggaucauauucauacuuucuuccccaacucuucccagaucaacccuucucccuauguacccaacuugguaucacuuaaaaaauauucuucaauaccaauuugugcuguccaaaaauuuuuaaauguguggucuucuacuguggcauggucaacuuguuaggggcugggcuauacucuuagagaaagcuguuucuacccucacccccagccgccgcuacuaauaguugccaguaucucuacagcuaggggugggauugugugcccaacuccccucucuauucugugauucauucuggcuugggcuugcacagguuuuguauguguuauuuugaccaccgugugucauaugugcagcugcccuucugugucugugucuaguucauguuuccuuguagucaucuguaccucuggcuccuuacccuguucaaccucuuuacugcaaugaugucugaaucuuagggagugaaguauauauguuuccuuagagcuaaacauucucuuacucucugcaucuugguuaauuguagaucacugugcuaauuacuguaacaaauagaaguuucucauguaaggguugagagauguguugauauaaugauacaucauuaggaguaaguuuaauaguauguuuauauagcagcauaauaguaauugguucucccuugagucuaugaccuguugagcuauaaguuuuagacuuggugauuaugcuagguauggguuuuaucuuguggaguaugacuuaaaucugaccguaaagugguugguuacuaucauguugaugccacuauugcaccagcacacauguccuuguagaccaauuauucuugugguuugcaggguucauagcugagauugaugauuacuuugcuccucuaguagcuugcauagcacuuuuuaguacuguggaagguagcuaauaggacuaaagcugucaggucuguuccagcuugguaucaccauguucuaugauaaaauuggaugcauuguuuucuguaggcuuagauuuuucaaaaccuacauuaauaaggguucugaaaugcuuuggcccccuccccuuccagcccaccauccaaagggagggggaaaaagaugguaaguagaacaagggaauguggaccuguuuaaaaguuguucucugggacgauuccaaucuccauuugucaguccaguucaguagugucaggauaucaacaguccaguucaaaaguguaccaaacaugaaucagcaaugguggcaugauccagcagaaacugccaggccucugccaaauuggccugaaucagcaggagcgaccaggaccagacggaaugccaggagagaccaaugaagaguugcacagcuagcuaugcaagugccccaucacuguccauugagucccauuuacucuauccaaauaucacguguccucccacaggucuugccucaacaaaacaugugaaucuggaucacaugaagcaaccagaaacuucuacuucaguuuucagcaguaggaucuuauguaaaguucuagaauauaaucaagaccaguggcaauagccaguaauguuugaagaccucuggaaccucacugaaaacaacuccaaaaggacaaacccauaccuggcgauggguuuuuauauaagcuucuucuggugucuaguuaggggcaguguugccuuguuuaagcauuuuucuguguguguguguguguguguguguguguguguguguguguguguguguaaacuucuacaauaguagguuuccacaugucuuuuuugaaaagccuuuaguguuccuuaucccuccccauacucccucuucuaucuuacccuccacuuccugaccccaguuuaacccuuucuguucuauuauucacuuaaacauuuuaugccauuguguucugucuccccuuccuugacagcccuuuccuguggucccuuagcaauuuccuggccuuuguggauauuccaaaugaauauucaaagcuuaaaucuacaaaugagagacaaaaaaaugauguuuuuucuuucugaguuaccuuacucagaaugauuuauuuccagcuccagcuauuuuucuggucuauguguaugugugugucuguguguauuuuaaacccacaaauauaaauaaacccaccaaaugucuauaaaacuaugcuuauguaucuacauguauacacacacauguacuuucaagcucuguccauuuagagaauguagggagaauccaauauaguaaacauaucuagcaucuaagugauuuuuuucuaaguucuuuuauucaccaaaaugagucagaucuucuuagagaaaucuguggacagggacaagaaaauuugguaggggcagcuuaagaugguuaagauacaguacaacauuuaaguaguucgguugacugacuggucucugaccugccucugccucccaaguccugggauuaaaggcaugugccaccccuuccuggcuguuuuuguauuuuacuggcaacauucuguuaguaaguaauaagauuauuaagauauaaccaaggacuugggaggcagaggcaggcggauuucuaaguucgaggccagccugguauacagagugaguuccaggacagccaggcgauacagagaacccugucuccaaaaaaaaaaaaaaaaaaaaaaaccaaaaaacaaaaaacaagcaaacaaacaaaaaauauauaaccaagggcagguuuaguugauauccaucagaggccugcucuuuucugaagggaaauggaggaugaguggaacugggggagagggaaguuggggggguugaauuaugaagaguugaaggaggggaacugcagucaggauauaauuaauguaugagagaauaaaaaauaagauaugggcaaggauaccaauacuaaacagcauuaaaagaauuuaaauaaaauaauaaauauauaauaauaaaaauuaaaauaucuaaugagguccuugacuucaauuauguuugcuacaucaaacaucaguaaguuuguuaguucuccagacuauuauaauuagaaaugucacaaguaucauuaugguuucucuucccguuccacagauuaaaaaacagauuuagagaccucaaacaaccucuucauaggauuugaacuuaucauaucuacucaaaagcucuaaagcccuuuucucuuuugcuugaaacauuugauugcagaugauguggaaguuucucuuccuuauuuuaaagugccuuuggugauaaugcaacuauaaaauacuuacuccagagauuugcaguuuuauucugauugcuucuucuggaaaucugaggucuuguacaugguagaaugaacauacuugaaacugauaaagcauugaaguauuuuuuaguggugucacuaaguggaccauaacuuugauaguugugaacaacaaucaaaggguucagugggaauggagaagagaggaaaaggaaugaagucaaagaaaugcguccuggggcuggaaagaugggcccagaguugaaagugcuuguugcuuuugcagaggacuaagguuuuguucccaacaccuauguagcagcucacaagcauccuuaauuacagauccagggaaucuaacaccaccuuuuggcuucaugggcaucaggcacacauaucguguauaagcauacaugucagcaaaacacaaauauaugugaaaguauacaucuuuuaaaaaagugagccuuucaucuaguucuaccugauagcauaauuaucuaaauuuaaaauguauucuuuaucuguucuucacaugaauacauuuaauuuuagaagauucaacaugggacuggguuuguagcccagugguagaaugugugccuaucaugcacacgccccugugcucaggcccagagcugccuuuuccauacacaaaagauuaacagauagaugaaucuauaauaaaaauguaagucuacuuuacauuucuccuuccucauagacuacaugguuaauuuuuuuucauaacaguaauguuuguuaacuuguaacauguuauuguuauacuuaauugaaauagacauuuuaaacuuccuuagcuuuaauuucuaauauaagauaaugauuaaauaaaacucauaaaccaaagucccuugacauuugcaauaauuuaugaguauaaagaaguuuugaaaguaaauaauuugaaaaucacuauggauuacuaagucacaauuaaugaauauuauuuuggccauauaauacagaaaaucccuguuguuugauaauauuggugagaaaaaaugcacuccaaauaguacuggaggugcggcguuggugguauaguagugagcauagcugccuuccaaauauuacuggaggaaauagagaaaaauagcauauaaaaguugcauuauuuuuaauuaucucaucguuuuuucaacuuuuuuauauugcuuuuaaguuuauauauacuaaaagaauguauuggguuauuaauggaaguauccuguguuuuagaagcucuguaaugaugcucaagucaaggucuuugggaagugcugccagcugaagccaggaggagauaguucuuccucuuuggauagcucuaucacuuuaucuucugauggaaaagaccagugucccaaauaccagguaagaucacugauuuauucauuuacaaguuauuuucaucacuuuccuagggaucaguuuauaguagcaacuugacuguaccucccugaagcguaauuguagcuguagagauggauacauuuacuaaacaaguaaguuuuaagaauuuaagaauaagaaaauacagagguuaugguauugguggcagauauuuucuccaucuuuauauuuuauugaauacccagaauaucuuauuuuuguaccccuuuauuaaauaauaaaucaacacaguuugcccauuaauuaaaguguaauuauaaagauaaaaugcauaucuuuguuuuuuacaaguaacuggauuuaaaauuuuuuuuuaggauguaagauuaaauuaaucaguagcuacauagaaacuuguauauaagcuuacuacaugaaauaagaucaauucaguuucauacuaaguucaugucagcugcugugaauuuaugucaucuaaagguuaugaaaaucagacagacuuuguauuuaguaguacuaaauagacucuuggucauuguguuuauaagagaugaugcucuuggauagaaauuuaacuuuguaugccaucaguaaggcauaauguaaaaggauucugaaaugacuaagaucugcauguuaggagguaauucucaguuacacucugccuuccucucguuuuaccuuuacguuaggcauaacaccuuaacaaguaccugacaacaguaauaugccauauagcuccuauauaacagaaaauuaugagauauuuucuaauuuguuaaguuguacaaagauuguagauaaaaaagguaguuauugauuauaaucucauuuuguaucagaaucccacaacguacacuuuuuaaaaaacaaaaaacaaaagcauucaguuauacuugauaaauuagauaaaauaugaucucuaggaauuugaauauuaucuuugaauuacuaccaggagugaguagcuggaaugaguagacccuuuaaagaaagcaucuaaaagacagcagugauagcagcacuuuguuaauucuaugaccucauuguggauugucuuaccugaaaauauauaacagugucugauauucacguuaaccauuugguauauguuauagcagacugguuuuuaaaauuaauuuauuuacuuacaacccaaaugcugcuacucaaccugguccaaccaucacagggucccuccucccacccccucaccuugccucugagaagguggacaccccccuguguaucccccuacucugacacaucaagucucugcaggauuaggcauauccucucuuaggcacaucuccugcauaaugugcuggggccuuuguccagcccuuccucuuuuuuugguggcuuacuuucugagagcucucggggguucagguuaguugacacuauagggcagacaaugaauuuuaauaucaaauuauaugauuuuuauuagauuaucuccauggaaugcuuaauugaacuauaaaugaggauuagucacagacuaugaauuguuuuccuuucauaaccagucuggagucaugugaugcaugggauuuucugacuugaagauguauguccucagaaaaaguccagaauucccuuaucuuucaauuucauuagauauauaauguguucuguugcccccccccaaaaauagcaacuccauuucuugugaucugcauuugaauuucauugaccaauucuuuaaaguauaugugagucaguaguucugaaaauugcuacuccaaaauugccacuccuagaccaucuuacaucagugagugagaguaugaaauaacauuccuuucaguugggcacauugaugucuuagaacaaacugggcuucagaaauuaaauagagagggcugcuaacacagcuuagggaauacagguacuugcuguucaagcugaguucccuucccaggacccacauaguggaaggagagaauugagucccaaauguuguccugggacuucuacuuuugugcuauagcaugauguauccacaaacaaccacacguaaauaauaaauaauauuuuuaagacagggucucacuauauaaccucggcuagcuuggaacucuauguagacuauauagucuucagacuuagagagaugguccacccuaccuccugagugcugggaguaaaggccugcaccaccggcuacauuuauuuuuaaauugagcagagaguacuuuguauuaguaguuagugauguuugccauggugcauaaauacuaacaaaauggauauuugauuuuuuuagugauuuuauaauucugguggcagcaauuaggguacaauaucaaguucuuugaagaaaaaagacauuucuaauauuugaaguaaaucuuuucguugucuccuaagugcugggaucaucauaccuagcuuaagucuuuuucuuaacuaaacuuuuaguauagaaugcuuuguuuguucuugacuauagauaugauguugugcagcagaucucaagaguuuauuuucaguuucuugacuggagcuuaaugcccauugauuaguaauguuucauuucaccuuugcuaagguccuggggacuaucaauucuguucuuuggcuccaugaauuugacuuucuuagauaccucauagaaguggaaguguauacaauacuuaacuuucuaugaugaccuuguuucauuuaguuucauuuaguuugcugcccuuaagaaucaucuguggaggccuggagagaugccucaguuguuaagaacacuugcuguucuuccagaggaccaggguuuaauucgcagcacuuaaauguuggcuuacaacuaacuaucuguaacuccaaucacaugggaucugaugcccucuucuggcuuccagugguaucacacauuuauguggugcacagauguacaugcaggcaaaagauacuuaaaaaugauauaacuuuuaaaguauauaaaagauuuauuuaugauaaugcauacucaaaaauguuucucucaggcugaaauauauuccacuauauguauacuauauguauauauacuucauuuucuuugucauuuuuuuuuuuauaaaccaccuugagguaguuuuuaugcauguuauguagagucugguuuuauuuuuugcauaugaauauccagccuucccagcagcauuucuuaaagagacuuuccuuaguacuuaucuugaagaucaguugacuguguugguauggauauauuucugggucucuggucccauuccauugauuuguuuaucuuucuguuggccccauacuguuuuguuuacuauagauuuauauuauauucugaaaucuguuugugugauaacuucagcuuuauuguuuucuuucaaggauaauuucacuauuugugaucuuuuuaaaauauuauuuuagaauguuuuucuguguuuguaaacaaguaucauuaaaucuauagauuacaagugaccuuuuuuaaaaaaaaucaugauaguuauaaauugcucuauuuguguuugcuucuuugccauaauggaaguaguaaaaacuauacugucugcucuacccuuguuaccuacuggagaaauguuauauauauauauauauauauauauauauauauauauauauauauauauauggguaagacaugaugcacauguugaguuuggauuagcaagauggcuuagcagguaaaggcauuggucaccaggcuucacagccuaaauucaaucccuagacccacaugauggaaaggaccaacaugugcaagauaugacccccgcucaugugcacuaugcacauccacuuuuguacaugaguaauuguacaaaaaaguuuauuugaaguuuuaauuauuuuuaguaccaauauccuauuagugaccuaaauacuccuuaguaauuggucugaccuguugaaguauguuauuuuuuuaaagacuuauuuacuuuuauuuuaugugugugaguguuuuaccaagauuuauguaugaacucuacacauaugccuagaagggagauuuccugaaacugaagugacagguugucaugagcuuccauguggguucuggaaaccaagcccagguguucugcaagagcagcaaguaguauuaacuauuaagucuucucuccagcucugaagucugggacuuuuauguaaucaaauucugugcaacuccuucuuucccucccuccuucccucucuuccuuccuuaaaugagucagaaucuucccaaguauccaacuugaguucaaacuugagauauuccugccuuagucuucucacuguuaggauuauacauacuaccauaccuaccaaugcacuuuuaaaaaugaguaaaauuucuguuuaaugauacuguugaguuuaauuuaggaaauuacaugaugaagaacaaauuacggaacaguuuguauaauguagaauuaaaguuauaaagacaauuaauauuagaaaucauuauaaggcuuuuaauuauuuuguuucauuuuuuauuuuaaauuuuauucaggguucucgguguucuucugaugccaauaugcuuggagagaugauguuuggcucaguagcaaugagcuacaaaggauccaccuuaaaaauucaucagauccggugaggggguucaguuuuucuuauguuguacucauuguagaaggccagguuuuuuggaaaugagaugauuucuuaguucuuuacucagacugagcuugucagaucccagcuuaugauguccauagucuuaguacuucuguaucucagccauugugauguugucaugaaaucucugcaacuuacauuuuuuuaacuuacaauaaguuaaaagucauguauuuaguuuaaaucucuucugucauucuguguucuuucauagcucgccuccacagcuuaugcuuagcaaaguuuucaccgcacggacuggcaguaguaucugugggagucucaauacguaagugcuuguggaugcagggggauugauauuuaagguacacaaagauaaauauuaaagaucuuuuuaaauuauagcacaauuucaacucuauaucuugcucaaguuugaaaguuuauggaguccagauuacacacccuuucugaauaugacuggauauauagaugugauuucuuuuucuguaguuuuccagaagguuuguuagaagcaaaauguugagcacaucuccauccuagauggcaugcugcuuuucagucuuacucuucugagcugaucaccauucacaccuuuacauucuucagugugcagagccccacagacucgaauggccuuggguagccaugucacuguuaaaucaaagucauccccccccacacacacacacacacuacacauauagaauagcuguggggagauuauaagcuguucucgcuuagacuagaacagugacauagaaacaagguugggccuccuaaggcuaacagacuauguagcagaacccuaguucugcaccaguaaacaaagugcugaguuagggccaugguuagguuagugggguccacaggugccaagucagagcacugacuagcuugaauccuggaggaauccaaagucuaagugcgugaggaagcagcagggaaccuaccugcucuagagaaauucuuuugagccuuugaaagacuucuguuuugagaggcucuaauaaagguuucuacuaucuguagcuuaauuuuaccuuucuuuuaggaaggaaggaaaagguagauuuuuaaaagaauauugggaauacuuuaaaaauuuuugccaaacuuuuuaaauuuaauacuguaguagaaaugaaauaguccuccuuuuuuccccuaaauuuucuaaauuccuaaaguuuauggaaagcacaguaauuuuacuuuugcucuucuuaaagagaauaaaagaaguaauauacaccauuuuuaaugugugaugauuugauugcuguuccugcugcucuccuucccguuuucuguucccuuccucacccgcaagucuucuuugaccauuuccaaccccaaauguuaacacaauaauuuuaguccaaaauaugagggaaaccuugucuguucuguaugucagugucagcaauuuauuucuaaaagagccacauuuuuacuuuuccaugugugagcuguauaguaugcuguaguuuccuacugcugaccuuacagcaguaaagcagcaacacacaaaugaguaagcaugagcuuuccuccugucaaacuucgcuuauaaaacguacaucagaggggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauaaaauaauaaauaaaucuuuaaaaaaaaaaaaaaaacguacaucagcuguaaauggccuucagguacagcuuacuaacuguaagcuuaggugauuauagauucaucaucauaguuuauacuuacagucuuaaugguaguaguuuuaacuuuaaagaguuuuuagcuaauauauaaaaggauagguuucauagugaucuuuucauuccauuauauuuuguucauauucaaccucuauuauucuuccuauucccuuuaccucaaauauuucaaaguuuuacacuugaaauuucauagggaugugugaagcauuaucauuaaauguauuuggaauuuguuuguuuguuuguuuguuuguuuuuuccucuguagucugcaggacagucuugaauucaucaaucaggacaguaauacauugaaagcugauagcagcacaguuaguaaugggcugcuuggaaauauagguaggugguuuauuuucauuuuauaaaguuuuaaaauguuaacaguauaagauuugaaguuacuucuugauuauauagauuucuuguauaacccaagagcuucuaaugguguaaacagaaagguuguuuaaauuuuacauguauaaccuuucuauuauuuggaaaacauuuuuucuuagauuuuaauguaauauuuuguaucuguaaaaagaauuugucuuuauuuuuuuuaauuaguuguauuuuuggaagauuaugucauugauauugaaagccauuaccagcucucuggaauauuuuaguuggguaaagacuaucccuacucucuucucuaaccuaaaagucauuuuaaaaugguguucauuuuuaugaauugugcuucauaugaguagaugcucaaacaaugauuuuuaagaagcauauuaaaauaauagcuuaauuuaguuaauuaugguucacaaugugugaugcauuuuaaaaugacauaguauuucugcaacuucuucucuagaaagcauaacuaauuuaccgcuugauaauauuucugaugcauaauaucagggaguggacagccacccuuacuuaguaaaaacuuuuuuuuagaugauuauuuuucuuuuuuaagacaugauuuuauugagauaugauuucagacuuuucuagcacuuacuauguagcccugaguaaauuuuaucuuuaaauguauguaucuucaaguaaggugcuguuaggccuuugcugugguuuaguauuaguguggagccuguuuucuagcccaugugcagggaugacaaguguguggcagcaugcuuggcuguggcuaauuuuuauaaauacaauaagcuguauuaguagaaaaugcaggcuuuucuuucucucccuguuucaaugguauagcauuguacucaauaaauauuguuuuuaaauuuguuuuuucaaaugagaugcuauuaagcauucacuguggguuaucaggccuauuuuauaauguaggucaacuuauagaaaaaguuuuuucuaguuuacuugauuuuaauuacugauuuuaaugaaguaaaauugcaacaaagcaaaacuuuagucccagcccucaggagggagaggcagguagaucucugaguucaaggccauccugggcuucagagugaguucuaggacagccagggcuacacagagaaaaccugucucaaaaaacaaaaacaaaaaauaagaaagaaaaaaaaaagaaagacagacaaacagaaaaaaaaaacugaacaaagaaauaccuuuuuaaaaaauuguauauuauuuuaaaauuccaaggacuuaaugaaagugauucauuuuaacagugcacaugaaucaauaguuaugaaaguaacuuauacuguuacugaagagauggcuuagcaguuaagagcacuggcugcucuuccaaaaugucuugaguucaauucccagcaaccacaugguggcucacaaccaucuguaacgguguccaaugcucucuucuggugugucugaagacaguacaguguacucacauaacauaaaauaaauaaucuuuaaaaaggguuuuauuaaaaaaaguaagucauacuauggaggcuagauguauuugaucuuucucuugaaauauagaggagaaauguaauccauuuaaucaagauacagccuuuaaauaaugcauggcuuucaauuccacacucuuuacugugaauuaaggauaguugagaccuauuucugacuuuauguuuccaguugacuaaucaaguauuuuuuuaagcguccguaauauggcaagcacucuaguagacccugaagaggugguaagcuaacacaguuucugccucaguggauuuguaguuagugagcauuagauaaaaacuacaaucacagaaugcuauagaagauuaaacuuauaugguuaugauuaaaauguaagcaugaauucccucuuggagaauuguggaagacuuuguugagcauaggacaccuaaauuugaggaguuauguauauaguucuuggaaagaacugccuuggaagaagcaguagaacauaucagaccaaggacacaccaccacgaagcaugggaguaacuucaugugaguggagcacacucauucuacugagggaagggaagggaagggaagggaagggaagggaagggaagggaagggaaaagggaaaagggaaaaaagggaaaaaagggaaaaaagggaaaaaagggaaaaaagggaaaaaaagaagggaaaaaaggggaaaagggaaaagaagggaaaagggaaagaagggaaagaagggaaggggggagggaaaagggggagaggggggggaaaagggggggagggggggaaaggggggagagggcaggaaagggggaaagggggggaagggaaaaagggggaaaggggaaagggggaagggaaaggggaaagggaaaggggaaagggaaaggaaagggaaaaggauugagguaaggguguggggaaggauuugaagggaggaaagggaagggagacaugauauuaaaacacagucucaaaaauaaacaaaaaaaugaagaagaaaagagaauugagcaagagcaagauggcagagggcacugugggccacagcaacaaauugacacccaugcuucauguugucacacaccagugaggacaugcuaguuuaguuuccucacuuguuuucuaaagcaagugccaugacacaguuagccacccaaaguuuucacuacuggaaauuacugcaaggaagaaaaugagugaggucggaaaagccaaaguaaacauacuuugugaugcaugucugacucugaaggacuguaaggacuguaaaggaauacaguaucaaagaugacguauccacccgugccccagccggugauagcugucuaaggaggaaggccugguugucagaaaugccuugugucuccccagaaaaggccuggacuuaguauccucuguauuuaauuauuggcugagaguauguuauggguaauauauaaccuuucacaaauguccaauagauuuuaaagcacaauugaaaucuuuuagauacacucccaaggcuucaacagaaaguuguuuugaauccaacaacauaaucaaaucuuauuuauaugugcaaaagaauguguagugaguauaaguaguugagauuaagauaugucaagaaaaaaaucucaucucuuauagguaagucaguggaaaacugaagacuucacugaacaccugaaagggucuuagggacggaccacaagguguccuuuaacuacauuucaaaagcugaacaacuguaggaacagauacuuauugaagaaacaugaaagagauuugauuauagguauuuuuggaaaaaaggaaaccauugagagaaugaaauuaaagcaagauauaauuuucugagaauauugaguugggacccuggcugacuuagaauuagcuuuggacgauaggaugaacuucucagaauucuugagaaaaugacuagcaucauaagguuuuacuguuaccuauuauuucaccuuaggcgggaauugucagacagguaaggauuugaguaacuuuggagguggaauguuaagaaggggacaguuucagucugaaagcucuuugugcgucuacaccaauguccacauauacagccuuuuguaaggaaguguaaaggaggaaggaauuuaaagacguuaaauuuugaaauagcuagagaauguugaagaaagaguugaacauugagaaauggaaggguugcugcauuauaauugcagaaauuuuuguugcagaaaaaauaguaucagcaauuugagaaacacagaugcuauuuaaagcaaaaggcuaucuguccuagguguacaacuccuacauaacuucuuagacuagugcuuaucagccugugacuugcaaccucuuuugggggagagguguugacugagccuuucauaggaggucacauaucagauauacugcauaugagauauuugcauuaugauuuauaacaauugcagaauuacagucaugaaguagaaaugaaauaguuuuguaguuggggucaccacagcaugaggaacuguauuaaaggaccucagcauuagcaugguuaagaaccacuuauuuagacugccauaauugaauaaaagcaacauauaauucugcuuccugacuugaggauugaauuccuuccccacauccaccucccccuuuuuguggagaguggauuucuuuuuguagcccugacuggcccggaacucucuauguagaccaggcuggcuucaaauucauagagaucugcuugcuuaguuaagaugugugccaccacuccuggccuuuaugcuuuuucuugugguauucaggcugcuauuagcugcuauuauuucuuuguaguuguguguauguguguguguagaacucuugggaaucuugcuguuauagacuguacugugucuucuguuuucauagugguuaacugcagcucuaaaaacaucaguuucuucuguuauuuaucacuuggcuugcaauagcauuuuuugugcuuauuugucaguaaaauuccuugauaaaugacuguguucuuguaguaaaugcaguaacauggucuucuuacugcauuugcaggagaacauuggaaucuuuaaaacuggcuuuugccaagucguaguguccucaauuccagcauucaggaggcagaggcagguggaucucugugauaucgaggacagccaaggcuacacagagaaacccugucuccaaacaaauacucccaaaacaaaaguaaaaacaaguuuggcagacauuaaauuauguagcuaccauuaccuuuugagugguuaaaauguuuuauauuaggauugagcacuugagauaguccuacuuuuuguaacagaagcguauuucuguuguuaaaaauggauuuauucauaaauaggcaugaaacuguuguuugauauaaacuaugaccaaaaggagaacuaaacuuuucuaaaaggaaaaaugacuugaguuguucuugcuuugguuaaaaguucccgugcuuuaccugucggucugcuccuguguugccuuaccucaccuuauuuuccugaugcaguguggcuucucuaacaggccucuuucauguguauuuugcauuuuugccauauaggucuuucacaguucugcagccccaggcgggcuuucucugagcaggguccgcuccgccugaucaggagugccucuuucuuugcagguuugccaugugcuguguggguagacuaguuggugugcccugguggcuagaaucucuagugaagcuauggaaacaagagaguauagagaaugaaguugggagguuaugguuauaagauagcauugcuuacaaaguggagggacuuacugcuuuccauuggcuaugcaccuaaaguuuucacaaaauguguuaucaguaggauugauauuuuuaugagauuucaguaugucauuuuuuucucaguaugucauaauuuuaaacucuagacucuuaaaagaaaaauuuaguaugagguuagcuuaguaauuaguuauacugccccuuggaaaauuuaacguuauaaucucuuguuuccauggcuaaguagcuuuuguauuguaauucaccgauugcuggaaauauccaaucuuuauaauuguugcaaauuuucugaucuacacacuucucuaaagacaacuuuucuuggagcuaugauuuagaugaacaagcacuguucuaaauaaaaggcaugugggcauaauuauucauaucauuacauuguuaacagagugugugccuugcuuacauauucaggacuagaguccuguugauuuuuuucacacauugcacacacacugaucuugcauuaucauuuucuaguagaaauuaucaguccauagauuuacucacucuuuauaauuaucagucuccucaucauuggcccagcuacaguugaauuugaaaacuuccugccugggucuccugaguaaugggauuaugaauauuugucaccacauccagcuauaucccacuuguucuaauuaaaauuuauuuuacauguaaacauuagauaugaacaauacauacuuaucuuagaaaacuuggaaaauauaaaacuaguuaaaaauauacaagcuauguugcuagcacuuacacuuguuuguuuuuuguuuuucuagugcuauggaucaaaucuagggcaguauauaugcccuaggccagugcucuaucacuaauuuacauccuuagcacccccuuccuguuuuuaaacaugauugguaucauacuauuuaaacaaaguuaucaaacaucuaauacaggguuuuaaauucuuacuuauuaugcuuguguuuaaacauuauuacagaucguaaucagaguuacuggccugaguaacuaacauccauacucuucaauaguaugcuuuuuuccuuuaauaguaugaacaucuauguuuuugaauauguucuuagaauaugaaguuuaguuacucagugcauuauauaucuuggguaguuuugcaucaugugguaaaucuucagauaaaucuaaaagcuuguucaacugaguaacagcuccugguguuggguggugucaugcuauugaaaaaggaaugcagugagaugaagcaugaucugguuugcgauuuaaaaggagcaacauccaccucaauaguaauguauuacaugacugaccauuuguuuugauuuguaguucacagcaacccaauggacaugccaggaagagaacugaaugaggacagagacagcggcauagcacguucugguaaugucacagacugaccgcacucuauucugagauuguuguuagcugauugauguugauuuuauuacuaucucugucuuuugugaucuacucuguucaaauuggcauuucacacaagaggauuguugaaaggauagaacaaagucucuuaaauuugacauuuuuaauguuuacuauuaauauuaaguguguuugauuggauguacucuauaaagcaaauucaaucuguguucugauagcuaaaugugaccaaggauagcuacaaguauagccuaauacaaaaaucauaaauuuauuuaaaacauugaguuauuuuagauuuuguuuguuuguuuacuauauugcauggaucuucacugaaaggacucuguagaugacaguaugggguugcaaugucaaaagguuggacacuucugauagaagaucacagaccaucaucuuaggcuuagucaggacaagaaaaaaaauugcuuaggauacuacuuaaaaaacauaguaaugccaggcgugguggcacacgccuuuaaucccagcacuugggaggcagaggcaggcggauuucugaguucgaggccagccuggucuacagagugaguuccaggacagccaaggcuacacagagaaacccugucucgaaaaaccaaaaaaaaaaaaaaaaaaaacucagcugauuuugauuguucagagguuaaaauauauauugguuugguuccaagcuucauauaacugcagcucuggguggaucuaagucucuuuuucucuggcaccuucacucucaugcccauucccucacacacacacacacacacacucacauucucucucucucucucucucucacacacacacacacacauacacaugaaauuuagaguaaugaacauaaaacuuuaaaacaaauuauuaacauuuccaauaaaauuguacuuauuuaucauguauuauuuuugaaacacuuuuauacuguacaaguagaaucuacuggugugugucugcuaccuuagaaugcuccagaaaguacaacaagaacacaagugguacaugaaugcuauaaaugaccccuuuuagugccauccaaacacuuucaaaucuucuuccuuguuaaaacccuacuguaucaguucgacugcugucagguuuccuuuaagaauggugaggguucagccgaguuaguggacacuaggguagcauaagaacugauagcuuguuuccaauagcauuuuuuuuucuggguuguacaaugccaaaaauucuugucuuagagacucuuguaaauauaguauuaauauacgaguuuucuccucugaaguauuccuccaaguauacuuuaaaauggaaaaaugagacacauugaugaaacaaaauaaaauauuuaguuuacucuguucagucucuugaaaagaaacuugucgccauaguucuucacugauuaauagucauacuuguucuucugccacaacagcaucucugagcagcuuguucaucaccccauuccccuccccaaacucuucacuuacccgaagcugugcuagcagcuaccagcgacguuggcgacguagccaaacaacaaguuuggaaaaugggguguuuccuagaugguaaguuggaauugaacaagauugacuaauuccuuaaacauaaguuuauguaagguuuuuagaguuugagacuuuuuuguguauuugaagucuguaacuggaaacuuaaaauuuuauuaauuuuuaauuguaguaaaacagacuaaaacaauuuucuguguuaaucauuuuuaccauaugguuuagagacacuaaauaccuuuacaccaucacuacucuuuuaaguccugaacuuuuucaucuucccaaacugaagcccugaagcuauuacacagaacucccuacuccucauuugcccuuuguuaacuuuugcacuuuaaaaauauuuaguuuuaggucugucuagaugucuaugagaauguagucauuuguguacagguacccauggaagccagaggaaaauccuuaaaucacuuauacauagaguugugugcacauaugccagugcacacagagauacauacauaaaaacaggcuguuuugugcugccugacauggaugcugagaacuaaacuuggguccucuggaaaaauauuaaguucucauaaagacugaaccaucucuccagcacuacuauuuuuaaucuccacaaacuuaauagcuauaaauaccuuccauaaguggaaucaugaaguacuuauccuuuuauagcuggcuuuuuuuguuuagugugucuuugaaguucacccauguuguagcauauauauaugaaaaucauauuuauagcuaaauaacauuacacuagaaguacauuuggggggcuggaggaaugguguuugcuauguaagcaugagaauuuguguucagauccccagcauacuacccauguaaagauucaggugcaccucucuuauccuaucacuggggaaggagaagcagaaggguuccugaagauugcuggccagaacauuuagcugaauugaugagcuugaggcucagugaagagaccucaucucagaaaauaaaguggagaaucauuaggaagauguccagugucaaccucugaccuuuacauccauaccuacauguguacauaugagccaaugcacacauagauacauaccuuuucucuauuuguuugcgaauacauagauguuucuuuuuuagcugcugugaacaacaaugcuaugaacauggguauauaaacauuaguuucagucugagccuuauauccuuuuggguauaugcccagaaguggguuuacugagucauauagucagucuguuuuuaauuuuuaaggaacugccugccauauagugacuguaugauuucacauucacagcaacaaugucaagacaguucugaaaucauuguauguucaccaacacaugauuuucuguuuuuaguuauguguauggaagcccuuaacuuccuuuauaugaggcauugugccacugaguugcacucugccacuaagccacauucucagucccaccccuuaguaauuuccauccuaaugaaacuggagugagucacaaaugcuuuuuggucauucauacaucaucuuuagaggaguauauauucaacucuuuguuccagcaugcuuauuuuauuguuguuguugaugaguuaggagacaucuuugaauauucuggguauucauuccuuacuagauacaugauuugcacauauuuucugccauucucuagauuguguuugccagcuguugaugaugaugugcuuugauacauuuuuuuuuugcaucauccaguucuauguggguguugccugugacauuuauguucuauccaggaaaucauugccaaagucaguacucugaagacuuugcuuucuuuggagaguucugugguuaagcgcuucccuucuugucccacgugguuuagugcucuaauuuuucaugacucaggcugggcagcuugcucagccucaagauuuucuuccuuuagcuuuugcuaaaguacagcuguagguucagaaacuucauguuuccgcguuuauuucacuuguucucuuuuaucuuaaaauucagauauuuuuagcuuauuuuuugaauuggaguuaucugcuucuuuaagacuucuaguaagaagcaagauucaaccauuuccaacuugauucuaguaaaguuucuucaaaaaaaaaaagaaaaauagauuucuuagaaagguagccauuauaacauuguaaauuuauauuuaauuucauaaaacaacagaagagcuuuuauucaccuacauugaauuagcaaggaaauaaacuauugauguuuuaaacaaaaacauuuauuuuuaaggucuguagaagaaagcuuuaaucugucagaugaaaguuguggcccuaauccaggaauugugaggaaaaagaagauugcaauugggguaaucuuuucauuauccaaagaugaagaugaaaauaacaaauucaaugaauucuuuuuuucacauuuuccucucuuugaaagccacaugaacaaauuaaaaagugcaauagaacagguaaguguaguacuuuguauuuuauuuuuaucuuuuacuuugcauucuuuuuaauaagaauuguguuuauucauuuggcaaaaauuugguaggugucuugaacuuacuuuacaaucugcuccaggagcugcaaacagaugcaguguuguuagaggaguuuccuguuuuagucaaaggccucagacaguuuauucauuaagaaacuaaauccuuaagaggcuacagaacaauuguagcaaccaacugaagggaagugcacaggcacuccugaguuuuccuaagcuagcagggagugaguaggauagugaauaccugugcauuugaggugcuggaagugcuuugaagugaaguagagcaguguuuuuuuuuguuguuguuguuguuuguuuuuuguuuguuuguuuguuuuuuuaaauuccuuuaucuucccaugguuuuagaauuaagagaacgaucauuaauggacauaagguaguaaaagcauggagcugauuuauuaaauaggaagaaaagagccuccagacacuuuaacaggucaggucuggaaacacgguaggcacaaugaaauagaaaaggaccaguugcucggcuaagaggaaaguacuuuuggaggaagccaaugggaaaguguuuuaagagggauuaauuguuaugucagaugcuucugauaguauaugaaacaaaugucuaagcuuagaaaauugcaaaauacaggaaaaaaacuaaagauagauaaaaaugaacaauuggagguuugguuuuuuuagaguacagaggauggagaaauaugauuuucugaugugaagucuucauuugggcuuacuuaaaaggugucucugucaggguuuggaugcaucccuuugugacucagauaaaguagaagcaaguaaacaaacaaacaaacaaacaaaacuuaacaucuucacugcucaggggauugauuggcaguuggcagaaaaucuucccaggccaggccacuuguaugcauauuguauucucauuugauagagauuagucuugguguguauuuuuaaaauucaaaccacuagcuugauaaucauggcaauauacauguggaaauauauauugcaaaacuaaucuuauuuugacuaugaauuauuuuaaauauauuuaauaauuuuucucuuuuuaaguaauuuuccuuuuaggacauuuguaauuuuuuacaauugauguuacuuuauaacuaaugccuuggugaauuuugcagauuauuuuuggcaaaguuuuccaaaaguuguacuaacuaaucaaaucuuuaaucuaugaucaaaguuguuuagcccugccacugcauuuggaaagaggaggaggagugauguugagccaguuacaaagaacccuacguaucuuauagcuagugaugugugccuauaaucuuuaaagacuguuuggagaguuuacuguagaaagauuaauugagcaaucuauuuaaaagagauuaaaaacuagggcaagaaaaucauuuagaauguaccacaggaacaaacuggauuuuucugccucuagagaagacacagauuuuuguuuaaauuaagucaauuaaaaauagauaauuuugcuguacaaaugaguuaaugcugucuaaauuuuucaaguuagacauuaguuauauauuuuuuuaaguuggcugcucuucuuuuguguagauuauuaacaucaaaguugauauauuuguaccugaaacauuuuuagugacuugaaaaauuuuuuauagugauuguagcuugggguuggaacuuugcuuugcuuugcuuugcuuugcuuugcuuugcuuugcugagauuggucuuacucuauagugcaggcuggucaggugcuccgugcugucuucauuucucaggagcaguaugcaucaccuacuuagaaaagaauuuuacacugaguauaaaguuuggugggcaguguaagaauuaaaggucacuguaaguguuuucauguuuuaaugacuugaccuuucuacagucuagaauaaugauuauagaaugaugaaacugaauggacacauuuacuuuaaugaauguaacuugauaauagaaaugauaaagaaauugauagaaguuaauaagcauuuguucuagaaccaacuugcaaaauacucuuauuauuucacugauuuuuguuucuaagcaccaugguaauuauuuugaagucuacaguacuuuuugagauuugugauguaguuuuaaaauguuagcaagguugaagaacaacagcaaauucugucaaaaagaacauuuauuuuaccaguugcaaaugucuuaacauugaguaaaacaguggcuuucuuuuuccuccuaggaagcuguccuuagaauaauggaaccuuaagcaaacaaacaaauaguaaauaaauaaauggggucuuguuuaaccaguuugaaauuacauaaagaaugcagaauuaaauucucauuggcaaaguuaaauuuucuuuuuuaaccucuaucauuugaaucccgauccacuuucuuucuaccuauaugaaagcuuuucaguuuccauuggauaugcuuuuaagaaaacaaguaccuagcauaguuguaguuuagugagagagccuaucuagcuguccaggggauggauuuggguuuucuggguuuuuuuuuuuuuuuuuuuuuagaauugaccagaaugagacaauuagagggaaacaagcaaauaccauguuauaaccugagauuccugaguugaauuguauuaaauuucagauuuuucaaaagguauuaagaaugugaaauacuaugaacucuguuaacgaguuccuguguauuuuguuuagagaaaagguaucuuauagcuaguuguagugaugugugccuauaauccuagcagaggagaggcugagacugaaggaguacuaaaauguaccacucugagguacauagucccaggguaggcuaguuuacagagugagugaguccuugucucaaaaagucaaaaguagauuuuguuguuguagcccgcagacugucaguauucuuuguguguugauguuuugcaguuuguuaccacggagacauuuugacaauugaaauuuugaaauuuuguaacaaucaugaaugaccaaaguacaggagagaaaaccacuguagauaauaauguguguuaagguuuuguuuuuuuuccuccaguauugugacuuggacuaguauaagaauuaacuauguagugauuguuuucaaggcaaugaaaaugagccggagaucagcugaugccagccagagaaguuuggcauacaaucgaauacuugaugcccugacugaguucagguacuuuacuccucacuuugcccacgacagaguuguuuuauaguaugcuuaggaaaauaauuuauguacauaggaagauauuuaccuuguuuaaauaagauuuagcuauuuagauuucuuucucuuuuuguuuuguuauuggcacuuuuucuuacuuguuuuucagacagggucuuacuguguugccaaggcuacuuucaguccuccugccuuagccuccagagugcuagaaaugcauuuuuacauuucuuucauguucuagccauaugagaauguaauucagucaggcuguuggccauuauguuguuaaaucacauuugggaguuguugggauguagcuuuaauccuagaccauuugaaacacacauaugagaagaguuccauguuugaacagaaguauagauuguucugucaagauagguauaggguuagcuuaguucaagugaaacuucauuagccuaguuagggcauccauuucuuuaggcauaguaagguaacuagaacaaugaguacaucauaacuaaauuuuaaaauguguauggggggggcacaagagguggugacuuugcaguugagaucauguacuacucuugcaggaggauucaugguuuucagcccacacauagcaccuuacaaccauuuauaaccucaguucuagggaaugugauguuauccuuuggucucagaagacaccacaugugaugcauauguauauaaucaggaagcacucacagaaauuaaaauauaaaguuuauauuuuauuacuaauuuguguuauauuaauauuuuauagcauucuuaaucuauaaaauucuuguuaaaaagauuuuuuaaaaaaauuuuuccuaaaauaucuuuaauucuucauuguuguuuggggauuuuugagacaggaucucacuauauaucccugacgggccuggaacucacuuuguaggccaggcugaaccugcacucagagcaguccucuuuccucucucaagggcugagauugcauacaugugccacaaugcccagcaaaaugucuuuaguucucacucauuuaaaaguucucaccagugauuuuuaguaaguugggagagcauuaaaacaagucacagcagagaacuuauaaaugaguaagaacuaaggacauuuugcugggcuggagaaaggagagucgucuggaagcucaugagccuacuggccuggagucuacaguguaggagaaacgagagagccugugucacugagggagaaagugagaacuagcuccuauaagcuggcuccugacuuccauggaugugcuagagcauucucuggcuaaaggaaaacuugcaugggcaaaagaauucuuuuccuuuuguagauucuaguugcuaaagaaguuuacugagacagguaauagaauuuuuggagauuucaaagaauuuucuagcguuauacuuuuuaauauaguuugugcccauagccguaugaggcuauuuauuuaauacaacuugaaucacuuuaguuccuccaucucaggacucauguuucaguuguucuguuacugccaauggucacugcacaggcauugcuaauguagugcguuugcaucgagguuggaaacugaaaaugcugcuguagagacuggaacuacuguuguguggaugccagauuuacuuguuucuuucucuuuuuaauuuuaauuuuauuuuucuacuuauucacuuuauuucccacucacugcccuccucccaaucacccccucccacaauuucucccuggcccccuucuccucugagggggugccccgccuccccguguaugccccaucccuucacuucaagucugugcaaggcuaggugcuuccucucccacugaggcuagacaaagcagcccacauacaggcaacagcuuuugggauagccccugcuccagucguucaggaccuacaugaaagccaagcuguauauaugugcugggaggccuagguccagccgguguauguucuuugguuggugguucagacucugggagcccugacuuacuuaccagauuuacuuguuccuaaagcuucuaaaacucaccuugguuaauauagugaauaucuuaguggaauaaauacuuauguaaaaggagaaaauuaacaaauaugcuuugagggcuucaggauagaguauguuaggacaacuaggaaagcacuguagugacugugcaguggucuuuccuuuguugaaaggcaagagagagauacaauagaugcuaugugucugguguucucauccuccuaaugugugucauuggcauggugacacaaauuggcuguguugguagauggauggguagcuggguugguuuuguuuuguaugugcuaauaauuuguacuuggcuuauguaaaacauauauuuuagaacuuuaauguaggaaggggauccagaaagaaccuaguacaauccuuuagcauaauagaugggaaaaaccuggugucuaaaguaggaaaauaaugugaucuaaggacacugucagugggggaaagaaccagcaccaggcccaaagcuagcgcuucaccuucaccuacagaaugcacuccaugccacuagcugaugguaaagaaggaaaagcggggugcauugaccuuuuuuuccccucccucagaaauucuaauaaucuaggagaaagucuucaguuggcaguauagccuuuaagauuauguuauuuggagaaccauaaauuuuacaauguuuuuucuucuuuuuagaacaacaauuuguaaucuuuauacaaugccaagaauuggggaaccugucuggcuuacaaugaugucagggacuccagagaagaaccagcuuugccaucguuucaugaaggaauucaccuuucuaauggaaaaugccuccaaaaaucaguauggcuuacuuuauuuauuugguuaacuauauauguuacuuuacuauaacugugucugcauugaaggcaagcuuaauuauagaauuaggagaauaacucuuugucuuaauuauuacuuauuuauggcuaagcuauccuaagaugauccaaugauaggauauggaagaguacugcagaacuauaugaauaaaaacgagcauaucuuuaugcuuaauuaaaauuccugauguuagagaauuuccccaaggauucuaauuuuguguguguaugaauugcauucauuuaugauaauuuuguuucaugaaguguaaaaauauaaggaaggacucagauuccauuguuagaauuuuauuuccuugugagugacaaggcgacuuuccucaaacacuaagcagaaguggaggugagcugggcugcagugagagcagcuugcugggccgaccgagcgaccgaccaacaugcuggggcuugcugugagauucuccagcuguuuuacccuaguuuccuucuuacuguuucucaagcuuuuacuauacacaagugacucagauguugucauccuaguuaaugauaaagguuacuuaauacuuucauucacuuauuucccaccaacuggaaauuugaaaauuagggaccuguucacugauucauuagugaacugggcagauuaaauacugaaaaugauucauauuaaguaaaaagcuuuuuuuguuuaauuuuuuuaauuguaaucugaaauugccaguguuuuacuauuaaaguuugaauugcuuuucaagaaaacauaagggcucauuucccaguugguguaccuguguuuucuucucaccucuucuuuuuaauaacugccacugaguaaccuuugaauacgcauucucauuguuuacucuagcaaacauuuuauuuauuuaaaguucaggagugcagauuggaguguaauagaauacauuuuguuuucagauucuugccagcucucauuacugcaguuuugaccaaucaucuugccuggguuccaacagucaugccaaauggacagccaccuauaaaaauauuuuuagaaaaacauuccucucagagugugggcauguuggcaaagacucauccauauaacccucuuugggcacaacuugguauguagucugaacaucauauacuguauauaaaccuaaaacucacuuuuaaguaaaaacuaacuacacuccuuccuuuugucaguuuuauucuagagugucucucugauacucgcccuuucacaacugcuaagcuguccuguugucuucugccugcucacauuccuuaaagcuaaagaacuguggguggaauagaaggagcacacuguagcugcuuuaacuuugauauauuaaauuaauaucaaauucuguggugauuuuuuuuuuuagugcguaguuguaucuaaggcucugugcacagagcauaagagaauguaaaggcagaugaauaauguuaucauuucaagagauuuauacucaugauacuauaggcagcauguauuuuuuacaauaguuguaaugcauuaauaaauuaugugaaauggaaguugagugguagcuaaggcagggaaguuagucuuugcacaguugggcacaucugccugagacgcuuuacagcagaagagauaaagaaggcugagcuccguacagugagggauucugaccauucuaguguuaaacuauugugcagugaaguuuaggcgagggcuuuagagaacagccaugcaaagguuaacuuuaagaagaugaaguggaagccgggcggugguggugcacggcuuuaaucccagcacucaggaggcagaggcagguggauuucugaguucgaggccagucuggucuacaaagugaguuccaggacagccagggcuacacagagaaacccugucucaaaaagccaaaagaaagaugaaguggagagagucaggugggaccuuccaugaaagacucaccaggccaaagcaguuucaguucauuggauaguuagugagaauugagaggauuauguuauuguaaugauauuguaauauucuagccaauuuauuagccagaggaaaaaauuuaucacaauucugucugcagcauauauuuacucaagauucauguucauucuuucaaaaaaauauucugcuuuauaacacaaaaguaaaggauuuuaaauaaacauauugaaaacuuguaaaagggauuuguauugauguauuuguucgcauuuguaaguuuuuguuuugcacuugagcuaaagguuugauuugacccauaaaacaacaacaacaacaacaaaaaaccccacaacuccuccuacugugcuccaugccaccacugucccucuccucagccugcagcagacacuguguuuuuccuuucuauauuugauuaugacuuccuuuauauguccuuugugucacaccuguuguagagaauauucuuauuuuuaaguuugacuuugagaacuagcucuuugagguuuuaaaaccacacagcuguuuagaaacacagcuaaaaaaacaaaaacaaaaccuguucaccuuucucccugguuaaaaccucucaucuuauccuacuuucuugaauaaucagucaucuuuuaaaguacuuaagaguaaauuaugaacuuguaugaggagguuucucaugauugaaagacuguuuagcuguguauuucuuaacugaucuuuuuuauugcaggagauuuguauggcgcuauuggaucuccuguacgguuagcaagaacuguagucguuggcaaacgacaagaccugguccagagacugcuuuauuuucuuacuuacuucaucagaugcucugaacuucaagaaacccaucuuuuagaaaauggagaagaugaagccauuguuaugccaggcacagugauuacuaccacuuuagaaaagggggaaauagaggaaucagaguaugugcuaaucacaaugcauagaaacaaaagcagcuugcucuuuaaagagucagaagagacaagaacucccaacuguaacuguaaauauugcagucauccaguccuugggcaaaauacagagaaugugucacaaccagaaagagaagauacucaagacaacucuaaggaauugcuaggaauuucagaugaaugccaaaagauuucuccuccugacugccaagaagaaaaugcuguugauguucaacaguacagagauaaauuaagaacuugccuugacaccaaguuagagacaguuguuuguacaggaucugcuccagccgacaaauguguguugucagagacaugcuuggaaccaagagaagaauccuggcagaauaaggaauugcuggauucagauaaucacacaggcacagcaaugagacccacaggaauaguuguugaaaagaaaccuccagauaagaaugugcccagugcauuuuccugugagguaacucagacaaagguuacguucuugauuggagauucuaugucaccugauucagauacugaacuucggagucaggcugugguggaucagauuaacagacaucacagcgaaccacuaaaggaagacagaggaguggcugauaagcaucaagaaaguaaaauaacuaaggaccaaucugaagacucugacacacagaacauaguuucuggagaguccugugagcuuccuuguuggagucauucagauccagaaagcaugagcuuguuugaugaauauuuuaaugaugauucaauugaaaccaggacuauugaugauguuccaguuaaaacaaguacagauaguaaagaguauugcuguauguuggaguauccaaaaagauuguauacaaaaacuaacaaacagaaaagugaacuuuguaaauguauagaaacaguucaucaagauucauguaaugccugcuuuccucagcaggaccagaggaauucccucuccauucuugucccccauggggauaaagagaguucagacaaaaaaaaugcuguaggaacugaaugggacauuccaagaaaugaaaguucagauagugcccuuggagauagugagagugaagacacaggcccggacauaaggagacaagcuggcgguuacuguggaggggaccaggaagacuggacagaagaggaugagauaccuuuuccuggguaaguagaaagcucccuucugaagcagcccugcuaacgcaugcacuagucuuugcuuuagccagucucuagagauuggggcaacuaacuuuaaaaagagcuuagggcuccaagauggcucugcaguaaaaagccucaugaucugaguuugaucccugaaacucaagguggagagagagaacugacucccaaggguugcccaaaguaaugauuaauaaaauaauuuuaacguuauuauacuggcuaaaaucucuuuuacucagaaggaggauuaaagacuauuccccacaucguccuuucuggaggcaucaaagacauuaaagaauagaagugaaugccggggcugggggcaguggugacguacaccuuuaaucccaacacuugggaggcagaggcaggcggauuucugaguucgaggccagccuggucuacagagugaguuccaggacagcccgggcuacacagagaaacccugucuggaccaaaaaauaaaauaaaauaaaaaagugaaauguaggaagcugaucacugcuuaguuuucagaccauuuuggagugaaggaugcauauacacauucccaaaguggacuauggcaagccugacacuuagggagaaucuuugauguguuagggaauaaauaaauuuagccugcacaaagagggaauguguauuugaggucaagugcaaggagaauaucccugcuuugaaauccuacagacccagauuuuuuagcugcuuuguuuuacucaccaguuuucauagucugauuguauuaggaauguguuacaaauauuuguaagguacaaccuccuaaagucuuuuauaaaagagucaugcuguucuugagaccuccuccaagagagaacaguauuuuauuguuuguuuuaguccuagagccauuuuuauuuaaggcuaauuuuauuccuuacguaguuuauaagcagaaaggguacuggaagacagacuagcagaguuuauaaccuuucccaccccaucuuccaccucugguaaaagauguguauuacuuacuagauuucuuuuccuuggucaucuuucuuucaggucaaaauugauugaagugagugcuguucagcccaacauugccaacuuuggaagaucuuugcuggguggcuacugcucaucuuauguuccugacuuuguucuucaaggaauuggaaaugaugagaggcuccgucagugccugguaucagauuugucucaugcugugcaggugagauaccuucauaggucuugaacauauuuaaagcaaaacugguauuuuaguuuuagccaagcugugaccacauaacauaguuauuguucucugaaucuguuacuucauauauagcaccucugucuuuguauuuaccauugugaaaacaagaguugaaucuaggaaucuuccaaauggaaauuugaaauaaaaaaaaauuuagauacucagaguaucaaaaauuugagauuuccaaaagaguauuuaacucccuugucagaugauugcuuauauaaagaaacagaacugaucuuguguguugaucuuuuauucuguagcuuuccugagcucuuaacucuuguguuaguuuuuauauuaaauccuuggaguucuuacacacgauucaugcugucagugaacaguguuacauuuuccauuccagucuugauuauauugguucaaaucuguauagugguacauggaaagaaaggcauacagaagaugguauuaucuugcucccuaucuuagaagaaagccaccgcgucuuucacuauuaggaauguuauugauagggcuuuuguagauagaugcccuuuucagauaugcaaggaccuucuauuccaagucauugguuuuuuuguugugagguaaugguguuguuugcucauuuugguugugcugguaguuuggggguuuauuuuguuuugacuuggauuugaaauagucuugcuguauagcacaaacugaccuaaaauuuucaauucuuaaucucaaguauuuuuuaauaauuuuauuuauuuaccuauuuuacuuauucacuucccacucacugucccuuucccagucaccccccuccccacaaucuuucucucauuccccucuuccuuugagcugguggggucccccuggugacuacccccacccuggcacuucaagucucugugaggcuuucuuucacaguggguccagacagggcagcucagcuaguagaacauaacccacagcuuuuaggauagcuccuguuccaauuguuuaggacccucaugaaggccaaacugcacgucugcuacauaugaggugcaagacuagguccagucccuguauguucuuugguuggugguucagacucugagagucccccaaggguccagguuuguugacucuguugguccuccuguggaguugcuauucccuuccgggcccacagcccuuccuccuguucuuccguaagagucccccaguuccauccacuguuuggcuguggguaguugcaucuguuugagucggcugcugguuggagucucucagagaacaaaaugcuccugucuggccucuucccuugccgucuuuaauauucuuucuuuguucuguagauuuuguauuuuaauuauuauguguugggugggauuuuuuuuuucuggucuagucuaauugguguucuauagucaucucuuucuuuagguugggaagauuuucuucuaugauuuuguugagaauauuuucugggccuuggagcugggacucuuuaccuucuucuauuccuauuaugcuuagguuaggucuuuucaugguaucccagauuuccuggauuuuugugucagaaacucuuuagauuuaacauuuucuuugacugauguaucuugcucucuauccaucuccuguauucuguuggugaugcuugcaucuguugcuccuguucucuuccauuggcuuuccaucugcaggauucccucaguuuguguuuucuuuauugcuuuuauuuuucacuuucaggucuugcacaguuuuauuuauuuucuucaucuguuuaauuuuauuuuccugugugucuuuaagggauuuauuuguaaaaguaguaugguuaaucucuucuuaacuccccgacuggugcaugugugcuucaccaccucaaugcugcgauucuuggaagacacacacacacauacauacacacacacacacacacacacacacacacggggggggggggugguggagagaaacagccuuauuuuuaauaugcccuaagcagaacaucuauauuccauuuuugcuaccccagacccaauugggagaggggccccuaggacaacucuuccccgauucuuuuuuuuauuuuagauuuauuuauuauauguaaguacacuguagcuguccucagacauuccagaagagggggucagaucucguuacagaugguugugagccaccaugugguugcugggcuuugaacucaggaccuucggaagagcagucagugcucuuacccacugagccaucucaccagcccccucuucccagauuuuuauauggccauaugcuuuuuccugaguucucaagccugaucaugcugcuuccccagcauggcgauucuuuuuuuuuuuuuuuuuuuaauuagguauuuucuuuauucacauuucacaugcuaucccgaaaguucccuauaccuuccccccgcccugcuccccuacccacccacucccacuucuuggcccugggauuccccuguacuggggcauauaaaguuugcaagucuaaggggccucucuucccaaugauggccgacuaggccaucuucugcuacauacagcauagcaauucuaaagccgccuucuucccuugcccaggaaaucuaaaguuccaccucugucucccuacccagccauuggucacaggcaacuuuauuuaccaaugagagccaacuaggggcaggaacccauggcauuuuacaugcagacaugggaauuccuguguaauuugggaacccaacuaacauaacacaagcaauaaaccaaaccuauaacauuuguuuccucuuuaaagaccucuguuugauuguauuuuccuguauuuccuuaagggacuuauucaguucauauuuaaaggccucuauuaucucuauaagauugcauuuaagaucauuuucuugugcuuugguuguguuaggauauccagggcuuccuguaguaguguagcugugcuuuggaggugucguauugccccggcucuuguugauuguguucuuuugagggccuuuagcuaucuggaugguuuuggucccuggauauucuuguuguaguagguauugggagggaggugaaccucgguguuccugguguggcagaccucugaugguuaucugugggcuguaugguucuggaccuacaguucuguaugguucaggagucucagguccaaugaagggggcagagaagugacaggagaauggaagucucccuggacuaucagacuacucagagcagcuuggcuuggcccagagggcugagaaaacagggaagagaagcuugccucuauguaugguucaggguacucuugaguuuaagauuauagguguauaccagcaugccugacucucuccagccuuuuuguuuacuaccugucucucccaucucucaguaccauuucucaaaacuucagccacauacauuuauuugauucuuucucacauugucucuuccuaaggagcugcuguguuucucaucucucaccuguagugcuuacccacacugcaguguucucucuucugccuccccaguaauaguuccugcuucaucuggaacaggauuuuuguuuuacucucuuuuaaagauugauaacuuccuugucuacuaucugggaaagaauuuuauucagaguggcugaucauuaacuggauaaaggaaugaauguugaggaugccaaacuugggaccauguaggagcaaauuuaaugaucuagcuuugucauuacuguaaugauagaggugagaggagaaaggccuuuuacucucgguuuuguugcucuuuucuuuuuccaguguuuuuuuuuuuaagccuauaaccuaucaaaauaauaaaagauagugaaguacucagcauugcaggacuguauuacugguagaaauacuguguaccuaguugcuaucuaucuaucuaucuuacuauuguuuuucaaagcaguuuuucuguguagcucuggcuuuccuggaauucccucuguagaccaagcuggccuugaacucagaaauccaccugccucugccucccaagugcugggauuaaaggcuuguacuaccacugccuggcauuaauuguuauuuuuaacauuugguauauaguuuuugauuuccucugagggaagcccaaaaguacagccuucugccuuauggccuuuuacuuguaugucaguguacuagauaguuaauuguuucguucuguuuuugcccacuugauauacuagagucaucuagaaagagggaacaucaauugagaaauuguguuuccagcagauuaucuuguaggcaagucugugauguauuuucuuggggauugauguaggaucaccuagcccacaugggugcuaccaccccuuggcaugugguucuggguuguauaaggaagcaagcugagcaagcaaacaagcagaauuccuuuauggucucuguuucaguuccugccucaagguucugccagacuucucuucagaauggauaugccugggauuuguucuccuuuguaucuauauucugccugcaaguccuaacaaauagaaaaguuaaugcacacagguaguaaugugcuucaggguagcacugaaucucuccugugguccugaggcauguugauggcugauagcacagaauuuuacaauugucccauuuauacaaauagguuuaugucaaaaagaaagaaagucuucucuguauuuuaaacuaagaacuguuuucuuucuguugucuggcauacggguuugugagugguugaucaaaaagauuaggaaaaguuaaauuauagauuuaaagauacaaagcuucauuaauagauauaaaguaugugugaugauuucuauaaaauauuucaauguauuuauuauuguauuuucuuugguaauaacuuauuuaauauauguuucugcuuuuuuauuaauugauuuguucugcuuauauuaccuuugaaaacuuugcuaaccauagacugaauucuuuucuuuccagcauccaguguuagaugaaccaauagcagaagcugucuguauuauagcugauauggauaaauggacuguucaaguggccagcagucagagacgaguaacagauaauaaauugggaaaggagguguuggucucuagucuuguuuccaaccugcuucauuccacucuucagcuuuauaaacauaauuuaucuccaaacuuuguaaguauugugagauuucaaugacuuugaguacucugcugagugaacuuggcuaaauaugugcacacacuaaauagucuuacuagcuuuuaucauaagugcuuugcugaaagaaguauuacaaugaauacuuauccuccacaaccauuguggagacauaaucuagagcugggauauuuuggaagguuagauuagaucacucagguggucuaggucuugaauguugguccacacgagaagacuagugguccacgcaggacgaaagauugagauuguucugucucuacccugugagaacacagcgagaaggcagcuguccaucauuugaaaagagcccucacuaggacccagauaauggacuuuuccaccucuggcauaugagacaaucuauuacuaaggccauucaucugugagcuaagaaaaaggauguucuuaaaucugugcugucugauuuuaggagccagauuuuuggucacauguaguguggccacacaguacucaugguucguauaggaugucuuuucggaucccaucaucauaucaggacuuugaauaauuccacggugugacaguuacagccucuucacacuugucccgcuuucaggagcucauucuuuuucauguuaagagaacuauaagauagcauggcuaaagcucucuguguccguaugacagauacccagaagcacugcucagugucaaaagacugaaagcuaccccaggaggaguaaugaagaaacccauuuuccacacguucgcuuagcacgguacuuaaguaguagccagaauuaguaugugaaaacagaaacaaaauacuucaaaauuggaaaggaagauagacuuaauuuuauuugcaaaugacauaaucuagaaaaaaacuuaccucaugagaaaaacugauagaauuuucaggagaaaagacguguaaaaauaagauauucuauauucuagccuugaguaaacugaaagggaaauuaagcaguucugagcuaaguguugugaccauaccagugacaagaggaugaaggauucaggcaccucuguucuaccagguguccugagcucaguucccauuaccaaugggguagcucacaaucgucaucugaugaucugugugggcacugcauacauauaguacacaugcauacaugcaggcaaacauacguguacagacacauauauaaaauuuuaaaaaucaaacuauuuuucaaaacaguagaaagcccuauuuaauccaguuauauagaacaucaggagaaugcaauaagccaaaauaauuuugaaaggaaaguacccaggcaugaugguacaugcaugucauucucacaagaucugagcuacacagugagaacuaucuuagaaaacaacaacagcaaaaccugauuucaaaacuuagagugcuacuacagucaaagcauggugggaguagaaugaagaccagaguacagacagacauucuucauucauuauaaaaugaagagcccaaaauuaagcuuuuucauauaggauugguuucagugauagugccaagaccacauuaaacaagaaaaaguacuuucaacaaaagacaacaacauuuuuuuaaauguucuugaauucuuauuuuaugccauauaaaaaaauuugcucaacuuggaggaaagaccuaaacuuuuaagagcuaaaauuuuuguugcucauguuuuagauguuaugcuuaaaaaaucguuuugucauucucauuauauaucacagaagauuuuccucuuugcuuucuuauaaguuaguaguuacuagagggugggagggaggaaauuauuauugggcuaagaguuugugauaaaaagaaauuuucaaguggauggugguuauaguuguacauuauagauguucuuaaugucacucaguuauagacuuuaaaauguucuguauuagggcagcggauauagcccagguaagaaugcuuaccuucuaugcaaaaagcccuggguugauccccagcaccuuauaaaccaagagugguggugacagagacagaagaaucagaagucauccugaacuuuauagcaaguauaugaccaccuugauacacaccugaccccauuuccaauuucaaaauaauaauaauuauuauuauaaauuauauugccucuauauacauauucuguagguaacauuuucuuuuuucuuuuuucuuucuucuuuuuuuuuuuuuuuuuuuuuccagacaggguuucucuguguagcccugucuguccuggaacucacuuuguagaccaggcuaaccucgaacucagaaauccgccugccucugccucccgagugcugggauuaaaggcuugcgccaccacacccggccaggguaacauuuucuuaaaggcauuuuuaucauaagaagacuuaucgaugagauguguaucacaacacaaucagugagccuccacauccacucagucauguuuucuaguuauaaaguaauuuuuuuaucaggugcuuuuaguaguucauuuucauuagaaaggaauuuauuguuuauuacuugaaauucacauuuuccccuuaaagcauuuauaauacuaaucaugugaaaaaaucaucuaaacacauaacaaauuaauuacaaaauaacaaaauguauguauuuuggguuuuacuauuuuagcuuagaaaucucaaucagcaaggucuuauucauucuuugaacuguuguaaacuguuuuuuauucuagagagagaauaugugcauauguguguaugcaugcauguaugaauauguguauauguguguaugcaugcaugugauguauacauacacacaucuauauauauauuuaucagauuugaaauuaaaguauguuuuauggucuuguaaaugaauacugaugaucauugugcaacaccaucuggaaugcuggugagucuuacauuuaaaaugguugagagaguaaauuuuauugcaguuuaaaaaaacaauguuguaggaguugaucuuugauacugaccagaaauagauuuauacucauuuucagcuaaaacugcauaccuaauuuguucugaacauaaauucuaguuggcguaaccaaauugaauuguggaaaacuugaugcugugaaauuugcuaccuggauguugugguggauacuuuuauaauacagcacccaagaauuugaggccauccugaacuauguugggaguuagcaaaauucuguuguuauuccucauguccucuccccagcaaggaaagaaauuugauacuacucaaaagaauuggaaggcuuuucuaacaggguuugguucuuuccugacugcaguguguaaugcaccuugaagaccgguuacaggaguuauacuucaagagcaaaaugcugucugaguaccugaggggacagaugcguguucaugucaaggagcuaggagugguucuuggguauguucaugguuucuuuucuggcuuuucuaugucucuugucauguuccuuggaacugcuuucuguuguuguuuauuauaauguaucuuuuccuacuagaaucuggguacuguuaguguuuaguuuucuuuguauccuggaaaaguagauuucuguuauccacuaauauaaaugcauaggcccuugaccuaaucugcaguuacucucugaaaaguaacacuuaucugaaaugauaacuaaggaggaaaaggaaguugguuuccaagcauaauguugccuuauuguauuaugugcuaucagcuuuucuauggucuguguguacaugauaaaaggaauuaaagauuuuucucccuaaauuuaauuucuauaaaaggaaaaggaucagcaucaaucauuuagaauccaguguguaugacaagcuaaguuaaagucuagauuuuuuuuuuugucauccauucugggcauuuacccuuauagccucacacuuauuaauacucuacuggagcuaucuaucaucucgcucccuugcccaauuuagucauucuguaguguguaagcaauauccaaauugaaaguggcuaguuuuauaaauuaacauguccuuuugucagauauuaggacugaacaugauuuaaugacuccagauauuucuaacuuuaacacuauucgcauucuauaccaaagguuguucaaauuccagugaagcuuuuuagagaaugguucuuuaguauuuggaaaaucagaaacauauaaucuuauuuuccugggaaauagaagugugugugugugugugugugugcgugcgcgugcgugcuaccuuuauuaauaccuuuagaaaucaaacauuuuaaaaauaauauaauaaacccaaguucauaguacauuugguauaaaauggaaaguaaacuaccaucaacuuuuccucaguuuacaaccccaacaucaacacuguugacauuguuuauuguuacugaauuuuaaaauguauaaaaauagaaauugguuuauauucugucaguaugcuguugugcaaugugcagcuaacauagcuugaauauuucugcauauggaugcauacugcuagaucucauuuuaaggguuguauagccuuccuuuauauaauuuaguuuacaguguuugcuguuauaaacuaaugcuggaaugaaaauaaauuuuguccugugagcauaaguuccuggaaguagaguguuuaauuaaagugcauacaaacuauuauacacauaauucugauaacacuaaucuggaaaguacggucugaacaaaaagccaucacuuauuaaauaaccagacuuauagcagacuuuuaaaauuguuacuccugaucuggaaaauagcauacauuuuuuuuucaaauuccuuaaacaaguuaaaucuaacuuuuucuaaauuuauugacaauuuuucuuuuucugaaaauugaguuuuuaaauuuuuguuugagacagggcuucccuuguaacuuaacuugaccucaagcuugugaucuucuucccucagucuccucacugcaggguuacagauguguguauaauuugaauuguacguuacagauguguguauaauuuuaauuguacagcaugcccucuuugaaucauuguggaaugauguauuuucaagacauuuccauuacuuguagcauauauuauagaaacuuuugguuaaaagcuuacacagacuauuauuuuauuacuaguaaauuguauuucuugcacauccgucccuagaugaauaacaggucaacuguggugcuuuccugugucuguucccuggcugcuuugcauuuagaagcauccauuccuuugagucuguggugcuacuguuggugaaauuuuccagguguuguuaucuuuagcuccuugcccuuuugcuuuugucuaggauaagcaccauagugcugagguucacuggccauggaggagugacuauugccucuaagauucauaguuuggauacagaaagccucaacugaguugucuuuucuuuauuucaggauugaauccagugaccuuccucuucuggcugcgguagcaagcacccacucuccauacguugcucagauacuccuuuaacaugucuagaggcuaacuuuguuuaaaguugaauagaaaccaaggagacaggcgcuguaucuguggagcuguugcuguucugugauguuuguuuugugcauuacgcuuuaggugaacgcaucacccugcgcugcggucuguguagaccaaaugacuuuuuauuuuuaacuggacaucugagcagugguagauuuuucaacuaagugaaacuaaaucaaaauaauuggggguauguagagggguggaauuugcaaaagccaaaguguaacuuagaauuuucugugaauauacaggaauuucauacaaacucuauaaaaugucacaacucaugaauagcaauaguugucucaugaucaaaugucagaaaucuucaauucacugauuuuuaauuuuuaauucuaugguacagaaaucuacaagaccuugauuuguuuguuguuuugcaauucagaucaacuuauuucuaguuauuuaaguauuuuuuuuauuaaaaacaacuguuaauuaugagaaacucagaaugagugaagaugucaugugcccaucccaaguguacauauguaucuauuuuuuuaaaaaagcagggguagaaauacaauauugauaaaaaugccuuuuuaaaaaaauauuuuuucaucuaguauuguauauaauguugaaauacuaccuucugaugauuuuucuguuucacgcauucuaaaauguauuuaagccaaucuuuuugaggcucaagguucuagauucccuaaggauacuacuuuuuaccauuuguuuucuaagaauaagcuaauucuuaucaauauuuacauauuaauuuaauaaauaaaaauuaagauuaaaaagugcaccaaagcaauggcaaaaauacuguauuuuuuaaauaugcucagguggccacaaacuucaguaucgaccauuauaaacccauaugagcagaauauuuccuaacaauccucaauuuacacuaguagaaguaauaucuuuaaaaacuguucuuucuuuaaguguuccuuucuuucaaauguugauugcuuuucaaagcuuuccccuuaucugucauugucuuuguauauagugcagauuguugcuuguaagaaaggcuaauaaggaaccaaacucuuguaaguaauguaaauaaaaagguggguagaucauguuuucaauauacucuacuaccucaguuuacuugaauacugaauuagagcuuacucucugcuugugugggcuaagauauacauaaugcuagaauuaaaguugguuucuguuuucauugacuaauucuaaauuguuuagcucaaaaaaaaaaaagagagaaagaaaggaaaaaagaaagaaaagaagaaaggaaggaagaaagaaagaaagaaagaaaaacauacccccccccaaaaaaaauccuacccacguguucgguuacugaauaauuuuauuauaacauauccauucuugcuauuuaaauuuuucaguaauuaaugaaaaauuucugugguuuauagucuucagaaucuugaauuuaugugucugguuacauuuaucuugcucuuuauguguguucaagagaauuccaacuagaaaagaauaaauagaauguuuuaauggaacauaaaccccaaauuuaggguaucuacaguuggccuugguucuguuuguugguuccaguuaguaccugggucucccauggaugacuuggugccaaaggguuuuuuuauagauguggagauuuuggggguuuuuguuuuguuuuugauguccuuguaacccauuuguuaguggaauugcucuguuguauucuguugaaauucagugaguagauuucuguuagaauuuagaaucugggaaagcuacgggccauuguacauuauuuuuugauuguggcucagaauaauauguauagcagguagauaauguuuugggauguuuucuugaacauggaacuuuucauaguucuauuugaaaucugucauuacuuagaaauucuagucuuuaauaagugaauggcuugugcaccuaauauucucaaaacucagcuuugcuggaaaggucuauaguuucuuaaaaacucgcuaguccuuauaggauuccugaguuuguaauacuuuuaucaucauauucuuuacuuacucaaagcccaaggaaugagcugcuacuucacuacaguguggcugugauaaaugugaaaagaguuuuggccuguuuaaaauaauuuuucaacuacuuaaugguacagacaaauaugugcugcauaauaaaaauaccuguuuauuguuacaggaaauuaaaaagggaucuuuuauauuauaggauuaaaacuaauuuucuguauauguuaacuaauugauuuaauuuuaaguaucuugcauuuauuaauaugucuuaauuuugaauuugaaaacaugaagugcaauaaacauacuacuacagauuucauuuuguugcaauuggcacgcagugcagaugaucacuaacaguuugcauaaugccuccaucgguagcuguccucugagaauguucugcuuucucuugaguuauuuagaugacgaauauauacaauguacauacuuguuuguuguucugaauacauuucucaaauguacaccuguauuauaauaaccucccaguucuaggggaaauuugugcaauaaacacucaugucaauuugaugggua

SEQ ID NO: 6000 - RNA, 176448 nt, Mus musculus
ugcguucucggccagucucgcccccgcgcaggcgucuuucuggccagucgcgcgugggcugaggcccugggcgggcguugcgaagacuuguuugcuugaguuuggacccugcgacaguucucauuucccucccgguggggcuggcguacacccggagcuggagaaugggcagcuagacgcaggcuagggagccuguggcugcggacaugaacucgcccguggaccccggcgcucggcaggcacugaggaagaagccgcccgagcggacuccugagguaaggccgggcacuggcgagcacugcucggccccgaccuggccguagccgcgcagggugaugagcaccuuuccugccgcuuccugccggggacuuccuuguacuugugauaagaaagcaccguuacuguugacuggcuucugaguuugugugugcucaggugggcugaaaaacaagcugggaauaaugauguguaagagacaguucauaccauagccagugugugcugugcguucaucucagauacugcacaauugcccccagaagacagguuuccaauguccguaucagacucugcgucagccagauaguaguaagucccguggcgggugaugcgugucgagugguucccuggugcuuuuucaaacuuuccgugggaaguuuaagauuauuuguuaaguuuucuugguuugaagacguuucuauaaucuuaguggcuauguguauuauaccaaaauuaaaaaaaaaaaaaaggaaaacccaacagcaauguaaaugcaaugagucgucuuguuugaaguugcaguaacugaaaugaaauguuuuaauuuuuagucacgggaguuucauacuuagaguucuuugcauagaaagucucaaacuuuggguaacacucugggacaugacuuuguuacagccauuauugaaguugugauguguccagcuugcuuccugaaaccuugaucuuugcauaguaacaaggcaccugcccaccccuuuccaggggcuacuuuuuccuacuuauaauuuaugaaucagcuuuucuguggugauuaccauuguaaugugcauuuuaaguuuuauuuacgaacauuauuuagguaaugaaggaaaaccuuguuucucuucagguaccgaauuacuuaguuugaaauugagucuuuuuaaguagaggacguuuucucaacuguuggggaacuuaugcuuggucaugugugcuguguugaggacuuuuaucuuguguuacuggaauagcaacauuguugaagggaauauuaacugcuuggauucauuggcuguauuuuugaaugaguguagaauuuagguuacuaauaaaucauuauccagagugcuagugaugcuuuauuuugacaaagaguucuaugaaauucucacaaguucguuucugcugucaaaagauucucguaguggacuccuaagagucuguuauaaauauauuaauuugguaauuauucauugccaaccuguucaaggcucuauuuuguacauuagaaaauuuuagugggcacaauagacaggucccuauaguucuuacauccugauggauuaaggaauugagaagguaggugauaaauaugcaacaugcuagcuaauaauggcuauuuccaauaauaggauaaggagaauuggggaaagggaaaauaagcuauuuccuagguaacuugacuugcuuguugaacgaaacuggguaucccuguguagcucacagcaaccuggaaccauaacuugucggcacuuugcuuguaugaagaugguagugacccucaaggaucugacuugaugaacauucuauugaugcauacgaaugggauuaugugcagaguuuuaugaggaagaaagcuuaugcaaauggaggaaauggucauugcaaagacccugugauuagaguguucuguucauacauuccaggauuaacagggaacucuugaauagugggcaaugagccagaguggguaggaaguccuagauagugcuguaggauaggacacagcauauaggacuuuguaaaaugugaggguuguuauuacuacuacugcuaccaccaccaccaccaccaccaccaccaccaccaccaccacuacaacuacuuuuaucugcagugaaaugggugagcuaccaucugaagguuuugaagcaguggaaugaaacugucuugauagauuuucaaaaagacuggcuguuauguagaguguagaccagguggaaacaaggguaggagcaggaaguuagaagcuauugcauaaaugggguaagagaugaugauaguucagacuaaaaugacagccauggggauucugaauagccaucaacuucugaaaauauuuuuaaccuuuagccaggagccuuuguuaauaacauagacuagguauagacugaaggauaaagaagaauugaacaugguuucagaguuuggggucuaaauuauggaguguugaaguuguuaccaaagacaaguugaagaguuaucaaagaaauggccuuggaugucacgaagugauacaaugcacaccuagugucaugagauccuggacuucauccucagcaccacaaaacagaaauacaagagauuuaccagagcugauuuuugugaggggguaauaucacaaauuauguuuucaauaugucuaauuuaaaauaucuguuagaaauguuggaguaaacauuuagcacauaaaagcuauguuucuaagagaaggcuggacuagagaguuaaaauuuauagucaucggguuguagauuguuuucaguugggagaauuaugaaauuaucaauauagaguguauagagaauagaagagguaaaauuuacagucauuggaauguagacauuuucaguuauaagaauauaugaaauuaggaauauaaagaauauacauagaaaauaggggucacacauuaugaucccagcaccugggacucugaggaggaaaauugccauugauuccaggccugccugguaugaaugaggauggauguguuuggguaugacaugucuuagaaaaaaaauguuagaauaaauagguagauuaagagacagagggguuggagagagagcucagugacuaaaagcauucacugcucuucagagguccugagcucaauucucaccaaccacaugguggcucacaaccaucuauauugagaucugaugccuucuuguggcaugcaggcauauaugcauauagagcacucauauacauaaaauacauaaauaaaucuucaaaaagcgagacagaaacagacacauacacccaguguauagugauaucauggaagccaaguuaauaaaagugcauguucuaggaguguaguuaguuguagagcauuugucugucacauaugaagccuugggcucaauucucaggguaggauugggggauucuauuuuuaaaagcuaggcaugauaacacaugucuggaauaccagcauuuaggaaguggaggcuacagcauuaagaguaccaguccagucugggcuacauaagaccauguuucaaacaaacaaaaaccaaaguuacaauggaaggggauaauauuccuguguuaagcuuaauuuaguuccuuuuccuugaauauguacugagugcaaagcaugugaaaauauacaaauaggcaacauuaugguuugaauuucaaaucaucucccccuauccauacacacauauaggcuucuguguuucaauaccuuguccccagcugguggcaauguuguugggagguuguggaaccuuuggagcagaugugggucacuggggauaggucuuucagucauaguccagccuuacuucuaguccacgcuugcucuuuucuuguuaaucaccaaacaucugaggagcuuuugccucacucucuacccuucuuuacucacagcauagauccacccacuuuagccauccugcauucccuguggugguggacugauagccccugaaaguagaaaccagaauaagucuuuacuccuuuuaagaugcuucugucaggaagcaagucagaauguaaauugcuaauacagcaguguguuuguuuuugagacagggucucacuguguagcguagacuguucucuaaaucauuauuaucuuuuugucucagcuucugaaguucuuggauuauaagugugugccaccaggccaaguuuagaaucaguguuuuuauaacuuuguaauaaaucuuuguguacuagacucugaaguaugacauuuagauaacuuucuaaaaguuuuuacuucucuagcucuuuguccuacuuuugggauccaaguuucacaacaaauugucuuuccugagcucucugauuuccuuucccauuuuuaaaaaggauuucuuaugggaaaaugugggcuuaaguacuggucuuguaauuaaaaguguucuaaaaccacaaaagcuauuaaagagauauggauucaaguagaacaccuaacuagcaugugugggaccuggacuuuagcccagccaaaaacagguacacaagucuauagcacuaauauucagucaaccugaaaauaguggguuauuugagcacacaaguuuaagucuaacccagacaaaguaguugagaccaugacucaaaaaaaaaaaaaaaaaaaaaaaaaaggcuuuacuguauuccaaaauguuuccugagacuucuaguagcugucauagugucuuaguauucuguauacuguguuauuugcacaggaacagaauggacuaaugauguguuucucagaauuuucuguuacaaacuuaagcucacuuuuuauuaauaaauacuaggucaaucuuucacaucuuaaauuagaaccuucaaaauggcuuauaggccauuuucauauuuauacauggcccauguauuaauucugauacauauacagagauuugagauacugugcaucaugccacauucuccaucucugcuuugcacaguauauaugugguauaauaacagccucggaauuuagggguuuguuuuggugauagagucuauguaguccagacuggccucacuuucuguauagccaguacugcccucaagccugaugauccuccugcuuuagccucccaaguguugaggcuccaggcucgcauggucaugauaccacccauugcaaguccuagaucccauuucaauacugguaucuaauauuuuuguaugugugaacuuuuccugagagaaguaaaugacugcucacuccaauuagguuaccaacaacaggacaaaguaacaguucuauccaaguauauaggccuacuauuaugugagaaaaacaaacaagcaaaaauagcugcaucaccaaaaagucucauugcgugugguugauaacuuccucauagaucccucacccuccuugaguuaaacuuccacccuuuauauucuaagcaggugugcccagccacagcccauguuugccacgacuggccuagaauacaguccaaaacaaaacugaaaacuuacuuugaaaaaaaauaugauuuccccuccccuacuuccuuuaaaagauaaaaagacuuagguugacaaaccugcaaauuuuccuauuuuucuaaaaauugaauaagagcugaagagauggcugaugauuaagagcccuugcuguucuuccaagggaucuguguuauuuccccaguccccucaucagguagcucacaaucaccuguaacuccuggaccagggaauccaaugcccucuuaagauuuuggcaucuuaaagugcaugguauacacauaaauaaaacaauucuuaaagaugaauaacauacagucaucauaaagaagcugaaauagcuuguaaaauaucugguugugcugaaagacaauucaaauagaagaaacuuaguuauauuuuagaauagaaauuucuuuucuguauggcuucaaaacguuuuuuuaaagaaacaucaaggaguauuacaaauaaaugacaguuuuaacuuuuuagauuuuuuuuuucaaaaaggaguuuguagggagcugaggagaagaagugcuaugaguucaagaccagccugggcuauagugugagacccuaacucaaaaugaauaggggaaaauuuugccagccagaauuucaugcucauuugggugcuaguacaauucuaccucaaauuuaaaaauaacaaaaaauaagacuuacaauuauuucuuaaccuucagauuuuagaauaauggucugugacucuaaaccuguagaauggauccccucacccccaccccccacccccggaccuggcaaaacaccacugauguacuugaaucauuuuugagugagucacuuugcacacucugaggguggcugaacaaagauuccgcuguguguuucccagccaguguacauucagaggguucuuggggggugggaggagguauuuauacuucuggacccuuugaccuucauuuguaaauccaacuaaauauaaaaaaaaagucagaucuagaugaaaucuuuauuaaagaaaagcugggggcuggagagauggcucagugguuaagagcacuuguucuuccagagaauguggugguucacaaccaucuauagcuuuguuuccugagguuucauacccuuuaacaggcucuauaggcaccaggcacacuccacaaccauaaauucaggcagaacacccauucauauaaagaagaaaaaccauggccaacugggaguucggaccaugugauuuuuguuucugagaugguuaggaacuuaccuuaauucucccagaaggaaaagcagccaacaugaugagcuucaugacaugaggaucuuuggaagggauguagugaaugugagugcuaugaacuguucaucauuagacaagcugaguuaguuaaaguagggugugacuguacauaaaaaacagaauggugacuucuggcauggcaguggaagcuaucauucaugcuaccacuaaucuuucccacuccugucuaccacuaaagcuuuuggacaagugcauagggucaagaauucacacuguuggccuggagagauggcucagcuguuaaaggcuaggcuuacaaccaaaaauaauucacacuguaaugaaguauaauagagaggugcacugucuuaauuaggauuuccauugcuguaaagagacaccaugaccaaggcaacucuuaaaauguacaacauuuaauuagggaugacuuacaggugguuaggacaaagcuaucucaaagccuacccccauagugacauacucccuccaguaaggccacaccuccuaauagugccacuucuugggucaagcauauuaaaaccuucacauuccacucccugaccccauaggcuuguucaaacacgagucuaugguggccauaccuagcuauagcauaaaacaaaauacauuuagcccaacuucacaaguaccauagucuauuacagacucaacaauguuaaagucucuucugcgauucaugcagucucuuaacuguaauaccuuauagaaucaaaauacaaaagcagaucucauacuuccaacaucauaggauauauauauuaccauuccaaaaacuucauggugaggaaauacuguaccaaagcaagaccaaaaccagcuggacaaacuccaucuccauaucugauguccaauuccguucugcuuuguugacuacagcacaauucucuuuggcugguuccacucccucuuaagcagcuuuccuuggcagguuucccagggcucuggcaucucaaauaucuuggggucuccaagacaacuucaacauuacagcauuuuguuccaaugccuggaacacaugaucuucugggcuucuucaaaaggcuucagucacaucucuagcuuugcccucuguaucacucugagcccugguugacuccauuccacugcuguugguguucuugguguucaucucaugguauuggcaguuuuccacugcaacuagacuucaccaguagccucucacaggcucuccucacagugccaagcuucagccaaguggcucuggcuuuagagucaagaauagaaggaacuacugggacaauugauacugguuaguuggagcuaagaaauugguggugauaagagaccagcauaacugaggugaaaucuucuuugcaugaucccuuuucaguccucugcuguuaacugaagcuucaccuuuacuaauauggccuuugcuagcgucacacagugccaagccucagcuucuucccuucaugccuucaaaacuaucucuggaaaacagcuucuuugugcucucagaagacacuucccagaagauuaagcucucucaaagcccacccccacugugacauacuuccucuaauaaaaccacacccaccccaacaaggccacaccuccuaauaaugccauucccugggguaagcauauucaacauacuacauacacuucuaacuuugauaacuuugcuuauauggugcuggaagcacaguuugaaaugcaccagaaggaagauuacuaagcuagaucagauuugauaaauggaauaacuaacauagcaguguucguuccuggagaaggagagccuaaacuacaaaucaguuuccuugacuugcuaaguuuuggguguuguuuguuuuguuuuaaccuguucuauaaaguuaaguuccuauuaauaggaaaugacugaagaugugcacccauuuuucuaagcuaaucuuugagacugucuuugugcccuagaugaccuggaauugcucuguuacucaggcuggauuugaauguacaaagaucuuccugucucugccucuuaagugcuggcauuaaaggugugugccaccacaccugucuguuuggguuuuuggagacuaaaaaauaaaaacauuucugaauuuaaaacaaaacaaacaaaaaaacaacaagaagaagaaggagcaaaaaaacccaaaaaaccagaaugguuauccuagcucacaggaaggugaggcagaaugauuaggaguucaaggcuagcuucagcuauaaguuugaggcuagccuuggcuacauaagauuuugucucauaaacaaacaugagaaugaauucuucuuguagaauucccagguuuuagagucauaagcagcacucauuugcucuucuggcguaugcuuccaaaggccacauuccuaacuguuugguguaaaugguaacuuaggccgugggagagauucagggcuuugacacauggcaaacaguaagauugauucuauaaaaccccaaaccauaguagaacuugcauaacagggcaacagguauuuuauuugauauuuguggggagagggaacaucauuaccaaaaugaggcuugcaugugcaaaggaacugaauuccaaagaaguaaaauaaaauuucuuguucaacuugggggucccugauggaggagauggagaagggacugaaggagcugaggggguuugcagccccauauagggagcaacagugucaacaggccagacccucuggagcuccuggggauuggaccaccaaccaaaggacauacauggaguggcccauggugcuggccacauauguggcagaagauagccuuguuggacaucagugggaggaaaggcucucuggccugaggauguucaaugcccaggguagaggaaugccagggugggaggaugggagcggauggguggaagagcacccucacagaggcauggggaggagugauggaauaauggguuuccaaaggggagaccuggaaaggggaaaacauuugaaauguaaauaaagaaaauauccaagaaaaaaaggaaauaacugcaggaaaaaaauucuugcucaagcuauaugacuuaacagggucuuuuuuagcacugacuuuaguuagaauaauaaacaaagguagcuucuuaacuuuggacuuucuguuguuguuguucuuguauugauaccuauauugaugcuuccucuacuaauuagugcuuuuaacucuuuuauugcuuuaagacagugucuuaacauaacccaugguggccuuaaucuggugucuuccugcuucaaucuccugaguucugaaaucacuaauauaccaugucuggcuauaauaaauaaaugacauucauuuaauaacaucuuauacaguaaaguugacucuuuguauauuaguuacuuuucucacugacaaaauacauaucaaaagcaacauaaggaagaauuauucuggcucacaguuugaggaacagagagaacaugauggcagggaggcauggcaacaggagcuuuggcagcuggucacacugcaccuccagucugaaugcagacaggugcuugcuggugcucagcggacuuucucuuuucuugucaguccaggacacagcccauaagguugauugugcauccauauuaacuuucuagaacaccaucauuagacaaggccuaggguguauuacuacuuucuaaauccugucaaguugacaauuaagauuggccauuacacuguguaccuacaaguguaauuuuggaaggccauacaacugcagauugggaauguuuucagaagggaugugggcuguauuuccaugguauaauguuugccuguaaugugugaguuuuuggaguuugaucccucaccaaugcaaaaguaaaagaaaaaaguauuguagaugagauugugucuauacugaacacagacuuuuuuccuuugucauucuuuaauaccauaucacaacauuuuaccuaacaacuucagaacuggugguuugauuaagaauggcccccauaggcuccuagaguggaaugcuuggucaccaaggaaugacauuauuaaaagguaugaccuuaaagaaguguguuacugaggguggacuuugagguuucaaaagcucaagcucucucucuuucucucucucucucucucucucucucucucucucucucucucucuccugauuuagacaugcuaauaaauggacuaaaccucugaaacuguaagccagccccaauuaaaugguuuucuuuauaagaguugccaugguccuugugucucaucacaucaguagggcaaauacuuucucaucacugccuuaguuuuucaagguaaaacuaagaccaccagagaccauuacacagaaacucuuaaaacugaaaagaaauucuuuauugcuggccugcagcugcauugggaacuugccuacaucaugcagccccaagccuuucucuuuaugcaccaaaaacauauccugguugucauaguucagauagcaggaagcagaacuacagaagccagaaagcaagguuaguacauuucgagacuuccuggaacuguagacuaggucuuugauggguuacaucuauguuccuguuuuggcacacuuugaggccuacauguuaugauuuacagucagaacguugcuucuagcauagugucuguguuucuaaggucugggggccuguuacauuagcuauaucucagagguucugauaaauugugcuuugauuuucauuugaaucuagguauuuuuacauuuccuccuugaguucuucauuggucauucauaauugcucagacccauuaccauucagagagaagaagacaaacuacuauuagcagcaaacugcaacagacucuacacaguaaauacacuugacaauggauugaagcccacugaugucaucuguuaauuaucacaggacauaaaaugacaagguugcauauaaugugcuuugaaguuaaaaucauuuaagguccagcacuggggaggcagaggcagguggauuucugaguucgaggccagccuggucugcaaagugaguuccaggacagccagggcuauacagagaaacccugucuccaaaaaccaaaaaaaaaaaaaaaaaaaaaaaaucguuuaagggguuaguguggauauaguaaguggaugaaauaaaugaaggggaaaggcaggaaaagggagaaauacauuaaaagaaaggaaaaagaagcaauagagaaguauagaagagaagagaaaagaacaagaaauuagaaaaaaauuaaaugaaaaauaaagauuucccaauaaugagaaaauucaaaagcgaaauuagguaaaugcaagaaggggacuaaaaaagauaagaucaucuaaaauagcuuaaagugcuauuuaaaaauagugugggaacgaggaggauacauggcagaaugauauaagagaaaagagaaauauauuguucaauaaauuucugugcgugagggcuggagggggucaguuaaacuggguuucugucuuuccuagagcuuaugcuguugcuguguuucuuagguaaacuugcggugucuagcacugcugucuucauugauaauuuuccuugucugaacaccagcggccucugcuggccauacuuaaauugcacccuguggcagguucucuccccuggcagaaguucuguugggaauguuucucucggguaccucaaaagugugagaaaaagucaaagcacaugggaaggacaugucuccguacuuuaaagaucuccugguuuucaaucacucugcuagauugauaugucagugguucuuuaguacaccacagaaccuccaacguucucaggcucuuuuggaaguguugauggcuccagagguugaugagcuacugaucucaggcuaucaaacuccagaaucauuucaauaaaugaacuauugauaagagacuaucauccuuauguacuugccugcuuggaugaguccccccaauucccugugcccuucagcuugccagccuuuaucuagcucacuguucucuauagcuguuuuccugggccuuccuucauccuaugucuuuggcaggccugauugcaguuuccagaccucugguuccccacucagcuuaacaauagguuccaucucaagaugguaucuggcucugccauuggggucuaauguaaagugaugaaguggaacuucaguuuauauugauuuuuccaccaaaggaauuuguuucucaccagaaccucccaacaggauuugaagcuuaucaaggcuuuguacuuuucuugacuugcuuggcuuaucuuuugcccuugcuucucccauuccccgccugggcacagaugcuaugcuugccuacucuuuuugguuaaucacauguggguuuuuuuuggcauuuucagauauucuuucacucccuuuguggauuuccaaaacucuuucaugucuuuuucuguuugggauagucuugucuucugacuuauuccaucuggucaaauaccucuugcaaguucagggugguagugggggggggguuguguaaagugucaaaggucauugguauuuugauacagauuacauuacauugagucacuaaauuacuuugggaggcagaaacauuuuaaacaguuauauggaauuuuucuacuuuguagaugugcuuguguacauaaauguaugaauacauaacauguucauauguucgugcauuucguaugcaugcauuccucaguaguauuuuauuuauuugggugcacauauauuuaggaaaguuacuuucucugcugaauuaaucccuuaucauaauacagugauauuucuugucucuuuuuacucuugaccuuuguuuuuuuguuuuuguuuuucuuuuggauuccauuuuaaugauagaaguauuccauuccuuuacuuugcaucuguauguguccuuagaguugaccuggauuucugauaagcauauagaguaguuuuucuauuuaaucauucuuuguguguuugggaauuguuuauuugccuauaauacugaggauugagccugaagccuaguacaugcuaggaaaacaguauuauaccccgagacuguuuagcuggggaccuuaacucacucagauucaaaguaauccuggaaagguaugcuguuaccauaaucauuuuguaaugcauucucuaguuuuguuguugcuccuauuuuuuuucuuucucccuuucuuguagucuuucuugaugguuuagugcuuuacuuacuauuuggcucgaguaguguggcuugauucuuuauuacuuuugguuuguauauuauagauuuuuuuccuuaugguuucugugaugcauacaaacaucuuuuaguuuuaacuauuuuuaaauuguagcacuucaacaugaucauaaagguacgaacaaaccaaaggaacaagaacaguuguuuuaaucuagacagggguagggccaugauaauauauauaguuuaugcaccauuuuuagcaauauuagagcaucuggauaugucuguguaaggacucucacuagucagcuuuguacuuuuuccauguucucuuauuugucaaucucuugugguuugaagaccuucccuuuaccauucaagauguaucugaugggacaauauccuccucuugcuuuuguuugucugggaaugauguuaucuccucaauuacguacaauauucuuuuuaaaaaacauuuauguguauguguguguauauuuuuuuuuuccuuugaguguguaggggaaggcaaacgaugugugccgcugugcacauguggagucagaagagugcuuggaagaguugguuuucucuuuccaucuuggguauuccaggaauggaauucagguuuuaugcugggcaauaggcaguuguuuuaauauuucccuggcccuggacacacuguucuugauuaauggugcuuuuucuucagugauaugaaaauuucaugccacuuuuuuccugccuuguaagauuccugcuaagacugcuaucaugagaauagggauacuugcauguguuauugauauauuuucauguacagucuuuuaaauauuuauauguacacauguguuuugcuaacacauaugucuuacacuacuugugugccuguagaggccaaaagaggacaucagaugcuccuggaacgaaauuacagaugguuuuaagcugucaugugggugcuaguagcugaacucaguucucuguaagagcagccagcuaaaccaucucuccagcccuuaaaaucuuuuuugucuuucauuuugagagcuuaacuauagagauaucuugguauagacuugcuuuaguuagauauaacugguguuaccuuuaaucuuuuauuauauauggauauuuguauccuaauacaaauucugggguuuuuuucacucaacguguuuucuacuuuuuuuuuuuucuugccauuuuuaaauucuugggacccuguaacuugaguacagaguacaggguacucaaguaccuucuuuaccaucacaaaggauccauaguuuuuaauuuuuuccauguacuugucauguauuuuucucccugguguguguacacuuugguacuuaagcacaauuuaagccuagguuugucuuauguagauucuauauauaucauuucuugguguguguguguguauauauauauauauacacauacauacauaccaagaaaguauagucuuuuaucugcaagcuucugccugagguccuguaggcccugcugccucaucuuuagcuccacguuucuuucugauguguauuauaugacagugcaggauucaaccuuguucagaaaagaaucucuuuggauagaucuuugauccuugggcuuuuaugucauaccagucgccaucaauacuuguaagaugaguaguacuuuuaaacccacauacuaccagcacaauacauaguguccuaugaccaagggucacagugcuaugagcugccuguugcugagguggacuccuagcccaagaugacuguaaccagucauaaguauuaguuuucugauucugggacucuucagagacacugucugaccagccuagcacuaaguuacagcauauagcuuugugcuuacuaugcugucccaugguuugggucuuauaccacacugugcugccaaauguugggauaguguugaugaagguucaguccugauccaccaggcugauucuuaagccuggucaggccuuacaugcugaagcuuaacaaucucaggugcacugagguccauaacugcugguaaugaaggaugugucuguccugcuagcguauggaccuaucuggcacuuuggcaguuugagagagacagugccuuggcuaccaagaugcuaagcuguuucauaccugagucucucacagcuauagagaacuguacuacuuuaguagaucagaugugccguggaaccaguccaaggcuggaaacaauacaggcugaagcuggaguuuugauuuacccauacacaaauaucucccuguugcaggagccagauucaaggcucuuuguguaaacuuuagccugcauauagggcauucaguuucuacagguguuuggucucacuuugggccaggcauagaacucuaggacaaagccuuuggcuaguuuuuaugcucuguucccuagcaaauggaaucuuauuuucccucuacugccugagguugaaagagguagucaaccuccugaccuaagcauuguuguaauggauagugggcugcugucaggggucaugugacuuugccuaacgcuggguuuugccauggcaggccuggcacugaguaucaagucuaagauauggguuuaacuucuucacuguacccuaaacaagagcccauugaauauaucuacaauaaauacuguagguuuggauuguuugaagggugcaagagagcuuguuuguuuuaggaugacagugacgccaucacucaccuucacacagagaaguuuagaaagucuggucaugccuuaguuaacaauggggauauguucugaaaaaaaaaucauugggcaauuuugugauuguauggacuuacauaaacucaacauaguacagcuaaaucacuuucuguggcaucuguuuacacaagaaucacacagacacacgagucuguauugcccuaugacauaaaguuaagaaauguaguaagcaugagugaggcuugugccaguauaauauggcauaugcuauuugcagugaauuuuaauuuauuuggcaguguuacggaugaaaccuggagccuuaugcaugcuaguugggcauuuuauccccugagcuauaucccuagccuuugaacuuuuuuucucuuaaugucaguacaggcauacucucaaagaauuaugugaaauaguugggaagauauuuuagucaguaauguguuuaccuugcuugcaagcgugagaaucugaguuuaauccucaacucaugugaaaaaucagaugugauaguauuuguaggauucuuguuguuaaccaugcaaucaaccagcauuaagugaauuccaggccggugagggagacuaugucgccaguaauagguaaacaaauaagugguagcaaaggaacaacacucagaguuguccuuuggccuccuauguacaaaugugugcaugcgugagcauacagagcaccaaaauaagguauacugaaacaaucuaaaccagugauggagacacuuaccauaaucaauauuaauuauuauauauaacuguguuauuguguuucuauacaacuaucaggacagaagcucuguuuacacaagaaucacacagacacacgagucuguauugcccuaugacauuguuacaucuauaaggucacuagacaauagggauuuuucauguccaccauaaugaggccaccauuguguauaugguugcuaauugcagugugugacuucacuuuuuugcuuagcugaaaucucuuauucccaauccuaaccuggucuuuguucuaaugcucugaauuuccacaguacuuuguugguacaguuaaagaaacagaugcuagugauuugggguguugucaugucccagaugguuaauuuucugucuuccucccugcuucuccuuucaggcuccaucaguagcuuucaaguacacucuguaaguaauuagcauccccuuucuagcauuugaauuugugacugcaaacaaaauucuauaagacuuucaguuugcuuccauugguguuuuuccauuuuccuucuuucuuucuuuuuuuuuuuuuuuuaaaggagcuaagugagguuugcuaggauagauuuuguuucuuuugcauacaccaagaagccuaauaggucauguauuuccucaaucuugucucauaguuguuaacugguacaaaagccccaagaaacuccuugcuaccuguguuuaaaaaaaaauacaaguaaaaaaaauaacuacccauguguucugggaguugucuuuuuaugaaggcuugguguuuuguaucuauuuagguugauguauuagaagaacuggcauuuaguaagcauccuaguucuuuugcuuuuauccccaaguuacuagacaaauaauguagagugacauggugccugccuguaaaccuaagcaucagugugugaagacuugccuguagggcuuuuuaaacuagaccggcaacauggagacauaaucccuaagauucugggccugagaaugcauuuuuuuccccuaagcucccaaguguugcuaauuuaggauuucuuaggacuacaugcaccagaacucaaacucaauucugccgcccccugugucuaggagugggcuuuugggauagucuuauuaugguaccuuggcugacuugacauuuaugauguaggauaggcugguuuugaauucaagggguuaauuccaggaccauaguggauacuacaucuguagauucuuaagucccuuauauaaaagugcuuuauugcauguaaccucuauacacccucucauauacuucguaguuucucuaggugacugguaacuaaaaacuauguaaguaguugcuauucuauauuggaguacuacguaaaagcagcucuauuucucccuggugaugaagaucaguuuauucuuucaaaucagcagcugcccucaccuguugcuucuuagguccuagaguuuaaaguuacucugcuagcagcuuguacuuguaguucaguaagagucuuguacugcucuuuuccucaaaaacuguauacaaucuuaagaaucaagaucucuaaaccugcagagucacacucagaaauucagauguauuucuuauggaguaaacuuacuucucuuuuaaucuaguuauuuaccugaaaaaaauauuuuuccuuuuuuguucaucuuuuguuuucccauuuugagacaauauuucuuaugacgcaauuuaccucaagcucccuauguagcuaaggaggaccuugaacuucugauucuccagguucuaccucuugagugcuauuauuauagugaugugcuaccauauacuguucucucuuuuguaauuuaauuuuacauauuugcacguggugacugugucuucaagacuaaagggggacguuuugcagguuucuagaaguacuugcagaucugaaguuaguuaaccuuguuccugucccauucuacugaucggaauaaauuauagaacuaaccgagaucagugggaagaacaaauagacucuguauggaaggugguauauuccuauugcaggaaaucaugagauaauaauagaaaagagaaaauaucaugguagcuguauuagaaguuuaauuugcuuuaucuccucucuuccaaaucuuuguagacccuucuuacuugaaaugguuuucuuuuuuaauuuuguaaccccuuuuauucacuuaaaauuuuuucacuuuucauuuuaauaaggacuaaucggagauacuauguguuuaacuuuccucaguagaaaauugugaucuuuggauucagugcaauguuucuuuuuauuaguauccccauauugccuuacuaacuuacuagaaugcaaguugccuugguuucuuuuuccucuguuacuaauagauacuuggcaagucacauaucagaguaugacaguaguuagcaguggucucugcugauaugaaaauguuucuuacaagagaauaagggauauauauuauauagagaauuuauguuugucugcuuuuuauuaucaucaccacauaccaguaaucuuaaauaacaugaguagcagaacacaccuuucuguuggggaugugaacuucugugaaguucucauuugcauaugccaaagcucauaguuaagauuauauuuuaucagagggcuaaagaaagauugcuugcugcuuucagaguuaauaguagugccguccauuggauauauuuuugcuuauaggaaauuauaauacggagucucuugagaguccuuuagaaaaucauauuuuaaggggacuuuaaaaaaccacggggcuggagagagauggcucaauggcuuaagucuguuuacugcucuuacagaggaccuguguucucagaacccacugugagcagcuuauaaccacuuguaacuccagcucuggagacaucacaugaacauacuccuuaccaccaccuuauaagcacauaauuaaaaauaaaauaaaucucuaaaauaaaggaaaaaccagaucuuuggagguguuagaugggaugccuaaagccuacaaacauugagacuaaucuggaggaaacuaaaaacaaacugagcuguauuugccugugugaguguuugaaauauuuuuauauuuaguguccacaaauauguggguacuaaagaaaaggucauagcuguuuagaaauacuuagguaagaaagguaagaaguaaugaguuguuggcuuuguauuguuugaguaggugcuaugcucaugaagaagaggaauuccuagagggagcuccuccuuacuuuuguaaaacuuggaauucagagguuucugcggcccuuguguaguuaacagagcucugucuuaaaugguuggggugcuuaaaaagauuugagugaggaggaugggucauauuuuggaguguauauuugaaaaguaaucuaaacaccuuuguguuucacaggacuuaaauauuauuuauucuuaucugcaugggauggaaauacuaucaaaccucagggagcaucagcuuaggugagugugauugguuuaucagucugcgcuauauguuacgcaucuguucaccggguacuuguuaaaccuuuacagucauccugucuuaggcauuugaaguacuuagacuagaucucuaguguccucaaguuugaaagcacaguaaggacuauauacagccaggguggaguuggcccaugggaaagcagaggcagguagauuucucugaguucaaggccagccagggcuacacagaaaaaccuggucucaaaagaacaaaaaggagagagagagagagagagagagagagagagagacuggggguggggguggggggggggaaacaccagcaaauuguaugcuaggcagaaauaaguacugugaguaugauacagcauggugaugugaagucaccuauuagcuucuugaauuuagaucauuacugaagaccucuuuuaggaaauggguuuugaaggaaggaaggccucuguaacagggccuagaaaacgggccaaagaagacuuugguuucugguacagagugaaaaaaaugauauagaauacaguaguagucucagggagccagauaacuuaggacuuuuuguaaggcuagacauaggaguuucuuauuccagcuuuucuuagugugauaguuaagucuccaucauauaugcugcaguuuugucuucaauaaaauggggugauaacuuugucuuuuuaacguguuuuuaauuuaaaugagacuaaagcaaagaacuauguucucaauuugugccagauaguggaguugcccugguuuucuuucuguuucugugauaaacaacauaacaagaggcagcuugggaaggaaaggguuuauuuggcugacaaguucccauuacaguucauaauugagggaagccacagcugaggcgggaacugaagcagaagucauggaggaacacugcucaugugcuugucccccauggcuugcucaaguugcuuuuuuaugcaacccaggaccaccuacauacagaucgugcugaccacagugaucugcaccuuuccacaucaauuauuaaaucaagaaaaugcuucauagacuugcucacaguccaaucugauagaggcaaauccucagauuccuucuuccagauuauuucuagguuuauaucaaguugacauauacuaaccagcacagaacucaaagcucuucuauuuccuuuuugaagacucucuuauuaguugugccagaugcuuaagcuggguacaauauguuaaccuggcaugaguuugugcagccaagauccauacacuuuaugaaccucugcuuccucuuuaagucagaccuugccuggcagugguggugcacaccuuugaucccagcacuuaggaggcagagucaggcggaucugaguugagggccagccuggucuacaaagugaguuccagaacacagagaagcccugacuugauaaagucagaccuguguaucugagaucauaugguuauauuguagcuacuuuagagugcuaugaagcauuaauuauugugauuuuguauauuuucauucaaccugcuuucuuuucaugaccaauuagcucacuguuuuuucucaguguucaagguucugaugaugaaccaaguuguuaaaauauaauuuauuuucuguuacauucuguguucuguauaaaguaacuuggguguuuguguuugugaauauaucaggaaaaaugaaaacuaaaaauuagagcaaucaucaaaaucuauuuauuuuauuuuuaaagauucuuuuaaaaugcaacaaauuuaugaaccuugcagauuuuuuuuuggguggguauauauguacuguugccaguaacuguucuucacaagaugggggaaugagccauucaaauguauauuuuaucaagauaaaauuauuuggugugaguugacaaguuuuguuuuguuuuuuuguuuuuucgagacaggguuucucuguauagcucuggcuguccuggagcucacuuuguagaccaggcuggccucgaacucagaaauccgccugccucugcacacacacacaccccccacccccccagugcugggauuaaaggugugcgccaccacgcccugcaacaaguuuuuuaauguguauaagaaccuuaauuccagggcuggagagauggcuccaggguuaagagcacugacugcucuuccaauucccagcaaccauaugguggcucacaaccaucuguaauggguucacccucuucuggugugucugaagagagcaaugguguacccauauaaauaaauaaauaaauaaauaaauaaauaaauaaauaaauaaauaaauaaaucuuucaaagaaaaaggaauuuuaauuccauaacaucauuaugguuuugauugguuuuguaguuucguuuuacuuugcuugauuuuuguauacaaaagcucacuuuauugcucugaugagacuugaguuuauugucauaugacugccucagccucaauccaccugcauauggcauaugccucagucacaggcauaggccacuaugacugguuugcauuacuuuuuaaaaagcgaagaagaggcaaaauacuuuaaaccaaaauaucuauugcucuuauaaaaaauguuauugcauuacaauauauuuccaagcuuaguaaaaauuuaguuuucugucugaucauuuuucuauugauauaacugauaguuuuaaaacaaaauguaagauaaaagccuugucuuuuuacccuuuuuauuagguuaaugucuacaagagcacgcuaugagagauacaguggcaaucaaaugcuuuuuugguaaguauuuuuaugauuagugacuuauguuuaaaucuguacuuuucacauuaaaguugauuugguaaucauaaacugaaguauaauacauauaaaacauaggaaacaguuucgugcauucaauguuaaaaauauaugcaacuaugacuacuguugcuaaagacacuggcuuucuuuccuaguaagcuccacucagcacuguuuuggaaugguaauuacaauugugacuuuauuguuaucaauuaauuuaccucuuugucaauuucuuacugauagaucuuuugaucagguuguuaaaaagcaaaagaaaggcaaaauacuuuaaaucaaaauauuaucuauugcuuuuaaaagaauguuauuagauauauuuccaaaguugguaaaaacacuuaguuuuacgucugauuuagcagaugucaguccaggauucuuuaauguuccacuuugggguuuaggauuugggaugguuuauugaacacacaccuaaagacugaucgaccagggcaauagcucaggcucaagagcugaaagcugugugcuggacauuucucagagccagcuuauaaagguuaaaacugcaaaaaccaccaugagcucauagacaggugcuggaaaugcuauccagugguuggcccuaacucaagccauguuuuacauaauaguucauauucaccuuuaauuugauggguccuaacaugaagccuauaguuguagaaugccuuaagaguaacaaaccucuuaacaugcagaacauaagcaggguauguggucagcaugaccuugaacugagucaaguuauuuuucuucaucaguaacuggcaggcacguuacagcuguaauaugaaauagcuggcgggcauggaacaaauagcuagcggcuaugguagagagacaggccucaacaguucucuuucacugauauaguuagaguauaucuugguuuucucuacuguauguugggguuacuuccagauuuuuacuguugugaagugaaaaauaagcucccugugggaauuuagcucacuccuuuguacccuuacuuauuauuaauuccacuuacacaucuuuguagaaauaaaauuaccagaauuucgcauauuauggaguguuaaauggaguuacuaaaauuuuucaagugucaaccagcuuccugcuauuguuguaccaguuucagugacuuucagcuguguaauaacuccuuguacccaucuuuuuugcauuuuuguauuuccaagaccaagguuaggguagaucagucuaccuuggccucccuguggauggaaccaaaggcaugagccaccucgccuggccuuguugacccaucuuuaacaccuuugcagccuauuuuauguucuugcuucaguuuuaggcaacaucacuucauuaucucaccaugauuuuauucuacaguguucuguucacuaaugaugauuaaugguucucauguuuucaaccuuuuuggcuagcuucuaaugaaaucuuaagaguuccuaaucauuuuucuguuguaaugccuuauuugggaaauuaauucaucauggauuaucaaauccuugguagauaugcuugcugcaaauacuuuccucguuaugauuuuugucuuuccuacaucuuugcaaggauguauacuuggaagacaaaggggugauuggaucuccuggaccuggacuuauagaugguuaugaacuacccaacauagauccucccaagaucaauaugcacucuuaaaccccagaaccauuucccuagccaugaucaaugcuuuuuauaucuguucuuuaaaaaauuauaagccgggcaugguugugaaugccuuuaaucccagcacucuggcggcagaaggcaggcggauuucugaagcuagccuggucuacaaaaaacaaguccaggaagauagccagggcuacacagagaaaccuugucucaaagaacaaacaaucaaacaaauuuauaacgacccaucucugcuuuaagauuguaaaaauuguauuguuuuuaguuaaaaccuucaguauuuugcuucccaaaaaguguguuaacuccaugauguaaaagauuuuaguuauuguuauaaauuguaguuaaacucuuauuucccuugauuuaauucuauuuuuaaaauaaauucauucuauaugauguagcuauauucauuauaacaaaguuauaaaauaaaagguacaaaaugguugacauuauauagauuuguauucagucuacuaugugucugacugaccuuuagugaaggaaaucugacuugauauagagaaaagguuaaaaaugaacaucuuaaaauaacuuagcagcaucuuaaaauaauuuguauuuuucuuugguauaaaaucaacuguuuauaacuuuuuuacaacacaaggauuaauuacaacacaaggaucugagacuuugucagugaauuuuguuguuguuguuguuguuguuuugcuuuuguuguuguuuugcuuuugaaacaggguuuguccuguagcccuggcuauccuggaacucuauguaguaccaggcuguccucacaaaaauccaccugccuccacggccugagugcuaggauugcauauaguuaaagugcuuuuaauuaguuauuuuucuacaugugauuuuuguggcauuuuguaugcuauuuggaaaauauuaauaauaaugaauuuuauaauuuuuccauuuugacaccuuuuauacauuaucuuuaaaaugucauuaacuaaugaaaccacuacucucuuccagaaaauuuaggaacauuccaaucuuguuacaucuaaaauugaaauuuuuuaaagcuuugguuuuaugauugacaguuuuauaauuagguuuuugugaugccuaaacgacccaguaguuuuuaauacuguuuuugcuuuucuguauauauuggagaauuaacccaucaguuuccacauucauaaaaaccuguuggacaauuuggcccuuguguugggagagcauuaaaucuaaaucagugaagaaagaauugacaucauagaaauaccaucuuucagcaugcacauacguauauucuuccacuuauuugcuggucuuuaauucuuuacagcaguguuauguuuugcuuugguuuuacaggaaagacuuugcugcauauauacuucuaaauugacaggguuuguuauuuugaaauguggguagucuuuuucucugauuuuuuuuuuagauauugauuuaucaugcucuacacaguuauguuaaagagucaguuauuuuuauuguuuugugagugacauuauuuucucaugaauauuuuucccucuugcuucucaacagugucuaguguccuuaaaugugauccccccuuuagauuucuuuguuaaggauuuauaaaacuuuuucauuacauuuaaaaaacauccuuagucacuauguuuuuaugauugacuucuuaaacugauuuuucuuuccuacuuucauucauuuuugucucucaucuuuauaccauuuuccucccuuauuuucucuauuauguuauuuucuacugacuuucuuguuuaugaauucuuuucuccucuuucuaguccuaaauaaaacuucaguguuugacuuccuggaauguguguguguuuuaauuuuucaguucuagguuuuaauacauuuuucauaaauuucagugcuuaaguaaguucuauguugucuuuuuugguugguuagcuuugagcuuacuaaauauaauggaugggguugguguuuguuguuuccuauuuuuuuaauuauuauuuuguuguuguucucaucagucuuaguaauuuucuacugaaugccagaugcugugugaaaaguagaaacccugcuuagcuuucucugggugcuuagaagugugcuuuguuuguucuugcauuuugauaggcagaaugaagacaucuugaugcgacgaaugcugcaucauguggucauuaguggaaguuuucuuuugguugcuucuauuuuuuagggguuaaggaagcugcagaucacucaaaauaaaaugaauaaggagaauuaagggaauucuggaaaaggaaggaagagagggagagaaggaaaugaguaagaucauuauggaauagacaggugauaagagucuagguaacaaacaguugcaaagagguggugacauugauuggagucuugaacucuagauuacugaagauuaacuugugacgaagcaaauauuccaguaaaugacuguggaaaugcauuuagagcaaaauagaagauaaaauuucuaacaaucuggccauggugggcucacauggagaaucucagcagugggagucugaggauagaagauugccaugaauuugagagcagucugaucuacauagaacguucuagguuagaccuguuauguucuggguuuuuuguuuuuuguuuuuuuguuuuuguuuuuuuugguuuuucgagacaggguuucucuguguagcccugucuguccuggaacucacuuuguagaccaggcuggccucaaacucagaaauccgccugccucugccucccaagugcugggauuaaaggcgugugccaccacgucuggcuccuguuguguuuuauuaaaaagaaaaagccaaggauguauuugauagaagcacgguagggugagauggaagggggugucucuguggcucaugcugaggcagcccuucccccugaaguaccagcuauacaauggguuuaguauagaauaguuuauuuagggcaugagaaagggaguagagacagacagaaagacagacagacagacaggaggagagccuggccaggaacauguggagagggggcagaggaggaguggggaagcaggaagugggagaauggggucaggaugagaaggggcagagaguaagagaaaguggagggggcaaacaagccccuuuuauaguaagccaggcauaccugacuguugccagguaacugggacagaaaggauuuguaucagccaagaauucugcaagaaaugggaggauuaacuuuuagugucuggaacugauuacaucacaggacagugacugauaugaucagaugaucuaaaauuuacagcugggaaucuuuaaugaaaagaauaguuuguuauugaugugagguauaaggagaagacagccaucuuuaggcccagaggcaggagaaauauaugagagaaucuaccauuuuaauauguuuguaaaguaggcagaauccaaggaaauccccagagaacacacugagaauaaaagauaucuuucagaugucugacuagaguucagaagacucgaguguuuuuauccuuaugcuuaguuguuaagguucaagagagcuaaugaguaucugcaguauuuucaaauuuuacugacaauuauaacauuuugaaaauuccuagaaaaugagugguaaauauggagaucuaaaaauacuagagcauuugguaaaaguuguuaauuguauaaaaaaagaguaucuuuacuuucucuuucucucacacauauauacucucuucgacccucauacacucugguaugcuagaaauggaacuuugggccacaaaacagcucuguuacugagcuaaggccccagccccuuuagugguuugagguuggaauauuaaucaagcucuacuggacuugaagaacuuaaaaacaugagaauuuuaaaaauuuuaaagaaaauucuuauaaauuggcccaacuuaaagguuguugaaaacugugacuaaucauuguguaaugacacugaaaaucaaaaucagcucuucuuuaaaauauagcauuauaauacaaagggcaaaaggaaauucuacccugaagcuccacaauuuuaucuuuccuaccucuauauaacacaauuucaggaauucacuguuuuauuguucaucuauuuucuuuuucuuuaauauuuuuuauuauuaugcauuuuccucaauuauauuuagaaugcuauuccaaaagucccccauacccucccccccccaacuccccuacccauccauucucauuuuuuggcccuggcauuccccuguacuggggcauauaaaguuugaguguccaaugggccucucuuuccagugauggccaacuaggccaucuuucuaauuguccucuugucuguuuuuuaaguucucauguuuccuguuuacuggugauuugaaggguuuuuuuucccccuucugcuuguguguugagaauuaucuucugccccuugugaacaugcucuauguguaaaacauuagguaaggaaacaagaagauaccccaauauuguuacuuaguuuuuaauuauuugcagcauuaccagaauguagucuaugcuuugcauucauauugaauccgcacauauguagacauuuguauuugcuuacuuuuuuccuuauauauuuaaacaguucagaaacuauugccagauguugguauauccugcuuucuggaucuguacuuguaaaagauucuaugguccuuccuccuugcagguaaguuuccagugauacuguguauuuuuuuguuuugugauuggaucuuaacuauuuaucuuugaauugugcuccugccucagucucagugcuaggauuuuugcagucugccugcuccaucuagcuagauaaaauuaauauuguaacucuuucguucuuuacuucagagcuaauguacauuuuuuuuuuccucagugacaauauauuuuugaaauauauuuucgguugaugcaauugcacauuuuggcaggagucuaauacuuaaauuucugaugguguaauuuuuccuuucuuuguguuugaaccuuacucaguuaugugacuuauuuuuaguuuucuguaagacaaagaugauaacccuugguaaaugucaugaggcauuagcaaguuugguuacucaaagcuuucaaaaguccguuagaacucagagcaagguuacugaaguuuguauuucuagcuagcaauucuuaggcagauuacuuaaccucucugaguuuacucagaaguagguauaauaaauaauaguagaagcuguuugauagaccaggucugcgaaauacauaaguuagcauaaauaaaucucucuuagacaucuccuggcuauuuacaguaguuguuagcaauauuuauaauuauuuuuuguauuuuaauauaccuuuaaaauauauucuuucacaguguauuuguauuuuuaucuacuuucccacuaaaccccuucucaacaagucuuuucucucucugugugugugugugugugugugugcguguguguguguguuuuacauucaugcugugccauggugcacaugucaggaaaucaggacaacuugaaucuguucucuccuaucaugugaguucuggagauggaacugagguccucagccuggcagcaugcaccuuuacucacugaaccauuucauuguccaaagaagacuuaaagcgagacaugagaguacagcuaaguuaguugaguaauguuaaauuuauuaaacuaaauaccaaggcacaggguaucuugauuuauaugccauuuuaaaagucauaucuuuuuuuuuuuuuuuuuuuuuuuuuuuuuuugagacaggguuucucuguauagcccuggcuguccuggaacucacuuuguagaccaggcuggccucgaacuuagaaauccgccugccucugccuccccagugcugggauuaaaggcgugcgccaccacgcccggcuaaaagucauaucuugaauucuaaaacuuuaaauuguuggccacggguuaaaugaaaucugugcuucuucaugaguagaauuaagcguguuaaccuuuuacaaagauuuuguuguuguucuugguuauuuacgccuuuuugcuauuccuuucucuauguuugugaaacuuaaaauaaugaaauuucauugggucugccugugguugauuuuaggauuaguauuuucuuuugaauauuuucucauucuccuguguuuuuuaaauaguuacaaauuuguuguaaaaacucuuuguagccaauaagugaccauuuguuucuaaucuagucaaugaaguuuuaguuuuuagaauaacucguaggaauaugaguuuugaacaaaguuaaagaaaguuauguuggacauuaacuuagcuauccagaacacagcaaacaugauaauacucguuuaauuaaacuuuauacuaaagaauauggguaauaggucuuuauuuuugugugugugaaaguuaagaaacacucauuaggaugaaugaguuaauggaaagagaaguucauaaaaugauaguugucauaaaauaaucaucacauuauuuuuggcuugugugaauguuguuucuaaccauuaugauacaagaagaauaugaacccuccauagucuaagacuagggaugauaguaguauuccagcccauagaaauacaaugagguucucuacuggggcagcuuaaccuaaagauauuaacuauugaauagcuucauuacuauuaaggauaaaaaaaauaacugaccgcaccccaacugagagugaggacccaagucaaaaacaaaccagaaaggggaacuguuuuuuuuuuuuccccuuaugacugaaauauaggcuuuauuagaaaauauuauucgcagucuaguacaaaagaacuuuagaguaccucuugccaaaaauuaguucauacugucugggaacugagaguaugagcugaugaacaguaaugguaaguaggaaaagcacccgagucuccccuuucuuccagaugaugacuggcccacagcugguaaaagggucaggaucuuugcccugcccuacucagccccacucuacccugccaacuguagagcaaagaccuuucuuguguagccucugcugacaaaacugccucuggcucuugggaaaguagaacacugacagaaucugcaacuuuuaucacaauguaggacuguugaaggguuaauuucaaucagagagucaguccauuuggaguugaggaaguaggugaaugcaaaauuaacuggcauggcauuuuagcuaaauacuuuuggauuuccauucaacaacaaaacaacucuuuuugacuaauaaaauauaacuaucauucaagaaaguacaguucuaaacucugacccaaaugaagagggaacaguccuauuaaucauuucuaacuauaucaauuauauauuccaccauaaugucucuguauauuuuauuggcuaaaguuuaccuuauaaauguucacuuccaauacccuguauuuaaagagaaugggggagagaguaacguguacaaacuaugaaaaucuauagguguaguucuuauccuucagaauucuugccuucagcaaaaacuaggcugcucuggguucuuuaucugauagugggagcugaacuuuauuguauaauguucuugauugucuugccuuuuuuguuguuuuaguuguugcuguucuagacauaagaguucuucuagcuacaguugugugccacaaacccaauuucuucuuuguaauugggguuagucacuugugacaauagaauaacaucuguuugcugccuauugguuuaguggcuagggagaaaaaagauuguguucuccugguaaaagcauuaagacuaaccaagcaaaguucagaguugguaggaagcaagcaaaaauacuauaaauaaguuguuagauuaaaacacugagaauacugggaaaagcaaagcauuguuauagcuguuuugccaaaaaaaaaaaaaaaaugaguuucuugauugaagguaaugcaaucugcagugccagauaagaaaauauacucuguaagcucaugaugguuagcaguacuagcauaaucuagaauguguuuggugaggacaaauaaccugacuccuccguaauugacgcgaucgauuauaaauuacguggcuccuauaguugucuuguccccuugagaaaugcuaacauauuaggaacucaguauuguuccuacuucugaaaaaauagguacucagauguaauuugauccccaucucaucuucucuuucuuugcugccauacucaguauguuuacagucucacugcucaagcacuguacaagcuugggaaagagacugauggaugucuacucuugccuucuuaauuauuaagagccuucucuggagcuugacagaugguucaguaaguaaagugcuuucagccaagcaugagggccugaguuuagauaccuagcaaacauauagcuaucuagaugcaugcucauagucccagcgugguggggugguagugguauggaauagagaagaugaagagagacaggaucauaugucuugguggccagccagucuagccagaacacugagcucuggguucccugagaaacacuguucuagaaaauaaguuguaaaaugauggagcaagacaucuacuguccaccucuagccugcaugcacauaaacaucuguacauacauacuauagaauaaaauaacagccuucuccauagcauaugcccuuuuagaaucuacauggacacagguaucuuuaaauucugugcuuguucugaaaggugcucauuuacauaccucuucccagacuaccuuguuaccaggcuucuaauucuguucuuugaaaucccugaccauucaaaauuaguaacugucucuuuagaucaguaauuguggccaucuguuuaugagaagaacagucaaagaaaaaaaucaauaguuauauauaaagaacuauaaugcauuauauguguuaccucagguucuguuuccuagaaauuaauucauuuucagcuucuguagaaucagcauuccuugggagcauggguaagagcuacaagaaauaaauggcaagaguaacauaguggcuuucuucaucuucguaucuauuuuaauagaucguguaauuuaauaggguuaguucaggaacugguggauggcucagcaguuaauacuggcugccuuuccauaggacacagguuugauuauuaguacccacauggcagcucacaaccaucuguaacucuaguuccaggacacccaacacccuuuucugaccuccacaggcaccaggcauaugcacauggugcacagacauauaugcagggaaaacauauacacauuaagaguaaauauuaaauaagaguuaauuuaagauucaaaaucuagguaugaugggaaagcucauaacuauauuggccuauauagggaugaacuaggucaguugaaguggaaguuggaaguucauuguuguaugauucuuagagcuucuacuauuuacuauuaauugaguaaaagcacagacuuaaagaauaaugauguugaguggcccuugagucugagggaguucaaugccccaaugcagggggaugccggagcugaaaguggggagugagugggugggggaacaccaucauagagacagggggaggagggugggauggggggcuuccggaggggagaccuggaaagcagauaacauuugaaaugucgauguucauggcccauauuaucaccaaaggccaugaagauguuccagggcuggacugccacuugcuugggaccauggugauauucaagcgcuacagaguggauccugcaccuugccuggguagcacaauagggcuggcacugguggcaugggugugagugagccagcccuaaggacaugagaacugccccacacuugccgacuguggcauuggguauguuggcgggguagggacagugcuggacuuugaguugaccagcaucuaugaacugcuggagcguaugaaggggccagaggaggagagacugguauaucuucuugaguuuuagggcacccugaucuacguauguaggaaguccagaacaguuggauauacauaguaacaagcaggggugggggugaggauauacagaaacuacuagcaaaauaauaguacacugaaucuagggauguauuuacaauacuguguuaucagcauuagaauuuuccaaauacaggguugguugugcauccaaaaucaguuaauaaaacauacuauaauaaaaugauaaaacugccggaugauuuaagcauagaaaacuauugauugaauacaaaacaaagugaaauuuguagacauacaggcagcaacuuccuaacccuuuacuuuguggucuuuuuacuuuuuaauaccauugugucaugcaguuugauaacuuguuuuccaccuucguuuuaguauaguagauucuugaaauuucuguguaaaucuuuggauuguuaugucagacuuuaaaaucaacuuucugggauuuuuaaguuauuauuguaacugcacugaaucuguacaauuuggagcuguuguuuuauuaauuggauaucagauuuugcacaucuuauguaaguggguucuuguuuuuguuauauuucuuaagauaguaauaagaauuguuuuacucuauagucucacuaucuauaacagaugugauuauuuugagccuuuuaaauuugugagaucaaaccuagcacuucagaacuguauuaucauuguuaaaaagaugcauuucuguagacagucuuuaauguccuuguguuaugugcuuguucaguuggcucuuuuuucucacauacccacuagauaugcuaugaaucacaguacaguauggacuugaggaccuuuccagagaucuccaaaguguauaauguguguguguguguguguguguguguguguguguguguccucucuacuucccuucuuuuauccuucuucucuugcauuucuaucuucucucugguacuccagcuuuacaaauuugaaaauuuugaagcaguuucucucuuaaaauugaguugauaucuuugaguucaauaacugcuucuuggguaguguugucaagauuacauguagcaaggauaguaagcuaagcauuuuucaaggucagcuuugcugcugcuuucucucuuggaaaaauaugcuacuccugagcugcuuaccuuccauuaucuuggaauuugucacauauauacuuuuaugauuuucuuucauuuuuguauuuucauuuacaagaguguaugcagcuccuguucuguguugcaugaaacucauuuuggaaacauacauaaaacgcuccaguauagaaauaaagugaucuuuuuuuacguucaaaagguaauuucauuagauuugggugggaggugguuuacuguuccacucuggcuggccuugaauuagauccaccugccucugcccaucuugauugcuggaguuaaaggugugugccacaaugcccuacuauucaauuuuauugaauuuuguuuaggauuuuuauuggaaauuauuauuuguuuguuuguuuguuuuaauguauuuauuuuuauuuauaugaguucacuauagcugucuucagacacauaagaagagugcauuggaucccauuacagaugguuaugagccaccaugugguugcugggaaucgaacucaggaccucugggaaaucaaucagugcucuuggccacugagccgucucuccauaucuuacauguuauaaaauuguaauucugagucuccuugugaaaguauaugcuacuuguugcuuuauuuagacccugguuccaguucauugguaaaguuuuguaauuugccuuauaaaugacuuagaauuuauucugaguagccuuuuuuugacaauaguauccuuccccuuccuguguauuuaauguagaggcaguauuuuacuuugauauauaauuuuuauuucauacauaugagcauuuuugucuacauguguguauacauauauauuggugccaguggaaaccacaagaggaugucaaauccccuaguccuggaguuacggaagguugugacccaccauguggguacugauacucaaacccaaguuuucugcaagggcaaaaagugcuuuuagccacugacacuacacacacgugguucacuuacacacacacacacacacaagaaaaacaauaauaaguaaauauaaauaacuuuuuaaaagccaaauuuucuaaaguucuaacaacugucuaggccucuuauggaacaauaaaaaaauuauucacuaaauacgaaccuaaaugaaagaucaucucagauuauuaaaggacacaguauuauaaacaaaucauuucuuacuugggucuauuucguaugugccuuuauuuucucuagcuauuucccugaaaccauucaaaauuuaaaagauaaggcucagaguaaucaagucugaguuaagcuaguagacuauacaguagaucaguuccuauugcugauaggaacuguaagcacuauaacaacucucagacccaucacauaucucugugucaccgugcuagugucuuagaucucaaauuuaaauguacgcuacaggguuugucuuugugucucauguguuugacaacuuuuuuuaaaauugaccuuucuaaagcucaguuuuucuuuuauuucuucuuaguuuugauuugcguagaaaucuuuuucucagaugaagcauauggaauacuuagcauagacuuuuuaaggcuuauuuuuuuaauuuuuuauuuuuuccagaaauaacuaaucuggcgauuccauuuuuuaaaaacaucauuuuauugucuaucugcauuucuucauuacuaaaauguuuuuuguuucucuauguuauuuaguauaauaauguacuuuuauaaaacauaacuauacuaucacaucuugaauauuuuucuuucaauuuagucuuguuuaaguguuuagaauuuaagauuaggaaaauaucuuacauaaacaauuauggggacuaaguaaagaaauuuuggaaaaaguuguacacagaauugaaaugagauuugucauauaugagcaauuaagaagaacucauuuguuuuuguuagaaaaaucucaguaagaugaucagaauuucucaguuaaugucuuggagcuuuuauuuuucccauauugacauacguuauaacuucugcuaaagaaauuguuuuucuguuuuuauaguuuugguaagcaguuuggaggaaaaagaggaugugauugucuuguguuagaaccuucagaaaugauugugguaagaugcugaauugcuuuuuuguaugcuucaguuucaacucuaaaugugguaggcuuucaauacucaagaaaguuucuuuuccauggccuauccuaugaugauauuuaaauaacaucagaaccauauagcaccuuuauauauuuuuaucucugacacuucuguugugguugaaaugaugucuaaaaugauaauagagguaacaugucccaaauuugguaacuuucuuuaccuguuccaccagaaaauuaaaaaguaggcucgggggaaugcggagaggaaauauguguaucucugucugugugucaacgaaguggggaggccucuuuaaagggacauaauuuuuuuccaguguuuuuuccuuugccaguaauggagucaguaaacuucagaugagcugaggggaagagcuagagaaaauaaaggcacauaggaaaucggcccaaguaaaaauaguuuguuuccaauacuuguacucuuuaauaauuugagauaauauuucauuuagacuuguguuuaaugaauauauuuuuauuuuccauaagagccuagauaguuguuagaacucuagaaaauuuggcuuuuaaaaagaguuauauuuauauguauguauauuauguaugauuguuuuuccugcauguguguaagugaacuacaugugugcaguguccacagaggucuaaagaggguauuggcugcccuagaacuguagguggucaaacugcaguggauaacaaugugcuuuaauacuuagugcacaugcaagagguauauagcauguuuauguaucaggaaaagucaggaagucauuuuaggcuacagucaucuuacauuugcuguuugaaacguggagcuguuaucucuuuuuuguaaagggaguuuguuugugauguuguuguuguuuuagaaaauguuuaaaaaccaagcuaagcucuggcuacugguugugcuuaaguuccuugagauccccucagugaaaugcaugccagcauguuuaaagcccagaguuuauucuggcauuuuaccauguccuuuuuauuuacuaagacuuagaaaucguuagcuuacauuuucauguaccuauuaauuuaucaccagguuguuuaaguauuugacuggugggaggguucaucagguaaagguccuugccaccgagucugacagccugcucuccagaaauuguucccugaccuccaccauugguguggaguguguggguggggaguaaauaauguaagaagauguuaauaaaaaguguuuaaggauuguuaauuuuuggcuggguggugguggcggcccacuuaaucccagcacucaggaggcagaggcaggcggauuucugaguucgaggccagccugaucuacaaagugaguuccaggacagccagggcuauacagagaaacccugucucgaaaaacaacaacagcaacaaaaaacaaaaacaacaacaacaaaaaaagaauuguuaauuuuuaaacgaguaaacuuaaugugcaacuaguuacaagccagacgucaugauucucgcuuuaauucaagcacuuggccaggagguggcaggaugaacaugauuucaaaaccauaugaugagucaggcggcauggguuacuuaagacuuugucucaaagagaaaaaaagaagaggaagagagaaaaagaagaaagaggacuagggugaggagacauauauuacuagccagaauacuaacuaacauacauacauacauacauacauacauacauacauacauacauacaugcauacagaaaauuacugccuagaauuuuaaugugcacauuuaauguauuaaauaugccuuuaaaaaauauuuaacaaugaauuucccuuuauaccucuuuaucaucuuuuuccccuuuaagaaacaaaguauuuucauuagcuggcaacaauguaaaggaaacauuuaagagaauuuaaaauaacccaggacccagaucaaaaacacucccauuggcgaaaccuagggacauuugggaauucaaauaaaaauuuauaguggugauggugccuucauauaucauacaaguaguuaaaaucuugaugaucugaagaaaugaagaaggaugaugagcuagcacuccuugaugguagaaugccaacuaacaaaugguaaggaaacacuuggcuuacaauugguaaaacuagggaggcuaauguucaguuaggcaacagaauacuuaggacaucacagaggauguuccuagcaauuauuuauaaaggggacauuacuaaauuucugauguuaaaauauggcagauuuucaucagaauaguaauuacugcuacugcuauuuuauauauacacacaaacuaaugggauauuacuccuguugugacaacacugagaagaagaaaggucaugacuagaauguauucuuguucagcauucauacuuaaacaaaagucacaaauuaucagacaaauuagagaauguucuacaaauugaugagaucucaaugacaggagauagaacagucauggaaccauucuaaaagacauaaauauagcaucuaaugaacauaaugguuguuuuucuuuugacuacuggacaguggagaauuguaaauccuguuagcaacauggcauacagguaagauacuauugaaaccuugauuuugauaacuguuuugcuaauaugagaaaguucaagggauaagaaaaugcauguugauaaauuucaugagaaauagacaaugucccuccaguuacuuuuuagaacuguuuuugcugauucaucuguguuuauaaugcuuuauuaauuauaguagaaaauaauccaauauuucagaauguauuaaaauguugagaauucauugaaauauuugaucucuaguaacuucaaggaugauuggaacuaccuacaaccagacaccuuuuucuucauuggauguguuagcuuaguugguaucuuucaaagcaaagaucacuuuguugccaugguuguaaaugccuguaguuccagaaccugagacaggugaaaugcugaacuuucaaggacaaugugggucauagugagacccucucucauaagcagaaaaaaaaacaauuuaucuuguuuuuaagagguugugaaucuguuaucuagaaugcauuucauuacagucacaaagauuucuuuucccuuuaggaauuuuuagguugagacuauacuuuaaaagguucuguacaugauuuuuauuucauuuuauuuuuuuauuuuugauuuuuaaauauaguuucuuccagguagaaagauaaggacagcuacuuaacagccuaugacccaauacauucuuggaguuagaccaguuuuucuuaagagagaacaacuauaugaaaggcacccaugguguaacuugaagacuucaucaaaaauuaaaaauaaugauaaaggguuuuauuagcaggcagucauuggcauuggaaagcaucuaauaaaauuggaacuuuugucuuugcugggagugugaggugcugccaccaguuagaaaaaugguuagguaggucaacauauuacccauucauuucaccccuacauauauaacaucugguaaacggauguacacauuauccauaauuucccagaaauagaaauagcauaaauaucugcaaccugaauaaaccuuauucaguguccauaagauggaauaguacucugcuuuauauagagugagcugucuauucuuccauaaauuaacaaaccuugaaaauacucuguuaagugaaagaagccagaaggggugagguaguggugauugggauguaaagugaguaaauaaauuaauugauagaaaaaaauauuguguugaaugcaaaaauaaaaaauggaaagaagcuagacaacaaaaccaucaguuauauuacuucauuuauauaaguuauguacaauaggacuccaggugguggcacaugcuuuuaauccuaguacucuggagacaguggcaggcagaacucuugugaguauaagguaagguuaggcaggucuacuacauacauagugaguuugaugccagcgagggcuauauagugauacucuaucucuguguguguaucugugucugguuuuuuucuucucugucuguauaccucuguguguguguguguguguguguugcaaauaaauauuauauuacaggagagaaauugaacuaauagguaaaauugagauuaguaguuaccuuuuauagaaaggacauagagaugaaauacagacagaugcugaauuucuuuagggugguaauaaugagcuagaccuagaaaguggugacuguuaaagaaauucaugucuauacagaaaaccacugaacuaugaguagguuuuuuuaauaugugaauuuuauauuaauaaaaagaaacaggaaaugucauaggugguuugacuacaaugguaacuagaacaagacuacaguacuuccgaguaccaagggaacuuuuuaaaccaacaaagaauacacauuuuagggcuggagagauacucaacaguuaacaguugugcucuugcagaggacccagguucgauuccuagcacccacaugauagcucacaaccuguuauuccaguucuguugcauguuuuugauuucuacaggugcagccaucgggccuacacuuguaaagcauauauacaugcagacaaacucccauacacaaagaauaaaauaaaucuaaagaaaaagaguacucauuucagagaaauaaauauaagaaauagaccuauaacagugaggcuucauuuaugucauagaaccaugugcaguaaauaaaaugauaaguauacugcaagugcauauauaauaugucccauaaauaaguauaauugugugaauaaauaaguauaauugugugaauauuccaggaauauugcaaguucaaggucagacacagauacagagcaagaaucugucuugggagaaaaaauaguuuaaggaagagagauauauggcuuugaauaucaggaguaagaguuuaaauuuaucaaggguagggagaugaugcugauuaacaguacuggcugcucuuuagagaagcugaguucaguuuucaacaccccaguuccagaggguccagugccgcuuucuggccccugcagacaccagacguauguagugcacagacauacaugcagaaaaaaaaccuauacacauaaaaugaauuuuuaaaauuucaauaaguaugguaaacauuggcuguccauugucauauuaggacaccugacaggaugauuaucuugguagcuuaucugacuacaguaugugauuggagaacaugucuaaagcaacaggaucacuguugauguauuauaagacugaagugauuaaaacucagguaagggauggugaugauacuguuaaaagaaaagguggcugggcgguaguggugcacaccuuuaaucccagcacuugggaggcagaggcagguggauuucugaguuugaggccagccuggucuacaaagugaguuucaggacagccaaggcuacacagagaaacccugucucagggaagaaaaaaaaaaagaaaagguguuaggaaagggacauguacaaacaauauugaccuccugagaaauggaucuggucuuuggaagaugagcauggagcuggaaauugauuguugacugaauugcuuaauucauugccuaaagcauauuuugugauagcagagagaugugauauuaguaggaaaaguaguuguagaggaaaaaaaauaauuucuauguuagguuaguuauaaaguauaauuuagaacuuaacaauauacguuugaacaaagauuuaaguuuagagagcugaagagaauguucuuagagaggacucagguuugguucccagcacccacauagagcuucucacagcuccagggaaucccauguccucuucuggucucccuagguaccagcacauguguaguauugacucacucagacauauacacauaugggcauauaagugaaaaauaaaucuuuuuuaaaauauuguuuuuuaaaauaacuuuuuuuuauuuguuuguggggguugguuuuuuuguuuuguuuuuucgagacaggguuucucuguauagcccuggcuguccuggaacucacuuuguagaccaggcuggccucgaacucagaaaucugccugcuucugccucccaagugcugggauuaaaggcgugccaccacugcccggcgauauuguuaguuuuuauaguagugauauauacucuguaauuggauagcagucuuacgucaagauuacagguuuugcaauuagauaguccugccagcucaccuuuaguaagggucacucuugugaccuggaaagauacuaguccuuggggguuucauuuuguuuuuuuaccuagagauaauguuguagauuuuuuaaaaauauauauauauauacauacacacacacacacacacacacacacacacacauauauauaauaugucuauuuuaagugggcuguauaacagcuucucuguuguuuuuaaaguugccauccuuacugauguuguuaugcauuaagguggacaaaaaaaguuucuaucaaauaauagaguaauuuuguuuugcuuuucaguaguucacuaaaaugauagccaugauuguuugguaaguaaaguaaaugcauaauaaggcaguuuguaauuagacuaacauccaagucauaauuauugaauguguagguguagcuaacagccuucauuucugguaagagacuuuacuuagacggauauguuuaugugcucaagacagacaguuuccuggaaggaaacuguggucucuaguucuuuauaaaaacauugucuuuaaucucuuucaacucagaacauugccuuguacagacuguuucuucaggcacauucuuggcaggaauaaaugaagcuuccuuaugagccuuuuaagacuucauagacugucugaaagauggaaaaacuggauauuuaaucaggaaucugaacauguauuucagguagagaauuccaaagauaaugaagacaguauuuuacaaagagaaauuccugccagacagucucgacgaagguuucggaaaauuaacuauaaaggagaacgccaaaccauaauagauggaguggauauuaauaacuaccuuucggugaguauaugucagacuuuuuuauggauccuugauuuucacauaaaaugucuuuaauuuaagugguuuuuggucucuacauguaaaaguuaugguaaaauaaacaguuuuuaaaaacauuacuacuugacuguuggauuaacuagaaauuuucuuaucugugggaauuuugcuuuagcuuuaguuuuacuuagaguaauuaaccaaaauaaguauuugugguagcuuaguacauaaauuugugaauuuucuugccuuuguagugacugaauuaggauguaaauuaaaucugagaacucaggcagucgacuaaugggaaaacuuaauaugauggaaaaaauaacaaaagaaagaaaaccauggcaguucuccuuggccugcaggacuguuagucacucauaaaaacaggcacuaguguagaaauguguauuaaaguaaagaagcaaaugaaacauugaacuuuguuaaagcuagagaaaggaagcuguugcuuuagaagucuuuuuuuuuuuuuuuuuaacucuguuguugcagauaacaucuuuuuagacugagaaaugaaauaauuugaagaauaggcccaugggcaucccuacagcuguccuccuuuggucugaguuuuaagugacaguauuagagagaugggagaguugguugcagaaacugacaagagucuguugcuuucguuuucaggaaagaaaugcucucauuauauggcaggguagaagaggauagucaggaaauuggcuuacuaaaauaagaauaggauucaaggcagcuuuaaagagucugucacauuugccuaauuucauuaauagaauguguucuguuucugaaaauaaacauacugguuccaaaauuugcaacuaauacuggagccacacagagaaacaguuucuuuuuaaauacacaguuuauuacugggcaguaguggcccacaccuuuaauuccagcacuccggagacaaaggcagauggaucucugugaguuugaggacagccagguauacacagaggaaacccugucuugagagcccuuuaccugguauaucaucucuguguguguguguguguguguguguguguguguguguguguguguguacacguacauacauauacauuauauguauaugaauuuccuguuacuaauuaaacugucuuuuaccuuauuauauacaaugacuauuuuaaauuuuuuaaacguguugugauuuuuaaaagcuuauauauaguuuaaaaucuuugcugcuagauuuucuuuuacauuuugaaugagugcauagugcucuauuauaacaauaugccacaauuaacuaauuuggaacucaguauuuguucauguguacuuuuuauagacuauaucaguguccugucaucacuugcauacaguauacacugaucaauccaaccuuuuauauaucuccgucaauacucucccuaaucucuuguuaaucacauuuugcuuagauugacugucuguccauguuucugcguggguaugugaagguacauucaccuguagugugugugcccuauagaagcuagaauccaaauuuaaguauaucccucugaugagcuauaccuuaacuuuugagaaagucuuucagugaaccuauaacucaccauuuugguuagauugacuagccaacgaaacacugagauccaaguuucuguauauauguauguaccuguaccauuauuaccuuuauagugauggggacucuaacucggaaccuaugcauucuuugccugcugaaccgucaacacugccccaaauugguuuuuucuuggcuucgccuugagagaaugcauugucuuucuauaucugauuguacaguuaauguaauucagauccuuccuucaugcuucauuugacaggauucgucuuuaugucagaauaauaacugcauuuugaacauauacuacauuuugucuuuguccauucauugguggguucaugcaucaacucgaguacaccaaggaugggaguugcucuuuagcauguuucauuuucuuuuagauaggcuguuacuuuauugccagggcugccuuugaauuugugauacacacacaaggggaaggaagggaguagaagggcagagguaucaccacauccaacuaugcucagcuuuuuauagguguuuuuauacugucuuccauaauaguucuucuaauuacaacucaucuauagagggugagagugucuuuuaccuguacaucuuugucagcauuuugugguuuugguuugucuguauuuuacaguugacuuauugguggcuaugaugauaucauauuauaauuuugauuuauugaauaauuaugcucuaugucuuaagauuauauugauugaucauuauauugcugccuuuugagaaguguucugaucauuugaucauuuuucccucuaugggauuauguggagcuucuccuauuguuucugaguuucuugacuaauauagauguuaaucuuguguuaggugaauagguggaauuuuuuauauucucuacacuuuuugggguuuuuuguuguuguauagaaacuuauaguuguauuugucauuucuguucauauuguugguguuuuuaggcuuauauucaaguacuaccuauauucagcauugaaguguaucuucuguguuuuuuuaauugguuuuuaguaguuuuggaaguuguagaucuuuguucuuucaugcaagguaagaaauacauaugcuuauucauuuuccuggcaauguuuauuaaagggcuguuauuucuuugguaguuucagcaccuuguugggaaucucucuacuauaggggugugugugugugugugugcgugugugugugcauguguguguguguguguguguguguguguguguguguguguguguguguuuguuuuaugaagucuuuuaucucuucuguucugaacuuacacuagugccagcauuuucuguuuauucuugcuuagugcuguuuuugaaguugauacugucaugccuacaguuuuguucuauauuccuuuugucuguuuuagguuguuugugcuuccauaagaauuugggggggucccccccuugucuuguuaagaauaccuuuuuugaaagggguuacauugaaccugcaaguuucuuuggauaccguggauaggaacauucuuuguauguaggucugugcucauacagguuggaaggugguguuggaugcccuggagcuagaguuagaggaaguuguaaccugcccaugugaguucuggggacugaacugugggacucuauaagaacaguacacacucucaaacaacugagccgccucuccagcccccaaacauuagcaacauuaauucuuaguauaugaacauagaaaaaauucauuuuagaggucuguggcuuccuuuguuaaauucaauucuaggcuaguuuuggugaaguuuuuguauuucuuuuuuaauguuugggguuagaguauucuuuguuugauuuauaccucuuaaguauuauauugauuucaugauauauuuuucaguaacuucauuuuuucuauauauuuaaaaauaguaaugaguccugacagugugguauacacccuaaauucuaguacucagaaggcagagacagacagacuucugugaguuuaaggccaaccuuguccauguaacaaguuuugggccugccagaagggcuacucagugaaaccuguauguacugaauuuuuuuuuaacuaccaauuuucauaaauguauguacaggugcguguauacaggaaggccauagaaccacuucagguuucauuccuuugguaccaucgauccaccuugcauuuguuuuauuuuauuuuauugggagucucuucucacugacuguccaaguccuauuuuugcuuccccaucacugugguauauacauccacaucauuucugguccuuuuauuuuuguaguaugaguacuagggacuaaacacaggcucugauauuugcagggcaagcacuuuuuaccaagugaccucucuacccagcaucugcaugaugaccuuuuuaauuuugcaaauuuaucacauuuuauuuuucaguucuaauaaucuuuugcugggguuuuuaggcaucucucucucauuuuuuuuuaaguauguccaucacauuuacuucugaaacaucgcuaaauuuuuuaaaggcuuuucuauguagagaaucauaucuguaagcaggcguaguuugcuuuucuguuuguaauacuuuuauuauuacauuuuaauuuccuugguuaaaauuuccaaaaauucuauauugaauaagcaaaucaagugaacaucaccauaccuaagagaaacccuuucagcauuuuuccucucaggauaaugcuggugcauuucuaucuuauguagccuuuauuagguuagucugugaucucucuagauauaauuaaucgggcuuuuaucaugaagcaguguuaauuuuuaccaaauuuauagagaaugacuauaggauggguuuuuuguuugguuuguuuguuuguuuuugcuuguuugcuuuauagaauagaguuuagggcauggaaaggugaguugaugggguaguagacagaauggcagggcuugggggaagaagaggaguagaggucggccaugaacauguggagaaagaggagguagggggaugaggagagagaggacagagagggaagagaagagagcaguauacuuuguccugaugugauguauuuuguuagcuuucuuauuugugugugagugugcagacauaaacauguguauguguguguaugcauguguuugaagguacccauguggagaccagaggacagacuuaguugcuguuccucaggcacuguuaacuaucuuuuuuggagacaggaucucucacugauuugaaacucaccaaguaggcaagucuagcugaucaguaaaauuuagagauuauccugucuccaccuucucagugcugggaguaugagcacuugcugcugugagaaauacuaucuaucuauggccagucucaaagucacagagauuauaguccuggaauuaaaguugugcaccacuaaaccugguuugcuaacccuuuuauaaaugaauuuucaauuuugaacuaaaauuauccccacugagcuaccuccauugccccuguuuacuaaguuuuuaaggcccccuuccccccccucucucuuucucucucucucuuucucucucucucucucucucucucucucucucucucucucucucugugugugugugugugugugugugugugugugguuuaaguuuucuguucuccuccacuuuagaaaauuuuuguuggggcuggagagauggcucagcauuuaagaacuacgacugcucuucuagagauccugaguucaauucccagcaaccacaugguagcucacaaccaucugcaauaggaucugauccccucuucuggugugucugaagagagcaaugguauacucuuauacauaaaauaaaucuuuaaaagaaaacaaaaaaaaagaaaagaaaauuuuuguugauuuuauauuugaagaaaaaagcaaacaaaugaacagucaugaggaccugaauuuaauccccuagaagccccuuguaagcccaugugagugguauaucucuuuuaaucuuaguacuucugcaguaaaaugggagcuacagacuggaaaauucccagaaacucacucaccgucuagcuuguagaauagcuacaagcaagguagaacaucuaccugccucaaacaagguagacagaccgcaaggaccaacagcacaagcuuguucucuaacuguccuccacgugcauucucagauccguguucucaucccccuccccacuucuuaauuucauugaccucuugcauuccguccaaucuuugcuguuucuuuuuguuuuuauuaauuuugguuuuaguuugguuuuacuuauuaugucauugagguacauuauuacauuauuugcuauucuguucuuugcuguauguaaugauugaaagaaaauucuuaguacuguuuuuguuguauucuaguuuuauugcuauuuucauuuguuuuaaaggauuucaagugcucuggugcuggcuaaaucucuauuaagcuccuuacaguuguauuaauuucuuaaguucuucuuagucuauucucagguacacaugucucucuuucugccugcuuuugguucuuuuugcaugggcugccuugucuagccugucacuuuggucuaugugugucauuacugauaaaggccccaucuuguugggccuuuaaaaaaaaauccauguagcaauugugucuuuuaauuggagaauguauuuauauacaagauuacuauugaugaaggcauaguucuaucauuuguuaauuuucuucucauuguuuauuuaaggcugaggaucuuggagccagggccuaguauaacuuggcgcucuacgucugaguauguuaagccugucaucauuuugguuguccuuuguccuuuuccuauuauugaucuguauguuuuacugacuggugauguuggauuguuuucucuuuuucauuuugucucuucugaguuuuacacuguauguuuucccugguaguucuaaucugucuuucacuauuagaggauuucccuaaguaauuuuucugaagcuugucuuguaaugacuucuucugccugucuuggacuuuuccucgauuucucugggacuaacagucucaaguggcagcuuaucucuuacaguacuucaaguaugcugagaagccugcauaguccuaauaagauaccuucagugugauauggcaggcacuguucuguagaauuuguagaauucuguuucuuauucuucggacaauuugacuauaaaaugugauguugaagauauuuucuggucagcccuguuuagaauccuguagaccuucuugugcuggauguccuuauguucuaacauuuuaaacuuaaauuuuuaggagauauagaaauagcugaaugcuuaugagcacuguuugcucuugcagacaaccagacuuagauucucacccucacaaccaccuauaguuccagggguucuaauacccucuucccuggguaccaagcacacaggugguacacaggcauauucaugguucacaaacauccaugcuggcaaaacacacaaaaauauauaaaaugaaaguuuaucuuuaaaagguaaauuuuuaaacuuuuuuauaacauuguuuuguuuuagauaacuucuuaccauguugccuagauugacccaagcugcugagcucaagagauguucccagcuuggccccccuaauagcuagaacuauaaacacauaaucaccaugccuagcacauuuaauauucauuaaaacaauaugucaucauuuguucauugagcuucuaauacuuggucauuaaacuuauuucuagguuuuugcuuuuuaaaaugauuuucuaugaaauauuguagauauguaucucaguauauuaaucacacuagaaaaaauuacaagcuauagcauugcuaaaugaaaggauguuuauuccauuuggcucuguguaugaugaguuaaagaguacuuauaauuucuuaugugugcauguguggggcaccuacauguguguguguguugcuugcauacuuuaguuuaaacuuuaauauguucuuucuccagauuuuuguuugguguuggugucauaucauaagacauagagagucuauuuccucuugaggucuaucuaugguuuauauauauauaugagucauuugcuuuuagucuuccugugugcugaaguaagucaccuuacuuuagacauuuugguuuucugaauagauuaaaccaagcaguuaguaccuaggauuuuguugggugauaauucuugaaguggcauuuuugcauauauaucgcugcuugaguuggguaguuuuccuacuagguacugucaggaauuugguaaauuaugaggggaacguaauugaucaacugagacaaaucugaugauuuagcaguaagacuagauuaguuagugaaggauuuuuaccagaauacuuauguauaugauaucuugaauuaauaauuuuuuucuuagaaaggauauauuucaggcaauuuagaaaaucuuacucgcguucucacgcccccggccaggaagaacacaacaaaccagaaucuucugcggcaaaacuuuauugcuuacaucuucaggagccaggagcgcaaacccccagccccaaaagcgaaagccaccccaauaacgaaaccgaaaccccuucccuauuuaggagaguuauauuucgccuaggacgcaucacucccugauuggcugcagcccauggccgagcugacguucacgggaaaggcagaguacaaguagucguaaaauacccuuggcacaugcgcagauuauuuguuuaccacuuagaacacaggaugucagcgccaucuugugacggcgaaugugggggcggcucccaacaucucccccuuuucuuuuaauaagagcaaauaggccacccauauuaaugagaguggagauagaggucaaauccccaguguguagguaaaggagccguacacauaaccuccucccaggcucaucacccagagggguccuggucuggucccguguuguuuuuccugggggaaggacacuugaacacucaaccuucuugaaagaugacaugucucccuagaauaggcucauuuuaugccgcagagcccuucuauugcagugcuuagccgugcaacucucucgggcugcugaagcacacucacucuaucccgugcaaugagacuagccucaugggauauaagagcugaguggccagcgaccuauugccuaagcauagauauaucaggggaagcuccauguucuaguccugcaagcgccugggcaauaaccaccuugucucuccuaguuugggccuuaagcuuacagaccaaucaaagaagcaacacuaauccacagcaaaguguaucuccaaauaauaucaaucccacccauucuuuaaagaagggaaaugcugaggagauccaauuggguaauccuuuggucagggacagguccaagcgcguggaguugaccugaagucucaauucccgaaggaucuguucaaauucagccguccaauucuguaacauauacugaaaaagacuuuuugacaaauuagcugcccuaguaaauuuaacauacugaauggaaguaacacacaaucccggaaacuuuuguuuacaccccagcugaguuauuugucauaauacaucuaguuguaucuggacaagaucuaugaguugauuaaccagcaugagaccucccuguaucaugacauuagcugaggccuguuuaucuaugacuguagucacugaggcugacaaaguguuaauggugucagucgucuggaccuguccagacagagccaaggcugucugaaucaaggcuaaacccaguuccuaguuagugguaaaaaagcaggagaauacuugagcauuauacaucaccgucauugggaguggaaaugucgacauuaucccccaacgcugcucucucuuuauuauugacgcccuggacaucaccaagacgagggacaucaguauucccuuggucagucuggauuuuucgggugagucuuucugguauccaaaauggguugucuucauucugugggaaaacacaaaccgcuccccuggaucuuaucaaaaugggauccgggccauaccauuuauuaucaaggacauuuuuccauuuaaccaucucauugggccuaucuggcucugaacaaugacguucagccgcaguauggccaugagcaucaauauuuaaaaaauugaguguaaagagugccauagacacagacacucuuggugcucgggguaaagucuccucaaaaguuccccucuucuguuuuauaagauaggcuuugagggugcgaugcgcacgcucaacaauacccuguccuugaggguuguauggaaguccagucaggugggucacguccaucugacggcagaacuguuggaauuuuugagacguauaagcugguccauuaucagucuuaaggaguuuggguuucccccaagcacuccaugccucaagacaauguugaaucacaugugaggccuuuucuccgguuaacggagaagcaaacaugaugccagaacaugugucaauggacacauggagauauugaaguuuuccaaaggaagaaacauguguaacauccauuugucagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuguuaugaaaauuuuuugcagccucuaccggggaugauagggcagcagccaccacuuuaguggccuuaucugccaaaucauuuuucagagccauggggccagguaggccugaaugggcucuaacaugaguaauauaaacaggaaaucuucuagauaacaaaacuaauuguaucugcugaaaaauauuggcaacucuacuggaaggcuuaaucacuccagccacuucuaaaagauuuacugcauuaaccacauaacaggaaucugacacaauauuaagggguucuaaaaagguuuuuaaaacuucuaaaaccacuaaacauuuuaccacuugaggugaauuuucauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacuguaaaauuggauguuuuggauaaugguuaucuauuuguccugaaaaggagguaacuaaaacugcccaaucauuagauguggcugccaagguuugaaccugugcagcgguauaagguacaauuaaaagauauggacuucgcccaaagugggugauugcugcuuuuaggccuuuaagggcaagcugugcaauugcaacaggauaccaaucuauuauuuuagcuggggauacguuuggauggauccacaacaauggcccauucugccacaaaacugcgguuggcaauugugcugucuuaaagacacacaaacugaaaggcugcgaauccucaauacguuguaauugugcauucuguaaggcuuuuuccaccuuuuguaaggccugguuagcagcuagaguaagaguccuaggggaggagauaugaggaucuccuucuaaaauaccaaacaaaggccuuaacucagcggaaggaaucuuuaaaaaaggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggacuuuuucuguggcuaucuguaaaccccacugacuuaaaguuuuaaguagaaaaggauaugccuuuuguagcaugguaaggucuuuauggcacaggaggaugucauccauguaaaggagcaaaauuaaagaggggaauuguucccucacuggcaaaagagcuucuugcacauaaaguugacacauaguaggacuauuggacauucccugugguaagaccuuccauugauaccucuuaucagguuccaugugauuaauagagggcaugguaaaggcaaaucugggccuaucucuuggacacaaagguauagaaaagaaacaaucuuuaauaucuauaauaauuaaauuccagccacgugguaaggcggaaaguacagggagaccccucuguacugggccaaauaaguucauuugcucauuaauggcucugaggucauggagcagucuccacuuuccugacuuuuucuuaauuacaaaaauuggaguauuucaaggugagguagaggguucaauauggccuaguuuuaauuguuccucuaccaguugaaucacagcuuccaguuuuucagaggauaggggccauugaggaacccacacuggguccccuguuuuccaugguaugggucgugcugccccaauggccacuaaggaaaacccagacccugucugucuugguuuccauuaggugagaugggcucuauccuucccuguucuugauguccuaacccuuuuccuucuuuauaacccaucuuugccaugauauuuuuugcuuuagcugaauacccucccgauggggcguuuucauuggacaaaauaaggcccaaaugcugcauaauaucccuuccccagagguuaaccgggagugggagcacauaagguaugaauuucccuugcugcccuuuagaggauucccaugucaaggcaauggagcuuauagugggacaugauugauaaccuaggcccuguaaugaaugagaugacucuguggugggccaugcuuugggccaccaauguguagaaauuauacuuuuaucugcuccgguaucaaggaugccuucaaacucuuuuccguugaucuuaaggcggagcuuaggucuaucauucaaagauacaaccaaauaggcagaaucauuucuugaggagcccauuuucuuuaucucagguccugcaaauuucucccugguauuaucagggaggagcagcagcugagcuauccuaucuccuuuacuaauagaaaaaacgccuuuagggcuugagcacaggaccuguauuucaggggaauguugacaauccauaacuccaggguggacuacuaagcccuguaaggugagugaaccccggccgagaauaaggcccaugguucccgggggcaaggaugguauaggcuccacuggcaccggcugaauacucauuugaggcauuaauaggaagucggaggcggcacgcagguccacccuugugggucuuucugggucgccucucugacugcuuccuggguccugacaaacugguucccauaucuuugagggcccugggaccgagggcccgaugacccguuuuuuggcacauaagcugauugacuaucaugugggggaaggauucugcccuuuauaucccucacagagcgacacuggucggcucuaugauaacccuugucacacuuagagcaaagagugagagucccucccuguuuaucuggagcucugcaaucuuucuuaaaaugcccaggcuuuccgcaguuaaaacauguccucugauuauuucugcccauggagcgguuuugggauugaaggauggcagccgcuaaaccugcauugcugagaggucccccaagcucucgacaaacccugagccagucuuguaagccuuuguucuuucuuggggcuauggccgcucggcacuccuuuguggcuugcucauagaugagcuguucuaucaaaggcgcggcuugcucugacucucuaaaaauacgcucugcugccucugucauuuuggccacaaaaucugagaaggacuccugaggucccuggauuaucuuuguuaauugcccaguggcuucaccugcucgggagagcgccuuucaggcccuaauagccguggaggaaauuugggcauaagcuccccaaugguaguuugucugaucagcagaauaagcucccugacccguuaacaagucaaaaguccaaucucucugcucuggagucaaagcagcugcguuuguucgggccugcgcuugugcagcuucgugccaaagagcucuccauuccauauauuuguccauacuagggagagcggcuuuuacaaucguuugccagucagcaggaguuagugccaugccggcgagccugucuaacugcaccaagguaaaauuagcauugguuccguauuuacggaccgacucggcgaguucuuuaaucugcacguauuuuaccggagcguggacacgcccacccucggcuccuucaaagacuggaaaugccuguuguauuuuucuuuguuccucucugggaaugaaugagucugcgcacugccucucugcgcacugucucucugcgcacugccucucugcgcauugcugacgcacuacgcagggcgggggcuccgcauagggcagaccuugaaaccgacugcccggagguugaacaguacgcuggcuuucgccagccgcuuuuggcuuuuuucuugaccaauuagcuggcugguaaugggcugcuucuuccucccagucuguuuccucagaggagaauucuucaucugcuucagagcuacuaagagcuggcuuccugagcucaucuagugacgaguaucuccuagagaccuucgcuaaucgaucuuuuuucuuuucuuuuuucuuuuccuuccuucuaaucucuccccagguauucuuaccugaccuaaacuuuuccucggguucaagacccuuggaaaggccuguauacuuauuuuguguaccauauuuucucuuugcuccuacucucucuccccgcuuuacuucugauagauugcccugaauuucauccagaauuuucagcccuaucuuaaucaccugauaacaugugaaaaggaacaaaagggcuccuaacacuagaaaaaauucaaggccaaacauaccuuguaaagccauuuuccacuuuacuucugauagacugucuugaauuuccuuagaaaguucaagaccagacuuaccuuguaaagcuguacucacugguacucuguucccccagcugaaaaguucugaauucaugcaguugaauccuucuuaacagucugcuuuacgggaaccuuuauuaccgcgacccgcaguucugguucuggaaugagggaucuuccuugcgccggucccgaguuuucuuguauuuuuucgucccggguuucggcaccaauucuuacucgcguucucacgcccccggccaggaagaacacaacaaaccagaaucuucugcggcaaaacuuuauugcuuacaucuucaggagccaggagcgcaaacccccagccccaaaagcgaaagccaccccaauaacaaaaccgaaaccccuucccuauuuaggagaguuauauuucgccuaggacgcaucacucccugauuggcugcagcccauggccgagcugacguucacgggaaaggcagaguacaaguagucguaaaauacccuuggcacaugcgcagauuauuuguuuaccacuuagaacacaggaugucagcgccaucuugugacggcgaaugugggggcggcucccaacaagaaaaugcuacauugacagucuucauaagacucugaacuagcugggagugguggugcacgccuuuaaucccagcacucaggaagcggauuucugaguucgaggccagccuagucuacagagugaguuccaggacagcccgggcuacacagagaaacccugucucgaaaaaccaaaaaaaaaaaaaaagacucugaacuaguccaacuuuuaaagaaaucaauaugacaguuucucaaaacucaaaguaggucugcuguuugagcagcuguauuguuccuggguauugaccugaagaacuccaagucagcauaucacagaaaugaugcacuugcacgcuagugcuuauggcagcacugaugcacuugcacgcuagugcuuauggcagcacuaguaaaaauagguacgaaaccacuuagugcuuaacagcagagaaacggguaagggaagcauggugcguguucacaguggaacugagagcugggcagauguucccuugcaagcaugacagcucgaguuccauucuuagaacccacauuucaaauagcuaguaauggaagucccaagcuuguaaccccagcagugaacaggcagauucuggucuccaaagcucccuagccagccaaucuauccuacuuaacaaguucuggaccaguuaaagauugucaaaaaagauggacagcaccuaaaaacaauagcuucuaacuacaacauauacaugacauauacuaguuagaagcuauucuaacaauauaacuuuauucucaugcgugcauguguguauguguaugcacaugugaacgcaugagaauaaaguuauauuguuaccaagaaaacuggugcaacuguagaaucauauugugaauuaaccagccacagacaaacaaaauguuuucucuuaugauuguuagaucuuauauauguauacauaaaauuauauguguggauauauagauauaugcauguguguauguaguauauaugauuaaaauagaaguagaauugccuaggggaacaaagacauggaagggagaaagguaagaaagggggcuuuagggagauugaacagaagggaaauauguucaacuuagaauauguaccuguacaaaaagaaaaguuaaccaaaauuuaauuguaaguuugaaugcuucuuugaaaaaacucauuggaauaaauuuauaagacuaaauuuuuucaaaaagaaaaaugagguucuaguuucugugaaagcauuuacagaggauuggguuauaaccacuguaaaguccuuuauuuucuuugccuuauugucagcaauucauagaacaaaaugagaaaugcuuuuauuugauaguuuuuguuuacuguguagcucuggcuggucuggaacuuuguuauguauaugcuaggcugcucucaaacucacagagauccauccaccuacaucuuugcuagucucuuuuauucaauuuagaaccaucaaauuuuuuaugcuagggugcuaaagguuugcaauucuuaaagauguacagaauauuuugccaauguugguuuuuuugucacaguauuuacagcauagccaguacauuauaauuuugugagaaagaauuuagauagauuuuaaguuuuucuuaccgaauacuuagaauaggugcagaagagcuggaauauagcucaaugguaaaagugaauacuuagcacuuugcaugugaaagacagaaugacugaaaaaagauggcuuacucaucauuuggaauauuugacuuuuuuuuuuuuuucgagacaugguuacucauguuauuccuugcugugcugcaacucacucuguagaccaggcuggccuuaaacucagagauccaccugccucugccucccaaguguugggauuaaaggugugcgccaacacugccuggcuggaauauuuugcuauuaacuauagaaaauaguuuuauugugauguuuuaauauauaacuguacugugaucauauucauuccucccaguggcaggcuuaaccucagugugagauaauguaaaaaggaauguagugcuggugauugaccucagcaccuucuguuucuugacugagcuacgugcccagccuucgucuuacuuuugagacagggucucaacagcuacacaggcugugcuugaacucagucuguagccaggucaggguugaaacuugcagucucagccuucaaaacagcucuuaaguaugaccugugcuuccaggccuccucuaguagucaucuucaaaacuucagucuuuguaacaguuuauguuucuuuuuaaguuuauuggcuaucaguagcacauaacucauaccugaaguuugauguuauagcagucagcaugaucaagauagacauuuuuaucacucccagaugcuuuaucucuuuuuuaauccauccuucucuaaaucccuguuuucuuaggcagccucugugcuuucucuuaguguuaauuaguuguauucacugggacuuuauauggcuuacuguguuacauuauucuuuuugccugucaucuuauucuuguuucagugauuaugugauauauccauauugucuauuucauuaucuuuccacuuuuuugcuaagcaauacucaauuguuucaguauggcauguuuuguuucauuuucuaccugauuuaauuguuucauuguagcaccguuaugaacgguuguguauacaucuuuuuugaaacaguuauuuucagcuuccuaaguuaauacucaggagaggugacuagaucagauauuaaaugcuacauuaaacagaacaaauguaaaacaaaacagagaaccuguucuucagagugccugcacaguuuccauucuuuguuguauucuuuccuuuggucuaagagacaaaguaacuuguuccuccuccuuauuagcacuugauagagucagauuuuacuagccuucuuccgaaacucuaauauuauguacauugugguuuaaagauuuuaaguaaucuuguugcuguagggauaaauaaaaccuugucauaauuuaguuauuuuggacauuguaaaaucuucucagaccauggaccuuugagaaagauguauuuaguauuuagaaauagcacaaagcuguuuguuuuauaaaaaauauuuagagaguagaaucuguaauuaauccauguagagagaguccagcaucucuagaugagcuggcugccuauagucccuccuccuuuaguacucacauugugcuuagguugcuuugccacuaaagcaguagugcugacuccuuaccugccuguucgcugggcuucuguugggguacuugggauauaagcacacaccuggugcgugauucuugguaccuguagacuuuuucucccucaguuauuuaaaauguauguuucaguuucccugugucauuucucuaagugcucacuacuauuuuguugugagaggucuugcaacauaugacuugguuauuuuuuaacucauguccucuucugucguucaugugccacuaccccugccuuaauuuuccucauaggacuguuauaacgucacccaagcccacucacugcacaaacuguuuucaucuggauuggggauauuucuuaagaugagaaguauuauguaaucucuuuaucaagacaaauguacuuagucauuuuuguauuugauuuuaaaaucuguucaaaauugguucuccuuuugguaggcuuguucuuaauauucuccuacccccuaccaccaacugguccauucauuuugcuuuuuuaaguuuuagauggagcucuaacaauauccuugguuugguugguugguuugguugguugguugguuuuggguggugguuuaccacaaucugucagagaaguugcagugauccagcaugugaggacauccagagucuagaccagccugugcaguggaacuuguuaugauggagcagaccuuaugugguacugcgcagaugaguaacagccacccacauauggucccuaagugcuuagaauguggcuaauguaacucggugucuuaaaguuuuaacuuuauuuaguuuggaaucaguuuaaguaacuaaauagauaaauugcagcugccagguugacaagcacagguccucacauuuccaguuuuguacuuuguuuuucuauguaucuccuauuuuuuuuuuugaccaugccacauuguugguccuuaaacaggccauguuuuuauauaaaucucuuguauucuucauuuuguuuuaaaccucccuuuauuauuuguugcuuuacuuaaaaccuguucauccccaggacucaauucuguaucauuuucuucuuggaaagauggagcaugcacaugugcuuuuagaacaucugucaaauguguacgcuuacucucuacauuacauugcucuugccuuaauaaugagagccucauuguauccucagaguaauuugccugucauaauaacagcaccuguuuuuuuagcuuagguaaguuuucuuaguuuuaugugucuuuggucaaguugugugagcuuuauuuuggucugaguguuuuugauuuguggguuuuauugguaguguuauaguucuggggauauugguauguuuagguugauaacuuacagguuuauuaaaggacuuugccuagugucuuauagucuguaaaacacucagcaauugcaaucacuuucauaaagauguuaaaguaaauaaagucaaguaagcuaauaaaugagaaugaaaguaugaguucagguuaacuugauaagcacacugcucgugcuaaauagaauguggcagcagcuuuuuuauuugcaaauaccgcuuuaccagacauuuuuuuuauuuuuugguccaaacugaauccuaaaugaucauagccaucccuuacuuauaaugaauggcuuggugucacucauuucaggggauccuuuaccgaggucuugauguaggccuauugcuuuuguguaccacauugccaucauuugaaugcaugucuuucuucuucaaguuuauugucuucuucaucuuaaccugaauauuacugugccuuucuuuaguuugauauaugccagcaaaacaguacaagauguucuuugccuuucccuuuugucuuagucaggguuucuauuccugcacaaacaucaugaccaagaagcaguuggugagcaaaggguuuauucagcuuacucuuccacauugcuguucaucacugaaagaagucaggacuggaacucaagcaggucaggaagcaggagcugaugcagaggccauggagggauguucuuuacuggcuugcuuccccuggcuugcucagccugcucucuuauagaaccuaagacugccagcccagagauggucccacccacaaggggccuuuccccuugaucacuaauugagaaaaugccuuacaguuggaucucauggaggcauuuccucaacugaagcuccuuuuccugugauaacuccagcugugucaaguugacacaagacuagccaguacaccuauuucacagguaaaagacucauuucuaaagauauuagcaaccucagcguaggaauuucuugaauuugagcauggugacaugggucaacagguaaagaugcuuggcaccaagccugauaaccugaauucaaucagcuauaucuaggaguggaaacuuaggggguagagaaauuguucaguggcuaagaguaccagcugcucuucuagaggacccggguucagcucucagcacccacauggagguucacaacuguucauuaccccaguucaaggagaucugaugccuuucaaggauaccaggcacaugcauacaucuaggcaaaauacucauacacauaaaauuaacacacacacacacacacacuuguuuuuaaaauacuuugaacuugaguucuugguagaaaguacacagaguaaguuucuaaacagagauaugucuagucccagguuagaaggagcaagacaacaggaucaacguaaugcuacucagaaggaugcacuauuuaaaacuuguagauuguguauuacuagaauugucaguucaacauuuucagacugcguuugcccuuguaguuggaagcacagaaauaaacuuugacugaacuggguugugcauccuuuuaaucccagcauucagaaggcagagccagaaagacucaccacaagcuccaggacaucucggucugcagaguggacucuugucuuacuaaaaaauaauaacuaccucuuuuuuuauaguaguuagcaaggccaguuguuuaacccaaauguuuuacaguuuaaauugaagucccuuucuuaugugacagcagucuaccuuuacagcuuucuggcccaacucuguccucccucccucccucccucccucccucccucccucccucccuuccuuccuuccuucagccugcucuucuucucuggaaggcuauuacugaccucuuuuccuaauauuaaugcugagcuucugagucuaacucuaauuuuaacuugcuucuuguucuuuuuguucauaguaguguugugccaugucuucugacagucuuaacuuugcucccaaacuccauucauccacauuaucucuggagaaaccucugacguuuccucguggacuguacuucccuuuguccuuuguugguccauaguacauuacauaugccugauacaggugcccauacaguucugcuccacugagaaaaauuaauuaccaacuuacugaauuugugaauguaguucauugguaaagaacaugugugguaugugcaaaccauaaguucaauccugagcucuuuuuuauuuuuugcauaagauuaauugcuuuuuuauuuuauuuuuauauuuguuuguguauaggcacauaugugucauagcaucucuguggcucagaagacagucuccagugccauuccucucagaaacacuuuuuguucaccuuugcauauaccaggauaguuggcccauaucaagcuucugaaauuucuugucccucccuuccaucucaguguaggaguacuggaguuagagauauacaauacugcaucugagacucaaagcucagucaguccucaugcuuguauagcaaauacuuuucccauugagccagcuccucaguccacuugccuuguuuuaaauaaaguguaauagugaacauuuucugucuuuuuaaaagauuucuuuauuuauuuuaauguaugugaguacacuguagcuguacagaugguugugggccuucaugugguuguugguaauugaauuuaggaccucugcuugcuccaaucagccccacuuccucagucccugcucgauccagcccaaagauuuauuuauuauuauauguaaguacagacacaccagaagagggcgucagaucucauuacaggugguuguaagccaccaugugguugcugggauuugaacuuaggaccuucaagaagagcagucagugcucuuacccacugagccaucgcaccgaccccaauagugaacauuucccuacauguuguucaauuuuuaauacuaguauuacccugaguuaaauuccaagaguaagccugaaacaugaaacaucuugauuuuuaucaaaguaaacacuuguaucuuugacuggaaaugaaauaccagacaucauuaaugcuaagucauuuuuguagaaauguaacugagucaauuauagaucuggauguuguuuuggaaguuuagaaauuaguugguguuugaguauguuaguaugaaauuuagguuuuuuuuuacuagguaaucucauugugauguaucaguguggucuuaacuggaucucaagccucucaauagagaaggucaccuucuccacuguuaaugcaaguguugugauuuuccuggugcuuucuaucuuaaauuuuuuucaaagauauucuccuccccccuccgcccuccauucacuacuaucuauaucuccuaguagaaucugguucacucuggaaaguaacauaguucuugauagauucuuaaaacaaacuccagagucgugaguccacaaaucaaugcaauugauauuaagugggagaaaugucaguuuaagaguuguuaaaguguuuggugaaauauaugcuucuuacagaaauguaacacauagaaguaaagcaagguccucagagccgagguaguuagugcuggaaaagugacuuucaaaggaauguuuauuaacacaaaccuuuauauuggaugauacugacugcuuauauauccuuccuuuuaaauuuuuugucaacuaaaauuuuccaaaacacuuuaacauucauacuaugcuguauguuuaucucuucugguuuuucuucuguuaacaaacaacuuuuauauauaaauugauaaauaacugguuauuuccuuaggauuaauacauagaaauuaaauuacugaguuaaaaguaugaaaauaacuuucuacauaaauauuacagcacaguagucauauuuuuaauaauuuuuauuauccaguaugcaugaauguuagugcugcgaggaagacagccagguauacuguuccuucuggggcaguuugugguuuccuaaggauaaaacuaacucauguggauguguccagggacccagaaugagaaagauuaucauacuugugacuguuugcacagcaauugccaaagaaagcucuuccaauaauuguuuaacucaggucuuaauguaugucagcagucuaaggauaauuuuugacagcauuccagguagacaaguauaauagcuccuuaaauggcaaacaaauuaacauuacugcuuuucagauugaucuguucucuguucacuaaaaacuauguucuguauucaauuuucacaauacuagaaaaugauguguuuaaauuagagguaauagugugauccaguucagacaaaguauucuugacaguuuauuuuuaaaaugaaauuuuauuuucuuguuuauggauuuuuuaaauuacuagauuuuuuaaaagaaauaacuauuuuaaaacuauguucauaauaauauauacuugucugacuucuaugugcaaaauaucuuccuucuauguauauagaaaaggccugguacagcuucuuuggguagggcaaaguagaagcaugguggugccuuuuauuguuccuucaguuucacugauucuaauuauagaagcuuacaucaccaucgcugaugauaacagcuuuccucucuccccuugcucuuucuuucucaaucacucccuaaggauauaucauauuucauaguacauauggacuucaagugguuuugacaaagguuuuugauagcaugcaagcaaucagugaguacgucacaguaugcuagcacgguugcuuacaaagaccaggaggaaagcugugaugcucuuuuucuuuaggaugaugaggaguagauaggacuggcuucuugaagucagaaauuacuuaaggggcaaaaggaauuagaguuaaccguguuugauagcuacagauugauuucucuaagcagagggaggaaagggugggacacugugguuacuuuacagaagcuggcgugcugucacugcauagcgugaucaucacuguagcauuaucaauuuauuuuucaggauuaaacuacuucaguaggauuuucuacagaaaucaauguguuuaacaguuuacauuucuaaaaccaacugcuuaaauaaaaggcagagaugacaguuuuauuuuguaaaauacuuuuguuacucucuuugggcauuuggcaucccuaaauugcgccuguaauguuucacugugcagaugggguggcgaagaauggguauauuauuaacuauuagaaccuuaucuuugguuuucuaugcagcaaauuuccgauauucaguuuauagcuggcuuguaaauuauauauuuaaauaacaaauuuuaguaaccagaucauuuauauauuuauaaaaacuguuuuguaauuauuggaaacuuuguuuuaucucacaguagucaaaugccccuuuuaaagcuaaagauuuuguuuguauggcucagcauacugguauuucacaugcaggaaaguguguucuucagugccuguagugaugagucuagacugugaaucaagacucccuccaucacugcacugacuucacuugaugaugaggugagaucaugauaaauucuaaaggugaugcucaugaaaaaaaauugguuugucuaguaaaucauuuugguuauuuaacaaauuacugaccuaauuuagaucaguaauuaguuaaaagauuaguuauugaaugugaagagacaauggagggggcaguauaauuagacugcuuuuagggucuauaugcugaguauaguuuggccucuugcuuccugcuggaaaagcagguuuguuaucccaggagguuucccaugauagguucaccauacugguucugaaauagcaaauacuguaagauaauugguagaauaagaugaugucaucuuuucuuauaagccagccaaacuggggaguagggaggagagaaauaauugucuugauccuuuauugggguugauguguacuccaguaggucuugacauauggcguuaguggcuugcauuucauucccagagcagcaguuaagagaugacugucucuuugcccagcuugaggucuuccuuugugucaaagguaucagcaugauuuauaaaaaggaacaaggagccacugcagauacugguugugguuggcugucguuuauccuaccaguacauacaugaauauaauuauagacuggcaugauaguuaaaauaaucuuaaguccuguuacuaauuuuuguguuuaguacauuucuuuagaaaauguaucuucagccaaaaauaucuuuauccauauuuuuguauuuaagaagugaaugcuuuuccuuugucuuuaaaguugcauuuuugaaauuccaacuuaguuuauauucauuaaauuggaaaaauaguucuugaaaaucaaucucuacaaaugguuuauauuuaguaaacuggugcuuauuugaauuugugagaacaaauuuuauauuucaguguaaguuuugugggaaaggacuggguuuuugaauacagcaauucauaggguuuugaauaaaacaauucagaggcaauucauguaaaauacaguuguauuuuguaaacauggaauauguguucaaaauaauagcauuacuacauuaaauuccaguuguauaggagcagcacgauucagauuaggaguucaguaucacuuggaaaguaagagaccuugcuugagggaaucaaggaacugugugugugugugugugugugugugugugugugugugugugugugcgccugcacauacauguauguuaauaagauuuauuuucagcaguaagcagaaucuuucauuacaauaccuguuugucagguaaucaccuuguguguugcacauucccugucuucaaaaguauuaucuaaauagaggaaaauaguucugucgcuuuacacacugacugcuggucucacaguugugcugccuggagguaugccugacuguauuuuagccauuggggggagcacugggaggcgaugaagugcuagguggguggauaagcagaagcauaaaagaaagggugccuuguagcagaagcaugaaggaaaggcuauggugcuuaucuuacugcagagggcguggcaaauuuuuucucuuuaaaguuuuaaagaaaaauaugacggcuuccuuuuaguccauguucuuaucaaagacagguuuaauuguuuccuuuucugauucauuuuguguuuugcuggcucucuuucuaggaauugcacauugacugcagugaaguacuauguuguauagauuauucuuccuuagaggaauuaguauacauuguaccuacauggauuuuuuuuucuccuugcaaaaggauuguuuuuauuuaaaucuguuuacauaaaaaucuugguuuuguuuaaaaaauauauauaaaucuuaccaccuguuuuaauuuuuaauacuaacucaaugugggcuugaagauuuaaccuucagaacauucaauaaauagcaaguuguauguagaaacccauaaauuuaugguauuaacauuccuuugaugugacaucucugaaccagacagcccauguauuuagaauucaauaguaucuuacuacagcaaauuauuuuccccugagagaaaauucuguguuaaauuuaaauaauauuagaaaagagacuuuucaaauacaacugaauauuaauguacagaauuguaaaaacuauaaaauagauggguacauuagccagguuuugugcuuacaggauuuagcuugccagcgugucucacagaaggucguguguguguguguguguguguguguguguguuuucguucaguaaauugcucuugggcuacaucugcagauacaguagccaauugaucuaaugcaguuugugaaggcuuucugcacaggugaugucauccuuuuagcucuauucuccucccacucucuuuccuucuuauuagauauuucaucuuacugcagggcauagaaucaauaggagcuucuccuuagggagcugcugugaagcaggcaaggacagcaggaauuaagacacugacagacucuugcguucacaaaagauguagugguuuuuguguugcaucguauauacauguuauccagaaagggcagacuuagaucaucggugcuuucuuacuaaugccuggaaucagaagcuguauugcagagcugugaaacugcuugggagaagagaagguugcuuugaauucuggauauucucagacauuauacagaacaaaccuguuagagcauuugucuccugccuccauuugcucucgaugauguauguguauggugggauuuuuuuguuucgucuuuuguuuugguuugguuugguuuuuaaccucuagcauuuaaggauauuuaaagaagagacuguagucuucagaauacagcauuugcuuugccucugaugcagaagacucugcaguguuugcucuuccgaaugaaauaaguugacggaaaaccagcuauauuacagagaaagguuucacagauuccaggaacacagauuucaugcauguugccuacuugcuuugacugauagauacgauauuagucucuuugcugccaauguguaugucuaugucaggugccuggggaugcauguaacugugugcugagccugaaaucuaaacaucuuuauuugauguuacuugcuuguaaaguggcauuuaaggauaauucuuauacugagaacaauauucugcuucugaaagcuucugauuuuuguuuguaaagaggguuggaggagcuacauuuauauagcaacaaugguauguggauuauaaaagaaacuuagcagaauuuugucaacauacucgucaguguggcucucucugguuuaaaagagaaacuaccccuccagccaaggaaauggcuuuucuuguucgauguuacgccaauugucuucagccaugggccuccaaaguaagugauuacuauuuuuauauaguuuaaucauuaaauuuaaacugcacuugaauucuaaauuaguucuauugugcuaauaacaacuauaaaacagucuauaaauccuugucucaaugucaugugauuuagagaaagccucugagauggguugaacagacucaauagucugcaacuugaaauguacauaugaauguacauaugaaauguacauaugaaaugcacaccuuagacacgcucaucacugagcuguugauauuuuuaaaauuacuugugcccaugcuuaacuugaggcauucuguuguuucuuuccuuaaagggcuaguauguuuagacaucguguucagaucaugggcuuauagaauguaucuugguaaugugaugcucccugauaacuuagaaaugaauuguucuaguuuguaaaauuggguguucauuccuaaagaauaauguaaaaaaaaaaagugaauguaaauuaauuauguaaaaauauucaguguuccaaaguauuuccaaaauaguaauugguaaaaaaacugcuugucauuuuaaggcaaacauuaacugucaacaaaauccugaguuguugaaaacuagucuauugcaauuuaguuuuauuuuugacaguagcuuuuuacaguguuugaagguaucuuuuagauuuuagaaaaugcuuagaugaugaauuuuaaauaugucaaaauuucuuuauaguucucugauacuuaggcacacuggagacuuuucauaggaaggucugaaaucgugucuuuguuucaaagguucacucuugauggugacuaaggagaaaauacuuugauagcacuguguuguacuguuuauuuggccaagcccauugcauaucuuuccugaauguucuagugggagggauauuuaaaugcacuguccauuuggcaaacagcugccugugacauaaagagauggaaaggagccuugguacacaguuugugcuuuuaucugcacauacaaagaguggcugcuucagugcagacgccaccugugggcccccagcacugcugacaguaauagucacaccacuagaauugaaaacugcacauggaagggaauuguauaagaccagauaagacugaacaaaauuaagauggggugcaggagguuuuuuuuuuuuuuuaaaggaaacacacacacacacaguaacagaaaaaaaugagaagaauucugugaugagugaugauugcuuuccuguauaaauuauguauaaguauacaugucuccuuccugucucucucaucuuuguguauuacuauuaagauuuaacucuuuguuuaaacacauuagacuagaaacuaauuuuaauacuugcuauauuggauuuucaaauuuguuuuacuccuuuaacuuucauuuaaugauuuuuuauuacuuaguuauauauaaaauaagcuuguugucuuuucucuauagcccuugaagcuaauacaugaucugcuauucauaugagaaguuugcacuuaguguuguauguuuuguuuuguuuuuuuuaaauauccaugaaauucaugaagcuucaaaauguuuuguuuuccuucuuaguacucugaagacuuuuuaagccacagagccuuguuugucuuuacuugaaagaaggaaaaaaaaaguuccauuuuuggcauaggauccuacuauauagcccugccuacucuugggcuagcauuguagagaucugccugccucugccucccaagaacugggauucaagguguguacuaccacaccuaguagaacuuguuuuugacaaaauuguagcaccucucacuuuucuucaccuguaauguccuuaaacauuuauuucaguuugauuuuucuaacucacuaauuuauugucucuuuguaacuagugcuagacauguuuuaaaauuuaaauguacccauuuguguuauauguuuuugaagccucaugagugaugcucacaauuacuuguuuugguaaugguuuuuauuuuauaggcgugauucugcucccuguauagauucuugucucugggucauugguuuccagggaucggcuuuacacaagggauuuuuagcuggaugcuccuuucacuauuggauaggacuguuugauugaggugucaucucacugugaagaagccauugugcuuuggcuucuuuuuucuacuuccugcuguucacaacagcaaugaaaaaaaaauuuuuuuuugugagccaaugaaaaaauaauaaacagcuaccuuugucagucauaccuggccuuugccuuacuuuacuucuuuaaauuucacuuuuuggaaaaugaguagaaauugaguuugccaugccucagaaacaacaugugaucuccaccaaaggccacugagaaacuuagaacacauguuucuuagggucagguuucugucugaggacugcucuugagaucuuacaaucuauuuuuuuagaucucgcucgcucucucuuucucucucucucccucccucccucccucccucccucccucccucccucucucucucucucucucucucucucucucucuccucucucucucucucucugucagcuauugguuaugugacucugcucuguacuaaaaguuccuuguaauuuugguggcuuagagaaugccuccacuuuccaaccagggcucaucucuaugacuuugaaaagaaaauaaugucuuaaauguuucuagaguaauuuuuaggagcccaaaaucucuuacaaccacuuucucucuuaaauauuuucagagguucacuuuuuuuuuuaggcugcugaaauauaauucuauuccuuuuuuuuaaauuuuauguuauuuguacuucauuuuuacacuccauauuccauucccugcccuuccccauccauccucugacugcuccacaucccacaccuccuccccaucccaccccauauucacauggaugcccccacuccuuacugcaccugaccucuaaacucccuggaaccuccagccugacaguagggaagggaacuuauagagcccaccuccagcagaaagacagggcaucaagugagggaugguguugccaucccacagucacaccucugacccauaauuguuucugucugaaagaauuacagggauggaaauggaaaggagccugaggaaaagaaaguccagcgauaggcccaaaauggggcccagcucaaggggaggucccaaggccugacacuauaacugagacuugggagcacucacaaaaagggaccuagcaugucuacccucugaaagagguucacuuuuaagacaggaguuguaagcacucaggaguacccuguuugagguuugggugagaaggcuguacuaguaugcacaaagcuucuaucuccaucacuuccaaacaaacaaacaaacaaaaagaaaaagaaggcugcuacuguccucuguacccuuaccugggcucugcucuucugcuaugguuucugaauacaucauaagccucugggcucaaugccacuuaacagaaauauagugugaaaauuggguuagauuaaucuuaaucauuauuaaaugauaguccauccaaaauaucauuucacuguauaauuaaaauauaauaauuaguaaugaaguauuuuaccuuuugugcucaauauuauaaauuucauauuuuaccauuagaacauaucacaggcaggccuaagcacacugcacuuauguaacuagauuuauuauuuuauguacuauguuucuaggucuuuguuauuauuaucugauauguuuaucaaaauauugauuauccuaaugauuugccccaagcaucauucucaaaauuacaucuuguuauucuaauauuuuauuuuauuuauuuauuuauuugguuuuucgagacaggguuucucuguguagcccuggcuguccuggaacgcacuuuguagaccaggcuggccucaaacucagaaauccgccugccucugccucccgggugcugggauuaaaggcgugugccaccaugcccggcauaauuucuuaaucuccuauaccccaagacuuaaauuuggauaugccuaccauuggguauacaguagaaaucccuaucugcaaauggaaaauuagacugcaaggcauauuagcaauguacuuauauguacacuaauuagcacuaagcucuaaaaugucuuccuaaaagcaaugaguggaaacuuaucaacuuugguacauagauaagacuggucuucccucccucaucccccuuguucguuuuaaguuuaacaaacaaguaaguggcuucugacaaaguguugcuauaaucaaguuguugauaucuugaaaaggaagcuuuaacaguacaguuuagauuuguaaagaauugcuauccuuaagagauacacaauuuuaaacuucauacagucuguauugucucacacuuuggcuccuuuugaacguuuuucucaaauguaacagguuuuggauguggguugugaggguccagcauuccagauagcaaacguuuuagauauuuucccuguuagaagucuuaauuguggcagguuauucucgaaguaggacauagagcuaucuuauaauauuauucuggcuauguugccuuuuuuugugccaguucugguugauauccuuccccaucugcuaagcuguaguguucuucauggcugugucuugacuaacacuaguugcccuaugaaagcauuucaaacauggaauuguugacuauaucagauuauuccaaagcaaacauaaauuucuuacacuaguaagaugucaauagcauauuggggaaaauaaauuuggagaacaauauguaaaaauagauuucugagccgggcggugguggcacacgccuuuaaucccagcacuugggaggcagagacaggcggauuucugaguuugaggccagccuggucuacaaaguaaguuccaggacagccaagacuauacagagaaacccugucucgaaaacccccccccaaaaaaaaaaauagauuucuguauugagggacuucuuguauuaucaagaguugaaggacauaaagaauauuaucauuuuccaguuuauucaaccauugaaccauuuuauuuacuuuucaauauucaugaauuguguuuccuaaaauaguauauacaguuucagagagucuaugcuauguggaacacagacuugaccuaugccuguggugccccagcacugcugacaguaaugguggcacuauuaaaauuuaaaacugcauauggaagggaauugggugagaccagauaaaauugaauuucauuuguucagaaaugcacaaaaaccugagcagcaguguugagaagccaguugcagucauucuuuuauucuacauauguuuaaugaauagacugugcagaauagacaucacuacaccaggcuuuuguuugauggguaauauggggaauauuauaaaauaccaagaaccagaaauucuacauuguaacaaauagaguaaaaauacagaaauauuuuauucccuguaagcuucuuauacaugcuuuguuuguuuguuuguuuguuuguuuguuuguuuuauuggauauuuuauuuauuuacauuucaaauuuuccgguuuccccucugcaaaccccuuaucucauccccccuugcccugcuucugugagggugcucccccacccacucacccacuccugccucaccgcccuagcauuccucuacacuggggcaucaggccuucacaggaccaagggccuucccuccuauugaugccagauaaggccccuucagcuccuucaguucuuccccuaacucuuccacuggggucccugugcucaguccaaugguuggcugugagccucugcaucuguguugaucagggucuggcagagccucucaggaaacagcuguaucaggcuccugucagcaaguacuucuuggcauccacaauacugucuggguuuggugucugcaugugggauggauccacagguggggcggucucugacuggccuuuccuucugucucugcuucacucuuugucccuguauuuccuuuagacaggagcaauucuggguuaaaauuuuggagauggguggguggccccaucccccaacugggggggggggggagugccuaaccucuggauauggucucaacagguucucccuccccuuugugguguauuuaagcuaaugacaucccugugggguccuaggaggcucuugcuuuccuggcaucuaggacuuucugguugcuaaccccaguucccuaucccccauugcuacacacuucuauucaaucuccugacccucuguacaucuccuccaucuccucccaugucugauuuuucccccucccccucuucucuuccucccuagucucucccacucucuacuucccuugauuauuuuguuccccuuucuaaguagaacugaagcaucaauucuuugaucuuccuuccucuugagcuucaugugguccgugaguuguauugugccuaauauccacuuaucaaugagcacauaccauguguguucuuuugugacugaguuaccucacucaggaugauguuuuucuagaucuauccauuugccugcggauuucaugaagucauuguuuuuaauaucugaguaguauuccauuguguaaauguaccacauuuuuuuuuuauucguucucuguugagggacaucuggguuguuuccaguuucuggcuauuauaaauauggcugcuaugaacauaguggaacauguguccuuacuauauguuggagcaucuucuggguauaugcucaggaauaguauagcuggguucucagguaguaguacuauauccaauuuucugagguucugccagacugauuuccaaaugguuguaccggcuugcaauccuaucagcaaugggggaguguuccucuuucuccacauccucaccagcaucuguacaagcuuuauuuuaauuauuuugaugcuguauuagcucauggcacuuucaacuccuuuuuuuuuuuuuuggcuuguauguuaacauuuauucacacacuacuauaaauaucauguguauuaauuauccucauaagacauuauaauaaaaacccauuuugaaauccacuaaucuuuucaucauuguagaaaagcagaauguggaggacuuagaauuagaucauucagucagugucuuagucacuuagucuuuugcugugaagagacaccaugacuaaggcaacuauuagaaaucauuuaauuggggccuuguuuacaguuucagaaguuugguccauucucaucauggcagggagcauagcagcaugcaggcagauaguggagcaguagcugagagcuacguccugauccauagacaagagagacucuggucuuggacuaggcuuuugaaacuucaaaguccgcccccaguaacacauuacuucuaacaaaaccgagccuccuccuccuccuucugauccuuucaaauagugccauucccuggugacuaagcauucaaauauaugagccugugagauccauucuuaaccaggccaccacaggcaguaaagugcuugcucagcaaacaugaggacacacgugcaaucccaagaacccacauaaaaaucaaaacucugcaauguguauccuuaugguagcaaaacuuccuaaagggggcagguuaaagacuauguuccacauuauagguacacagaacacacauauguuacacauucaguuuuagcaugaaagguuuucagauuauuuauagaaauaaagaaucaaguauggcagauccuguaauacugacacucgagagacucaaagcggauuuggaugccagcuuguguagcauacaaagauucugcuucgauaaaacaaauaacuuucuccauaaggacuaaguucaucuauauauuuuaaauuggcuaaaauucauuuugagucaucaguccuagacuuuuucuagaaaacagcaauauugcuuuucuacuuguaaaucuuucccccuaaacccagauguuuacccagggaaugaaugaauacauacauacauacauacauacacacacacacacacacacacacacacacacacacacacacacaccccuauaccuaugaaauuccuauacuuuaaacauuuguggcaucuuuuauauucauccuaaagcuugcuuuuuaguuuaaaaaaauugagaaauguauugagguuuaaauguacaaaucuaccucagaguuuuaaauucuggauaauacaguuagaccuuagcaucugugaucucuguauacauguauucaaccaacuguggagcaaaaauacauuaaacaaaugacauuagauuuguuuuuccccgaguuaucauuccuaaacaacuuuacaugccacuaacagccuuugcauagcguuauguuuuguuuggucuuguaaaucgucuaaaggugauuuaaaauacaguggaaagagguuagaaggacagcguaaugacuaagugcacuuacugcucuugcagaggaugcaagccaguucccagcacccacauagcgucucacauaacauucauagcugugguuccagaggaccugagacuguucuauucuguagguacuaagcuuacauaugguacucauaacaugcauacaggcaaaacagacacacacccaaaacacauaggaaaugugaauggcuuauaugcagauauaacaauuuucuuccauuuuggaggagacuagagcauuugucaauucuaguguuugaaaggauggucuagaaaucaguccaccaaggauacugagaagcaacuccguuccaaaauaggcugguaaugacuacucucauucugauugauuguuuuucuccaccgaauguuagauaguuuguaaugcauuugucuuuguguaccuguuugcuuucugguagguauuccaagagccauaaggcuaugcuuuuaauuuuauuauauauuauuuauuauguguguugggguggcacaaauguaccacaaauggauggaaguuagagaauaacuuguaucauggguccuggagauggaacucagaucaucuggcuugucagcaguucccuuuacuugcugaauuguuucaacagccugguuuauauauuuuaaauguuuucuucuacuuguuaauauaacaguuauuuccccaaauuauucuccaaaauggcuauaccaauuauacucugaacagcuuaugagaauaucauguuguuguugguuuuuuucuuccuuggucuuggcuauucuaaagauauugaaacuaacuaaaagucagcuaucagagguaggguguaaaaguaacuuguauacgucuguuguaauuguccacuccgaggauuacaccuaacuuaggccuagcccuggaagccucuguacagucuuaccuaggccuagaauguuuucagccucugagacuugcugccgaauaagcucacccuuucuaguucuuucugaucacuagcuggcugauucaacucagcuguuccaacucaaacucuucuccaagcugacugauucaaucuugcuucucugccuguccugaauugcuuugccugaccucaaacuaacucuagcaaucuguucuaaucuggcuccuucucauucucuuuggcuuguucuaucuuuaccugugucuaacuuguucucucucucucugcaaccugucucccuaucugucccagcaaaacugccuauucuuuccuccuuucuuuuucuguggugcucucuuaaguagacuuuuuccugucuguucucuugagaguugggcauauccuaucugucagaucuuucucugaauugucacuuugucugcaacucaauuaaacaucauuuugaaacuugggugcuuccuucuacaaacuaaauuuacuuuuauuguuugaauuaaauguauguguuaagggcaugucuguauuccagccagagggauuaauagaagugugugcuaagugccaagccacaccacaacuagaaacagguauuuucaguaaauaacauaaucucggguaucacagugugaucaaauagccacaacauuagaguuuccuccauagaccaaacaagaaaucacuccauacuguggaccuuuugagugucuccucacuaacacuauccaccugcagauagcucagaucucgacuguaucauacauuguaagccccaaauuauuuuacccuuuuuuuuucugcucaaucaccuauagaucagguucuuaaaucccacuguuaggguuuacuugcuuugccucaauagcucauagaacucaaagacauacguuuauuacuuaguuaagaaggauauuacaaaggcuucagcuugagagauguguaagccaaggaacaggaaccucuaugacuuccccugacacccuccugugucuucccuguguucagcuauauagaaacuuuuaaaacauguuuuggggguuuugguuugguuuguuuuuguuuuuaauaguuucucuguguaucucagagcuguccuggaacuugcuuuguaaccaggcuggccucaaacucagagauccaccugucucugccucccaagugcugggauuaaagucaggagccacugcacauggcacugcuuugggguuuuuauagagacaucauuucaugggcaugauaaaguugggauagccacauagaaauaagauugugcagaaaaagucagaucuacuucucaaagacuggaaagggagaccuagcaaaaguauguccucaaaauuagggcgcagaauccuuggugggagucuuaacuauauaucagaaagggggucagaggauuuauagccaccuucaaggaaaaaagguaaggaaagguuaauuuuguaaacugccugguggaagagaaaaaccugguuucuauggccugccucugggagggaacuguaagccaagaaacaugggugaaagccaaaugaguauuucauagacucucauguaaauauacaacuugcuuucuuagauguuuuuguuucuuucuggaggaaaauaaguauuuguuuuucugguugcuagcaagauuaauaguucuagcuguuuucucugcuauccuaaccuaagugaugucacauuguuuagauaaaugguaaagccaaacaacaaaggaguccugauaucugagccuuuaggcuguuucucucaaaagguugucuguaccuguggagaccuuaagucuucaguuuauccagucagcaacagucagccuuuauacuucuguaauguuuguagucaagacaucuuccuuccugaaugucuauaaaaaacacaugaucuucagcagaccacacgaguccagauauagaauauacaugacagagucugacacacaagacauucugcagagcuuacuggauuagaaggguuaggaguaaauaaauugaguuugcuggcgaaaggucaacuauuaauucagacuuggucaugaagaaaagggauaaaauuuuucuauuuugauucuuacaaaguaaacagaaacuucagcuuaaugucaugaaacaucuaccucauuuggucucauucucagaucagaauaucuguguaaaggcauauagaaugcauuugcuaugguucacaaaugaaccaccuaaggaacaugcaaguguuagcugagucacugucuccuccucuaucucaucucuucucuuuccuuccccuuccccuuccccuuccccuuccccuuguguguguguguguguguguguguguguguguguguguguguguguguguguuauguaguggauguuuagggguaccauucaugcacauugaggccagagcaaaauaucuaguguauuccuuuguuguuuuuugccuuacucucuugagauagggucaggagaacccuaccuggcuguuuuggauagacuacuagcuaacuagccagcuggcucuaaggaucugccuaucucugccucucuugaucuugucucuaccuccuguguacuaggaagacaggugugugccaccacacccaucuaaaugauuacuucaauccccuucuaauauguagcauuuauuugguucagauauugucuuguuuccaaagugauaauauugauuuauagguuguugagggguuauuuuauaauuccccaauaugugaucauuucuauuuuuuguuacagaagccuuugcacaugaguacugaauguucucuguaugauuuuaauuguauuuuucagcugugucugauucuuagaaauauuugaugucugccuuaaagaacgaauauucuauaauuuuagauuaugcacacuguaggugacauuucuuaacacaucuuuuuguugcaaagagauuugcgcuaacauuucacaacaugagugugacuucauuuuccacuguuauuuucaccuuuaaguuuucuuuuauugaaaaauaauuguuugugaugagguuuugauacguuugcauacugugagaugaccaaaucaaggcuaguuagccugcucaucauauaaaauuuuucuucucggcuagagcauuuaaaaucuuuucuuaguuuuuggaaaucuguaauacauuuuuuacaaugauuguuacuugugcuguguaaucugugacuacaauucauuccuuuuguauaacugaaacuucuacaguucucuagcucccagccucuaguacccaccauuuuauucuuuguuucugugaauuuuaacauuuugguucccuguagaaguuagaguauacauuagucuuucuauuuaugguucauuuuuuccuugcacauuuugauacugugcuguguguuguuuucuuucagcaguguuugucagaauuacugaacccaccagcaguaguucaugguauaauuagucugugcaauuucuguaguuuguauucuuaagauaguggaacucaaacuugaucauuuucucuuuaaaauagauauagaauacauugaguguaugcaacaagaaaacuuacuucaaauuuuagguuuacuuaaugguccugaauagaaaauugaagagaaauuauauggaaugauagugaaugaucuuaucucuuacuuaaaauacuaacugcuuuggagcauagagaauuauuucuugucuuaacuuccauaauauugcuuaugauauaccuguuuuauuucacaguaugagauacauuguauagucuguguccuugauaagauuagucauauauuaaagauaaagugguagagucguuugcuuuuuauuuuuaauuacauuuuauuuauuugugugugcacuuggacaugcuaugaugagcaugugaagaugaaggacaacuuguaggaguugguucucucuacucuguggauccagggagccguuuuggauuaucaugcuuguagacaagcaccuucacccacugagccauuuugccaugucuuuucuauucuuguauucucugcacuugacaaaggcauucauuggauaauugugaucacuaauaaauuuuucaggagcuaaguacagcauaguacaauguuaagaacaaagauugugaacacuuuuaaaucuuguacagucauuuuguuaaccauaaguuuuacugccugcagaugcucaucuguaaucucaaacacuaguauuaauuuuauuuagacauacuaccaguguguauguauuuguguuuucuauucuugacauuuaaagcuauuuuugguuuuaaaaaauacauuacgucaagaacucucgaacgagcaaaauuuggcauucagaauaacucaaguucuuuucuccuucagcuuccagcugaucuuaccaagaugcaccucacagacaacccucauccacaggugacgcaugugucuucuagucagucuggcuguagcauugccagugacucugggagcagcaguuuauccgauaucuaucagguaauaccuuaggcuggguacugugcauauggacuuuuugauucugcuuauccucuagauccaacaaccuuucacaggaguuuccuaaggccaucagagaacacggauguuuacauuaagauucauaacaguaggaaugguacaguuauaaaguagcaaugaaaauuuuaugguuggggucauaauaauaaagggucgcggcauuagaaagguugagaaccacugcucuaauuuaacugugagacucaaguguaagauuuuuagcaaaguaugcuuaauauguugucacauucgucagccugauuauuucuuuuauccaguugaauccauaugauagaaugcuugccuuaauuaagggaaaaguuugugggguuuuguuuuugagaaacagaauguugcccuauaaccuaagcuaacuugaaauuuucaaucuuccuaccucagccucaugagaguuggguuacaggcucaucccuggguuuaaagaaaguuuuugaaacaacagcuuacacuugugaaaggacugauuuuuuucuuaauuauaauuguagaaguuuucuauaaguaaaauuuaugaagaaagguaggguugcuuuuauauuauaaaacuuuuguccuguguaaccuuagugaaauagaaaguuaaauagggaguguaauuauagacuccuccauuuuuaaagcugaacagaaaauuccaaacuaaauaaggugguuuuuuuuuucccagugauucuuauaauaaaaagaggguucugagaaucauuacaaaguaagagaauuuuugcacauccuacuagauuaaauucaaauuuggcuugggccaguacugauuuguuaggucuucaugguagagugugaucuugucuuaguguagggugucuagggcaguuuccuagaugaccugaagcccagugguaguaaaaaacuggagaugcaauauuaaugguugguuuaguuaagaauucagauacuacuggcugguuuaugugucaucuugacacagguuggaguuaucaaagagaaaggagcuuuaguuggggaagugccuucaugagauccagcuguggagaauuuucucaguuauugaucaaauggggagggccccuuguggguggugccaucucugggcugguagucuugguucuauaagagagcaggcugagcaagccaggggaagcaagccaguaaguagcaucucuccauggccucugcaucagcuccugcuuucugaccugcuugaguuccaguccugacuuccuuuggugaugaacaacaguguggaaauguaaggugaauaaacucuuuccuccccaauuuucuuggucaugauauuugugcaggaauagaaacacuaagacagauacauuuuguguuacugggaugacuaguagauauuuaauguaagcuacaugucuaauuuaagcuuuucaauagucaucuaaaaggaaacauaaaaucaacuuuggugauauguuuuauuuaugguauacuuaaauauuauuuuggcauuuaaguaauauuucaauauugugcugaguuuuguugcacauacuuuguuuagauuuuuuucauacuuaguuuagauuuacagcccaucucaguucugaugucauacuuuaaugcaugcauacacacacacacacgcgcgcgcgcaugcaaaacuuccuguuugccuuuuuuacaauauuuauaaccaaagaauuuauccuuucucuucuguagaaauacuguaaggaauuuaacaaagaaagucaaaacaguacaguaacucuuaguuaccuacuccauaucuuuaguaauuggugggguuaguauauuuugccucucaaaaaggaaguacauucucugcuucuguguuguucacaaaggaauacugaagaaggcuaauucuaaaacaaucaagaggaguguuguagcuguacuuuucucucagaauacuugggaaugugugcuuugcuaagagaaacaguaagcaaagauauguuucugacaaaauguaggcaccugauuucacugggauauucuauuucuaagauagauaugaauaccuuuuuuaggcaagaagcaaagcccuaauaguuguaacagaaagaaugcagggauaaugaacauauuaaauaauaugucauucaagucagugcuuugcuguguacucaaagauggguuguauacaacugguaucucuuucaagaugcuggaagagugccugagauccagcacugauuauagcuuccuugccuacuaguguuaguuggaagucuuguauugcaaggucaugucccucuaugugacuacccuucuugcagacuuccauauaucaauagcagucugcaguuuuguugccuuguagcuauuuucuuuauaauuagucgaaauauagguagacaucuugcugacuaaccauauuacagaguauugaagaacauacuuuauaauucaguuccaugccaucaguucagcuuccuauaucacuaaucaugugccuauguuucauggauauuagugauuguuuacauauaacaaaauuuauccucuuuaauaugagaaauuagcuuagggucugaaagcauuuuaagcuuguuuguauucauuuccucuccugaucccuguccuuacaaaaaccaaucuguguucuaccuuuacuguuuugcaucuccaaaauguuguguuaaauagaaucucuauaacaaaagggggggagggugcuuugaaauuuauaaauuacucaauaagacagugguaaguuuuaguaaauuuacagaauaaacaaguaaaaagauacagacauugaaauucuagaaacaaaacaguuacucaaaaauuuaaagcagaagaaaauugugguaaugcuaaacccaaaaugcagaaguauaagauaaagaucuuuuaagagaggcuaguuaagguagaaauuaucagacccuuacuccacuaacuuuuaaggcaauugccuagaaacagaaacauuuuaucuugacaaaagcagcuuagaggaaaggguauguuugcucacaauuccaguuuugcagcacagcauuguggggaagucaaugcagcaggaacuugaaacagcuagucuaaauucaucucuagucaagagcaaagaacagugaguuaacggaugcacgugugugcuggacuucuuucucuacccuuaacacagucuagaauucuggucgggucuucucagcagaaucaagauagcccucuguagacauucucauaggucaaccugauauagauagucccucauugaaacacuucccaaauaauucuagauuacaucaaguugaugauuaauguaugugacauuccauaaaacaaagcaaaucaggccaaaaaaagguaaaaguagagggguauucuuauaugcuaugccuuaaauggaauaaacuuaaacaauaauuuuaaaauguguguggaacaauuaaaggaacaucuacuaagagauaaauuagaacagaauaauaaaguagaccucaaaaaauuuuaagauuuuuaauaagaagccauguguagcauaagaaauauuuagaaaaaauuguguguguguguguacaugcgugugcaugccugcgaguguguauauaaaagagcucagggaauaaaacagagguaagaaagguuaaacauuaguacuggagccaggacuaccauuagagagauacuuguuaaaacuaugaauauacuauuuuguuagauaugaauauugcugauaacugaaccaacaacuguuaaauuacgugguuguaaguauuccagcuuuugaaggauuucaagugugaacacugagcacuuaacuauacaagcaaaguauugugaaaugaugcaaguauuuuacuuuggagaguugggguuaguacuauacuagaagcacuguguagccaaguaugaggcuacauacucuuaggcacugcugccuuuugauuuuuuuuuuuuuuuuuuuuugguuuaaaaacaaaagccuuugggcuuaaagaaacaaaaacauuuuccacuguuuaaaaagaagauuacaaguaagguuccaaagugaauguuuuuuaucagauuaucuuaaauuuuaacucaauguauccauuaaaaugcuagaauguucuuagaguguuuacaugucuuucaagaauguacaggagaauaugaagugcuucuuucuagauccuuuuuucuauuaacuuuagucuuauuuaacagcuggacaauuguaaagcaauagcucuugaacaaauacauuugucuuuuuaaaaaauuuuuugauuuguuuagaacacaaaaugugucucuauguauggguuguauacuugaguguagugcuccuggaagccagaaaugggcauuacauuagauccccuugaucuugacuuacugguuguuccaagcaacuuaggugccaggaaccaaauucaaguccucuggaagaguaauauauguaugcucuuaacuauagugcugucucuaggcauuugucuuaacucacucuuaaguaaucuaaggcacaaagccauucauucccccaucuguguggaaaagaaacagacuuguaagaaucccuuaacuuucaacucauguuaccauguuaccagacuuugguaccauaucucuauuagagcugcugcuuccccccaccccuuccccaauuagcuuuguucugcuaaauguucuuuagccaccggucuuucaauuuucuguuaggaauaucaucuguucaguaggggugucacucggugauagauguuacuuaaaaauguagauuugcaaaaaggagcuggcacaaaauuuuccuucagaaagggcuaugaucuggagagaggaaggauucccacccccaugaccaugguguauaaaggaggcauuaucaagccuuaaaaugaaagaacauuagacaagaaaaaaaaaaauaucagaccauaggaagcauuauagagccugcagggaagaggagggcauuucuucagauccugagcaaagcuguaaucagcuauaacucccgugcuguagagcaugacuggguucccgaaagugaggagggaugcgagagaaccugcacuugaaauccagagagaaggggaagggugggggcgcugauucuuuuagcuucucugaugaacaggguagacaagcuucauccugcagcuugaaggcaggcacuaggcagcacauaaaugcagcuuguagcugggagaaguagaagagcugcacagugagcuuccuuaccaggucugaccagaggcugagcugcuccgagcuguggccucguuucuggaagaaaaaggcagcuagagaauuugugaucugacaguggagugcuugccugguaugaacaagguccugggguuuaaucuguaguauuaauccuaggaaaaauacaaauacaaaaagacaccaucuaugcccuuguccaaggcuaaguuacccacuacccacauacagugccauuuaauuuaaacuccuacuugaaacaaauugcaagaaugugauggcuuaaauaguauucuauuaaugaaauuucagugcuucgcucuuaccaaacuacgaauuucaagccuuucauuucccacuaccaucugccaucugguucuguauuccauuaguuuccuacagcacuuagagucugcuucauggcaagaguacaugcugcuggacccucagcaugcuuuuucuuagcuguguuuuugguguuuuguguguauuuauuaucagaauaaauuuaugcagaugggaguuuauguuuuuacugaucuuguuucuuuugcugagucaagcacugugguacuuagaaguaaucuagaaaaaaauucaaggugaauaauauuugaaguaaauaccaguauugguuucaagguaaauggcaaaauaucucugcuaacuaaaauguuggucuguaaggcagaggagagaaauggacagggcuauccuggacugcagaauuguggaagauuucauugcacaaaauucuccucugaccaagaagacaagaugagcuuaaaagcugaauggucccugaaaagggaaccuggacaugaugaugcugaaaggaaaagcauugaaaauaugaagugcuggcuuaacacuuaaaccucaauuuuaaaugugguuuuuauaaguuuguauaacauuuucauuaaacauguggcaccuuuuacuguagcuucauguuuaguugcaaacaggaaagagauauucucugaugguuuauuuggugaaggccaacucaucguagagucagcuuguacucaccgcauuauauguacaaaguacaugugacaggaaaggaaaaccaagagagguuuaauccuuguccuacuagaccccugugcuuaaccuauuuaucauaaucuuuuuaaugaucugccuagggcgggcucaguuugcuaacuauccuacaaaagugagucuccuaccaucucuuaauauuaucauucuaauccugugauuauucugcuccuuuuagucgaccauuguccaucucuuccauuugagucuucauauuuacucucuuaaccaugccaaccaccaguguuacucugggcuggucuagaacucagggauucagucuuucauauguugggauuguaagcgugagccaccacauauaguuaaauuuauucaucuguucauuuuacaguuaaugagaauccuucuuuuugcuuuaaaguacauguugguuacagaauaggauauuguauaugagauacuaucauaguccauucaagcugcuguuucaaaaaaaaaugccgugcacuggguagcucacaaacaguagaaauucacuuuucaugguuuuagaugcugggaauuccaaauuacaguaaugacaaauuugcuauccugugaaagaucucuuucugaucuguagauggcaccaucuagcuauuuccucauauggaagaaagguuggaugggcuuccucuggccucguauaguacuacccgugaggcacuacccauucaugaggauucuaauaacuuggugagguuuuagcugcucagaggcuccaccuuccagcaccaucaucuugaaguuaagauuucuuucuauuaagaauuuuuaggguguuggagagauggcuccauguaagagcacuugugauuuuggcuccuagcuccauauagcagcucacaaccaucaauaaccccagugcagggaauuagaugcccuuuucugaccucuguggacaccaggcacacaugcaguuuacuuacaauacauguagccaaaacauucauauacauauaaugaaaauaguuauaauuuuuaugggcuggagagauagugcaaugguuaagaguacugacuacucuuccagaaauccugaguccaauuucuagcaccuacaugguagcucacagccauuuuuaaugguaugugauucccucuucugguguucaugaagacagagcaccacucauauucauaaauaaaugaauaacucuuuuuuaaaaaguuuuaggaucuggggauaugccuuggcuaaaggagccuuggguggcccuauauuugaugccuagcacuguugaaaagggaggaagauguauguagcccaguuaguagagugcuuaccguuaccauuagguucaaccuuagcacuucauaaacugagcauaggagcauauaccuauaauccuaaauggcagcaggaagaucagaaguuuaaaggccuucuuggcuacaggucaaggcccaucugggccacaugaaacccugucucaaaaaggaaaagaggauaaugguccaggccauagcagcagacuguuacaaaccaucuuuucuagucuuaaaggagcucauuguauauucauucuggauuauuaacuacuuaaaaauaaagaggaauccaaaggcacuauaaauugugcauaaagcaagacuaaguugucaucugagcccuaaugugaauuaacaaaggccagaagauuaauaugcuggcccacagagaaaauguggaagcaguucugacagcagggaggcuguaauugcagauacggcuuucuuuccugccugucucuaaggucguuuuguguccuauggcuuaccuguuuuuucuccauucuucucugugauccuguugcuggcacucuuucucugcccaguauguuguauuucuguugcuucauugcucuuucugguucugcuucucuuacucaagaguucuccuucccauuucccugccucuccucuuccuguucauuuuuagcuuuguuccuauuuuuaacucuuugaaacuuguauuuauggucacauacacacauauuuauacauccuacugcagcacaaggaaccugccagugucuaccccucauagaaaagugacuuuucuacaccuucuuuauagauccucagcuacgacuggggccucgggagcaacucuauaauggaguuuuguuuuuuuuauacugacuuaauuuuauuccagaguacuucuaaauaacagugccauauuaugcuggauauuuuauacuuccuuggucuuauauaggucuuauguggguaaccacaguugcuaugaguucaugaguacaacauguuauauacaaaggaaguauuucagagcacuuguccccaucuucaggcucuuacugccuucucuucugugauguucccugaaucuuugggcucaggaaaggagauuaauaagagaauaacugacuaugaaagagggcagaaagcauguaagaccuuagaugaagcugucauaaucuccacuacuacucauuuugauugcuuauuuuauaauuauggauuuccugugcucaacucacuauuuacuguaguaacucuuaauauucaugccuuuucauuuacaguauagaucaggagcauaguauuaaaaguauucuaaauguuuuuuacuuuuggaaagacauuuucaucuucugugaaugguaguuuuugaagcuuccuaguucuuacgauaucuagcauugauaaguuuccaaaguugugguugaaauuucuuucuguaggcuacagagagugaaguaggagauguagauuuaacacgccuuccagaaggaccuguugauucugaggaugaagaggaggaggaagaagagauugauagaacagauccacugcagggucgagaucuuguucgggagugucuugaaaaggaacccgcagacaaaacugaugaugauguugguaagaaauauauacauuugaggccaaccagagcuccacagaaaaaccaucuuaacacagagggguggggggagagggagaggagagagagagaagaaauaauucuguucacauaaacauuuuuaacccuauauacaaaauaaucuguugccacauaacauauuguaccaaaacauaacuucuaaacacaauauacauuuauuauuucauagucuuuguucguugggaauucaggaacaacuuagcuagauaauauuagcuuaaaucuuagucagaguuuaccugcaaacuccagucacccaagucuucacuggagugugugaaaaucuuaaguccaagaugacgacucaugagacuucugguacaagaccucaguuccauggcauggaguuuucuuuguagccugcuuauucacccuaacaacuuaacaauagaucucugauguggguaguccagggugagcaagguagauagaugcccuagugucuuuugugacuaucauuccuucugccauaaucauuacaccgugcaaaccugaaagaguauuugugaagacugugccuggacauuggcaucaagaugucagaucauugagagccauuguugagacuugcugugaguguuuauaaaauaaaaauguugauuucauuuuacugauuuuuaucuugagguucauaagacucacuagaguaguaccucaaguccaugaaguuauuuauuuauuuauuuauuuauuuauuuauuuauuuauuuauuuauuugguuuuucgagacagaguuucucuguauagcccuggcuauccuggaacucacuuuguagaccaggcuggccucgaacucagaaaucugccugucucugccucccaagugcugagaucaaaggcgucgcgcgccaccaccgcccggcugaaguaauuuuuaaaucaauuucaaauauauuucauuuacccucauuugugccacccucauuaauguuacccucauuaaaauuauaaagcuuuuuguguauuucuuaauuucuuacaguuagauaauauguuuuuaauugaaaaauugaaucuaaagaugguuaaggaacuaaguuuacuuugagucaguuacauauugcuacuguucaauuacgauauuuuuuuuuaagauuuauuuauuauauguaaguacacuguagcugucuucagacacuccagaagagggagucagaucucguuacggaugguugugagccaccaugugguugcugggauuugaacucggaaccuuugaagaguagucgggugcucuuacccacugagccaucucaccagcccccauuuacgauuuuaucuuggauuuuuuauuaucuuauugcuguucauauuagaagucaauguuagugaaaauuuuaacuuuuauuagcaauggccaguauauuuuuauauauugucugccauuauaaagauagaauauuguuaaauaaccacuguuuagacuugugcuguaaacaaccgcacagacacuacauuuuaugaauuccaaauaccuaugaguauauaccuucuuuguauagcuauuuuuauugaaguucguuuaucuuauugcagauguguguguauauuucucuuauuuuuaucuuuauuacuuaauguguuuuuaaucaaaaaauagccucaaacccauaaacauuuaguaaaaauaguaaauuuuuaguaaaacuaguuaacuaguugauuuaacaaaucuugagcuauacaucacuuuaguuaucccuaacuuacugacugauguuaccaguagaauuaagaaaaagaaaauucuagccuaaaaguaauagacaaaaggguuuuugcaaaucuguuagaucaaaguacagcacuaaguugcaccaccaaucaagugacaucuccagcuaggcaaaucagauagaugcuacagcuuuguuugaaccuuugugguuuccuguuucucuggguguuuugaaugauaucuuucaauauaccaguauauauaugcgacgguaaauauacauacaguuuauaaauuuauauguguacacauauaaccuacuaaauuaacuggguuuuuauaaaauauuuuuauuugauagcucuauugccugcauauacaucugugcaucauaugugugcaaugcuauggaggucagauaugggugucagguccuacguugauuaacaaguugaauacugaauuaacaaaauuuguauguuaaaguaagcaucauugaucuuuauacugggauuuguguuuucuuacagaacaguuacuugaguucaugcaccagcugccugccuuugcgaacaugaccaugucuguaaggagagaacucugcuccgucaugguuuuugaaguaguagagcaggcuggggcuguuauucuugaagaugggcaagagguaggucagcagauuauuaaauuaauuucucuaagcuuguauaaauucaagcuuuuugguuuaaauuauuuugcgugaauacuugguuggggugauuaauuuuugaagagguugucuuguugugguuauugcuuuacucuuuuuaaauugcuguuuuccuggugcuagacuuuauguaaaaucaggauucaaucaauaauugaaccacuuuuaauacuaaaauuaauuagacucuuuuaaagaauucuucauugucaauuugugugcgugcgugcgugcgugcauacacguauccguaugcguaugcaugagggcaagguauugaugcuguugccugccuccuaguggauaugauaaagcuguagcaugauggcucucaauuuuucuaaugcugugacccuuuaauacaguuccucauuuuguggugaugcucaaccauaaaauuaucucauugacgaaguauauauacuucgucacuguaauuuugcuacugguacaaauuguaaugcaaauaucuguuuuccgauggucucgggcaaccccuguaagagggucacaacccacaaguuaggaaccacugcuguagugagacugggaaacacuacuguaagguugcugagaaguguuuuaccauuuuuuuuuaacauuucugaaauuuauuuagaaauucucuguauucacagucucuaaucuguucuacuuacuagugucucuccuuagaacggaauaaacucaagaguuauaucaaaagauauucauuacauauuuauaauagaaauaacugaggauaccaaacugugguuuaaaaacaagcaauagcuaaccaaauaaauacauaaccaugggauaaaagaguaguguauccuuaguaguucuuuguguugcgggggacucaaacccaaacuguccaaacuuguccaagcauacuggacaagugaugacccacugagcuguguacucugcaagcucacauuuuuuuuuaacuacuagaaauucuuucaggggcagaugucuucuccagcuuuauuugaauguuuugcacauccaguaaauaauauacacauccccaggaaguuggaggagacagaugagguuggguuuuuuuuaaucuuuaaagacaagauaaggacuggagagauagcugaguugguaaaguauuugccaacaagugugaggacccgaguuuggucccuagaagcugcaacaaaagcuagacaugauggcaugcaccuguaaaccuagcaucuugcuccgugcaagaucccuggggcucauuggucaaccaguccagucuguuuggcaagccuaaggccaacaagacccuuucuaaaagaaucacauagaugguaucugcagaaagacagccaagguuguccucuagccuccaaaugaguauguucacauauauacauauguguaccugcagccacauguacacaagcaaaaauaaaccaaguuggacagcaccugagguuggccucuuaucaccacaugcacgcacuugucuaccuacauauacaaacacauauacucaagcagaauaaucucaauauucaaaagcuuaaaauaauauacaaaugcagccaauaaauaaaagcuguuuagacaguaggauuuuaaugagcuuuucuuuucuacgaguuuuuauguucccugagucucguuagcaaaaauguauugucugguuggacaaggugcacaccuuuaaucccaguacuaaggaaaacaagcaaauaguucucuauguguuagaggcuagccuggacuauuuuagcaaguuccaggauacccauaacuacauagagaacuugucucaaaaaaccaaacacauuaacaaaaaaauguaucaucugucaacuuccuaccagauauuucuguaagcaggaauauggugguugggaaaacacacagccccauucucuguaguuuauauaaucuauaaauucuaucuauaaauccuacuguauucuuauaaucaguaacaaaaaaaggacuuuauaaaggucuuuuuguuaccuaguuacuacucaggaugcaucagaaauguugaaaguuuaaucuaauguggaggaauggcuauuaaagaauaaaugaucuuucacuaauacacagaagacuuuuaaaaauacagcugugggggcuggagagauggcucaccagucaagagcaucuacuguacuucuugaguaccuggguucaauucccagcaccuacauggcagcuuacagcugucuguaacuccaguuccaggggaccugacacccucacauagacccaaaugugggcaaaacaccaguguauauaaaaacaaauaaaucuuaaaaaacaauaauacagcuuugggcugaauagguggcaguuucaggggauccaacagucauacacaugauacacuuaaauccauagagguaaagcauucauacacauaaacuaaaauaaaucuuuaaaauuagaaauguguacaugcauacaugucaucuccccggccaccaauauggcucuguggguaaaggaacuugccacuaagccuaaccucucuuucaauucaugguacucacauagcaggagagaaacaauuccuacuuuuuauccuucagccuucacacaaacauuguagcaacauguuucagcacacaccaaaaauaaaucucccucacgauuucauauaaaugaagaauuguuuuuauuauuagcacaaauuuauaacauaauauauauauauauagagagagaauuuguuagcuguguauuaaaauucaggcuuugcuaguuuuuaucauuagaacgauuauauguuggacacuguucuaaguauuuggucuuuauuaaguuggccaucuccuuuaggaguucuguauuacuuuuaaaaaaacaaaaacaauuguuuaggaauaaacugaggccuggggacauuauauaacuuggugaaaaucacugugcugcucaguggcagggccuggauuuuaggaauuugugcuccuaauagauggcuuagcaguugagagcccugggucuucuuaucggagauagggaacaccucucaauugucuguaaguccaguuuuugggaguaugaagcacuuaucuggagaccuagggcacacauauugugcauauacauauacucaugcacauaaaauaaauugucuuuaaaguaagaauuauucucuuaaacacuacaguauuuugccuuagagaaaguggccgauuaugaaauuccuuuggugacuaaaagaagaaagugaaagaaaccaguaguuuuguauagacaagacauaggauauuguugaauaauuacugaauaauagagccaggucucauuuuacauguuuuuuuuuuuauuguuguucaaaguuaacuuauaacuauccuuuuaaaaagauuauaacaccuuucuuuuccucuauagcuugacucaugguaugucauuuuaaauggcacuguagaaauuagucauccagaugggaaaauagaaaaucucuucaugggaaauaguuuugggauuguccccacgcuggauaagcagcacaugcauggagcugucaggaccaaagucgaugauugucagguacgccugcucugcucggugcucucucuccuuagugaugaaaauggcggagcugcuuuucucucucuugcucaaaauuaaacagcauuaguugagaauuaggauuuucuauagccugcaguuaacaagagaaaguagauuuuauauuuuucucaaauuuuguugacuugagcaaaguauaaauuuuuaagagaauguuucaaauaaauguugguuuguuugagcauucaaacucuuauuauccaguucaggcuguuuucaaaaaaggaaggaaauaggaacuugugaguuguuuguuucuaacuuacuccugcuucaugauuucuuugcauagugucuguuugagagaaguggauguucacuucuccuuuuagagcagaauucagaagauuccacuuuggucucugugugaauuguuuaccuugauuuuuguuuagaguuaacaaaauugaaugagaaagagcuuaugccgcuugauuucuugccguugugcucugccuuggugcauagugauguguuuauguacuauagguuccuuaacuguccccauguuauucuuggacaguuugucugcauagcucaacaagacuauuggagaauuuuaaaucauguggaaaaaaauacucacaaaguugaggaagagggagagauugucaugguacaugagcaccgugagcuagaccggagcggaaccaggaaaggacacauuguaaucaagguggguguuuuuacuuuuuguucuagaaacugcauucagaucuuucaucuugcuuuaaaaauaggcuuuagaccacuuuuaugaguaauguaaaauucuucacuagcuuguugaugucuaauuguuucuuacacaucugaaugauaagggguaauuauugccauuuaguauccaaauugauauaauauuauuuuagauuauacugaucaaaucuuauuuuuuuacauauguaagaccuugauaguggguguuagcaagaagaaagcaagcaauuuuaguggggagacaggaaaaggaaauuuaaagacuagccacaaacacacagaguccacagugaaggugcagagcucuuguuagcuugaaaugagcuguggcuucucugaaccuuucuuuaaauugaaaacggaagagauacaggaagugaaguuaugacugagugaggaaaaucuggaguuuuaguauuauuacacucaacacagcaaucucuguauuuccuucucuguaucuccaauauucuuugucauuccagucucuaugaagacccccuagauauaaaguaagucaaguauaauugaaacuaaaauacacguuucucuuuuuaagcuagccuuauuugcaaaauaugucauuauuaauuggcagauggacaacuuaauagcauagagaggaaauacaagugaugccaugucaguuuuuuccugggaauugaauucuuagaacugucucuuaguauaaguuuugugugcagaaaaggugaguauggcuggguauggugguuacacaccugaaucauucccacacuaagauagaagcaagagaauccugaguccaagaguagcuucagcuguauaaagcaaguucaaggccauacucagcuauaugaaauugucccccccacccccaaaaaaagagaaaagaaaggaaaacauaaauagaauacauagacuaauucauauuaucauuuugucuuuggcaaagaccccuguauuuuaauaauuuaaaacuuauagaaaaguuuaagaaauaaaguagggagauggcucaguuuaguuagggcuuaucagacaaaugcaaauauagggaccugagucugucagaacucauauaaaaaaaaaaucugggcacauugaugugugccuguaauuggagcaguggggaagcagaggugaccagccagccagcugaauucaugaguuagggguuugggcugagacucugucuuaaaacauaguggagaauauuugaguaagauauccaaaauugaccuuuggcccacacauacccauguacacaugaacaauaagaaguuucaagaauaauacagacagcucuaaguugcaucggccccuuuuacaucagucuucuuuugaauuguuugagauaguuuacaaauacaaugucucaccauuccuaaagcaaaaguuuucuuacauaaacaccauagaguucuccaauaauggaaggacacauuguuaagauaauacagucaauuugaggucccuaguaaauucucacuagugguuccaguaauuuauuucuugucuggauucucaucuaagaacguaguuguauuucauuguugugccacuuuggaccacuccaguugccugaucuucuuuuguuauucauauccccagcagacuuaaagaaucuuauauccugucacauuuacccauggccaaacuacacucauguuuuccauaaaggaauaucacuaugauuaacacugcucuguguguuuggugcaguguugacacuuuccucuagggaagcuaauaugaugaccuacguccauaugcgaggaucuuuuuuucugugacgucaccauuuaugacacuucauaauugaugaguaucugaugaagagauguucugagaugacucagcauacugccucuaguuuguggauaguaacaacuaagucccaccuguuuuuuauuauuauuuuauuuuuuauuauuccuguugaaaacacuguuuuacuaauccuauacuuucucugucauucuuuauguuugauauggccuuggugucgcacucccuugccaucaguauuauccagaugcuauacagguugacucauuuguauucuucugaaaugcccucaucauucuuugacaaucaguaaggauuaucaugaacuucuuuuuuguuccuacucuggaaucagccauuucuccagaaaguucuugaucuuuccaguagagaauagcauuuauaaaccaggaucuggaaauuuacuauauuguauauuuguggccccucaugagucagagcuagaaaaacagguauuuauguuaucaauguacuucuacagcugucucuguuugcauucugcaaccaugagauuauaugcuauuuaacaggucuaaaacuaugcuacaggcuuagucuaauguuuuauuuacauauguauuuauuuucuugcuuauuugcugauuuuaaccagucucuaccuugcuagaauaacagugccagccaugucuuaugccuuucuccaagugaaaagcauccagagugugauucucuccaagugucaaacuucuugguuguuaggguagacauuggagacauacuuucccauaauaauguccucaaauuuuugaauguauagcccagacucuguaggaacuuuuaucuaccaguuuagacaaacagaauaguguucuuccuuuaaaguugaccaguuaccacacucacuguguauacccuaagaccacauauaaguuuccuagaccaugauuggcauaaauaacaaacccauuuugauaaucuuagacuuaguauuuuugagaguaagacacgcagaggaguaacuuauagucucuaugccauacguuauuuauaugacaucuuucuuacuccugaauaccuucagggaaugugauuuauauaccuuguuaacauugagugcccuuggggaauaaaaacucugagcauugucagaauuaauguauguuuacuauagagauguugggauuauuuguaugguuguaacaaauuagaguuugaacuugagggccaucauuagauuauuuaauuuuauauuaguguuuugcuugugugugugugucuaugcaucauauaugugucaucuacagagaucagaaaaggguauugaauccccugaaauuggaauuagagauggugagcuaccaugugagugcuaggaaccaagccaagugcucuucaucacugcaucaucucuccagccccacaguugcuuucuauaucuaacugaauauuuguuuucuuuuuacguauauucuguuuacccccuuuuguaaagguaacagagcaggauugcaaaggcaguauaguugguaaagugcuuaccuugcaaacaugaugaauuugauccucagaacuuaggagguuggagagaugggucaguugguaaaguguuugcugugcaagugcaagacucuuacuuccguuuucuuuuaaaaggcuaguaugaugacaagcaacuguaauucuuacauugaggggggcaaaaacaagggucccuggggcuuacuagccaguuuguaaaccccaacaaaauuuuuucuccaaaacaaaaguguguguguguguguguguguguguguguguguguguguguguguguauacauacauacagacauauaguaaagagcauuugaggaagacacugauguaauucucuggccuaagccucacccugcaaacccaugauggcucaugcuuguaagacucccaggccagugagacucuuaccucaaaaaauaaaggaaaguucuugaggaacaauacucaggguuguccucuggccuccacaugacacauacaccaaagaaaugauuaauuagaagaccugcaaagucuaauaaauuuuuaacauugauucagaaacucaauaggaaaugugugugugaguguguauguguguguguaagugugugugugugcacacacacacacaugcacucacaugcauaugugaauuuugagguagacaagcauuuaaaauccugaauguacaaacaauacaggauuuauuuagucauuucacauacagcaaagcaggaagacuagaagaguaaauacuuguauauuaugccuguagccugggauagaagaauuaauuuggauuuaaaguggaagaaagcuuacuugcuugcuuucuuauuucuguuuguuuccuuugccuugggcagucauuacaugccauauuguagcagaaguaguaguaacagcccauacaaggaauaagucaguacauuuccuagguccuaugauggugagauaccaguagaaaguacagcugaacacaugcuauuggggacuuaccccucuaccauuaucucaacucuaagccucuggucgcuacuaaauuacaaucuaaagucuacauaaggagaaugaugggaaauaaugugacaccuugaguuuuguuuuuucuuaaucuuuccuuuccuuugauuuuuaggcaacaccugagcgucucaucaugcauuugauagaagaacauucuauuguggacccaacauacauagaagauuuccucuuaacuuacaggacauuucuugaaacuccuuuggauguugggaucaagcuuuuggaaugguuuaagauugacaaccuaagggauaagguugguuuauaaauauaaaacaacuaacuuuaaccuuuaaauuuuauuaaggacacuuuugcacuuaauagauaaaguggagguuuuguuguuuuuguggaaaaaauaaguuuaccuaaauaauuuagugaguugguguagauauguguuuggucauuuuacuaacgaaagagccuugagaagaaaaguggaucuaagccacagaaaucagaaacugagguaagacagugauacagcuaguuauaaacucaugaaccauaguaguaguuugugcagauggaccaagcaugaagcugguuagugaguuuuaaguaauauuccacaaauaaacuuuucaagaagaugaguuguuuguaagucucaggauaagaccauccaagcuuuucugaguuagagacucuauaaucaucuaaaaaguuugucagcacuuaguuucuuucccauaauguaugggaaaugugucuuuggguuauuuuuuuuuccacugagcauuguuugcuauuuuuuauugaugacuuuagccuauuuuaugggacaucuauacauuuaauggaaagacaacucaucauauugcuuggaaauaaauuguuuucagaaaguaaaaguggggucauaauuuccugguaugcccuccugaauugcauguuagagauaauaacucauaugugagaaaacugugaauguuauuauuuaggagacuaaacuguccaaaacuaaagccuuuccuaaccccuuacuaccacccauguuucagaauuggguacaaguacauuagcccuggagaaaauaaagguguacuuaugaaaagaacgaaaagaaaacauuauuuagaaauagcuagauauauuuauguaaaaguauaaauuggacccuuuccuacaccauauacaaaaauccauucaaaagagaucaucagcgacauaaacaaaggaaccaacauuaguagcuggaugaggacacacaugccuacaguucacuacccagcugauguaagcccaguguugcagguuugagaccagcaguaugacucaguggguaaagauacguggugcacaauccaaacagcuccacaacacacauacaggugaaaagggagaaccagcuccacagaguuguccucugaccuuaauacguaccacagcacauguaccccacacacggaucaugaacauacacaguagugauaauuguaaacauuuuuaaaaaccaaaacuauaaugcccuuagacuaauugacuuuauuuaugcagauauagcacccaaagcacaagcaaaaagaaaaaagaccagauaagcagaacuuccgauauuaaaaacuuuuuuccguaucaaaaagcucuaucaagacaucuaagauagggagauggcucagugaugaaaacaauuugcuggacaaggaugaggaugggagucuggauccccagaacccauacaaaugccagguaguuaaguauuacagccaacuuaaaaccuaagccucaaaagcuggagauggggccucccaguucaagcuagcuugcaagacuagucauaucagcaagagcuggguuugauugagagacccugacuuagugaauaaggaagaaaagugauagauagaagaugauucccaacaucaaccuccaaccugcacaucuauaccccguacacauaggugaaaauggaacaggcaaaaaauugcauaaaagaacauacaaauuauaaaucacagaugugauaaggaccuacuaaccagaauaaagaacucuuuaaacugaaggacagaaagacaagcaacaugacugaaaaaugaacaaaugacuggaauaaauaccucucugaagaagauucauaaaugguucacaagccuaugaagauguuuauucucauugcacauaugaagugcacucaaaaccaaaugaguguaccacuuuucaccuacuaagauggcuuuuuuaauaggagaaagugaaaacucuuggcuauaaggacuagacacauacacaguauugaagaugguaauauaaacuguuguacuguagaaaacaauuuagcaguucucuaaaagacugaacacagagcagacacauaacccaaaaauucuucugcuagguauguaccuaaagaaagaaaguggguuugcaagcaaaaacuuagacacaauguucauugcacgauugauaauaguuagaaaguggcaacaacccaaaaucaucagggauaaauaaaucauguauggcaguaaaauaaauaugcauggaauugaagcgcuaagugaaaaaaagucauaaaugacuacauguuacaugagucuauguauaugaaauaucugaaguaggaaaaauccacagagacaggaaagcauaucagcauuaacuuucaggggcaaaaggguacagaaugagaccacacuaauuaaugaauauggauucuucuuuugaaguaauaaagcagugguucucagccauccuaguacugggacccuuuaguacaguucuucauguugugguggccccaaccaucacauuauuucacauuauacauauauccguaacugucauuuugcugcacuuaagaaucguaauguaaauguuuuuggagguagagaguugccaaaggggccaugaccuacgaguugagaacagcugugauaaagaauguucuagagcuucauauaaugagugugugacauuguuggauauacuaaaugccagugaugugugugcuuuagacugcuuaaaauggugacauuaugaauauucugucacaaauuuuagagugugaaucauuacggacuuuauuaggcgcaguauucaaauccacuuauauuuguuagcuaaaacugugugucagcagguccauguaccacaggagcauccucuugcucccugcauuauauuuugagacaaggucucaagcuggacuagaagccaccagcuggcagcuccuuggauuuuccuaucuccaucucucagcacuggacuuucaggugugugccaccacauucacacaucugaauuuagauccuuaugcuugcacagcaagcacuuuacacacugagcccucucuucuagccccgucuuccuugaauucuuuuuuuuuuuuuuauuuaaccuauggaacaaaguaaacuuaacauuuugcaaacuugacuauuuagugucaaguuugaguauuuagugacuuuuuuuagauauguuuuucuucaaaauuuuggucaaguacauuuuuaacacuuuuaguguuugaaaugacugccugcacuuguguuuaauacacugugaaauacacaucuuaguuugugucuucuugcugaaccaaaggaaacaugcugagauuaaaccgccucucuuguuagaacaaaagaagcucaagaguagccagaagauaaugcauaaccaugugcuuucuccuguuuccgcaggugacacggauuguacucuuauggguaaauaaucauuuuaaugauuuugaaggugauccugcuaugacucaauuucuagaagaauuugaaagaaauuuggaagauacaguaaggcucaaaagaauuuguuuuuauaauucagcauucucccuaccccucagcaagaacagcaacucagaacacguucugucuucucccgugucuguuguagcaugagaaugucucaccaaaauaaaauuuaaaaaauguuccuuuuaugcucauuauuguuuuggaacuugccucuuguuacaguguucacuuggacagguuaccaaagcuuuaugccuuagaucucuguagaaaaugguaaucgccaauuuggggagauugugaggacuacagugagguaaaagcugaaagcagacugccacagagaaagcacucaggaguguaguucccagagcaaguggguugagcacagaaggaacagaguggcagcucuggucccuuuuuacccucagcuccugcagacuuuccuguagcaugucugcucugugcggaauaggaagcaugggcagagauuggggaacuugacugauggaccauagaggcacacuaacaucuguagcucuuacagugccgaugcguggcuauuuaaaggacacuggaaagacguuggaaaucagguugagucauggauugcccccaucccuauucauugaaaucucccucucaaagauacuauguauaaguguagaauuugaucaugaucacugcccuggaaguaaaaacuauagcuuuuuauuagagccauagcauguucacaaacacauuacauuaccuguuugagaaucauugaauauuauuaaacuagggauagaacuucaaguuagaaaguuacugaguuuaaaaaagaguuacauauuuuuugaagagguagaaacuuggaugugucugaauauuagguaauaggaaguuuuuuuuaaauagaauuuuagaagauccuguuuuguauaacagccaggagguauacaagauaauacacuaaacucagaagauucggguaacuuuucauuaucaaaaagucuuuuaaaacccuguugaaauguuauugaaugcucuagggugggaguacucucucaucuugucuaccucacucacaaguucuguaguuuguagguuuggguucuaaugcuaaccauugaagaauauuuuaaagccuguaagaauagguacauacauguauacuuucgucuuuucugcuucauagaaaaugaauggucaccucagguuauugaauauugccugugcugcaaaggcuaaguggaggcaaguuguacugcagaaggcgucccgugaguccccgcugcacuucugccuuacugggggcagugagaagggauuuggagucuuuguugaagaaguagaaucugguagcaaagcugcugacgcaggacugaaaaggggugaucagguaaguaaauaaucccacacuuaaauaagaacauugauaaauaaucuguuacuuuugucucuuuuggggaggguaguuuugagaguaagagagugugucuguaucagagacaacuuagaguguuuuccuuaggagcugccuacuuuguuuuuccuugacagcuucaguggccuggaacuuaccgauuggcuaggguaucugcucagcaagcuccagggauccacaugucucuaccuucccagcaccaggaaaucagguccucacuuuuccaaccaagcuaucucuccaucccgaguuuuaauguguaaauaggguuuauuuucagaauauuuaucauauauucauugcuuuugaugggaaauuuuauagucauaugguugaaaccauguauucuacagggcucagucaguauaaccaccuuugaauggcccucccuauuuccuaaggauuaugaaauuuauccuuggcaaguuuagaacauuccagaaagauguucaugaauuagcacccuuacaagugugauggaauagaugcuucauagugcuuccaguguaagugacugaagauuaagugauaucaaauuaacuaauguccauauagucccacagcuucauuuauaagcagagugaacuagaugaaaaaacaggaaaaacugagauaugugaagaauugggugauagcucacugguuuguuugcauuuugguuguuguuguuguucuuuuucguuuuugguuucuagguagggucucacuauguccuugauaucaauauauaguagaccaggcugcccuuuaacacacagagcuccucugccuccguacugggcaugugccaguguaaugugccauuauaccugguuggcuuacucuuuuuagggauuaaguagcuauuguacaaccuaauuaauaauguaauauacugcaucuuauguauaaaguguaacacccaagcucacuucaguaauuuuaauuuuauuaauauaaacaagaaagucugagaaccuguucugauuuuuuuuuuuuugguuguuuuauuuucaaguacuggaaaucagaucacagcuuuccaaugugagacaaacacuuuacgacuaacuuacaucuuugucccaggaauccguauuuuuuuuaaaaacucuguagaugauuuucacguacaccagagucauuuucuugcugaucuucaguucauauacagaguggccagcauuuggcaaugucuaaaaauagacaugugcccucuuucauuuuguuucuguuaggacuuuguuguuguuugguuuaguuuguugauagugugcuaggugagcacuucccuguauuuucaaccccuaaaaauauuguuuggguaucaaaaccuagagacuguugcuggcgcauagugaauagaggccacuagacagccuacacugcccugaaugugggaaacuggugggugggguauggggaaaccgugguaggccaggcguaguaauguacaccuuuagucccagcacgugaaugcaaaagcagauggaccugaguucaggccagccagggcuaaucacacaguaagacugucugggugggcgugggggaauaguaauaauccuuugauuucuuuaagggaguuuuuuaaucugucccuuuccucagucuacucauuaaaaauaucuaacaaccaguauuggagaauuaguauauuuauuaugauuuuuaaaguauuuuaucauaaaacauuuaaagauaucauuucucacaguaggugggaagacaaugaaauccaaaauuuauauucccaacaugaaauauguccugguuuugcuucuuccauucuuucccaugaucaccucuagugugucuagaucauucagcucuauuauuucucauuuuacagacauaucuguauauauuugaagaugucauguuuaauguguuacaaagguccaugguaacagugauuuuacuccuaagaacauugaaguugcagaaaaacauccuauuauauuguugcccaguggaagucagaagcuggccuuuuuuccuacuguugacucauacacaucuuuauucuuuguccugagauucagcauuguugagaauuguuacaauggagauaucguuagugccagggcguuuugguauauagauauggguuauuuggguuugcuuuguuuuguuugcuacagagucucacaguguaacccuggcugaccuggaacucacucuuuagaccaggcuggccucaaacucagagaucuaccugucucuuccucucgaacacuggaauuaaagguguuaggcagugggccuaacgugccuuuuuagaauucugacuuuugcuucuauugaugugucuuuuccuaauauaugguuuguauucucuucuacuuugggaauuucugugucacuucugaagucuguccuuugcuguuuguuugcugaagaauuucugcucauuaagauuuuuaucuuuuucuuugcccuggggauuugcuucccccacccacccaccuguccauccauccauccauccauccaguaaacaauuugugugguaaugggguauaaccaaauuaaagaauccuucugugaagaagcaguuucucaccugaaggaaaaauaucacgguaguguugcuuuuggcuggcugcuugauuguuuuuauugaaaaaaagaaaaaaaauaggaaauauuuagaauccuaaucuguuuuucccccuuaagacagagccugacuauuuagcucuguacuuucaauccuccugccuuaguauugggauuauaggcaugcaguuauauucaauaugagcaugcugcuuuuaaauuaauugaauuaauacauugggaugcacuaaauaccacuuuagacuauuugauuauaaucugcauaaacauacauaaguagugucuuucgaacuagacaugauuaaauuuuuucuuuacuuauaaauuaucauauauguauuuguguguguucucauucacacacacaagucaugauguauguguggaugccugagaagucaauucucucuuuucaccguguggauccuggggaucaaauucaagcuugguggcaagcaccuuuaaccacucagccaucuccccagucccuguuuuauuuuuccccucccccucuuuuuuuagguuuauuuuauguguauguauaaguuuuugugugaaugccugugaauuguaugcuugcccggagccagcagagaucagaacaaaguguuggaguuauggaugagugugaggcaccgugggcguggaaacugaaccugcauuuucuguaagaacaguucuugcucuggacugcuaggccagauccuuuaggauccuaaagaaaauaaccuuuuaaaauacauauagugcaagauuuagaaauuaagcaguacagggggaaaugauaguccaguuucugaucauuauucacauauggugugauuuauucaaguucuaguucaguuuuucuacucugaagcucuuaagauuauaaaugcuacuaauaauuauuuuugucuuaauuuguauuucuaaaauauuuucaagguaauggaagucaauggacaaaacuuugagaauauuacacuugcuaaagcccuugaaauuuugagaaauaauacucaucuugcacuuacugugaagaccaacauuuuugguaaguuuuguuguaaaagcuacuggggguaagguuuuguuuuauuuuguguaauagaaaaauuaaaaggcauuucagugagguagaugauauaaaauauaaacuuuguugugaaacugcuaagauuauuaggauuuuauaaucuauaauuuuuauauuaucuaaauuccauggaaagaguaguaauccuaaggaaauggagauacagcuucaguccuguguaaaguaucucuugaguuccuguuguguacugugcaggacagaguacaauaauaaaaccuaaauaauaaaaccuuaauaaagcuuagacgucauaagcaggauuuuucuacuucugaccuacaaaccuagcuuucuacagugaaucaaaugucagauuaguuguuucaucaaauaaauugagugaaacauugaaauauauaaaugagauuucuaaacagcauguccuuccuuucuauguagaagcauuuauaguaacuacacuguguucuucaguucugugguaugaggggcugggccuagggcugcucaagugccuuauagcugaacuacaucuguaccauacauuguuuguuuuucgcauuguucuuguaauuuuuaagauucguugucauuuacuuuagacauuuuuaugauuuauuaucauuugcuuuagacucuauugaauuuuggcuaaaaucaugagaaugaaagucaaaaaucgagaauagcaacuuaaaaaccaaagaccacucgggaguuuuuacaagacagggaaagaaaaucccuuuagguugguuagauugcaaucaaaauaacaguagagucauaguaauaugccuuuuagauggaaauggagugcuugggguuuuagggcaaacugaaaugucugucuuggugcugaagagauggcucauugguuaaaagcacuugcuagucuuccagaggaccugaguucuguuuccaucacccacagcagauaauauccaucugcaacugcagguucaaggaaucugaugcccucuucugaacucuguagguucaugcacacacaugucagacgcucacaugugcacauaaguaaaaacuaaaucucauuuuuacugucauuuucacaugcuuucgucucaucuugcugaagacccuacaagaugggaaaaaaauaucugucaguucuucuaacagaauauaaagaucucaaaaagcuaguaugauggaggcaggagaauuaggacuccaaggcuagccugagauacguaagacccuaucuccaaaauauaagacaaguaagaaggaaggaaagacuuggaggcugaagcggaauuggaaggucaaggccugacugagauauacaaugaaaugcugucuuaaaaaaaaaaaugaaugaaaaaguaaucuuauauuuuuuuaaugagcaaauuaucuaaaaagaggaagcagacauggucaacaaguauuugagaaaguacucaauauuauuaaccuucagaaaacuguaaaccucgaccacagucaucuucugucuuaagugacuuuaaacaaagaaggaaagaauagagcagauguugaugauaaggcugugugggaaaggcacucuuacacauuuuuuuuuuuuuuuuuuuuuuuugguuuuuugagacaggguuuuucuguguagcccaggcuauccuggagcucacucuguagaccaggcuggccucgaacucagaaauucaccugccucugccucccaagugcugggauuaaaggcgugugccgccacugcccgacucucuuacacgcuugguggcugcguagcuuagcaugacugcgguggagaagacaaguuccucaugcagcuaaacagugcuugugcacgccuccuuagugcacagccccaagucaugacgucagaaaaucucagcaaugccugcguacggcuguccucacaaaugacuaaaaugaggagucagccugaggcccauuaauagguaaaagggugauauguaauauucaggaguauuaagccacaacagaagucgaauccugacaccuggccaaaguggauggaacuggaagacauuacgcuaaacuacucagucuggcacacaaagaccagugugggauguucucuccucuguggcagcaagagcagcguugaccagaaaucaggcuaaagauuacuagagacuaagaaagggaugggggagagugcaaacauggacaaauggugguuggggauauggugauaaugaauguuacaucagugcauagcauaauauccugaucuccauaaauauguacaggcauuuuuuuuuuuuuuuaucaaccccaguggagugacacaugcauguaaucccagcacuugggaggcugaggcaggaaaacugagaguucaacaagccaggcuguaaaacaaaauccugugucaaaacaaaagaaaaguaagagaggaaagagaagugaaggaaggaaaagaacaaagaaaagcagccccugggccaggcuauagcucagucacagcagagcuagcuguaugagacuaggcagucucauuguguaguacaugauuuucacacaugcuagcagccuaccuguuuccucucaguuuuuccccagugacaucaucuuaucacuuuggggaucgagcagaugauuuuaaaauguguauuagccugagaaagugacgauuguuauccuuaaaauguguugguauaaaacuuuuugacaagagccgggcaugguggcgcacgccuuuaaucccagcacucgggaggcagaggcaggcggauuucugaguuccaggacagccagggcuacacagagaaacccugucuaaaaaaaacacuuuuugaugaagagauggaaaaugaugaguuuguuuauuuccacaguguucaaagaauugcucaguaggacugaacaagagaaaucugguguuccucauauucccaaaauugcugaaaaaaaaaguaaucgccauucaauucaagaugucccaggggauauggagcaggcaccacaggagaaaggaaauaagaaaauuaaagcaaauaccguuucagguggaagaaacaaaaucaggaaaauuuuggauaaaacacgauuuaguaucuugccuccaaaacuauuuagguagguaauaccaauauaccauguggggauuuuaauguuuauuguaggaaagagagcugagucauauuuguuuuuauucaucauaaaaucuucaaacacaugaguaaaaucaaaauucuccacauuaucucuguagacuuagcacugucggguggcuucuaguguugugaaugcuagagaagauuguuucaugugauuuguuuuucuaucuuggguccaguuucaauuuacugaaucuguaaauuuggacaucuuaaaucuugggauacauucauugcuaguaauguuuuugguuuugaauauuuuuauugcugguauuauuuacuuucuccugaauucuaauagugaaguuuuugauauuuggguuuuuagagaucaucuuucuguauguuuugucaggaacuaaagagcuucugccauagccuucagacuucugggcauauauucaccaugcccaguuuauaccuauuuuuugcuucacacaugagauaucuccaaaggucuuuguaugcaaauggaagucuguaaaaugauuguugaaucauugugcugaagugucaugguuaagaauaacuccaauuucuaagccauuuacaaaauacuacgcaaguacaguacauaaagcaaaggugguauucaguacuuggugaaucaauuaagacagugaauucgucacuaacaaaaagauguauccaggaaaaacacauaugcagucuucuguuuucaucaguauuaaaaaaaaucacaagcuagaaaaauggcucaguagguagaguccuggccacucaggcaugcugaccuaaguucagaccccacacccacauuauaauaagcuagguacacgagcuaguaccuguaauuucagcugggggggggggcaaggaugagcggaucccugagacuuccuagccauccagucuuguagcauugguaagcucugcuuccagagauuuucugucaccugucugaaaaaaauaaaauguggacauuaaggaagagagcugaugccacccacuggcccccuacacacauggacacacacaagcacauguauguccccaucacacacaucuaucucagagauaaggaaauauucuuuacaaguucuuacuucuagcuggggagacaaauuuucucuucaauuaauuaauuaauuaacuugagacuuaaaugugauggcucuauucuaauuccgcucuagagcucauugcucauucauuucugagucacugcuuucauugaggugggaagguuauaaaaaccacaacuuuaaaagagccaaaauauuuacaguuguacauaucagcaaccucugacaccaguagaggcugggugaagagacuguuagagggauagccuacacuaaaagguugaggaguguuugaagucacuguggaaaaggagaagaaccuaggggccagaaagcagaaaauaguucacguggagcguuccuuagcagguaauuucuucagaucuguuuccagaaacccugauggcuugguguggaguauguacaucauugcaacuggugguauaguuaugucauguauuaucuaaaacuagagaauguuacaauuguggcucauuauagacccuuucugaucagcuaaaccaauggcauuaugcauauucuuuggagaguggaaauagguuacuaggcauggacacuagguucauagcaggaaacagaaauugcugucaccaggagcagccaguugaguauuucccauaugauaauuuugaauugguaccaaggaaaaaagaucuacuagaaauggguuuguuuaaauucaggauguauuuuuauugaauuuuuucuuuguugaguuuuuugcuuugugcuacaccucucuuguauguaugcaguagaauaugucaaucauuucagucacuaaaagccuaaaagauaagauuccuacagauuucugaggccaguuugugagaauuaguuuuucauuuuuaucuguuaaacuagcugcucaguauuuuugagaauguauuauuuugacaccauuuuaaaugaauuuggauaaguuuuucuugcaguucuuggggggucuuccccauguaaggcaaguaaucugccauugaaccagauuacuaguucuuggcuuuuuuuuuuuuuuuuuugaaacagggucuuccuaaguaguugcagcuggcauugaauucacuguguagccauagcugguuucaaacucuuuaaagggcugaacucuugcuucuacuucuucccaagagcuagaagcacagguaugcgucacccacagcaaguaaaugauuuuucuucuuucauuuuuuuuuucauuuugcaaagacugcaaauaggaaauggaauaagacuauaaacacccaaagucuucucccagugaugaacuuccucuagcaaggcuacacuguccaagcuucccuacauagcaccaccaacuuggaaacaaguguucaaauauuugaaucuauaggggacauacucauucaaaccacuacagagauucacccuuucagacaaacuccugagaauuauuuauaagggaaaaacaacacugugauaucaguagauaauaggcagagaacaugaguucggaugauacauauagauguuuauccaaggguacacacccuuucuauagaccucgucaugauggugaucuugaugaucaucaccaugaugguguccucaagcuccugugaccaaauaagugauccuccugcuucagccucacaagagcuagaaauacgccacaaguccaaguaugaguuuguuuagcuaaaugguauguuagacgugaaaguacaagaaggacaaauguucagaugucuguuuggguuuuguuuuugucuuuguuuuuguuuuuuauaaggcacaaguaaguuuuccccuuuuuucccguguuaucuuccaacuuuccuacuauaaaauauuucaauucuuuucauugaaauuaaaaauuaaguaauuuugccaggugguagugguacacacacacaccuuuaaucccagcauucacaaggcagaaacaggcagaucucugaguucgaggccagccuggucuagaguggguucuaggacagccaggacuagacagauaaacccacucucaagaaaccaaaauaaaauauuaauuuuaauucuguaauuuuugaguaucuccuaugugccaaaacuccuuagcugaagcauggaagacagaugguacuucucccacauacccucuuaagaacagggcagcuuuuacaguauuggugugagcgggaagaaaagaauguuuucuuuuuucuuaaugugucuacuuuagauuaaaguagacaauucuuaaaucucaaacaauuauguacuuuuuugugugggugguuuguuuuuuguuuuuuuuuuuccgagacaggguuucucuguguagcccuggcuguucuggaacucacucuguagaccaggcuggccucagaaauccgccugccucugccucugccucccaagugcugggauuaaaggugugcaccaccacugcccggccaauuauguacuuuuaaaguggaaaauaguccuuaaaauuaaaaugaaggcuggagagauggcucagagauuaagagcaccaauuguucuuccagagguccugaguuaauuccuagcaaccacacgguggcucacaaccaucuguaaugagaucugaugcccucuucugguaugcugguguacaugcagauagagcgcucauauacauacauaaaauaaauaaauauuuaaaauucuuuaaaaucaaaaugaaaaugaugaucuggauacaucuguaaauuaugacauaaaauuacgguuuucauuaaccugagacuauuucacaguucaagaaaucaaauuucccuuuuaaaaaaaaaaucacucagcuuuaauucuuucuuuacucacaguugcccagcuaacaucacuguaucuuccuagaaacaccaugcuuuguucugugcaucaagaacuauuuuucucuccaaauacgaguauuuuuuuguuugcuuuuaauguuggaauuauuuuguggccucuuugguuucauaaugaaacuaauacuuuuauuucaagcauauuaaauguuagggaacuaauuauugaggaauuuuucaaaaauaucuuguuucuguuacugcaucaccucucaggagacuguuuugguaagaaaugacaugauuauuuucaaauaggcuuaucaguucaacuuuaagcauggauuuuuuugcaaauuaauuacuucauuccugucauagcuugaauugugcaugacagaguuuucaugccuacaugcuuacacccuaauugccaugaauuuauagccuacuuaauaaugaguauagcuagauagcauuguguguguugauuauuaaaaagcagaaucaauguuaaguggcacguuaagugauagcaaauaauaagaacuuuuaauaauccguggacuuuaccucuauagugaauugcuuuuaacaaaauaaucugaccuagggcugggaacauaacuuaauagacagagugcuugcccaacaucugaaaggcuuuguccuugaucccaagcaccuuagaauaccaacacuuuggagguggcugcaagaggaucaggcaugcaaggucauucccgauauauggaauguugaagggcaaggcuauaugagacccugugcaaaaagcaauucuacuuuuaguuuauuuuguuaguugagaguagaucaugucuuuaaagauuugucuccuuggauuuagugaccugaccuuauggaucaaaaaauugguguguuuguuuccagaagucaacuagagaaagacguacuauucaaaaauagaucuuuacacuuuuugugauuuaaauacucagcagcaauucuuuucuccucuuaacuaaucuuaaaauguuuaauugugacagcagcaaccaacuuguagagagcuaguuuaggguaagcaagaauugcucaccaaacaaagccuuucuuuucauaagagaaaauugauguuucuccuugaagguaaauguuauuuguaucaguugcauuguugugccucuacuucucagugucaaguuaaaguaaaugacccucuucuguggguuugaauuguucguuugguaaaaggacuugacucccuucauaaagacaaaaguacuacuuuucaucuaguugagcucacacagucuuuguaguagcccuucagccaguggccagcuagagaaggaauccauccaagccaaccuuaucaguaguacgucugcagucgcaguaacuucuuuccaugccacaccuucaugccuuccugacugugcaggccucucuugucuggccguccuucugaucuuacuaauaacuguccauuauucuccaucuugcuucauuucauagucugccuauaucccauauuuugccuuaauauauucuaaauauauuccauaucacucaucuuuuagguuguaguuuaaucuuuuccauaauaauagguaagugcucggugaugccgcuauauaacaaaaacaaaacauaaggcugugcugaguaaaauuuagaugggaauagauacuaaggaaaacauuucaacacuggccaguuuagggaaagaacgcuuacuuggucaucggugaucuuaaaauucuauacaacaguuuuacuuuauaauuuaacuaauauuuggaaaacacacaaaguuuaacugaaaguguuuauauuuuuccuuacaguggcuuuagaguaaccugugugacaguucugaauauuuuaaaggaagaguaucuuguccuagauaaugggguuuuaguuaauaugugguuuugaaaccuuaaaagagaacuaacuguuacugacuuaaaauaucuugugauuaucaugugcuuggaggggacacuuccugugguguggccaugaauagcuucauaaauauauuugaaauuugagacuagcaaauuuuaagcagucccuaaacuuucaguuuuucuguacuaaaaucagaggaagcaaauuuguuauuugugauauaguagaauuacuuaauuucauuuuaauguaaauuucaaaaacauuucauugcugucucuuuauuauaagcaccauuuuuguuuacugagauguuuuaaucuaacugauguuuuaaucaucacacugaauugauuuuguuauuguugauuaagccuuuguacauaggaagucaaauuguuugcuaugucaguaccuucaaauacuugaaaguaauauaugccuuucuuuugaagugacggaggccugagucaaucacaagaugacagcauugugggaaccaggcacuguaggcacagccuggcuauaaugccaauucccggaacacuuucauccagcagcccagaucucuuacagccuaccacuagcauguuggacuuuuccaauccuucagguaauguucccauguaacucauacgacucaauaacuugagccuuguacaacaaauacuggguuaaacuauaguuuuuaccucuguuuuuuuacuucaugcaaagagcuagugggaaaauugucucaaaaaaaaaaaaaaaaaaaaaaccuaugcagaagugguuuccuucuucagaauugaaacuuaacaauaaaagagucucagugguauuuuucaaaaauugcugagagauggaaugaaaacagacugugaaaagaauuaaugcaaauugucuucauaccucuaaauauuaaaacgucuuaguaauuuucuuaggagcacugauuuuuuuuucccucagcaugugaugcuaaaguuguuuuuguuuauuuguuuguuuguuuuguugauucgggguuggucaagagcuguucccagaguauagcauuguuuucauugcuaaugauuuucaggauggaacaucaaguugcuuucuacauguauuggugcccagaggcauaaaaugucacauaacuguaugaucuaaaauuucauuauaaagaaaugauuauauacccaucacuugaaaagaugugaaauguuuuuucaagaaaagacaaaauuaaaccugaguaaguaauugaauccaagcuagagauggggaaaaggauuccucggaguguuugugauucaacugagguuucaguugugaugcgcagaggaagggagcucauucacauacaggucagugccaggaagcacauacaggguguuaguacagugugucucuuccuacagagacuuaaauacagacagacucuuaacacaguagaaaacaguuacugaagacugugcugugcacuauuucuugugguuuuuauaacaaccuaaaacuccaggcuuuaacaauacaagugaaaguaguuguauacauuguucucuucuguucccaacugaggccagagucaugacacucgcaaagcugaugcuugcugcuguacgucugucuuucuggaggacugccaaauguagagcaaacguuuuagggaaucauaacuuugcuuaaguucuagcaguugcuguauuagugaaguuuugucaucauacagaaaucacgaauaaaugcaaaacuaguugcuaguacauaagaugaaauauuugcuucagaaagagugagcacuaaagugucacagaggcaggagaacagcaggcuggguucauuucugugccagguugagguguuucagggaugaaucuucucucuagcuaccuguugaccuguugcuucgcuguuucuugaaaguggcaugugcuuugagacuccugaagauuuucuccuuauguacagugagcuuguuucuuacucuuccguguuacucucuagugcccagaucccucugcugaaagcaacacauuguccugucuuccuauguccguguuguagaaucaaaaucuguuccucuguguguauguggucuacagugguauauuucuuacacuccauagaauauucacaaucuuaaauaugcauguuuuuuacuaaggcgauuauuuagaaagggcacaugguuuuauggguuuauugauuuuuauggcuguauugauguccuaagcauuuauagauguuggggaugaagacccaaguuuaagaaagcacuugccaccaaaucugacagaguuugcucccuagaccccauguuuuaggagcaagcugacuccugugugccaucuucugaccuuccugugcaugcauacagacaaaaauaaugaguaaauaauuagaaagugaugcugaaggaauaaaagacuucagugaaagaagagagagaagugguaaaagaaagauaaagauaggguagcaaaaauaaaagauguuuaaaugguuaaaauuaaggcaguuguacuguggaacugagucagcccuuaggaacagguacuucucaaauugcucucauacuggcuucacaguucugucauugagaauaucucaagaggacucagagaugcauuuuuaaaucugcuuggagaaagucccaugcaggugagauuccacggugugcacgugguagugauaaagcuggacacaccuguuagagacacuuuauuuuuaagacccccagauguacagcuuugugaaagaugcaucaaacaugauaucaggcuguuuuggaaaaaguuauuaccaguuccaaauucagcuucuuacauuuaacaguaguacuagaauuugcuuugugcauaaacccuugauugcagugucauuagccagcauugacugguguuugucagucgagcucagcuauguugagucugcacguguaaaguucuuaccagaucaaaguugcaaugcaggcaaagcuauagaauuauugauacuuugauuugauugcugacuuuuuauaauuuugcuuuauuuucgcugccuacagcuguugguuuuuacuguaaguaucuugguauucuuuugucuuuuguguguaguuuguuauuuucaaaaagaauauaugauagugaacucaaugaaauaggaagcagaauuccacucaugagguaguacucuuguacuggugugaagccuuuuaguuauuuuucuugacuacauauguuuuuguuuucauacagagucagaauauacaugccacuuuacaacuuaugaaaaguuuuuugaaauuuuuuuucuuacucugugugugugugugugugugugugugugugugugaugguaaaugugucauggaaugcuugugaaaguauuuuuuuuaaucuagcauaaauugaagcuuaaagaauucagaguaugaaacuaggaauuuagcucgguuguuagagugcucacuuaacauauaaaagaccugaagcuuucguaggugucaugguggcacaggcuuguaaccccagcaguuauuugguuaucugaaguucaagaggaucauccuugacugcauggcaagugugaggccagccugggcuaaauucacugugacaaaaugacguuggauucugauccccuccacccugaguuuacauacucuuuuugcuugcuuuuucauuuaguagcauaacuccccucuccccuucuauguaucuaucugauguagcaaacuuaauucugcauucaaaaucuuuagugauuuuuuuaauuguagauaucauacacuuuuuaaaguaaaacuuuauagagagugguuaaauacaaaugucuccaucccuaggauuuugcaaugaauacuuuauuuagaucucacaaauuucauuaaugcaaaauguguguuccaauccccuugauccaaaugagauguuacacucucacucaccaucuuauuuaacaaaguaccuuaauauaucuggauguaauguucuaccaacauuauuuaaaaauaugguaaaauucguuuaacuaguccccaaccauagaaauuuguauuuugcuaagucuuuguauuuauagauucccacguuuuauauuuguauauuaucacauuuugaacuuggucuauacuaagugccuaaaaguaaguaaaaugcucacuauuuaccauugauagaauaggauaagugugacaauucuugaucucuucugcucuccgucaccuaggaggcauguuuguauauugcacaugccuggucacuucaugggccauccuacuucucuguuacugucuaucccugaaccacuucccacucucuggaauauuaguuaccuccucaggucagaggcugguccuucaccauguguuuucaucaccuggaacacuggguacaaaggugcuuccuaaauaucaguucagcaaagaaaaacuuaaagacaaaguaaacuuuauuucuuaaagaucuuucuaaaaacaugaaaaaauaucucauucuuaguguagucauggucaguacaucuuuaaagguuuugcuuugauacaggaucucucuaucccaggcuguccuggaacgugauauaaccaggccacccucagucagacccgccugccucugcuuuccacguccugggauuaaaggcgugcaccaccaggcccaacuccuuaaaguauuuuuuuuuuuacacauacugaaucagaguuagcacucuagaggcuggagcaaugcucagcagguacaagcacuggguacgucuuuagucaguuccacgagaugugguacugcucaaaugaccacaucucauauaugcagacagucaagcacacacacaagugaauaaauaaauaaaucuuuaagaguaaauuaagggcacauagggugccuuuaaucccaucagauagaagacagguggaucucugugaguuugaggccaccguggucuacaaaguaaguuccacgacagccagguauaucacauagagaaacccugucucacaaaacaaaagaguauagaaaaaugaucaggcauaguggcacgagccuuuaauuccagcacuuaaggcagaggcuggcggaucucugugaauuugaggacaggaagggauaaacagaaaccugcuuggaaagaaggaaaagaaggaaaggagggagggagggagagagaaauuaaaucugagggcugaugagauagcucagcaggcaaggcauacuacuaagccugcccaccugaauucuguuccugggauccacaugguagaagaucaacucccacauuuuguccucugacuuccacauaagugcuguggcaugaguaugccacucacacccacauaccagucacacaaaauaaauaaaugcaaauacacacacauacaaauauauacauauauaucauaaaucucugggcaaaugaauacuguguacuuccaagaccuuuuagaaacauguuuuucugggacuacaaugauagcuuagugggagaacucuugccugguguacauauauauguauuaaaagaauacauacauacauacauauguauuaaaagaauacauacauacauacauacgcaugcacacacgcaugcauacacacacacacacacauauauauauccaaaaauaaaccaaaccugcuuuuauuuuaauggaauuuuuguguaugcauguuuguuucauaacuagaauucuaggugauuauacaauucuuuccuuuugauucuuuugaaucugucaugagccaaauauuuuguuuggcccuguauauuauucuucaucuggcaguguguuuauaaauaauguacguauagugguucuaaaauagauucuaaaauacucuuacuggugccagugaagagaaauuguuuucuccugaccucaguguuuuccagguugguucucauugcauugcacguucaucuggguuucuguugugcugccuuuggaugaucccauuuacagaguucuucuagaagcaccucuuuuuuuuuuuuuuuuuaauacuugacuuuguguuaugugucuauggaacaauuugucuuuuaccugaggaacaaauggcuuuagaacguucagcuuuuuagccuguucaaaauacacaacucuguguuucuucccagguguuagaacagcaaagaaagagaguggaguugugcaaaucccuauccugucugugaaucuauccuucuaaagcugcuaauaaaggcauugauguuuugccauguucucaaggucagccagaaccacuugcugaggcuuagccuccaaaguucuaucagagagauccacuucuagagccuaagauccaguccaugaaaagugcagagacaauacaaguaacacaaguacuguuugguuccuuuuuaaagaguaaaagugcauggugaaauccguucacccacuuuucuucuccugacaaccaaacuucgaccugcuuacaguaauuucuaguucuaggcagagaagcaugccuaauuuggguggaguauaaaacuaccuuguaacucagggaauaauggugcuauuagcugcaacucagaaacucauucauuggcaagaaauaugagcaaguauugaugucucagaccuuuacauacaucaaagacagccagcuugguacaucuuccuagaacagagacuacugaguacaugaacuugacccaggguuauuuuauucuguagaauugcuugcugcugugccuguucauuauucucaucuucccuuuuuuccuaacagugcguauagugcuagaaagacaguacugaacaaaaguauauacuuauuugcugccaucaucacaagucacagccauaaauaucccuauuguaaauacagcuuauuuuccuauggaaauucagcauuuguuuauucugucgugucauuguucuuuuuuagcaucuuuccugaaguaagcauuguccuggagaugugagcucuucccuuagauaagacagaaggaggaagugcuuacauaugcaugucauauguacauaucuuagcuagaauguauuugcuauuagcaaaucacagaacaaagauugagguguuuaaucauauggacauuuaaauacuuuucucuuuaaaauaaaguuaauauaaaacugagaaaauaggcugcagaggagaugacauaguaggugaaggaaguauuuguuacacaagaguuuaauaccuagcauuuguauuuacaaaaaauuaguggcugcugcuacacugcacagcagucaccaucucaaggcuggagaaauagagaguagggguucucacuggcuacucaguuuaguggaaucaaggagcuccagguucauugaaagacuauaucucaaaagauagguggagaaccguugaagauaccuaacucugaccucuacaugcacacuuauacaaacucacauaaaaaacacaaauaaugccucccucaaaaaaaaaaagucuaggauugccacuuuauggaagaaugaguauaaugacucagaaggaacacagguaaugccaaaaaguauuggaagccagauaugguggcacacaccuuuaaaccugacacuuaggaggcagaggcaggugcaucucugagagucuaaggccagccuggucuacuuuguaagauccagaacugcuaguacuacagcggggaggaggagagggaggaagaggaggggagggaagggaaggaagaggagagaccguguauccaaaaacaaaacaaaacaaaaaaaaaccccaaaguauugaagucaagaaaaagauagccuuucaaaauaggcagcaagacaaaaauguaaaguaauaaacaauuuuaauacggaccugaccaaauuuccuuucucacauucuaggauuguaaagauuggaaacuauuuuaaagaccuggaaaauauacauaccuuuucaaaggcuuuuuaaagguugucacugaaaagcuugaaaagauaaauuaccuacugucgggaaguuuguaucaugcucuguaucaagauagaaaacaguaaucccauguugguuggcuccaguagcaucugcacucuugugcacauacccacaaacaauacauauggaguacucuuccuacuuguuaacauuaaauagcuugaggccuagagaaauggcuuaaugauuagaagccccauccagaggacccagcuucagucccagauccuacaugauggcucacagucaucucuaacucaagucccagugguccagcauccucuucuggcuucugcgagcuccuagcauucauguggaacacaagcauacaugcagucagaacaugguuuuuuuuauaauugauauaaauagcuuuauuaaggaauaauuacauaaauguuuguaauauguuaaacgaauaaugucuuuaaauuguauuaucacaguuuuuaucuuugugaauuucuauuaguauuuuucaucugaagaaaauggauacauuucugucauauccugugugaaauagaaguguauauuucaauguguagagggguccuuguacuccaaguugcuuuuggggguauuuaaauguuacuuuuugaaauacuaaggcucaacuuuguguuuauauagauauuccugaucaaguuauaagaguuuucaaagcagaucaacaaaguugcuacauuaucaucaguaaggauaccacagcuaaagaaguggucugccaagcuguacaggaauucgguuugacuggugcaucugacacauacucccucugugaagugucuguuacuccugaggguguuauaaagcagagaagacuuccggaccaguucuccaaauuagcugauagaauucaacucaauggaaggugagugagcaugcccugaauacgcagagugcuguuuguggauucccuguuaaaauggguguuuuaggaacaaacagcaugcuucuuugcuaguucuaagaauuaaaguaagauuucuccucucaaguuuuugucucuacaauuauguaaauagaaacuuggagggauccuuaaagacugccguaaagagaagaaagaaagcaguccuguguaaucuaugcccagcuguaaauagucaaggccugccucucagcuacuaaguaccauagguguucuguucuaaagagaacaaggguugauccuaccuaccacuugcugagaugcaacguuuauuuaauauaggagaaaucacuaaggacaacuucuguguacagguccacuuuuuuuugccucacuugaaaguuucagacaggaggaaaggaggaaguggguccaauagcaacuacugaauauggaugaaaacgagucuugauguaugugcuuuuucuugucagucagaaauuauauuuccugugaacaaacauuuaucuaauagcacccagaugucagguacuguauuaaguucucauugcugucacaaaacaccaggcagaaacaacuugauggaggaaggauugacuuuguuccugguccaucguggcagggagaguguagcagagcagaagcagauccucucauggcagucaggaagcagagagggaaugagauuaggggcuagcuauaacuuucagaagcgugaccccagugaccugccuucuccagcucauccuucuuuacaaggcaugcaccaccuuccaucugaacucaugugaaacaguucauauuggaacguucuccccagucgugcagucucaaaauguaaaacacaguccaucuucuaagaaucuuaaacaucuuaauccuuccaacuuguuucacacaguuuguuugcccaaacccagagucucuucuaagacucaggacaaacccuuagcuuguccuugaagaauaaaaaagaugaaaguauauagucccagcacucaggagauggaggcaggcagaucucugugaguuugaguccagccuggucuacaaagggaguuccaggacaccagagcuguuacacaaagaaacucugucuucaaaaacuaaaacacaaagauaaaaguggcacuagguaaauuuccauuccaagugggaauaaccaaucagaccacaauaagacaaaauucguugaggcaaacauuaaauccuguagauccaagccugugcccagggcacauggugucauucuguuggcuugagaagacccaccuuugaacugucuugaacuuguuuuggcuuuccuugccuugucuggcauuccacauugauggcaucuccauaguaucuucaucuucaccuuucacuuuacuuaccaaccugcccagacagaggcugacugcugcagucuugccccugccacacauugccugguuucucuagccuuucuuugaaaaaaucuugguagaaaccuccaugacuacaugccugcaaaaacacauagacagugccacagccggcugccaggcuaagcaauagcaagacccuucggacucgagcugcaguaguuuaugaguggcuagauaguugagcaugauaaaguuaacccugggaaacaauauauuuaguggcaggcacugugcuaauagggguccagguggcucgcccuuuuuucaaaaggaaguuuuuuacuuagacauuuuguauuuguuuuugaaguacugucaguugaaccuagauccucuuacaugguaaggcuuccaccacugggcuauauccaaucccuaucccaccugccacaccccaccccuguuuuaauugcuuauuuuugaaacaugaucucacuaaguuaucaaagcacaccuugauagaaucuuacugucucagacucccaaguaacuggaauaaggccugugccaguggacaugauggugcacaucuuuaaucccagcacuggggagacuaaaacugauagaucuuuauaaguuugagguuagccuggucuagagaccuuuggcacugaguccagacaaaauuucuuuuaaauucguuuacaaguuagcacacucagcugcuacaagaaagaucugaccauguccugauaagcccuucagacaguuccuggucauccugaugugcuugcuuccuuuaaaugagcaguucucaaccugcgggucacggcccuuucaaguggaaugauccuuucacuggggucacaugucagauauuuacauuaugauucauaacaguagaaaaauuacaguuagggaguagcaacaaaaaugguuucaugauuggagucaccacaacaugaagaacuguauuaaagaguugaaagauuaggaagguggagaaccgcugcuguaaauggcacugauccuuuuuuaaaagguuuauuuauuuauuuauguacaugagcacuuuauuugccucuacgccuguauggcagacagcaucagagagggcaucagaucccaugacagaugguucugagccaccaugugguugcuuaguauugaacuggagaccucucgaaaggacaggcaguacucuuaaccacugagccuauuugugcugaucuuuuuaaaagcaugcccuccuuaguuccagcuucagguuggcugauaaaacuaagcuaacguguuuauauucuuacucuuucucccaauuuucacuauaaaaguaaauaaagcaacuaguaauaguguugguccacagacuggacaccuuaucaggcuugaaauuuccucugccuaaauuauuuuuaaacuuggucuccagcagucuuagcauaaacaaaaugguaaacaaguucuuaggcagaauauaacauggugaccucuaauccaguuaccaacugucaucuaugauagugguauucuaggacuucuguguuccguauuuccaaggucuuacauuuuccucccaccaaccagucccaaaagcuuaguaacuauuugauaagguuagcuacagcaaugacccugcuuguccagcaccaguuuucuguguuaguuucccaucacugccccuaaggaccagacaagcaauuucagagaagaaucuaacauugccccguagagcuuuuauucucaggacaacacaugaugguucacacaugcaaguaguuucuuaaaaugacugacuucaagauaauuuucaucauuguuuuuauuuuuucugcaaugauagauguuagacagcagaagugggacuucucaggauguccuuuaaaguauuuucccauuccaucuauuagaugaaaccuacuaaugauaauuuccuucucauuuagguauuaccuaaaaaacaacauggaaacagaaacauuguguucugaugaagaugcucaggaacuacuuaaggaaagccagcucuccaugcugcagcucaguaccaucgaggucgccacccagcucuccaugagagacuuugauuuauuucguaacauugagccuacugaauacauugaugaucuuuuuaaauuagauuccaaaacaggaaauacucacuugaaacaauuugaggauauuguaaaccaagagacauucuggguugccucagagauuuuaagugagucaaaucagcugaaaagaaugaagauuauuaaacauuuuaucaaaauugcucuucauugccgagaaugcaagaauuucaauuccauguuugcaauaauaagguaaguuuguauagauaccuauaugaugacuuuuuucuauaaagauaccauugaguucuuuuguucuuguuuaacaaaaaggcaugacauaugguuacauacccagugagacuccauuagaaaaaacuauuuuuuuuuugucaguggguauuaauuacagauagcuucuugguuaagagugggagcuacuucccccucuuagugcugggaccuugucugguuugaacuuacacagacucugugaguuccucuguauaucagucuuguaucuugaaggugguguuuucuuggagucaucauccccucuggcuuuugcuaucuuuccaccuccucuuccaaauagauccaugagcccaaagacaucccauuuacaacugcauguuccaaagucuugucgcucugcauguugucuauuuguggguugcuauguuaguucccuuuggcugcaagaagucccucuaauaauagcuuaggaaaacacugaucugagucccagccuggaguggccccuggagauuccugauaauguuucuugggaucaguggcugauaaaagaaauagagguggcuagaacagaaggcuaagaggaaagcuuauuguuguuguuuguuguuuuugagacaggaccucauauacauacacacacacacacacacacacacacacauauauguguguguguguguguguguguguguguauauauauauaaauauauauauauauauauauauauauauauauauggacuggaacucacuauguagaccaggccucaaacucacaccugccucugccucccaggugcuagauuaaagacaugcagugacacacccaacuaggaaaacuaauguucaacuuuugaauaagcauuauauaucuacauggcagcccacaacuaucuguaacuucagaucuagggggucuaaugucuuuuucuggccucugcaggcaccaggcaugcaugugguacacauacauacauguagacaaacacaugcacauaaaucuuuaaaaaauaaaauaugcugcuaacaccccaaacaugucuuggucugcuucugcauucuauccuagugauuuaacuauaguugcuagagcuuuaaauugaguucucacagaacuagucaagcucuuuguucuuguccucguccuuucucuggcuguugcuggcauguuugauaugagccuuagagccaguuuauuuagguuuucuaaaaaaaaagucuucagaguauuuucauuuaaauuacauagaauauauagauuuauuuagcaauggcuccuuuacccccaaaacacugcuacacuucauuuucgccugugacauucauaguuuuauucauauaagucuugaacauuucuuugaauguucaguauaucuuacuacacauggcauccuuauauugucuuaauuacccuacaaucugauggaagguguguguguguguguguguguguguguguguguguguguguguguguguguguauuauauaaucaugguaaguuuuaucauauuguucuuuggucuugugguuugugaauuuuaauguauaaugucuguucuaugauggguucaucaaauguauccuccaaaggcaagcacucuuuauucuuuugcugcauauaguuguugcauucuuucugaauggggacuuuccuguacuagcuauuuacaaagguucauaugagagagaagcuagggcacaauuccugguuaacaggauuggccuugaaaauuauuuugccuuuggcuuuuuaagugaguggagaguggcagccuuagggcuguguacaacuuaguuucuccaugcuauccuccugaacagcuuccuucagaauuuaucuuuacaggcacugauuuaauauuacuaccccugacauucacguugaagaaaucaacccuuccugauggcagugcacagacuuucuugcucuuaucccagaccaggaauuguucuuugccuuguaacuuuagagcccuauuguucagccuuccuucauucuuuagcugcacgugucauuuuuuggucccucuacuuacugcuguuuauccuuggcuaauuuuuggcaaucauucuaguuugggacuuggcugaaguuacauuuucuguuuuauucuuacaguaguggggaggugauuucuuagaaacaagggugaauaaacauuuaauuccuaccuuaaaauuggaaguuggagaacauuuuacauguagugguauagguaaaaaucagaagcccgagaagcaggggacuaaacuguaggaauguuggaauguauuagguucacacuguuuauugauaggugaccuuuggcaugcagcaugaaaguaaaggaaugaggagaaacugcuggcugauggacauaaauauuguuuucaacuuagggaauaucugaacuuguuuaaaguccacugcagcagggauaguggguaucuggagacuuaggggacgagauuggagccuugagauacagaaacuugaaucaagagucuaccucagucagucauguaaacuguuucaggucaauguuguguaaguuaguugauaaugagcaacacuccaaugcuuacguucuuuuuaacucuuaugugauugguacaguuaucucuuacaugcagaguauagagcaauuguuauacuaccagagagccucuggaagagauucuucuuguuuuaagauuaaaagaguccuuuuuguuuauuuuuaauaguucucuuuuguuuuauuauauauagaucaugguugugucuuuauugaccuacccuuuccucugaaucuauucuuaauguuuuuauucucauuuugacaguggcuugaaccuggcaccgguagcacgacucagaggcacuugggaaaaguugccaagcaaauaugagaaacaucuucaagaucuacaagaccuuuuugauccaucuagaaauauggcaaaauacagaaauauucuuaguagucaaagcaugcagccuccaauuauuccacucuucccuguugucaagaaagauaugacauuucuccaugaagguauuugaagccauuugaaaauuagcauguuuagcuuuagcugcagcauuuaaucuauuauccacuucaauauaauuauuucaugucacuaaaucuucauacagcuaagugcagugaauuuaugacauccaaagcuauauuguugacaguagcaaauugaaauguucacaguaaaaguucagauauaaacuugacacuaagauaaaacuuugcugacaccucccuagcacuuaggcacauaccaaacauacccagccuuguauuugcuuuaagcuuaguaaugguuuuuccuuccaauuuuuuaaaauuuaauucucauauaaggaaaaguacccaaaacaaaugagcaacuaauaaaaucuaacaacauagucaguuuuuuggguuuuuuuguuuuuguuuuguuuuuuugguuuuucgaaacaggguuucucuguguagcccuggcuguccuggaacucacuuuguagacaggcuggccucgaacucagaaacccaccugccucugccucccgagugcuuggauuaauggcgugcaccaccacgccuggcaacauagucaguuuuaugggcaaaauuuaguauugccagcacccuaaaagcuugcuccugcucacugccaaccucccucuuccucucuuuaaggugacuuguauccugauuccuaaugccacaguugagucucaauuguucuugaccuuuagacaaacagauucacagaauguuugacuugauuuuugucuuauuuuggugaaaaaauauuaggauuagggagaaucuucacuguuguccaaaacugcuuagcuuagugauccaugucuuagugcuauacagugauucauucugaucuguggguuuuaaguaguucccauuguuguccugcugugaagaaugcuguuuauucucuguucauacucucuaggcagauguagucuuaaugacuauacaauauauucuuaguagacucuguggcucaacccuuaaaaaaaaugguguggugguaaguugguuucuagcccuggagguguucucacugcucauccuugccauuaucuguucaauucagcucuguuuuucacauuacaauaacuaugugcuuauaacuugauagauaguuuauagcuuauagcuuauaguuuguacuuugaugacuaugaaugggcuaaggcacccucugugcgcuaacccucuugacaguuaccaguuuggauuccuugcucauuuuauaguagauuuccuuuuuuguuuacaauuucuacaaacauucucuucuacauccuggguauagaguaacuugucuguuuuaaaguuauuuuugaugaguagaaauucuuaacuaaaaaguuuuuuuuuuaaucuuuuccuacuauaguucauuuacagucuauuugcauuaacuuuucugugauaauaguauuuuuccuacucuguucccuuaguaaccucauacuguuuucuauucuuuuuacuguuacaccagaugauauaagugucaguguguucacacauuaauguuguguuauugcaggccaugugaagaacuugaacuauucaaguuucauuuacucaucacgaaauuuuauuuaccuauugugcugucaauccuacauuguuuuacugucaguuacuaaaaucaguguuuaaucucacgugugucuauuugugcuugcugcucuuucuuucauccuacguuucuguguguccauguggcuaguguacuuugugguuuugagggcuuuguuuaguuguuuaggaguuugauuuuguuugguacaucagacaccguuauuaccuuaaagugauggagaucucaauuuuuguucaucugaaaguccaagacuucaauuucagaaauauaguuuggauuggcagcugcuuuccuucagcauuuugaaguagcaucuguuguuuucuggcucccauugucacaauugagacaugaacuguacacuuacuauucuuugcacugccucugcugauagcugcaguugggaccuuugccuucucaugguuuucuguucuacuagguuuuauaagguaugaggcuuguaauuuuguuucauuuguagcucugguuuacauuuaugggucauauuaaaauagauugauuuuccuucaguuuuggaauauucuguauaguuaguuuuuuauuugcccguuucuggcaucaguuuugggacuuugguuuuauuuugacuacugugccucuuuagucucacaucuuccugcagguuaucuuguugucuugcuguucuccaaguauugucauucgucuugacaaucuucucuucagcugugucuagucagugaaaccugucccugaauuccuacucuacuucaauguuucucaguuuuacuguuucuuuucuuucauauucucuguuaaaguagcaguauugauuuuguaucuuugaacauguuuaaaauggguauuucaaaguuucucuguagugacucugugaucugggucuucccugguucucucucugaaucaucuuuuacaucuugucauguucacauucauuuuuuucuugauauacauugauguuuuuauuuuuugguuuuuuguuuauuuguuuguuuagagaauagugaaaaaguuaccuccccccaaaaaauuggaaauuuaugacuaauauucuguucuuccaaaaaggauugaaccuugcucaguuaaggcaaucacaauacaugcauauacauaaguaaguauauaugaaugaguacacuguagcugucuucauauacgccagaagaggacauuagaucccauugcagaugguuuugagccaucaugugguugcugggaauugaauucaggaccucuggaaaagcaguuaguauucuuaaccccugaaccaucuugccagccccaaucccaaauguuuuuaauucauuuccaggguuuuaggcuuucuuccaaucuacauuugguucauuauuaucuucagaauaaagucagagucccaaagcaaaacauuaacguuuaauuggauuuaacucuauuuuauucuuguuaccucaaagcacugaagggcuuauuucagcucccugugcccugucugcccuugcuaacugucaucagcagggagagucuccuaguugccucagaauuucguuaucaucacauuacuuuaagaaaagauccucacagauuucucacguauucuuacaacauuguucucacuuagcaugguugguguuguuuuguuuccagcuggcauugaggccacgaaccauuccugugaccaguguacaaaugccacucacuuacuguggaaagggaugugaucuagacccagagagcucucaaacuggcuucagggcuuucccuguuagaaaaauuggguugcacuaacaguuacagacagguguaguuaaaugcuacuaucuauggucagacagacugacuuuugaacacugacauucuugccugaugauuuagacuagguaagccaauuaaucucuucaagaaaaggugacagccuucaacuuuguaaauuaaaaacuuacacacagguauuuucauaccaaugauuaaagucuuggugacaaauucagauucaaagagagaaaaagugaauaugaggccagaaaguauccccaugacacagcuaccuuaguuuuagcuaauuuuuaccauuugagaaagaauuccaguuuuacuuacucucccacuauuuacuccugugaguauaucugcuacuucuuuaauaguuuuuauuucuuuuuuuuuguuguuuuuuuuguuguuguuuuuuguuuuuguuuuuguuuuuuuuuuuuguuuuuuuuuuuuuuuccgagacaggguuucucuauauagcccuggcuguccuggaacucacuuuguagaccaggcuggccucgaacucagaaauccgccugccucuaccucccaaguaaugggaucaaaggugugcgccaccacacccaguuuuuauuucuuaaaaagaaaauaagaguuauaaaucaaaaaaauugcaggccaacuuaauuauuaguaaguaaaugggccccacagugccuuugucaccuggcuagccuaaguugucaggugcuguagcuuccuucaguagaacaaaccaugaacagaaggagauugugugcuguaacuugugcacaugccugugagauaaugaaccaguuucagcagccauagacaaucacuuucuguauucuguauucccaugagaaacacagcuguuagaaacucauucccuggggucagggcugaacagucuaugaauuuaucaagucuuaaaagggaguggggggacaguuugauuaacaaaaaaaaauaaaaacacuuaccuguacucaggaguaauaacugaacuugugcuacuuggagauaaaauuguaauuauggaaguuuaaaaauauauauauuucauaggaaaugacuccaaaguagauggcuuaguaaacuucgagaagcuaagaaugauugccaaggaaauccgucauauuauucgaaugacuucugccaacauggacccugccaugauguuccgacagagguaugacauggaaaucacauuaugguagcaucaggcuggugagguaaugaugucuguccuuuguuguguacacaucagccuccaguaaucuuucauuacaguaauccucacagguaagcaauagucaaccucccuuuacaucugaagaaauugaaccccaaguaguuuuguuuuauuuuuaauuuauauauguuugccugcauguaugucuguguaucacauauguacaaugcuugcagaguccagagaagguguuggccucucuggaacuagugucucagaugcuugugauuaaccauguaagugcugggaauugaacucggguccucugcaagcaaggucagugccuuugacugcugagccauaucuccaggcccuggagcaguuuuuauauaacuugcuaagauuugagcccuaguuuuuccaauuacuuuucugacuauaucaguaguucuguauggugguuagguaaaguaccaauaagcaaauaaaauaaaaauguugagcucccugaaaucaucugaaugcaaauugucucaucugcuuucuaaccuaaguaguaaagaauuauucugcgccucuuuuaaaguccuagcacaucuaacuaguacuucaguuuucuagaacauuucuuucccaaaaguuacaguuauauuguaacuguuugcuugcauuuaaacucuuucccagaaaguacauuuagccaugcuacaucuuuauuagaguuucauuuaucuuuuaauuuuaucggagaauucuuucuguacucacuuuauagcugaggcuggucuagaacucaugaucuugccucuacuuccaauugcugguauuacagguguacacugccacacccaaaacgagaaugcuuuuuuaauuugauacuuuguguacuauaaagacuacuacagaggcuggagagguggcucagcgguuaagagcacugacuguucuucugaagguccugaguucaaaucccagcaaccacaugguggcucacaaccaccuguaauuggaucuaaugccaucuucuggugugucugaagacagcuacagugcacuuacauauaacaauaaauaaaucuuuuuuuuuaaaagacuacuacagauuuauguauagaguuuauagaaaguguauuaagcuauuuccaguaauuuuuguagucuucagcauguaaguagacauuacaguugcuaacuuuuuuuuaucagauuuuccuuuuggaccucuccaaauagggcauuaauaaauaaaauaauuuuaaguauauauaauugcuaugauuuuaaaauacauauauucuaagaaaauaaaaauacuugauacuuuauaguguguguuggauuaaguuugucugggagagguauugcuugcgcgugcuucaccuacaucacuauggagcagucacugcuuuucuuaguagcugaucucauguucgcucuaguuuagagauucucagaguagugggaaaggagugccaagucucuucccaucucuugucuuucucuugguaauguaaugaaaugucacuucuccaaauuguggaaacaaaaaacaguaagaagcagggacugaagcacaccuggaggaggcuuguugucugucuuuguuuuuguugaauguccuaguacaguggacuuuccacugucucuugucuuaugugaaccuccauuuacucgugcaucuuuucauucgguaccugaagacauaauaaauuaggucccugccaaaucaucugauaguguacuaaggugccagcuguacuuccaaauuaauauaagagggccaagagaggauucacucaguaaagugaaagcucgaguccuugucaguccccagcaucauguaaacuagcuagcuaccagccaaugaaaauaauccugucucaaaaugggaggggcaggggagggcagauuuauaacaccuuaggaacaacaccagaggcuuaccucugccuuaaacacacaaaugugcacacauacccacauacaugcacacaaacacacaacuaaaaagaagcagccuggcuguuugcuugggaauaaccuggguugaguaagaagugaauggggaaauaaauauauuuauucuaguucaguuguguccaccagcaccuagauuauuagggucucauuguagacuggcuuggaauuccucccaggucauaucgcacaagugcauaacugcauaaguguacaccaccacacaccaccccugcuuuguuaccucuuuauuuuccaaguugaauuugcuagucaauuuuucuccuaaaauacuuccuuagagaaauuucuucacuuagaaauggauuuacauaucuguauguuccuuguaauuuuucagcauuuaaaggagugguuccaaaaguguguagagacucuguucuuaagaccagucccuacacuuccaaagacagaauagaaaguuugaauggaacacgucguguuccauaaacugcuuaguaacaccauccuuuaauaguaggcagugguggcucacaucuuugauuccagugcucgggagucagguggaucucucugcauuugaguucagccauguauacagaaugaguuccaggaccuccagggcuauauagagaaacccucucuuagaaaacaaacaaacaaaaacaaaaacaaaaaaaucaacuaauggcuagacggguguuaaaaaugcaguugaucuaaagcauguuuuaaaguacaugcuauagaggugucuggccuucaggacucaauguguccuucccaguccuucauuucauuaaagccauuuuuuacuguuaagauauaauuuuuuccugguaaauuuuucuguucuguucugucugcauaaauucucugacucucaacuguugucuuuuuuucugugcuuuccuauucaaauacaugcuucaauguuuguggcucuugcuuacaggaagaagagguggcggagucugggguaaguggggaaaugaacaacuggaaugaagguugugcaucucuuaacaugugcugcauccuuuucauuaaugcacgcaaaccagauagcaugccuucuauuaacuccgucagccuacauucugacaaaugccuuuugcuaacaaggugaaaguagugauggaacuagccuuguauugaucucaguuuuguuuguuuuguuuuuccauuauuggcauccuguagucccuuuuuagauuuaaauuuaacagauucaugagauguagacaauaauaacaaauauuuguugcauacuuccuguguccucuacacuguuguaagcucccaaaaugaauaaccuuuaaaagucuuuuacccuaugagcuggucuguuauccccaugguacagauggggaagguaaauugcccagucuugcagcuuauugaugguguauccaaaccuaggcagucugcuuuaaaagcugccuacacuuucucuaauuucagugccugucuuaugaaagagaacauauauguugauguauaaaaagucuguuuguaaggguugcauuuuuuauuaguuuuacagagagacguauuuacuuaaucuguauugucaaagugaauagagguuuuaaucccucaucagauccacugaaugccugaaacuugaagcuuaaauugaaauuuacuuuuaaguuucuaccaccuuugaauaaaaagauucccuuuucuccccuaaaacuucuuaacugcucagccuuugugguuuaaguagguucuggacucuuaguucugcauugguagccaucugguuuagagccacaggcaguuaaagaucguaugcaucauuuuccuagaccuuucuauuuuaaguaaggaaacaguugguacuauaggugcauggaauugcauacagagaccacauagaauuuugauguuuaaaacuaaugaaugugaaguuagauacuuaggcuacauauaagaauuuuuuuagccaugucuuucuuugagucuuauuuguggucuuguuuuucauuuggugaacuugacucuccuccucugguguguuucuuguguguuuucuucuacgucauaccuuugugucuuggucuucccugguucuucuuacugaaaguagaaauugaugcauuaccaccucaguagggcaucuuaugaccuagugacugagcuacagcagccacuguucaacugauagcauuuuuuccucuaguauuuggagcuugcaaacagcagguguucuuauuucacaucaguguuugaugcuuugcagugguucagaagauacuuuaucaucaucugucguucucaugcauuagaacuuuguaguuuuguuuacaagcuggcuuuuuuauauuggauaacaacuaagauaaaauaauuaaaugcuagcauuaaaauuuuguuuauaaauguuaagacuuuguuucacugugaguucaaucucuggaauccacauaaaaguuggagauaaaccaguuccauacagcaguccuuugaccuucacaaauccacuguagcaugcauacacaugcacacucacacauaauaauagucaccacauuauaagauguuuuaucuuguguaccaagaaaagccagugcaguaccuuguuuguuugagcuuauugaaaugcuucucacgugucuggaugcuggugggaucuugggacuuucucagcacggagaggagacuugggagggucauagcugauagaacaggcagcagaggcgauaaggaaucaucgaggggagggaagucaggcaauggucaagggaacuuagcaccccuaacugucuaacauuucuucuacuauaacuuacuagcaaccagcugcgucuugauuuaauuuuuuuuuuuuuuuuaaagauuuauuuauuuauuuauuauaaguacacuguagcuguccucagacacuccagaagagggagucagaucuuguuacagacgguugugagccaccaugugguugcugggauuugaacuccugaccuucggaagagcagucgggugcucuuacccacugagccaucucaccagcccgcgucuugauuuaugucagcuucacagaauaaagaccgacuaaugauuauccaaguggugcuuuucauuacauguccagagguacaaguucagucacaauuagaaaaggcaaacagaacagauuauucuuguuauuauuaaccauauaauuccagauuaaagaaaguaucugaacuggucuuuuuaugaauagcaaauaccuaaccuuuuacuguguguuuuaucaucuaugccauaaaguagaaaaaguuuguuuuagucaaccuaucuuauuuacugaauucuauuccuccagggguguacccuguaugauucccuuucuuuaaacuacguuugcagagugcucuaggccuauaauaaaaagagaccuauaaccuauucuucuggccagucaggauuuuucacuugugucuguuuacccugcaccaacuauacuguuugaguuugcucaagggcagcuaucccaggcagauuccuggaguaauggcuucauuaagcaaugugcuuucugugcuuaaccaacuccagagcguaagguggacuuacaaauaguggccagauagaguucauuuaggauuuugcuaaaaaagacucagacacaaccuuucucaggaaaagacguaaaaugaaccauaauucagaaaguccccaagaaugcagcacacagagaccacauuguaagauauuuacugaauuuuucagguuucauucuuuuuaaucaguuacuucuuaaagauuaaaggguaauucacuaauuacuagauuuuucuuccaacccauucugcaaaauuugcagucuuuucuguggguuacucgcagccacaucaucauuucugccugacucgaaacuacaaguugccaucaaugugucaagagaucauuccucaugucuuuaaucccagcacucgggaugcaggaacagguggaucucugaguucaaggacauccagggcuacacagagaaagccugucuuuaaaacaagacuauauaaaaugcaaggcauaacuguacuaguucucccccacccccaagaauuguagagguguugguuaguuuggguuuuuuguuuuuguuuguuuuuuuaauuucaguagccuccaaaaucguaggauuaugacauuuucaugcacguaucccugaccuuugccuccuuucucccccucuucugggagcccuacuucaaaauccuuaaaaauguaucaaaaaauaaauaaaauaccaauaacagguuuucaguuuugccuuauaugauuuacaaugaaaacauuaagauuuggugucuguuuuaaucuaggugugugagcauugaaggacaaguagcccauguuuuagaauauuuucuguaaauaugaugcuaauauuaaaaauagagauauucuucccuuuaaauuaaagaccauuugagccaugcaccuagagucaugagugguaccucgaguccacauaaaggcaggaggagagaagcaugccucagaccucacagucuugcuggggcauguucccaccucugcacacacaugguaauaaguaaacagacacacaauccucuguaagcauugaguuugcuggccuguuagaaaugaccugcaaaaaggaaaaaaaagacaugaccugcuacauaacaauugcugccuuccauugguucugaaugugcaucguauaaguaggcuugacagaaaagguagaggugaauaaagucauagcuuacuugacucguacuuacuucuaagacccaguuugaaguaaguccuaucauguucaggaguauuacauauuacauauauuacauauauuacauauaucauguucaggaguauuacaaagacagaaucucagcaaguucuagaaugcaaguaauuccauugugccugcagggaugguagcaauuuuuuacugcauuucugaucucucacuaugcuggguugaaauguuauuuucagauauuaucuugguucucuuuaauuuuuagucaaaauaugguuacuggaaaaauuggucuucauguuugaaaugacccugcugucacaaaaugaugcuuucauagcauacugcaagcagccccgguaacaaagcugcucuguuugccuuugcugaaggauugagaacaaauuuauccuaaccuagacucuugccacaucuuagauugugcauggccuaaaaggaccaaaggaaagguuuuguuagcacagugugccauggguuuguugcauaggcacacuaaaacuguaauggaauauguugcucagggaggaacugguaucuuacucuuuugaaauccauguuuugccagaucuuguucuuaauugagaacauugccaucugugccaaaguacuuugcauuaaugcucuucaucuuuuaacucauuuacaucagcaugcaauagcauuaacagaaaaaauauuugaaucuucauuccuugaugccuaagucucaucuuuacaggcucucauugcaguuucugucuucuuacaggucauugagucaaggcagcacaaauucuaacaugcuagauguccagggaggugcucacaaaaaaagagcacgccgcagcucacugcugaaugccaagaaacuguaugaagaugcccaaauggcaaggaaagugaaacaguaucuuucuagucuggacauagacacagaugaggagaaguuccagaugaugucacugcagugggaaccugcauaugguaccugugaguaguuuuccuaugugucacauuggugagcagagcaaaauagacauuuugauauccagaauuagugcugauuucauuugcaaauacgacuacuguacuccagcagacuggucugcucaugagauacugagucccaugcagcccuugaauaacucugaagaagggagagagguaaauaguuguucuuuaaaggcuuuauaaaugagauuuuuuaaauuggagcauugccaggcagugguggugcacuuggcagacagaucucugagaucaaggccaaccuggucuacaaagugaguuccaggacagccagggcuauacagagaaaacuuccuuccuuccuuccuuccuuccuuccuuccuuccuuccuuccuuccuuccuuccuuucuuucuuuucuuucuuucuuucuuucuucucuuucuuucucucucucuuucuuucucccuuucuuucuuuuuauaagaacauuaaugaaauuuuuaaaugaggaguagauaauacacaguaagucagucacuggagagcuaguucaggugugaagagcgcuugcugcccucacagaaccugaggucaguuuccaacacguauauggugucucacaacugucucuaaucccaauuccaaaggauccagugcccucuucuagacuccauggguacuacaaauacauggugcacaaacauacaugcagaaaaaacacacauucacaacauaggaaaaaauuuuuuuauuggaacauuauagaaaauacuguuucagaacguuauugcccuuaccuauaaaugcaaagugacaucaauacuaggcuaaaauuacuaauuauaaagcuuggggguuugguuaaaacacuagcagugauaacuuaccaguaggauacaagagaaaguagacauauccugacauuguggaagggauuuucuccucacuacugacaccuuagaguccacccugcccacuacagcucugcucaguaaguaacugucuccccaaggaacacacccugaccagugcugccuucuucaagugcaggcuucagaacacauaucucuggguuaagaaaauugugaguuaagggcuggagagauaacucagugguuaagagcacugacugcucuuccagagguccugaguucaauuccuagcaaccacaugguggcucacaaccaucuguaaugggaucugaugccauggucuacagagugaguuucaggacagccaggguaauucagagaaacucugucucgaaaaaagaaggaaggaaggaaggaaggaaggaaggaaggaaggaaggaaggagggaaggagggaaggagggagggaaggaaggaaggaaggaaggaaggagggagggagggaaggaaggggaaggaagggagggaaaggaggaaggaaggaaagagagagagagagaaagaaagaaagaaagaagaaagaaagagaaaauuguauuaaaugguaaauuaaaugauaagaagcacaauggaauugcaaguuuucuguugacagaagggaaugguauacuuuguguaguaaccuaaaacuugauaaauguguugauauuuccguaguaauaugaugguuugccagcugaguagaacagagaaacaacuacugguuucacagugaguuuaaaauacuggguaaagagagucauucaaugcaucauauauuagcaagagucaggcauagugguauguuaaucccaccagacaaaaauacgagcacuaucaaaauuucugagccaaauuugaagcaaguuucauuaaguucugaccagaucaauggacacuggcccacacccuggauuuucagacaauggcuucaaauuauguuagugagguucuuauaaaggcaaaacccacagugugugcuuuugggacaagcauacauccuaauguacguugugccaaggcaccuccuaccucucuguggugaaacauuuugugugcaguuuguggaaacaaccuuguuuacagaagugagaaugcaugguuuguuagcuuacaugaacagcguucaguauuuuaggaaguuaucuguccuuggacaagugggguuuauagguuagaggcaguuuugcuuuauagaucucuuaagcauaguaauuaauauuuaaaacaacguuagcccucacagguguucuugagugauaaacaguauuugagagacugagacaggauaguauauuuucauggccagucugggcuauauaauuaagaccuguuugaaacaugagugaggauuaagcuaguaucaaaaaaaaaaaaaaaaaaaaguacauuagauacuucuacuaaagaaaauuaauggggcauguuugcagugacaccagacagcaaagacugacuugauagacaccucaagccucuagcauggaagaguggaggcaggcugauagucauggcuucacgggccuugcuagagccuuucucuucagaguauggggaguugugaggucuaugggacauacagagaaggaaggggguagguuacauuuccauguuagugcucacucuacugucaucuagagaaugacuggcggcacaccugaguugauccagugagagaauuucagucauauagaugugagagugugaacuuggccucaggagacagauaaugauaauggauucaagaauuuaagaagcaaacagcuuauuccacagcaguuucagaguuuaaauuucuuuuaugaaaauaggucuuugauuuuuuuuuuuuuuguauaaaaauguguaguuuuuaagcaacuacuugucauugcaaauagucuugccuuaaaauuuuucaguugccugacuauucucucuuuccuuguagugacaaagaacuuaacugaaaaaaggucagccaaaucaucugagaugucuccuguaccauugaggucaguuggccaaacagcuaaaguccacuugcaucagccacacagagugagccaggugcuucaggugccagcaguuaacuugcaccccauccggaagaaaggacaagccaaagaccaugugcugagugagugcucauaacccucaagucacuuuacucugaauuuccaaagguaauuagcuaagugcuagcaagaguaggaucacggcaucaugagucaaaaagguuugguuuuugcuucaacauauuugaugacagcauguuuuuaaauacuaguggugggauuucuauacuacuaaaaucuguucaucaacagaaucuuacacagccgugcacugaaucaaaucuacaucaagucuuagguagcacaucaagcuuacguccauucugcauucaaagcuguaucucaaauacaggccuccagaagcugugagaaucaaacgguuuauugugaaaaacacauauacacugccuuuuucauuaacgcccccuccagaaaaccucauuaggauaaaagaacauguaagauacacaagaauacagaacuacagcaauggcucagugguuaagagcacugacugcucuuccagagugccuggguuugauugccugcauccacauguuagcucacaaccaucuguaacucuaguuccagaggauccuacauccucuccuggccucuaugaccacugcacacacgugguauauaggcacacacgcagucaaaacacacauaaacacacacacacauacauuuuauucacuuuacaucuaaaucucagccuuccaucucuccucuccucucaguaccacccuuaaaaauucaucccccugccccauuacccucuucucagagaaggggaagcccccccucccuccuuuggguaucacccaauccugggacauccagucgccaugggcguaagcacguccucucccauuaaggaccaaccaggcaguccaguuaggggaaggagaucuaguggccggcaacugagucagagacaaccgccacuccaguuguuagggacaccacaugaaaaccaagcugcacaucuacaaauguguagggggccuggguccagccccuccguauucuuugguugguguuuuagucuuugugagcccccaugggcccaggcuaguugacucugaagguuuccuugugauguccuugaccccuccaacucccucaauccuaucccccucucuuccacaagacucccaucaagcucugccugauguuuggcugugggucucagcaucuguuuccauccccuguuugaugaagccucucaggagacaguuauaguagguuucugcaagcauagcagaguaucauuaauagugucggguuggcucccauggguuucacguuaugccaauuguugguuggcuguucccucaaucucugcucagucuuuauccaugcacaucuuauagguaggacaaauucaagguugaagguuuuguggguagauugaugucccucucccuucucuggaagucccaccugacuacaggagauggccacuucagucucuauauccccugcugauagaagucucagcuagggucagucccauagacucccuggaaauuuuuuaauuagaaauaauuaaauagaaggguagagauauugcucagugauuaaggaauacugcuuucaugagagcccaaguuagauucccagcacccacaucagguggcucacaacugccugcaacuugaguuccagauaauuaacugucuuuggccuccuugggcaucuuauucucuugcagacacauaauaaaauaagucuuugugguugguuuuugggguuuuuguuuuguuuaaguaacaaggcuagagagauggcacagcacuuaauagcacuuguugcucuugcagggggaucuaaguuugguucccagcacccguauaauaacucacaaccaucugugacuccaguuccaggggaucaaaugccucucugaccucugugggcaucaggcauacauguggcacacauacaugcaggcaaaacauuuauacacauaaaauaauaaaucuaaaaaaguuuuuaaacauaaaauaacauaaauauaaucuauagcucuguuuucccccuugagccauauagacaucauuggaauuaccuuuauuugguguuuuaacaguaucucuauuuccguuuuuauaugugaagcuagauuaccuucguuugcugguauuauuaacaugguccauguauuaauacauaguauaugcuuaguagaaguaugugauuuuaauuugauuugaugugaaaauacagaauugaauuuuaaaaaaugaccaggguuucaaucuagugucauuauagacacagauuacuucuuuauuaugugugugcuaacacaguacauuaaaagaaaaaaacaagagaagccuuuaacaaagucggggguaauguguaaggagcuacagauacuuugguucacuacaaacugcaugcauguuaagagacaguaacugaaagucaggguuuuggguuuugacuugguaguuaagugcuugacuaguguacucaaagcucacccgacucccagcagcaugcauacacacccaugcauuugaagcucacauuuaauacugaguuucagacacaguccaucuuuguuaacuuuauauauuuacuuggucuucauaauauccuaugaggugagaugauagaaugagacagccucauucuacauggauucuuaguaaugugcacagugccaggacauaaccagucuggcaggugauccuaagcugguuggcucuaaaguacugcuuuuuaacuaccagacuaaacagccucccaaggauaugagaaguauagucauaaauauguccagauuauaaaggugacaaccaaaauuugucacugggaaaccacuaaaaagauuugaaaucuuacaugcuguacaccccucuaauucuagcacuugggagacugaaacagggggauugcacguucaguguuaauccaggcuacaaguuugagaccagcuugaauuacauaucuguuaagagagugacagaaggagacaaggaaagagagauggaaggagaaagaggagggggagaaggugggcgguggagccauacuugaacaugaggugguugugggaacgagucgagcaaauccagaugcaggagagcccagcuggugugagucuuuucagaagacugcugugaguguaccagcucgucaccacgguuguccuugcuccggguagagaguaaucuggagcucagugacuuccuagaagcuauguagugagugagugacuuccuagaagcuauguagugagugagugacuuccuagaagcuauguagugagugagugacuuccuagaagcuauguagugagugagugacuuccuagaagcuauguagugagugagugacuuccuagaagcuauguagugagugagugacuuccuagaagcuauguagugagugagugacuuccuagaagcuauguagugagugagugacuuccuagaagcuauguagugagugagugacuuccuagaagcuauguagugagugagugacuuccuagaagcuauguagugagugagugacuuccuaggagcuauguagugagugagugacuuccuagaagcuauguagugagugagugacuuccuagaagcuauguagugagugagugacuuccuagaagcuauguagugagugagugacuuccuagaagcuauguagugagugagugacuuccuagaagcuauguagugagugagugacuuccuagaagcuauguagugagugagugacuuccuagaagcuauguagugagugagugacuuccuagaagcuauguagugagugaguggcuuccuagaagcuauguagugagugagugacuuccuagaagcuauguagugagugagugacuuccuagaagcuauguagugagugaguggcuuccuaggagcuauguagugagugagugacuuccuagaagcuauguagugagugaguggcuuccuagaagcuauguagugagugagugacuuccuagaagcuauguagugagugagugacuuccuaggagcuauguagugagugagugggcugggacuguuucugaaucucaccuaugcucagagcuaguuagugaaggauagaacuucccaagaaugguuuuaggagugccauauaauuuuccugucuguugcuuacuuuuguucuguaauaggaacuuagugcucuugaaaagggcuggccuggcagccucaugugcacccacagcagagaugcaacucagguggugacaguaccugcaccccacauaauugugaggguuaagauaccauaccacaaagcaaauugccuuauuaaucugggcugugcuggccaucugugagguugaacaaguuacauagagaugaggccuguaugauauuucccagacacuuaagucccaaacugcacuuaaaugucuugauugacuauaccagccacugucuuuacuuaaugauuuagacaacuacgucuguuuucauuguaaaauguuucugauuugcuuauuuguuuguuuauucauuuuuuagguacaaguuuaccucagaaagguuuaggaccaacugaggaagugaguguuaagaaacacacagaagacacuauuucuguagcguccucucugcacucuagcccuccugcaucuccucagaacuccccacgcaaagguaagaaggaauguuucccauuaacucuucucagaccugauaacacuucagcacagcuugcuuucagucuguaagccugaaagaugaaaaugcuaaggccuaguuuuucagguguuacuaaguaacuaggacuccaguacucaagucaugauccuuggcuguuugaaagagggcaagcauggguagaaaugagagcguaaaucacaguuguuuugcucugugccagugcucaguaccauccuuccaguuucauauaagugagcaucucuguggaaaauuugcaaauaaaauucuauaagaaauuguauuuacacugggugugauggugcacaccagcacuuaggaagaggaguccagggggucaggguuguuauugacugcauaaaaaguucaaggccugaaacccagcucccaaaaaagcauuuuguuuugauuuuguucaaguacaaaguauaggaaaagaaauaaaugcuagcugcccauggagacauaacccuuuaaucccugcacucaggcagcagaguuggguagagcucugugaguuccaagacagccagggcuacacagagaaacccugucuuaaaaaacaaaaagaaagaaaaaaaaauauuuagcuuucuccuucugguuucuucuguuuuucuuguuuauggggauuuaaaauaaucuaugucuuggggcauuuacauuuauacaaaaccagaaaagaaaagauauaacuccugguucuuuaaauguguuuucaugagucagacugaagauuuucauggcuaaagugacuuauugaggugccacaugacacugagcacaugucaggcaugcugaagagcaugcgucucuuacucugccuuccacacucugcacuuguaauggagaagggccauccuaauccugccuucugcaugaguguaaaaagaaaaacacuuuauaaagcacaguagaggaccuugccuggccaggggggagauuaaguuuggcaguccugccugucacucauucccuucccaagagcuaagugucacucuucagggcugugccagcugcagcacagucauauuaacacuggaggcugacacucuguccuuuguccccauucgugacuuguucauaagguccagacaaacccuuugucuuagggucuguguauacaguuuaacagaaauguuauuucuaugugugguaagugauuaguacauucagauaucccuuuccugcugagauuuuaauaaggaaugguucaugaaaaucaaauaggacauagaaggaauauguauaguagguauauucuuaaaauaguuucugauucugcugcaucucauacuuuguaagacacacuauaugucuuuguaugucuucucuuugucuauaugagcugauuauccagaauaccuucgucagaucucuagaagcagcaaccaagccuguagugaggcaggucgucaaaccugcagggccugaguuuggaagcugugcacagacaguuguguaaggaagaagcugcuagaucugauuauaguuuguguuuacugugucuugggaagaaauauaauggauaaaaauaucccaagaaaaauucacucucuuuuuuucuuuucuggaaccugcuguguuggccaggcugggauugagauccaucuuccucugccucccaagugcugggauuaaaaguguacaaugaccacaccagucuaaaaagcuauucuuacacugguguaaauucccuuuacucuguugucuuucaguauguggcugacuguugaccaugauguuuauaaagagggcaucagauuucauuauggaugguuguaagccaccauaugguugcugggauuugaacucaggaccuuuggaagagcauuuggcgcucuuaaccacugagccaucucaccagcccccagaaauuauucuuaaauauuucaagaccccaucaagacaaccaggcagagugagugauacauaccugcaaugccagcacucagccagcugaggcaggaggaccuggcauacauucuaggacauccuuagaacugcauaagacccuuccaaaaagaaaagaaaaacccaacagcaccucuauuuccauaaacagcugcaugccaguggccugugggugaacaaaauuuuuguaguacaaguccauuauucaucuguucucaauuccuauuaaacuuuggaauugcugggcgugguggcgcacgccuuuaauuccagcacuugggaggcagaggcaggcagauuucugaguucgaggccagccuggucuacagagugaguuccaggacagccagggcuacacagagaaacccugucucggaaaaacaaaacaacaacaacaacaaaauuuuuuugaaaauaguguuuuucucaucaccaauaagguaaaccuauuucauauuuucauaagaagaauuuaaacaagaacuuagaagccaagagauggggagccggcucaguuaauaaugcagcuacuaugcaaguacaaauaccuagguuccccccuagcacuauguaaaaucucaggcaugguagcacagucauaauucugggacuggggaggagagagacagaucacuugggccagucagugagcugcuccuuagggagagcaccacuuagcuugucuucuggccuccaguggggcaccugcacacacacacacagacacacacacggagagcaccacuuagcuugucuucuggccuccaguggggcaccugcacacacacacacagacacacacacggagcgcaccacuuagcuugucuucuggccuccaguggggcaccugcacacacacacacagacacacacacggagagcaccacuuagcuugucuucuuuuauuuuuauuagauauuuucuucauuuacauuucaaauacuauccccuuuccuaguuuccucuccaaacguccccuauacccuuccccacccccugcucccuaacccacccacuccugcuuccuggcccugucuucuaaccucuacuggggucacgcucgcacacuagaaugaguggugcaggguaagccaaacaagcugaacaucccuuugucuuggagccccacaugcaccagugcuuuauaaagguguccuuagauccuguguguguccuauuugguuuuuacugagcuuuguuuacuuaaaaucuccugaaaguucuaaagcauuauuccuucuaagggaugguucagaucaccagauguuguuguaauauuugucuuuauaaucuuuaccaguaucgauugcuuuccacauuuuuugucagcauguucugagcaagguaaugucuauccucuugucuuguaguaacagagguguuuauuauguacaauagcuauagcuccauaguuucuuaauuuauuuuuuaaaaaaaacuguuacuauaguucaguucuuuagauauugucaagaugauaaaauuuuaaaauagugaaauguuauguaagccaagcuaauugugacuaguugaaaagaauuaauugaccaugucaggguuuuugcaucucucccuccaguuggcaguauccuaucugaucacagcauccuguugcgucucucagggucuuccucauccccuccccgugagcccagcaccaagaucaguggccagagcugccccggaauaggugggguuuacuugcaaaagaaaauccuucagauuacugggagcacagccaaaagaacagacaggaccaagaaggccacugaggagaauagagacaggacaaggugugaggacacuaccaggagaaggaugacauccccguuuagaagauuuagggagagaacgcuuucaagggagagacuagucaacaaccaaaaagaggaugcacaucacaaucaagcuacagacagcugugagaaagugaaggauguuggaagcaacaucacagaugagagagggaaugccaucuacgacucgaguagccaaggccacaguaccgcgcucagcugcuucuguacgcgguucaagacuaaaaggagaaagacucucugaaaaguuucuuaucuaacauuaguguuaaacuuguuuuaaguuauucauguaaauguagcucgaacucagccaucugucagacauugggcagacgauguaguaaguacuauuaagcauuuuaugcguacuguagauccucuaagaaauacugauuuacugugccucacuuguacauauguucucugaccgcuguguugaguuaguaaauuuuauccauuguuuucuguacuuugcuguauuuucuucugauagcagcugagacugagugaaaugaucaggaaagcuucuuaagaagcuguuugccaucuuacuaccccagcagguucagcaucaucuggaaacuuuuaaguaaaauuaccaugucccacccagaucucauaaauaugaaugggugccagauguguguguguguaauuuaauaaauguuccaggcaacucuuaguaucaguucccuuugagaaauucugguguaacaaacauaaggaucaagucuauucaguacagugaaaacgcaguggcucuuuuuggaaguaggugguuaacugguuugauuuuucauuugacacauuuauugucuugguuuucuuaaaaacugaauaaucauuucauggcacugauaucacuaacagugagcucaaacacaaggccaugugguaaaagucagaaacacuggcuugucugucuuacugaguuguuggcccauaagcccaaggguaaaucacacauuucuggaucuugauuuuucuguaaaaugauugguggcaucucucaaaaaugaugcuucacagccauuuuuucuucagugaauuuagucacacaugccaaaauccugaaggccuaaggagacaguagcacuuagcucgcugucuuauucguuguguuacuaaggaucaggaacauccaggggccuccauuucuucuuuagugguguuuugagaauagauccaaaagucaugugaccugucaccccucacucugcccugugaaccggaaggcauuggugcuucuuaaggacccaccuucuguggagcugcugcagcauuuucucuuacuucugaaacccaaguaugaugucuugcugcagaccgcuuuguccauuuagccaucauccuguagaugugguuuuggauccuucuccuuacuccaucccuacccuuuuaucccuccaaaacagacaggucucuguaggcaugcagugugcucagcuacuuaauucuuaacaaaauuaaucauguccaaaucuaaaacaguuuguuuaaagaaacugaaacagggcuaggaagaccuuuaaauguggguaccugaaucccuauucccugcaucuaaguaaagauccauugugcauuauacaacccuagcaugggucagugagcuagagaugagaggauaccugggcccucuggcuagccagcugaugaguuacagauucagugucuuaaaagaaaaauaagguagagaacaaucaaggaaaacaucuuacaucagccucggacuuacacacauacccacacgaacauagacauauaccaguaauuugcaugcacacaaaaucaccuggagcucucacugguagagccuuugcccaaccugugcaagaauaccugaauuguauucuuagaaucaccacaaauaauugauugaaauaguggucuuauguuugggaaaagacuaucugagguaagugaaugcacuuugaagauuuccaaguacaguucuuugagccugcguguugcuuccuuagggugggccaugaaauauuucaugucaaagaaggggauauagaguuaaaaugaaugagguugaaaacugaaguauguguacuuguuaauguuuauaacauauuuauuguucuuguuuuacugaaaauuugagaaaguaugugauucugggacaguaauacuagauuuugacguuuuucugcaauguggaguucuguggaugugguuguagguggugggugaauuggcuauauggggaaaggaauggagaaauugccauccuuacagccucaggcaugcauccuggcauucccuccuacuuuggguuuguuuguuuguuguuuguuuuccuucauuuuuuuucuuggucucacacggcugccccuguuuguccccuuuuuugaaguuugauggguguucucuucucauucagguuauacacucacaccaucaaguaaaugugacaacuugucugacuccagccacagugaaaucuccucucgguccagcauugugagcaaugguucuguugacuccaugucugcagcugggcaggaugaacgcuguuccucccacagucuggcaguuccugagcccacaggggcauuggaaaagacagaucacccuuccgggaucucagaccacagucagcuugcucacggguaaacauccaugucugugcucuugccuccaaaacagaaccaguaugcagcauugagagccugccuugcacccucccccaguagcuuaggucuauggcauacuguguaagagugugaggcuacauguaugcccuuuguacauacugaguguggaaauucaugcuacuugagagauacacagguuuccuuuuuuauuguuuugguuugguuuuuguuucuuuagacagaguuucucuguguacccuggcuguccucaaacuuacagagauccgaucaccugcuucugccucugccucuugacugcugggauuaaaggaaugugcugcagcugccaccugguagauacccuuuuuguauguuccugaacucucuuuauucagguuacuuucugccauguaucucgucacucacuaagaauccugugcaccugcugcuguuacuagugguguggcuccuggagaaagauuucaccguacagcagacuuccaggccagcaugucuguccagcacaaugcaagagcuaggagaguagggccaggccuuggucugaauucccauguuuagccuuuugacauugagacuguuguuuucuuaaagaaaaaaaaaauugacauucaagaaaagcacaauugagucugucccuccuucaaaaaaaaggaugucaaaugccaauuucaaauuucaucuuguacuuuuauuuaaagucagucaggauuucuuagaggaaacauugccuagcuaaggauucagguguguccuggggccaugugcugaggagucuccaguauaccaccagauuacucauugcucaucuguuuguccccacuuucagguggaugcugucaaagccgugucuuaucaaggguguagcugucucaucuucucugagcagcgaagagaugucucaugagcauguugugcuggaagcagcugacagugggcggggcaguuggacuuccuguuccagcagcucccaugacaacuuccaaagccuucaaaaucaaaaaagcugggacuuccugaauucuuacagacacaugcauuuagaugacccuauugcagaaguugagcccacugacugugagcccugugccuguccuaaaggcugcucaagaacuuguggccagugcaaaggcagccuagagacgaaccagcugaggcagaguugggccuccuccagcucacucucggacacaugugaaccaaacuacgggacaguuaagcggaggguguuggaaagugcaccagcagaggcaccugauggcuuggagcccagggauaccacugacccuguuuauaaaacugucacuuccaguacagacaagggcuugauugguaagugcaggguuuuuguaucacugauguugaggcauuauuugccccucccccuagaaagagauacggggcuaucuuuaccagauuuuuuuuuuuaagaaugggcuauuuauuuauuuauuuauuuauuuauuuauauguaaguacaguguagcuuacuucaaacacuccagaaaagggcaucagaucucguuacggaugguugugagccaccauaugguugcugggauuugaacucaugaccuuuggaagagcagucuuccaugcucuuaccugcugagccaucucaccagccuucuuuaccagaucuuauucuuucucugacgcuauacuuauuuucuuccuuccacaauuuauugcuccaaaauuuguggcuucuccggagcuuuguuuguuuuguucuguuuuguuuuguuuuguuuuguuuuguuuuucucugucaugcauguccuuguuuuuauaaaacaaaaagggaauugacaauaauauuaacagaaaauauacuugcuaucagauacacauggaacacacagacccacagguagagccucggcgaugccuuuucuaaaguuccaugccauuaggaguaugugcagggaaaggaaagauuguuguauugaucucuaaguuguuggguccacaguugcuauguauacaugacagaaacaacagguccucuuacuuuucaggcagagagaccugcuaagauacugaaccaacucugacacaguaggucuuagccccgugaguggacccuguacucacucucagcaccacagagacagaaagagaccccaggcauuucuguggaccucaccaggugucagcugaugugaggguugcugucuagugagcuuuugcaguauauuuagucaucaauuuguuuauucccugaauuaaaugaguacuuucacauaauaucucuacuucccuguuacaugaaauaacuaucaaaugugcuaaucuuguaauaucuuggauuuauuuagaacuuuucaggauucuaggaauguauaagcacaggucccucugaguguuaauuuuaaugucuuucacuucuuggugauauggguaaauccuucuucauuuuucucuucucuugacaacuuuuccacugucauacuuagucaugucugcuuguccucagaugaaagcagaggccuauucugaccuugacauuacauugaccuuaagauaccacaaagaguuaguucaucuacacuaagaaggcucauugauugcauugaccuugacauuacauuacuuuugaguuuuacugguagaagacuaggaacccaaaggacaaagcucuuguugugauggugugaugugcgauguagaugugacuccuuaaguccauucugcucauguguuggcagugucuuagauguucuuuguauaaucaacagauaguugaacaggcuucacuccuuucuuccuuguucugauacuuuuugaagcuuagucccuuuccagggguuuauuauacacucagcaaaaagaaaaguuaucauuauucuuuuuuuuuuuuuuuuuuuuuuuuuuuuuuugguuuuuuucgagacaggguuucuccauauagcccuggcuauccuggaacucacuuuguagaccaggcuggccucgaacucagaaaucugucugccucugucucccaaguugcugggauuaaaggcgugcgccaccacgcccggcuuuaucauuauucuuaaggucacauuuucuaaacuuuggguuuuuuuucuacacuuuaaucagaaaacaggaguuagaaguaagacccuaagccaggcagugguggcacacgccuuuaaucccagcacucgggaggcagaggcaggcggauuucugaguucgaggccagccuggucuacagagugaguuccaggacagccagggcuacacagagaaacccugucucagggaaaaaaaaaaaaaaaaaaaaaaaaaagaagaagaagaaagacccuagccaaggguggcagcauaagccuuuaauaucaacaccaggagucagaggcagaccucugagagccacggcuguguagagauccuucucaaaauaaaaauaacauaccacaaagaguuaguucaucuacacucggaaggcucauugauugcaugccuggacugggauguguccacgcugagccacccgaagacggucugcgaacaugugccagugcugugacucagagccaacaggaagugaguuugugacugguugucuucaggagugagggcuucauugagcuguugggugcaagggcugugccuggggagagauguccugucacuguccucuggcuucauguagcugucuauguguagaguuuucuuaaaauaucugauagguuuaaauauuaguguuuguaagaacauuuuuaguuuacuaucauuguauuuaaguguauucauuuugucuguuuuuaaguuauauuuuugccauugugauguucagugugggguuuucuuuccuuuguuuauguuuuuccauuaacauuuccacugcuuauuuuuucacaccaguguacugugucaccucacccaagaaaggugauagguauagggagccaccgcccacuccuccaggauaucugggaauuucuuuagcggaccuaaaggaaggaccccacccgcaccuaaaaccuccagacuauaguguggcaguacagagaucaaagaugaugcuuaacagccugucuagacugccgccagcuccucccaguagccacaccucggccuggguucccucgaagauuggaucccagccucaaaggcauagccaucccaagcuagcagauguggcugaugcagauagcgaagcagaugguacguugacaaacugucucaauggcucuuaaguggauuguggagcauagaaggguuuuuucucugguaucugugauaaucuguaauguuuuuuaaucucuuuaaauuuguuuuuuuuuaaacugagaucuaagaauauagcucagugagaaaguggcugacacaaaugaggucccagggucagucuccagcacuacuaagaaaauaaauguauuuauuauucuauugaacccaucaagagcacuugugcaaaccuggcagccuacguucuggcccacaaacccacacaaggagaaaccaacaacaaaaaguacucccuggccuccccacacacacacuguacacacaugcacacacaaacacugugcacacacgcacaaacacacacacaaacacuguacacacacgcacacacaaacacacacacacuguacacacacgcacacagaaucaggcugcugucucugugcccacugcucugaugccagcucaaauggaguaucauuaucuuugauaaugaaacaguaggaguuucccguaggagaguucugagagaagacacuuuaugucuguugaguaaaguuuuacaaaagacaguugucuaaaagacacucuugacuuaguuccucugaggaacaaaacucuuaaugaacuuuguaacuguagcaaaaguuuaaaagguagugucuaacgcuaaaaauaaauauuuuauccuucuaaacaguuuaguaguaaaaugauacauuaaaaccaucugggaagauggcucugaagaucagaauucagagucccguguaaaaacuggccaaaaucccagcagagacaggauccccagagcaagcuggcuauguaaacuacucagaucaacaagcuccagaacaccagacgauccugucuggguauagggaguaaguaaaauagagagugauccauccauuaagacaucagaugccaaacuccauccaugugucuccauacacaugcacacacacaucuauacacacauauacucacacaugcacacaaacaccuauacacacggauguacucacacacaugaacacacacccacacacacauacucaguauauacauguguaccuguacacaugcacacgcacauacacacacacacaccaaaaaaaugaaacuacagggaccagcaagauggcucaggagauaaagccugaugaccugaauuuuauccccagaaaaagagaagcaauucugcaaauuguccuaugacacuucacacgugcacaguggcauuuauguacacacauacacacacaaacacaaaauaagugugaaagaauuuuuuaaauuugaaauuuccaguuuucuauuagcccucaguguuacagucaaaccugagccuugauggggaugucuaccaagauuuguuuagauagagaaagcuucuuauguagcagauaaucugucuguuauuguuugaccugcauuagcagauagaugugcuggcuaauugugucuucauuauuuucagaaaacgagcaggugucagcagucuagccuuuggacagaguguuggagagcacuggaagucaggaccauggacaagagcucgugguucuguaggccaaggccaucagcucgcugcugccacucaugcugaggguuccacacugggcucugaggaugagcucuucugagucgugcuuccuuuuguucugucccugcaggugcaguuuccuuaccuggguguugcaccugaucucagccuauacuuugcacaucacuccugccuugggaccacauucaagcucagaguucucccccuguauaucacuaugaguuuuucuuuucgagagucauuuuaaagauagugguauuauuauuauuuccaagccauagcuugggcuaaaaggacacauucagaaugucugccaauaccaaggauagucuuguguauuugaaaaguaacuuauuauugcaaguauugugauuuuguuugcauucaaaagcucuuguuagcuguuauuugucuuagucuauaaagcugucuguguguggucugagcagcaguugucaucccaacacagguacggagaugugacagcauuguagcagacacucaggugggaacaagacacccgugcaggugcagugcagguggccagcucaucaugaugugggcuacagcagccacaggggucucagcagucuuucggaaaggagaacaaagcgcaaguaggaagaaagaacucuaauuuccaaagaaggaaagauuaacauugaacuuguuucugaaaugaacaucauguugcacccaauugugaggauacuacaaacccacuggcaguggcuucucaaaggcuuucuuucuauagaaacccuaagcuaccauuucacaacacaaguauggaaucccuagauuaaaagaaauauuguaggagcuggagagauggcgaagauacucuugcagagggcuggauuuaauuucagcccucacaugguggcuuacaacugccugcaacuccacauccaggggauccgacacccucgucugaccuccacaggcacuucaugcauguggcccauaggcauacaugcagucagaauaccccuacacacacaaaauaauaagaaaaaaaaauuuaucauggaugcaauaaugaaguuucccuuggcuugugcugugacuuuacagcacacaaccacaugugcaaucauugaacuugagcuuugagaccuccacagagcucaguccccaagagauaguagacucauauaagagagagaggcuaaaauaauggaggggacuucauccuggaaaggacauccuuugugaccuccuggacauggcacucuuaacuauauaauucaaaucagugacugcuuacuaaaaaaauguacuuuucacauuuuuacaaauuaaguauaacauuuuguauauauauauuuaaagguuuugauuugcuuuuuaauguaaaggcaaauaagaguucauaaacuucuguaauuacaaaaaaagccaaagccauugaaagugcacugaccaugacagcuuugcuacagagcagucauguuaccaaccgccuuuucaaguuuguacuuuucccuuacgcucucuuccuguuuuucuguccaaucacuugagagucagaacaguuccaaauguaacaguauugugucuucccacagaaugccugucucuaggaagcauaauggcugaagauuccccuggggagacaguaacccggaagccuuagacuugagcccaggugccgagcagugcagugaggcgcagccuuacuggcccuuugagugucagcugccacuuuacagccaugcuucacuaaucuggccuaugaacuaacugugcugguuucugauugugaaucuuuuuauucaccuacuugcagauuguuuucauguccaaaacaaaagaaauauuuuugcuauauccaccuuuguaauccaaguuugaguacucauugucaccauuuucuauccauugcuccagaaaaaugugcugucugcacagcuucugucuauccaccaggucuucagacagauggacccuugccugccuugguccuuaaagguguacauuaaaugucuuucacagagaguuaagaucuguggcuuugaaccugcauuguguagcugccuugauuuuaaucaagcuuuaucugugaguguucagaccaacugaucacauugaucagaauaaaaaccaaaugcuuuguaguuugauguguaugagucccugaaaaaaaucaugucugccuuuuuuuuuacuuuguuaggugacuagagcaagggaagccuuaaagcccaugauugcuccaguucuaagcccccauuuguccuuguucuaagugugcaacauuacuaaacagacuagugcccagcaccugccaagacugucaaagcaggagacuuuuagugcagaguuuugccaaauaauaaauuucaacaaaaucucagaguaaaccauuaagagauuagugaauccagccacugcuuacagcaagguuacucggaaucaccagauuucauuuccucuaauugaugucuuuauaaaugaucuuuggggaaaaaaauccuuuagagaguauucaugaggguggcauguugguuaccuccaugaucucuaccaagcuggaagagcaggaauagccauagggucaccuuauauaauuacaaagaaagaggaaggaagaaagguuuccuuaaacauucaacccagugauuauuuggguggaaacauucuagaagacgcugggugugcccgugcagcguucuguuacacgcuacaggcgggguccaccgagacaagucggguacauuuucaaaucaaacuugagccccagucaucuuuagcuuucuuguuguuuaaaaggccucuuuauuuuuauuguacagaaugaaugcaguugaacuugauagauguuuuaaaauugaaaugugaguuuaucaaaaacaaaagcaaaauugcacaguugcuaugaucaagugacaauuaucugcacaauucauugauuguaaggcauccugucacaagcaauguugucuccuacuuucugaugccucuuaaacuuaugucuuuuagaaagacagugccucuguaugcuuuguauuuuuacugaguguaaauacuuguuauauuuugguuaagaaaauguaaggguaucauuuauuaccacaucuccuaauacaucggaaccaauaaagaacaugcaucaacugugu

SEQ ID NO: 6001 - RNA, 5900 nt, Mus musculus
cacacaacaggaccugaaacugcacacuguauuuucuaaauaaacaacaaucucccagaugaggucagaugacuuacaacaauagggucuuuuaggcaauguuuuagaacucauaaaagcugccaguuaaugggaacuuuucauacggccugcagacaggacuggguaauccagugugaggcacuggguagguacaggaaaauaaagcuagagcuuuuuaaguuauuugaaacagcaguuguuuuucuucuuaauucaucaaaaggcguuucugacuuucuucccaggguuuuguuuguggcaauggacaguacggugaaggagcgcacagcuguaauagcacuguuugccugggagcugaagcaggaagguuccaggacagucuaagcuccacccuuccucaaagguaacccuguuucugagcugggcacucgagucuacagcaugaaacacaucuaucugggacuaaaaagucucugagacaugggaggaaaacacaauaaauacuacuuuuauuuuucauuauucuuaaagauuuuaguccuucaaauacuugauauacagggugcuaugaggcuauaagguguguuguuucuacaaaaguuauuaaaaacaauaaacagaaaauauugaguuauauuaguacuuaaccuaaaucuaccaaugaaagaugcauagcagagcuuccuaggaugcauuccuccugcagacaugugccuuucaaaaugccagaaugccuaaguguggugguuuggauaagaauggcaccaagagacucacgugugaacacuucgucaucaggguguggcaguacuugagaaggauuaggaagugugaucuuguuaggucuuguuggaggaagugugccaugggggagccacugagauucugagauuucgaaagcccaugcuaaacccaguucuccuguccccucaccccucaucucucucugauuuuuccuuugccuacagaucaggaugugacccucagcuacugcuccacugucaugcucccugccaugaugagaauggauuaagucugagaggguaagccaaccccagcuaaacgcuguucuuuauaaaaguuuccuaggucacacugucucuucacagcaacacaucagugacaaagacgcugaccucaugcugcaaaugcccaugggccaaaaaaugaggaaugaaauuggggaauuuuauuucaagaaacuuuuaauuuguguaucacccugauucauaaccuaacagucaaaugaacccaguaucaugcacauuaaaaucagacagcacaagaauaaaauucaacauaagaugcuaauuuugauucaguaagagccugagucagaggagaaaguagagaaaaaggaaggaauuaggacacaaacacaagccccaaccccaccccagagcuuuucaguuagaaaugucagucagcugacugagagcuugccuagcaugcacagagcccaggguuggauccccaagcaccacauaaaaccaggguugggggccugucaaacacagaaguggaugcucacagucagcuauuggauggaucacagggcccccaauggaggagcuagagaaaguacccaaggagcuaaaggggucugcaacccuauaggugguacaacaauaugaacuaaccaguacccccagagcucgugucucuagcugcauauguaucagaagauggccuagucggccaucauugggaagagaggccccuuggucuugcaaacuuuauaugccucaguacaggggaacgccagggccaagaagugugugugugagggggggggggggcugggggacuuuugguauagcauuugaaauguaaaugaagaaaauaccuaauuaaaaaauaaaaacaaaacaaaaaaacaaaccaggguuggugguacacagcuguaacccuaacacucuugggaaggugaaagugggaucagaagaagucauaggaagucugaggccagccagggauacacaagacucuguagguagaugauagauagauagauauauagauagauagacagacagauagauagacagacagauguucagacagauuagaugagagagagagcacaagcuugcucaaaacuagucugcacauuuauccaauuucaugaaucucuaaacucaacacagaucuaacugaaaucucaacaggucuuucagaaaaccugacaaacuuugaaauuuguauggaagauuccacuaagacuggccaaaacauaaaauaaaaacuaaacgacagaucugccuuuccagacaccaugacaauauaaaacaguaaaauagagaccaugauaucagcauaaugcugagcucaggaaaggcaggaugaagagacucggaguguggcucacacaugauguguggacacucguuuuagaggcuaagcuagaaagacacuuaugaagcauguuacaacacacucucauagaucucuuaccagggacaaaggacuacuggcgcaaugagugguggggcaaaaagucaccacauagaaaaauaagcacaauuagauucuuucuuccaaagccaacuccaagcccagcaugguggugcacaccugaaaccucuacacucaaaaggcugcgacaagagaaacgugugaguucaaguucagccugggccacacaagcaagacuuuugucucaaaaaacaaacaaaacaacauacauuaauucacuacaggcuuuuauuauauauggcaacugauucuacuuuuacaagaaagucuagguaagugucuuuauaacucaaaacguuuuuaaacaagacacucaacauaaaaaccugugccuauaacccuacaguuggggaggcaaagacaggaggcuguuuggugcucguuagccagcuaauauugcugagucagagagcuaaggucagugaggaagaggacggcacugucguuagucucuggcuuucccgagcguguacacagaccugcauggauccuauguguacacacaaccaauaguuugcauucagauauuacgaauaugcccaugacuauggaauacagaaaaucacacugaucaauaaacaucaagagaugcuaagcucugugcugcauaugcagcucagggggcagagcacuugccuagcaugcacaaaugaaacccgagacuaagugugccugugacccauaauccaagcauuuggaagguggaggaaagaucaaaaacacaagguggaugaugggccuggugaugcacgccuuuaaucccagcacuccagaggcaguaggaucucugugaguuccagagaucuguagagagaccuugucucaaaaaacaaacagcacaaggucaucuguggcuauacaguaacuuugaggcuagccugggauacaugagaccccacuucaaaacauaaaagagguuagcaagauagcucaauagguaaagacacuugcugccaaaccuaaggauuuguguucaguucccugggauccacaugcuagaggaagagaacugauucccauaguuguccucugaccuccaccugcauguuaugacaugucucccuaaauaauguaauaauauuuuuaaaaauuaagaaagaaaaaaagggagaguaaaaggugugggggggggcugugaugguuuuuauaugcucagcccaggaaguggcacuauuagguguggcccuguuggaguaggugugucacuguggguguggguuuaaagacccuuacccuagcugccuggaagccaguauucugcuagcagccuucagaugaagauguagaacucucagcucugccugcaccaugccugccuggaugcugcccuguucccacuuugauaguaauggacugaaccucugaaccuguaagccagccccaauuaaauguuguccuuuauaaaacuugccuugccuuggucauggugucuguucacagcaguaauuaacaugaggaacaaaaaggagaaaacagaaaaaucagagaauuucacuuuacccauuagacuguuaaaaacuaagguaaaaacaucaucaaugaagauucugugacagccaaagcagccaacacugcuacaggaaccauggguauuagagucaguugucacuauccuaugagacugacuuuucaugacccacagcucaaauucccaauuuacaagggagcagacaggacaagagccagguccaaccaaggggcaaguguaaaaaacccuuuccccaaacaagacauccauccccgcuggucauucuggcacuggugagcauugcugcgaugaugauucuggcauaacaugugaauucuacagauucauaaaucaaaaaggauuugauuuugcuuuaaauacuaaugugcucacuuguuuuucagcuguaaccucgaggugccuauaaauuacaacugcaagguagcuaagcuguaagaauacaggagagaggaugagggagggagggagggagggagggagggagggagggagggaaggaagaggggguggagaaagggaggaagggagagggggagaaggagaggucccaaucuaaauugaaucaagaucaauuuaagaaaaguacuaaaagaugagauauaacuuuuauuuauaagcaaauaaauaucagaaaacagaauccagggcguguguaaguuccaggugagccacacagcaucacaggcuagcacuggccacacucagggguuaucuuuuaaauaaauaaaaggcuuuucacugucucugacucacuuccccaucuugaacccaaucuguaccuagcucuccaauaguuccuaacugcuuaggaauacacauagcagggcuggaucaucaaagccuuccuaauuucuuaaggaaccgcuaaaugaagacaaugucauacucuguacuuacaauuauaguacuuguacaagaaauacagcauacaggaaacacaugcauuagucagcucuuuguuucuaucacaaaauaccagguaagaggcuuaaaaagaggaaaugucuauucuggcucagccuuggaggcuuuggggcaugguuggcugccccaucaaaucuagaaaauaugucacacggaagcacaaagcacagaagcugugcagucaagaggaacacacuccaacggcaucgugcagacuacugaauccguccccagugaagugugaccucuuacggguugguuccaccacugcccagaacucaacaccaucccuaacugcagauccagccucgcugacgucauagcacaaacacccaggaggcaggcagcuucugccuaacagucuugggaauuugggggcucaaucacacaacuacauuucaaucaguccucuucaaugaccuuccaaaagauagggccauuuuuuccccaucuuaauugauaaggaugaccuuuuuucuuaaauuacauucauguacuuaagugucuugagacaauuauaauuaugauuuugugugauauuaaaugaauuaagaacaggcacuucuguuuucagaaugaucggcauaaugccugauuaccucagcagccacuccugcgucacagugaccccugaaaucacacagggccaggacugcuggcugcugcucucccacuucacugaagacagauuuucuacaagacccaagcaguccaucaaauccaucuccucaaccacuucccuugaagauucgccaacucucgugcucugaugccugguggcagggcuagcagucauuuggagccucccucccgcuuugcuguacaucagagcaacacauggcagaaaaaaagccaacacaccacaaacucagcuccugaagcugaggagaugcugcccugugugagcgcgcccgucacuagucucuuggcucaaacaugcaacaguuguuuagguugcuuguuuguuuucacaaagaauaaaaccaaaguguucugugaccuggaaaag

SEQ ID NO: 6002 - RNA, 5900 nt, Mus musculus
cuuuuccaggucacagaacacuuugguuuuauucuuugugaaaacaaacaagcaaccuaaacaacuguugcauguuugagccaagagacuagugacgggcgcgcucacacagggcagcaucuccucagcuucaggagcugaguuugugguguguuggcuuuuuuucugccauguguugcucugauguacagcaaagcgggagggaggcuccaaaugacugcuagcccugccaccaggcaucagagcacgagaguuggcgaaucuucaagggaagugguugaggagauggauuugauggacugcuugggucuuguagaaaaucugucuucagugaagugggagagcagcagccagcaguccuggcccugugugauuucaggggucacugugacgcaggaguggcugcugagguaaucaggcauuaugccgaucauucugaaaacagaagugccuguucuuaauucauuuaauaucacacaaaaucauaauuauaauugucucaagacacuuaaguacaugaauguaauuuaagaaaaaaggucauccuuaucaauuaagauggggaaaaaauggcccuaucuuuuggaaggucauugaagaggacugauugaaauguaguugugugauugagcccccaaauucccaagacuguuaggcagaagcugccugccuccuggguguuugugcuaugacgucagcgaggcuggaucugcaguuagggaugguguugaguucugggcagugguggaaccaacccguaagaggucacacuucacuggggacggauucaguagucugcacgaugccguuggaguguguuccucuugacugcacagcuucugugcuuugugcuuccgugugacauauuuucuagauuugauggggcagccaaccaugccccaaagccuccaaggcugagccagaauagacauuuccucuuuuuaagccucuuaccugguauuuugugauagaaacaaagagcugacuaaugcauguguuuccuguaugcuguauuucuuguacaaguacuauaauuguaaguacagaguaugacauugucuucauuuagcgguuccuuaagaaauuaggaaggcuuugaugauccagcccugcuauguguauuccuaagcaguuaggaacuauuggagagcuagguacagauuggguucaagauggggaagugagucagagacagugaaaagccuuuuauuuauuuaaaagauaaccccugaguguggccagugcuagccugugaugcuguguggcucaccuggaacuuacacacgcccuggauucuguuuucugauauuuauuugcuuauaaauaaaaguuauaucucaucuuuuaguacuuuucuuaaauugaucuugauucaauuuagauugggaccucuccuucucccccucucccuuccucccuuucuccacccccucuuccuucccucccucccucccucccucccucccucccucccucccucauccucucuccuguauucuuacagcuuagcuaccuugcaguuguaauuuauaggcaccucgagguuacagcugaaaaacaagugagcacauuaguauuuaaagcaaaaucaaauccuuuuugauuuaugaaucuguagaauucacauguuaugccagaaucaucaucgcagcaaugcucaccagugccagaaugaccagcggggauggaugucuuguuuggggaaaggguuuuuuacacuugccccuugguuggaccuggcucuuguccugucugcucccuuguaaauugggaauuugagcugugggucaugaaaagucagucucauaggauagugacaacugacucuaauacccaugguuccuguagcaguguuggcugcuuuggcugucacagaaucuucauugaugauguuuuuaccuuaguuuuuaacagucuaauggguaaagugaaauucucugauuuuucuguuuucuccuuuuuguuccucauguuaauuacugcugugaacagacaccaugaccaaggcaaggcaaguuuuauaaaggacaacauuuaauuggggcuggcuuacagguucagagguucaguccauuacuaucaaagugggaacagggcagcauccaggcaggcauggugcaggcagagcugagaguucuacaucuucaucugaaggcugcuagcagaauacuggcuuccaggcagcuaggguaagggucuuuaaacccacacccacagugacacaccuacuccaacagggccacaccuaauagugccacuuccugggcugagcauauaaaaaccaucacagcccccccccacaccuuuuacucucccuuuuuuucuuucuuaauuuuuaaaaauauuauuacauuauuuagggagacaugucauaacaugcagguggaggucagaggacaacuaugggaaucaguucucuuccucuagcauguggaucccagggaacugaacacaaauccuuagguuuggcagcaagugucuuuaccuauugagcuaucuugcuaaccucuuuuauguuuugaaguggggucucauguaucccaggcuagccucaaaguuacuguauagccacagaugaccuugugcuguuuguuuuuugagacaaggucucucuacagaucucuggaacucacagagauccuacugccucuggagugcugggauuaaaggcgugcaucaccaggcccaucauccaccuuguguuuuugaucuuuccuccaccuuccaaaugcuuggauuaugggucacaggcacacuuagucucggguuucauuugugcaugcuaggcaagugcucugcccccugagcugcauaugcagcacagagcuuagcaucucuugauguuuauugaucagugugauuuucuguauuccauagucaugggcauauucguaauaucugaaugcaaacuauugguuguguguacacauaggauccaugcaggucuguguacacgcucgggaaagccagagacuaacgacagugccguccucuuccucacugaccuuagcucucugacucagcaauauuagcuggcuaacgagcaccaaacagccuccugucuuugccuccccaacuguaggguuauaggcacagguuuuuauguugagugucuuguuuaaaaacguuuugaguuauaaagacacuuaccuagacuuucuuguaaaaguagaaucaguugccauauauaauaaaagccuguagugaauuaauguauguuguuuuguuuguuuuuugagacaaaagucuugcuuguguggcccaggcugaacuugaacucacacguuucucuugucgcagccuuuugaguguagagguuucaggugugcaccaccaugcugggcuuggaguuggcuuuggaagaaagaaucuaauugugcuuauuuuucuauguggugacuuuuugccccaccacucauugcgccaguaguccuuugucccugguaagagaucuaugagaguguguuguaacaugcuucauaagugucuuucuagcuuagccucuaaaacgaguguccacacaucaugugugagccacacuccgagucucuucauccugccuuuccugagcucagcauuaugcugauaucauggucucuauuuuacuguuuuauauugucauggugucuggaaaggcagaucugucguuuaguuuuuauuuuauguuuuggccagucuuaguggaaucuuccauacaaauuucaaaguuugucagguuuucugaaagaccuguugagauuucaguuagaucuguguugaguuuagagauucaugaaauuggauaaaugugcagacuaguuuugagcaagcuugugcucucucucucaucuaaucugucugaacaucugucugucuaucuaucugucugucuaucuaucuauauaucuaucuaucuaucaucuaccuacagagucuuguguaucccuggcuggccucagacuuccuaugacuucuucugaucccacuuucaccuucccaagaguguuaggguuacagcuguguaccaccaacccugguuuguuuuuuuguuuuguuuuuauuuuuuaauuagguauuuucuucauuuacauuucaaaugcuauaccaaaagucccccagcccccccccccccucacacacacacuucuuggcccuggcguuccccuguacugaggcauauaaaguuugcaagaccaaggggccucucuucccaaugauggccgacuaggccaucuucugauacauaugcagcuagagacacgagcucuggggguacugguuaguucauauuguuguaccaccuauaggguugcagaccccuuuagcuccuuggguacuuucucuagcuccuccauugggggcccugugauccauccaauagcugacugugagcauccacuucuguguuugacaggcccccaacccugguuuuauguggugcuuggggauccaacccugggcucugugcaugcuaggcaagcucucagucagcugacugacauuucuaacugaaaagcucuggggugggguuggggcuuguguuuguguccuaauuccuuccuuuuucucuacuuucuccucugacucaggcucuuacugaaucaaaauuagcaucuuauguugaauuuuauucuugugcugucugauuuuaaugugcaugauacuggguucauuugacuguuagguuaugaaucagggugauacacaaauuaaaaguuucuugaaauaaaauuccccaauuucauuccucauuuuuuggcccaugggcauuugcagcaugaggucagcgucuuugucacugauguguugcugugaagagacagugugaccuaggaaacuuuuauaaagaacagcguuuagcugggguuggcuuacccucucagacuuaauccauucucaucauggcagggagcaugacaguggagcaguagcugagggucacauccugaucuguaggcaaaggaaaaaucagagagagaugaggggugaggggacaggagaacuggguuuagcaugggcuuucgaaaucucagaaucucaguggcucccccauggcacacuuccuccaacaagaccuaacaagaucacacuuccuaauccuucucaaguacugccacacccugaugacgaaguguucacacgugagucucuuggugccauucuuauccaaaccaccacacuuaggcauucuggcauuuugaaaggcacaugucugcaggaggaaugcauccuaggaagcucugcuaugcaucuuucauugguagauuuagguuaaguacuaauauaacucaauauuuucuguuuauuguuuuuaauaacuuuuguagaaacaacacaccuuauagccucauagcacccuguauaucaaguauuugaaggacuaaaaucuuuaagaauaaugaaaaauaaaaguaguauuuauuguguuuuccucccaugucucagagacuuuuuagucccagauagauguguuucaugcuguagacucgagugcccagcucagaaacaggguuaccuuugaggaaggguggagcuuagacuguccuggaaccuuccugcuucagcucccaggcaaacagugcuauuacagcugugcgcuccuucaccguacuguccauugccacaaacaaaacccugggaagaaagucagaaacgccuuuugaugaauuaagaagaaaaacaacugcuguuucaaauaacuuaaaaagcucuagcuuuauuuuccuguaccuacccagugccucacacuggauuacccaguccugucugcaggccguaugaaaaguucccauuaacuggcagcuuuuaugaguucuaaaacauugccuaaaagacccuauuguuguaagucaucugaccucaucugggagauuguuguuuauuuagaaaauacagugugcaguuucagguccuguugugug

SEQ ID NO: 6003 - RNA, 5051 nt, Mus musculus
ugaaauugugcuuauuuaucuacucauuuguuuuuguagaaacugucuuucuauguaguugaggcuagcucgggacuuauaauccuccugccuccaucucucaggcaugugucacuguucccagccacauggcucucccuucucuccauuucccacccacccccuuccuuagguaaaccaugugacuauaaacuguccguugcuaauguuggcacugaacagaaccugacacguuaucuuucuguugacucacauucauauacacagauuuauaaaccaugaaagagacaggguaaagaguauuugcugugcuugugcgugaugaucaccucagccaccugagacaguugacaugaagacacucucgcuucccagaccaccgcagcucuaacucagcucacacagagaaaaaguguaaggugggcaugcuguguuacgcauaguaggacucuuucuccaaacaauagcaacgaagguagauguuucuacuguaagguucugugaugagacaaaaaucucaguuaauuggagguggacucucacuguguaaagauacaccggcuucaccacauuucaaaagagggaguucuuggccauccagacauccaggugacaaagucagguggcucggccaccucauagcuuccgcaaggcaccuaccccuuccccugcccugcauccaucaaaggagaacggugcuccuccugaacugcuggggcuggagugaagggucagugguuaaaggcaugcacagcucuugaagaggauccgaguucgguucccagcaccacacucgguagcuugcaacugccucuaacaccagcuccuagggauacaacacccucuucuggccccugaaggcauuuccacucuuguguacauagcacuccagacuuaguuaauuaagaacauuuuaaagagagauuuauuaaucuuuaauguguguguguguguguguguuugagugagugagagagagagagagagagagauugauuguguauguguguguauguguguauaugugugugcuuugugucugugggagucagaagucuaccagcugaacugcagccccacuaaaggaugugucauuuuuuaccucuguuuugccacacacccaucuuugcuccugacagcuccuugcugcccgugucuccagcugcugcagguuagagucccuggcccucugcccugaaagccauaaugaacacugccugguuucugagcuaaugugaugaaaucaucaccaccccauccaccuucuuaaaauagguuacuuucucuccuccuucccagcgcuguuucuuagcuaauuuaacuggcucauccucgccccauccauuuacuuaaaauagaagacuuuccuacccccccccccucucgcucaucuuccuuuccagucauaauggaacucaauugacugucaggcauaauuucuucuuucucuccucuauucuugccugauagcccaauguaaucuggaccacagugaccuugagaaagucagucccccuucucuggcuacccuuaaguguaccugggacaugugguuaauccuuugcuucaacuuccucuccucagagaugugcuccuccaagaagaugguccugggggcccagcugcugucucugaagcugauuuucuggggcuggcaaugcacuugguuucugaugaucaauauuauaaaucagauugaacaugugaugucagggcugggaaauggcucgcucagcugguaaaacguuugcugcacaagaaaauguuagggcaugggggggauggcuacauacaucuuuugccccagugcuggggaaaaggggacagaugugaguagaucccaggggcuggauagccaggugguccagccaaaaugacgaacuugccugaaaugcaugaagcccuuguuucaguccccagcacugcauaauaaacuggacauggugauucaugcuguaaucccggccauggaggauaugggaguggggguggggcaucugggguuccagguugucuuuagcugcauagugaauuugaggccaacuugggauacagaagacccuaaaaacuccaguuuaucucucuucucccucucucucucucucuuccccucucucucucccccccucucucuaucucucucucucucuuccccucucucucugguguguguauuugugucuaucuuugucucuuuguuauuuugagacauagucucacucuguaguucaaguuggccuggaacacauuauguaguucaguuuggccuagaauaugugacaguccucuuguuucagccucccaaguguuggaauuacaaccaugaaucacccugcuuaaccuaaauauacaacuuuauaaauacaacaaaguucuccccaaaugguuugccccuaaugacaaacuguucugcugauguccuggaucccacccucccaccccacacuccauaaaggaugcuacggcauuuguuucucuuacuugcccaugcuaucaauuuuucauuuucugcugagcuagcuccaucagccaacaaugauguuuuacuauuacuguuaauuguuugugaaauaaaggucucauguagcccaggcuagccuugaacuguuccucgugccuccucuuccugugaaggauuagaggugugcuuuaccucaguuagguucauguggugcuggggaugaagcccagaaugccaugcguagcaggcaagcacucugccaacugaccuacauccccuccccccgcccccagcccccagcccgaggauaucauuuugaucauuuuaaaucugauuuuauuguuuuguugcauuguguuugagguaggguuucauguagcguagauuuuuccuggagcucacaauguggcucagaccuacuuuggcuuccuaguccuccugaagcgcuguaauucucuuaaguguuaggauugcacagugugcccuugggcucugcucauccuuagcaacuacacagaacacagguuuuuaccugcuuugcuccucuaccugcuuugcagcuucuuuauagcuaaacuuccuacuuacuuucuauagaccgacuuucugcuuccucuuucugcucuccccuagcccuauaccgacugaguuuugcccauaccaaccauuccagcaaacuguuccugucagggcuauaguggcuucccugucaaucaugucuggucaguucccaguccgcaucuuuccugaccaauggcauuucccuccuuccguguccauucugcccuuugcuuauagaauggaguacacacuuggguugguuucugguggcagcuagcugguggcagcauguaugugugcaugcaugcaggcuuacguguauacauguggauguacacacauacaaacaccacggccauuucccucugagaauaucaaaaggaaaauauaaggacccugcaguggaggaugcuuucggaguggagugagguacauaccagcagcugggccuuugcucggggauagccauaguuaagacaucuucuucucagacaaguauccaugcucuguuccaauagaaguguagcccagugaugccuuccuaaaggacaaguggacuucgaagcuccugggagaaacccaacaugaucucaauggcagaaaauugccaggcaaaccaacuuagugaugagauuucuggaagcguuugcugugcaguguaauaccuuggaaccaaucuucccagccuccuucagccucugaggccaucucuggccaucauggaccuguauaaggagaacaagugacacuguagugacacccuggccccaagccgcuccuucccccauaggagcauggggaagaagaaacuguauccugccuguuuuaggaaaaaaaaaaaaaaaaaagaggucaccaccagaagauggugauagugaaggagacugacuggacccagaggauagcaugaccucagcagaagccccugccaaggcugacagcugcccccccccccguccccccggcaaaaaaaaaaagcagauccagcagaagcagucagggaugggggaaggaacaccacugugccacagcagccuucguggaagggccacccaaggcagcaggagcaugaggaacauccugagggccagacuggggauccagcaggggcagucauguucacugguggcaccuugugccaacagugucccuccucaagggcaacucagaagugcuacagugccaauuggauucccagaaguggcccagagccaaggggaccccagaacaaagaagaagaaugucacacacacaguggcuuugucugaugccaaaugacacucucugacaaccuucacaaaccugagugugacccuccagaaagccucagggcuuuaaacuggugcuaggaguuccccaacugaaaggaagccgggccaauaaggccagcacucgaggcugaggcagaauugaaaguucagggccagucuggcuguagagaaagacccugucucagaaugcgggcagggauacagcucggaggcacacugcuugccuagcauacacaaggcuuuggcugucagucccuccccgaaacguuaagguguuuuuacccaugcuaggguaauuuggggacauccauaauuacaccuugcuucugaccauccuuuaagaaagucccacuuccugcaguggccaaguucagguuucugaaaaccaaacacaggagcuaauucuguggcugguugaauuauaaaacaaugggaaucuacaaaugcagagagucccuuuuauucaaauaaagcaucaacugggaagaagugggucuuugaaaacugguaggagguguccaguggcagagaacgccauccguccgccauuccugucugagaagcguuagaaauaaaagaugacagauuuauaguaaugaaacugaaauaauuacuuuuaaggggagccuuauuggaagagcagcggagguaucaucaaggccauagacagccaugaggaggcccugaagggagagacagauccugcaguucccuucgguuccaaagaagagccgcauuagaggucccgaaguaaaaga

SEQ ID NO: 6004 - RNA, 7942 nt, Mus musculus
agugcuguaccacuaagcuacauucccaguuggcgcagggucucagucuguagcuaaggcugcagauugcacugaaccuacgcaauccuccuguuucagcuuuuuggauucugcgauuacaggcgugagucucuacaccuggcucacacagugcuuauuauuugcacuaacggguucuauguuaaguccucggggcccuagguuuucagagcuuggggaaaaaagcuguguccuggguguugucuagaaccuuggccgcgcccaucuccuguucuucccaggcagccgggcccccuucucuuccuccuaggcuugugucaccgucgccccggucuggggagaggaggaaaaaggggcggguaugucuugcccuuuaaaucuuaaccgcguugccauuggcuaggaagcccccgccuggcugcggauuggccacaguggauggcuugaaauguggcugagcgcuucggacaccucagacggacgguggccaccccaagacgcgccccagcccgccauggcccggauccuccgggcauccugccuucugucccugcuccuggccggguuuguuccgccgggccggggacaagagaagucuaaggugagugaaccuccggagcucaagaagaguccauggcacccagguguccacugcgcgacugggagagccacugcuuccccagaggcaccgagagccucacuuguaacccucggucucugcgcucuuccaacacagacccgcgugcuucagagggcaguacuaacccaggagggcagucuuucccgaguuuauacauuuucuuccacugucaucuuggggucgcugguggccacaauccugaaaaaaaauugccggggaagagggugggccgaugguuucuucacucaucccagggcgcuggaggcagagaucugugacaggaagaauuuuuauuugggggcgcaucccuuucugggccucaguuucuccaucagcagggcguagcuggagaggauggcuggaaggcuauggaacccugcaguugcuuucccuauucacaguucacuggccugccaugcauggagcagacacuguagcuagagaagccaacccaggccaggaagucuucuggagcuucaucucuccuagucuagcugugguacccugaacuggaauagaaauggcgagccugagggcagaugccccggcaugcuuaucuucuuggucaggccugugcugggugggcucuguaggccucuccucuucccuagggugagaaugcagaaagcaugaacccaaagaaagagacugugguccccaacuucacacacaccaugcacaccaugcaccccugcacacuugcaugcgugggcacaaaacuggguaggcucuagcuuugaguuucuaaaauccucagggucuuccuucuaagaucuuguauguccgagagagagagagagagagagagagagagagagagauugauuagggggugugguguggagaugggguggggguggacgggggcacuagcccugugccuuuagugugggaacugcuuggguuggggguugaauccuguccugaggaggcugcaggaaagcacacuggccuugugcuguccauagaaugaaggagagaugggugaguucagagggaagagagagagcagucuagaaaagucuuagggugugguguuaucuuaucucauaacuagcugaagcuucuggcuccucacagcccaggcaugcccaucugagcucccagguccuuggaguuaacacauuacagcucuggcuucugggauucaacugcuugccuggauccaacuucagaacaagggaacagggaggggacgugugcagacccagugugauaaagccacugaaagauguccucuacacucaaagggaggggcaaggacagggaaagccucugucugguccagguuacagcugcagaaggcuuugcauagcuguggacuaccagcugcugacguggcauccuaguaaccacugguuucuaggugacugacugcacaaggcagagagcaucaugggagcacaggcugacgucaaggcugaaaggccuuaaguggaccugaaucccacuccaucuuacaguugacaggcuggaauccugagaagggggagggauggucacacacugccagaggcccagcuggguccagcugccaucuccaaccucucagaccugucaugcucccaacaucucaccaauggguguaggaagauggaauagggaagacauggaccaguaguagcccuaggcauccaggaagcuuagcucaguguauucccccccagccccaccccuuuuguuccucguucccuuucaguacucuucucuggccucccugguggaggaauagggcuaugggauucuaugaacccagaggaaggaagcugggggugggggugggguuggggacucaauuggugaguauaaucuauggcucauuuaucaagaccacccuccgaccuaugcuagccugggcccccagcaugagcccuauucuccucccauagaaagcauggcaguugccauuauucauuucuuagggcagcuagcacacaauuaaggccucucuguacuaugacccuuccaggccuuuggcccuugcugcagguaaucuccauguccugcuggcccaagccuguuuucaucugucaguaguuucucaaagucauuuugaguguugggaugacaauucgaugaguaaaaucauuguuauggaagcaagaggaucugaguucaaauccccagcauccaugaaaaagccagguauggccacacacgugccaacaauggugaggugguggggcagagacuggcagauucaggagcucaucaccagcagagucaaacacugagcacagcugacagggucagcaacauggcucuggggugacgaugcuuguaaccaagcuugagaccugaguuugauuccuagaacccacauguaggaacucacugggucuucccagcuguccuuugaucuccacaugcugugacauccucccccaaauaagugaauaaauguaaugaaauaauuuaauagagaaacucucacgauuuucuucuuuggcuuccacauguaacuggcuagacacacagccaaacaaaacagcaacaaacacacacuuuugagaggcaaauggaauuaaccucucagaccaaagcccaaaggauuaagaugguuugcucagggccacacagccgguaaagauaaccgagucuuacucaagggucuccucauguccccuuccuuaagacuauccggagaagcuggacccacggguguuucccauuauucagugagccucugggaucuccuccccacaucugagauucagcuugguaugaaggugaagcgccaugcagggagguagcaggguuguaucucacuguuuuuacuauguugcucuuguugaggcaagguaucucaacguagcccaggcuagcccuaaacuuuccaccuccuguuccagccucugaugcuggccuuacugaugugugacccccaagccugaggcuguuugccuuuuaggguggaagugaucucagcuggggcuucagaagccuggggcagggcuguccagcugagcauucagucuaacacucgcaguauuuagacucccggaaagcagggacuuugcaccccagccaggagagcugucagcugucagggaugacccagcaaaggcagccaggcucacucggcuggcuagccaggccugcagugauagaggcauuccacuguaccccacuggggcaccugcccugcugccuggaugacuccuucacccagugaggcugaaggccuugcuugggcagcacguuuucuagacccagagggaagaguaccuuccuaugaggcucucccacuucaagaggagcccuggaguuuugcugucccuguugggggugaggugggguggggaugggucccuuuccuccuguuucaguuaaaaauagcuaguccagcguaauagggaggcuggggaggagaaaugaucaagauagcacugagcugguggcagggcucgaggggaaccuggguacucuggcacaccccacugugcccuaugcuccuucccucauucuccuggagguagccuguggagugucagcuggacagacaggaggguguauggguuaauacccacugugucuucacucugggugucacagugaggccuugugacaaacuguuccauacuccggggcccuguucccacaucccugcuuccucgagcucugacucauucccaacauccugacacauccuuucuguccagugucuccuuccuggucaccuagcccaggcuuccucaugcuugucuggacuucgguagcagccacccaacugugccucucagaccaaccucacccaacugccuaggaaauaugaaagugguuucugcuaacuucagaguuccacagcacccaguaagcaauuaaugcaaauacugagugcuuacuggguccucaaguaucucaguuaugggagaugaggaauuaggagaccucagguuuaguccaguuccaguuuuuguuguccuggguaagucacucucucccugcuggcaaucauccaugacgggaagguggagaaauguccuaaauguguccacucuaacagcucccuucuuccaccuucuucucuuccagacagacugccauggcgguaugagugguaccaucuacgaguauggagcccucaccaucgauggggaggaauacauuccuuuuaagcaguaugcaggcaaauauauccucuuugucaacguagccagcuacugaggucugacagaccaauaccuugguaagagcucccucaggacuugcuacuaaaucuggacccaacucugucuuuuggggacacuuuaauaacugugagguacaagggggaaagggugguggugacgcacaggcccagguuuguaucccagcuccauuggauuucauacuuucuggagagcauuacguaagccugaggugugauggucuuuguacucuagcaaguucccggcuaccuuucuuuacccuagggcaccucagauaccuugaccgugugccugcuugcuucccuugucugcaguaagaaaugacagagguagcugcagcucacuggcugagaaugccuccucucccccuagcccccacuagcaugagcccgucucuuggcuucacucuggagaagagucccgcuagcuugaagcucuggagauugauggggaaggaugggauccugaagugguggcauccaacaguucauucuuuuugguuguuuauuuucucauaacaggguuucuggguagcccuggcuguccucagacuugcucuguggaccaagauggccucaaacucaggucugcuugccuccuaaaugcugagaucaaaggugugcgccaccacugcccagcucaacaguccauucucaagcaaauguuaaaggcagacuagcucagcccugcucuuaacucaguauccauccaggaaagggcaccuagggucaggguguauaaacgaggcuggcaauggcuuaacccgguaucugacuggaaccaugucuccuuaaugucucuauccugucuuuucuucucagugagggcaaacagaagccuaagggccaaagccugauggcccaagggcaaacacuuuggggccaagcagacccaggccacuuggcuggcaccugcaggagaguuccugggcugggugauggcgcugccucuaauuccaggggucccaagggaacuggcgagcuggccagggccuccccugggcuccugaauucccagaugagagggaugugaauacugcccuccaaucacccgaagaaaguccucagccaccugcccaggggcuaagagacccaggcagcaggugugacuacccauauacagaagcauacuccugacuucucucccaaaccgccacugcccccagacuggaggcucagccuugccacugacucugucaccccgggaaaguccucccuucuugggccucacagguuccagcagucuggaggguguugaggcagguucuucaccucuucucuucucucucccucgucaagaacugaaugcacuacaagaagaacuugggccauuuggcuuggucauucugggcuucccuuccaaccaauuuggcaaacaggagccaggcgagaacucggagauacuccccagucucaagugaguucucauggcuggagacggcagccucuauggggcagaggcucaggggcugcagauauugguugacggucuccacgucagccacucaguuacucccgcucccccauccucaccccaguuugggguuuaauggaaugagggggaggguacaggaaauaggaggcuguggguaacugucugggcagcacauugaaggguagagaugugggguggguauagagaggggcugagauggcagauacacacugggccuauguauguccaugcaagucgugcgcuugauaaaggagauucccagcccccuucccucaagucucuucaucuuaguucugagcuauguguggcugcucuggacucacucaaguacacuccucccagguauguucgaccaggugggggcuuugugccuaauuuccagcucuuugagaaaggagaugugaacggggagaaagagcagaaauucuacacuuuccugaaggugagaguggguaauauggaggaagcuccccuuagcggcuuaggcccuggcccacaggaaugucuuggcauuggucuaguagacccaugagagggcuuggcagacccaguccuaucacccuacugcagacguaagacaggguccacagccuuccagucagcauagagauggacggacagucaaguguucuuguucccgaacugggcccuucccucagugccaguuuucucccuggaagggaggggaggucaggaggagccucaagucagacuaacgccccucucaccccugcuccagaacuccugcccucccacugcagaacuccugggcucaccuggccgccucuuuugggaacccaugaagauccaugacauccgcuggaacuuugagaaguuccugguggggccagauggcauaccgguuaugcgcugguaccaccggaccacagucagcaacgucaagauggacauccugucuuacaugaggcggcaggcagcccugagcgccagggggaaguaacugaugcccccacccuaccccuacccccugcccaucaugcaagggccgaggaggggcucuucaggaaggaagccacauucccagucauucuacccccaccccagauucucuuucuuauuacauaaaagacaagccuggcacaacugugugucugaaccacuguggacacgugacaauugucccagugugugcauggcuacacagccacguaucugccugcuugaaacccagggaugguccaucuguguuuacggcuuggcacaacacccucauauuuuuuucagcuuucuguuccaaaugagcccaaaggaaacacaaguucuagguccaaugguucugcucaaaccugaacaucauucuuggggccagcaucucccacaugcccacacuacacaccaccagccuccuucuuccuuccugaaggacccuccugagcccccaagcccaucccacagugcuccugagaccagccaagacaacugugagcgcgauggccguguaccccaggucagggguggugucucuaugaaggaggggcccgaagcccuugugggcgggccuccccugagcccgucuguggugccagcccuuagugcauucaggcuuaggcucccaggcagggacacuacccccgcgccucuggaggacaugcuauccucucacucuguccacugguaucucaacacccccaucugcccaguaaaggucuuucugcagcaguucagccuacuugga

SEQ ID NO: 6005 - RNA, 52156 nt, Mus musculus
guugaucuucaaguuggauuuauguccaagauuugugcaaacggcugccuagcaacagacagcuaccuuaauauagaccucuggcaccauaaacaucuaacuguggaggccggagucaucucagucuggggcccuucagcagacauggcugguguggccuucaucccagaucuugguggcucucaggaggcugccacaggugcaguggagagcaugacagcaucaggccgucccaucauucucuucugcucuagagacaaagcccucuccguaacuccucacagaggggcaaggagcagggggcucggggcagguccugcuacugagcuugaagcaaaaacggcacaugcacaugaguuggguauggucucuggagagccuggaaccaagucuuugagguucugugagaauggggucuuguugcaccucauucuuaggauggaagccaguggccucagcaacggauggcaggucaaagccaggugaggcuuccuugucuuggcaagaggcaggguguugagcuucuccugcuugcauccauaagaaccuggugggcgcccauggguggauucucccuggucuugucaacaguucgaggcuuggcuggggaugugagccagcuacccaucccagccucuccucugccaaggcuugggucacacagaacaugcacauggccuucaaacuuuuggcaaucugaggucagcuggcucugaaagaugaagguggaaccaaaugacccacugcagccucacuggggcccaucacagucauugucugcagacucuagauaaacaaaaguuuugaagcuucaagaucauguggucuggucagucucacacucucacauggaugccaaaucaggccuccccaccaguguaaacagcuagguauuguaugcuauggaguaccaggcugugucuaagacauucaccaugcaaucuauaucuagccccgaggaggaagaggccauuugucaccucuguaacagaggagggagcuaggacaaagagguauacaaaucugucccaaaucccagauuuauaauguucuggagcuaggauuugaacucaguucgucgucuccaaauccccaaaguaaacacugggaaaaaggggucagcucugccuaccgugccacccucugccacucacuaagauagccccaaaggacuucaaagacccucugaggaaaugucucucuguuguaccuacccauccauuuuccaagauggcacucccagagucccuagggcucacgauuccugacaagcuugcagcuccagagccuuuaaucucaauggcagacucugaggccagauggaguuuucuaaaguuccaaucuggucauguuacuguguuuuaaaacaucuaaggaauuuacacuacucucaagauucagaccagcccuccuaccacauucugcaaaggcccuacacuguggagaccucugccaucucuugccugccuugccccagucucucccuccuucaucucaggcucccucagaugcagccaccuuccuuuacacuccuauuaauacaccaugacuugaaucuuaaaagauuuuuuuucugagacaggguuucucuguguagcccugacuguccuggaacucacucuguagaccaggcuggccucaaacuuagagaucuuccugucucugccucccgagugcugggauuaaaagcgugcaccaccaccaacuucuugggauuaauuguuuucaaagagagacauuuaagagcuuagucaccagcuagcccacagugcucucauaauuaaacaguuaggaggcaaggccucaugggauaaaucaaagucacugagaaguacccuugaagguacuugaacuccagaccucucuuccuuauuucuggguuaacagaccuacucuacuacgagaggcaguaccaccaggccaagugaccaugggcugaaaccuuggaaguucugaguccaaaauacaucuuucuuuuguaucaguagauuaucuugggugcccgggcccagggauggaaaguuaagucagacugaaaacugccaaccaaggaagcugcugaccauagaggacuccaucaucuuggagucugugaugucccucagggccccagaaacugcuuagagaguaguagacaaaacuaaacagugacgguagugagguuucagaauagcucaauacugacuggugugucuguacuaaggccaggcuccugaggucuuggguagacauggaaacccuauuggaaacugaccacucuagcaagaaccugucaguuuaguccacggccugagaccugugugagguggaguguaacaaguagguggcgucaaugccaaggucacaguguucuggcacugccuugacuacugcugauugccuucagccagauuuacucuaagaucgggagcgacggcagugcagauaauuuaaaacuacuguagcuuggcugggaaagaagcaucaagcauaugccagggaggacgugccuuuaaucccagcuucccuucauaagaacugccucuggccuggcaggguggcucacaccuuuaaucucagcauucaggagacagagaggcagguggaucucugaauucgggggcagccugguuuacagagugaaugagugagugaguuccaggacaaccagagcuacacagagaaacccugucuugaaaaacaaacaaacaacagagagggggggggagggagagagggagagagggagagagagagagauauggagaugccagguggcugaguaaccuguaacccugcucaaagggucucugauacccgacuuccacaggcaccggcacucauauaugcacacacccacauacauacccacauaaccaaaacaaauuuuuaaaaaagcagcacagaacuuugcaagagauaauaagauguguugagggauuccucauaauaggaagacccaaaguaaggugggccaacucccauccauaauuucaguccuggaaagggagaggcaggaggaucaccacaaguuuaaguccaacuugguuuauuacauagagucccaggccaaaagaccuagaaauauaaagcccucugaccugaccugagagcaccaguaugccuucaggagggacugccuggagaaccacuuccagauuucuuggccauguucaggucaaagguacucggagguccugacccacugcauuagagcugcacaguucuaacuggcaguagauguuggcacugcccacaugauggugguuuggcaggcaugcauaacgccaaguauuauggggucauggcuuccacccagauuucaaaggacggccuggggauuggaggcaagaguguguauggcaggguccaagucccacugagcaacccgagagaggacaguaggcgaaacugcaaggaugaagucuaugcuguacuggagacuccaggaaguuaaaaaugccaggaguguagaaugguggucauggggagccaugggcaacaugcauagcuagccaaggugccaggccagagcuguggagcuucuguuugcuuuucuggguuuuagugucacucuggucugauccuucuugacuguacuucuugacucccuucugaaacagggauauuuacugugccuggcccaacacuguauacucaaguauggaaccuucucuuugaaucuuuuauuuugagacagggucauagcccaggcuaaccuuaaacuugcuauguagucaagggaugaccugggaucccugaucucuugccuccuccaccucccaagugaugggaauauagugugugccaccaugccugacuccuuuuguuuucuguaagggcucacagaugagucugccuugagccuuagagacuggacuuuuaaguaguuuuagaauagucaugaucauggggacucugggaagauagccuacauacacuuuguacuguaugauagaaugagucuaggagccagaggcagaauguccccaaaugccuucgucaccagccuguggaccccaaggagguggcgcagagugaaagaaaguuguguaugccccugcagagacuauagauucucccaguuccuccuucucuuucuuguuuugcuuccuguccaucaagggguggucaccucugcugugcucuccuggcaugaugcucuggacagccauaggcucaaagugauggggccgagugucugaaaucagugaaaccuugagccacaucucucauccuggaagcugauugccucgggcauuuugucccagacacagaaagcugcuaauacacaaggucuuuguggcucucauuuuucucugcaaaaguaucucuaccccuuuggcuucucagcuugggugucaccuccucccccaaacucuccuggcccuacucuaggucaggcccuuugaccucucacagaaacuugcuccuuuucugggcaagugcaauccaucuguuuaugugaguccugaaauucacuucuguucccucauuaggacaggaccauaucuguuuccaugugugagcagugcuggcucccagcacaguacuaacaugguagugccugcgccugcuccuuccaauuaucucacccuucagucaauaucuuuccucucucaauacuauuccagguccucugugucaccaagcucacaaaaaagacagucuuugcaagcaggaucaaugcugucagguaaaaguccuuccuacaugggggacccacacucaccuggcucugcaggccugucugggggcggguccaucacuugagagcucugauuccgaaucccugcacaggguggacgccagguguacuccggcugcaacaagauggguguuuaagaauucacaacugagccgggcgugguguugcacgccuuuggucccagaacucuggaggaagaggcauucagauuucugaauuuugguuagucugaucuacugagugaguuccaggucagccagagcuauacagaaaaacugucucagaaaacagacagacagacagacaaaacaaaacaacaaaaaaaggaaaaagaagaaagaauccacagccacacuccagagccacaaccagaacaguccuaaaugcacaggaacaaagugccaaacccuaaggggugcaucucacucagcuaagaaaaguggcuaugagaagugcagccuuugagguugugacugcuucccucuuuuguuuucugagauagucucacucuauagcccaggcuggacuaucucacuauguugcucaggcuggccccaaacuuucgaguugugcugggauugcaggcaugaaccacuacaccuagcuuaagcuaaucuccuaaacacaguaucuauaccagugcuuaaaaguguguauaaggagccgggcgugguggugcacgccuuuaaucccagcacuugggaggcagggacagucaaauuucugaguucgaggccagccuggucuacagagugaguuccaggacagccagggcuacacagaaaaacccugccuugaaaaaccaaaaaccaaaaccaaaaacaaaccaaaacaaaacaaaaaacagaaagaaaagaaaaaaauguguauaagggagaaaguauaagacauaggaggcaccuguacccacugagggaagagcugggcacaucagaaguggggcuauuauagagacugcagaagggacaggugacaacaacuaucgagagugagagaaaaauaugaggaaaggagaggagccaaaauaagaggagaaaaagcagaaagaccagagagaaaggaagaaagaaggcagggggaggggagagaagcauggggaaggucagagcugacucggcagccgaugguacucagcuggagaccugguggcaguccugccaggccuucucccuuugacaccagugguacugagcggcuaggagagcagcccagggccaggccuagauccuggcccacaaccacccugucucagaaaccacuggacagcaguuucuuaccaucucacuagacagagucuacaggaaggagggacacacgacucaccagauggaagaggcgagaguuggggugugggggcgggugcuccaugggcacaggggguggaggguaucggaucugggaccaguccuuguaggcauggugagguaccauggcuggcauggguggguaggcauagggauaggcgccgcagacgugcucagggugggguuccaugugguagcgcucucccgaagccugcaagaaagacucauaucugccacuggucugccaacucccaguggcauccaccucguugcccuguagccagaaccuuagcucucagaaggcaaggaaggccaggauacaggcagaggacuugggaccuggucauagacgacugauaaugacaguuaacaaggaaugcucugauggcacuucacuggcacaauaccagcauaacccccucccccugaagguggucagggggcaugcugcaugcugcccacacccuccagcugcucaccuuugcuuuccucuucugcuguuugagggcuuccuuggccuucuccuccucuuugagaguuuugagcuggaggaggagggaaaagaggccucaugguaccgguaguucagggccagguguagcacuaaggccucaccauugaugaaauacaaaguaaacccuagacagauggcugaggcccaggguaccacucaagcgugggaaguuccaggaaggggacuggggcacagccgaagcugugcuguuagcuguggggcccaaacauaggucaggagggcuguuauguguguuccuggaagcgccuuuucauucuacucuacuaauuuaccccguaggcucaucuacugaaugacaaagcgauacucaaggucccaucaacacugaugagucagagcuagaacucccuaccugaccucgacauuauacagaggucaguggacaagggacuggcagaggucagaagagaaccauggcgguagagcuggacagaguccagcaaguucccaggacccucuaacuccuaaggccaggguggcgcucucaccugggcauuagucagggugaccugggccugcagcuucucuacuugcuucuucagcuccuccuucucuucauucaugcguucacggucacuccguucccucuggaaguccucuucaaagaucuuuaccuggaggagauggggaugugaggcguguggaagucugcuagaggcugcaugcucaggccccgcauccauguuucgcacuggcuguggggagagagcugggggcauuggagauuugaguagggcaccucgagccccaaauccaacuuuaccagaacaauuccguguucuuuuaucuuaugcucuggacuuugagaaagggguuauuggcuggagaguuggaucagcaguuaagagcacugacugcuuuucccaagguccugaguucaacucccagcaaccacacgguggcucacaaccauccauaaugaauucugaugcccucuucuggagugucugaagacagcuacaguguacuuacauauaauaaauaaauaaaucuuugagaaagggguuacuggcuuacaauuauaaaguacaaacaugggcuggagagauggcucagagguuaagaacagugcucuucuagagguccugaguucaauucccagcaacuacaugguggcucacaaccaucugcaaugagagcuggugcccucuucuggccgcaggcauacaugcaggcagaacacuguauaaguaacaaugauaacaacaauaaugacgauguccauauagaauggagagcagagcuggcacacuggucagcugcuccugggaaugcaucagcucucgggccucaccugcuguuucagcaacucauucugugucacuaguuccugcuuccucagauggcccccaacgccuucuggacucccaaaagcugcaggcggagaugauggagaggccuggaugcugagggccuccuccagggccuggaaucaggaaagaagagacagaaccaucagcaggcgacccuacaagucagacccaucugaagaccacucacagagagccucuuuccaucaauacuguaaccccagcagcagcaguccuuaaccaaccucacucauuaccgcugcacugaaugggccacugcauugaagucucuucaucauccugcaggauaaaggaccucaugcccauuuuacucacuugaaaacugagggccagauacuaugacugagugucuugguuuguguuuguguuuguuuugucaacuuggcacaagccagaaucacuuugagaagagaaaccucaauugagaaaaugccucaaccaaacuggccaacaggcaagccuuugaggcauguucuugcuuagcgccugagauggcgugcucaucuuucugaggguggugccaccccccucagcugguaguccuggaguguguaagaaaggcugagguagccaugggaagcaaguguguaagcaagcaggauucuuucauggcugcugcugcaguuccugccugcagguuccugcccuucccugccuccugccucccucagugauggacuggggccgaaacaaagauuuacugaagcagcagaaacacuaaaggagacugcugaggucacacagcuagugagcaaacacaaggaugccagcccagcuguguucuuacccugcaggcuagccugaggucuucauguacaggcccggcucagcuccucacacccaagaccuagagagaagccuagcuuucugagagaagcugcauucucugccagcuucugcaggauacuuggccucagcaacccaucuugucucuagucacaucaacugcaauuucuacuuaguuucugcaaccaacucugcagaccagccacagccaacgcuggggcguggggaggaacugggagguaguggcgccuaccuuuaaucccaacacucaggaggcagaagcagccuggucuacaagaaugaguuccaggccagccagggcuacacagaaaaauucugucucaaaaaccaaaaccaaaaccagaaagaaacccaaacaagggcuggagagguggcuccaggguuaagaacaccggcuacuauuccagagguccuguguucaauucccagcaaccacaugguggcucacaaccaucuguaaugagaucuaacauccucuucuggucugucugaagacagcuacaguguacuuacauauaauaaugacuaacucuuugggccagagcaaguggggcugacuggagugagcagagguccuaaauucaauucucagucaccacaugaaggcucacaaccaucuguacagcuacagugcacucacauacauaaaauaaauaaguaaaucuuuaaaaaaaaaagagagagagagaaacccaacaaacaaaagacaaaauagugugcucucauuucuuuccuucuugccuacagaaagcucccaucuccugagaauccuucacugguuuccaccaaccccagucacaugauacuuuauagcucugaccaucucagggauggccauucauuaccaccuggacuuuagccccuagacaucagggacucccagugacaggucucuugcauugccuucaagaagugugcgugcacgcgcgcauguguugccuaaacaggacagccuauuuuagcaagaacaagaaaaaacuauugcuaccuuaggaccacagaauggggccaucaaagagagauccagggauggcuuugcugagcaagugacauucaagcuuggguaggcuaggcacugccaggagauaguggggccucagaggagggcacauguacaaagacuacaugggaagcaggagugaguccaaacuccucccagggcugggugugugggggcagggaagagaggaauggugccucuaagcccuuucaccaggugucaccucucuucagcucgaggugacagcagaggaaugggcucuguagcugagcucacagcagccauccccgaccugggguccuagugcccaccuuauugagccgcuggaucuccuucuccugguauucucguugccuugugagcgggcucagcugauccuguagguaccugaccuucuggcgcaguuccuuggccucugcugucagcugcuccuugucggucugcagggaguucaggguugguaaacaggggcaguccuggaggccaggacugccugaccuauacccuggcuuucccucuuucucagcaaccaucucaaauugcuugucugcaaaugaccugggaagacaucgcugucuuucagaguccauaugucugucucuuccacuccugguagugaagaaggcccucaacucuaaugccagcuuccucacugacuggcagagacucugggccccacacaggcccucuuaagcaagcuuccucaauauugaggcuaacgggaucuuaacgaaagucacagagggauuucaugagagcugaguccaaaaaaaaaaccugaguguauauguugucugugugaaauucucucagaagagugaggaauaccacagucucuuaagggccucagauaucugcgcauagaagagacugugcucauaggguaagcaggacagaaggcucuccagggaagcacccagaguaaaaggucaccacagcugagggguggaagcuuccaggcugcaccacacagcugcagcuggaauggcgaaggggaaucaagcaaacuccuuggcucagugagaagccaguguguguacggugacauccuggagaccacacagggagcagaauuuaaggucuccaucuccauuccauuuacuucaaaggaagaguuucuuugcuuuuuacuuucuuucuaucugucugucugucugucugugucaaaugacaacuugugagaaucgguucucuccuucuacgugggucccaggcagcacgugcuuuuauccccugagccaugucacuggcccaaauacccuucccugccuggaaacuaaaccgggcggcagugguaaaugcuauucaccaggcaggaaguguugauucacuucuccaggggcugaguuccacacacgcugggcaacuguccuaccacggagcuacggccccaaccccucagcccccacuguuucuuuauauuucaggacaaggucauacuaaauuaccuaagcaagcuuuagcucauucuguaguccagggaggcccugagccuuggcgauccuccugccuccgccuucccagaaccugggacugcaggccugcaccaugauucucaguuuaaaacagugguugggcugagucuggaggcggggucaggcggaccucugaguuagagcccagccuggucuacauagugaguuccaggccagucuaggcuacauagcaaggcaccugccucaaaaauaaauaaaaauuaaaacaguggauggcacuguagcauuaggagcaggcacaucuaaaaacaaaaaacaaaaagcaaaaacaaaacaaaaaccaacaacuguauuguuagcagauauguuuuuaaaaggucugggagcuggagaugguucaauagucaaaagcuaucguugcucaugaagaggaccugaguucaauucuuagcauuaacaugacagcucacaaacaucuaaaaguccagucccaaaggaucugaugcccucuucuggccuccaugggaccaggcacucaggagguauacauacauucaugaaagcaaaauacucauacacauaaaauaaauaaaucuaaaaauaaauaaaauucaacugaaauuaccucccagaggaccagggucuggggagggguuggggaaguauuccaggaacguguuagcuugucuguauugugcccuguggaucagugcucaucccuuccugugugaccuuuagucaacauucuacacaccaguggguaagugguuucuagucagaggugguucagggcagccugggccaggacaaaugggugaugucccggcuucuacuuaggccuggagagcaaggaaugcucuugaucacagaguucccaucggcaagggcagacuuaaccaauggagaggacugaucugucaggguccagggguuugucucccuuguagacaggagugaggaagagaggccacagagccaggaggacucuggcugagagugccaugcuggugcacucagaaccaagugcagugucucuacugcccauccucaagggaagggggagacauaggcggaggcugugcuuggacacggcccuggguaucacaugcuggcagaaggucucugagaugcgaucuguguugaaaauaucugcuuuaaagcuaggcaaagcagccgcgugcaggagguacaagcaggaaguagcacugucacuaaaaucccaaaggucugggagucaggcggucugucugucugucugucagcugcuucaggacucuggagggcugugacuggcagucacacaugacaaagcagaggccuuuuuuguuuguuuguuuguuuuuaagagcauugcuccacagcacaaccagaaugaggucccuucugcuuagucucugaucucugccccuucucuguuguagaacacacuuuuacuuaugaaccucugccugguugcucagcaucucuucuucagccagggcaagcuaguuuucccugauucuaucuaguacaguggcuggggcaggcugagaucacuagauaaacuaacucccccaguuuuaggcccuauacuacucugaaauuugaucagcacuucaccccauugaggccugcuuuugucuuucuguaucaggacagugucuuuuuauuuuaacagucucauauagcacaggcuggcuucaaacucacuaugcagccaaggauagccuugaacuucuucacuccucucuacguaacuccugugccugguuuaugaagcacaagggauugaauccagggccucaaguacuagauaagcacuuuaccaacugagugccagcuccagcaaggucuugcuauacagcacaggcuggcuuguaauucucuauucuccugccucggucuccugucugcugggauuacaggugugagccuacuaugcuuuuguguauguauauuauguauucuuuguauaguucuuaggacuuaaauuuuaacugcccaggggcuggagagauagcucaguggcuaaggacauuggcugcucuuucagagaacuuggguuuaauuccuaggacucccacggugagcucacaaccaucuauaacucuggucccuagagaugugaugcccaccaggucacggaacgcucgacccugacccuggcucacagaucccggggacucuggcaggagccuggaaccccaaagacagcauggcuguccacacuugccucuuccaucucuaucuucgauuuggccaggaggaguuuccggucaaagucacgcugcuucugcucccguucggccuccagcucaguuaccuguuucugcagguccaccagcuucuggcgaagcucugugaucuggaggagggguagggagggagugugaggacaggagaggagcaugcacccacugucccuccaccguccccaucucagccaggucacaagccucucagcccgccuccccgagccguccucggcucagcucccgggaacuccaucaccuucugcucauacugcugcuucauggaccggaaaugcuggucccacugcuuguucacuuccagcagcugugggcagacagguacugggguuagaaacaugagggaggaaggaaggauggacagccagauacccaccgagugccccggcuucccaggcgcccaaaguacaugcugauaaagcugcaaucugggcugccucagucccccacuggucaggugcuccccgcugcuccacccugaucuccagcugcgcuucacccuugcuaggcaagccacagggaacacugaggccuggagaguuacugugaggcacaaacaugacucuucagagggcucuuugaaaaggugugacaaucccagguguuacugucuuuaacacaaaguauucuacucugaaaauuuaaccaauggaaauacugaaccaggggcugaggcaggagaguguaucuguaggagaguguuugucaagaauguacaagguccuggguucaaucucugguauaggaagaaaaaaaucaaaaaauaaaaaaacaaaacaaaaaaaaaaauagccgggcaaugguggcacacaccuuuaaucuuagcacuugggaggcagaggcagguggauuucugaguuugaggccagccuggucuacugagugaguuccaggacagccagggcuauacagagaaaccccugucucaacccaccaccaccaccacccccgccaaaccaaaccaaaccaaaacaaaccaaaccaaaacaaacaaacaaaacaaaaccaccaccaccaccaacaacaaccccccaaaaugaacaaacaaaaaacccugguauacaaagaaaaaagaagaaaagagaaacacuuuagccaaguguacaaacauacuuaaaggcuaaucagccagacaugguggggcuacaccuuuaaucucagcacucaggaagcaaggcagaaggaucugucuugaguuugaggcuaguuuaaucuacauagugaguuccagaacagccaaggcuacauaaagaggcuguuucaaagcaaaaccaaaaguaaaaauaaacccuccuucuaugugugucagcuuaguguaggcuauggcuuacagcacaucauaaacagaucaugcgcagccauuaagaaaauaagacacuuaguacauccuuugagccuuaagauaaugcuaauuaugagccauacucuugacacagcaguuacucaggaaagaaaaacaacucuacaucacuauaaauaaaaggacaggagaugggagaagauauucagacuucagauuacuaccaaugacaaaaguacuuagacacgggagaacuggcuuaugcuauugaucugaacagaccuccugagacaauuguaaaagagaaaaacuuaucugaaaagcaguaugucuuuuuuuuuuuuuuuuuuuuuucugcauuaaaaaaaccaugucuguaaccucagcuacuuaggggccugagggaagaaggcugaguucaaggaucgcagaggcagcucagugaggccccagguucaguuccuagugccacagaaaaaaggaaaaccaaacaaccccaagggaacacagugagcugaugucagcggcagccaucuggagggagacucuugguucauuacauaaugaacauucuuuuccuucugagagaugagucaaucuagaauaugaauguaaguaagacuucagaugugugugaagaaagagggguggggaagaagaggucgggaagaccucaacugugugaggagggacaaggacaggcuaguggccugggcuggagguggggaggggcuugggagacagagaaugcugcugccaagggugugggagcuuccuucacuguuagccacucccacugcagcaugugucuccaaugccgacuguccugacugaccaccaccucucccguguccagcuuaccuuagccuuccuaggcucacccuuuuaauauacgggucugcaucuauauguggugagugugggugcccgugaaggccagaaaaagggguuagacucucuggagcuggaguuacaggcaguggugagcugguaugugagaguccugggaacugagcccagguccucugcgugcaccauuaccacugagccaucuguccagcucccuaagguccccaaauaauuucagccugugccacaaacucagucuccucagugaucccugugguuggucccgagaggacagacaucuaucccaugggcagaugguucaaugguuuccacaauaacucucuaaggugaucuaggcccaacaggaaccagagagccagguggggccuucgucccugaccucccaguuuggccaccuaccuccaugcguugcuguucuagcaacuucaccuucuucucagcugcuccaaaggcccccgcuucagggacuuuacucgccaucacacuggccuagggagagacagagccuucaccaaagugucagauaaaacuucguuccccagcccagugcucucccagggccucagccccuugucuccaaucucccugcuccucccacccagcagccaugucucagccacgaccuccuccuccuggaagcccacgaggaacauuccccuuugcugaugcauacuguggcugccagccucacauccucucaccagcucuuuccacagccaucuuccccacuuuaacucugaggcccugcuggucaaccccacaacaacuccgaauccccuaaccuaaaaggcguggcuuauauauuuuuuagaaguugugaggagccagugagauggcucagugagugaacacgauugucucuaagucugaugagcugagugcaaucuccagagccuaugguggaaggagagaacugccucagaccuccauacacgcaugcagcccccaacauaaaauaaacgccgugaaagugugauggaggcuggcaagcaucacgagcccagacacaugugccgagagcccgcaugugcagaugugugugcacaacaugccaucucugagauucuuuccaaauucugcaaccacaaucuaaucuaaacccaaaacccauucugcaaaacaaccggccagcauaacucaaaagugccaaggucauggaaaccaggacagcugagccacgucgccgaaaugaggagacuaaggagcugugauaggaaccccacgugggauccuggauucaauucuggaaggcagaaagggagggagugaaggaugggugcaucuggacagcgcugcugacggcagugcccagucugguaagaaccacaguuauguaagaugcuuggugagguaggucugcgguuauagaagccagccagggaagacggagggaguacgggaacacaacuccacacuauuucugccucaguuuaaaguuaccucaaaauaaaauguuuuaaaacugaacaauugagguguugagguaagaaccacaggacaaggcgagaagugcacgugcagugacugucgccagugucugcucagaccagaagcuguucugcacuggccccaucaacucucuauguccuaccacaggcugggcagaggcuggaagcagagccugugagccucuggugcccccuacaggcuauguccuguaaacauaccaugccaccuggagaggaaaggguaucuaucugauaagguggccucaaaaagggcagaugccugccccaggaagcucacugucaacagcaacagcuaaaggcuaugugucacuuaguuuuaaucccaacagaggcaggaggaucucugugagcugacggccagccugaucuacccaguguguuucagaccaaccauggcuacaacagugagcaacaaugccagcgagaggcagagcgagaaggcuuugcucuucagccggccacccccacaucugcuugagaggugacagaagaaucuuaauuguaugauggcacaugaccucuccaagucuccugcuggccccgcacauggaagagacaucccuucaggcaaaagagcccaagugagcucauggcuuugcagguaaauuacaucacugccccgggguggggagugagugaccaaggucauuacuauauuacauagaaagcuggcauuagggcuuauguugcaacugacugcaacucacuugaggagguaaacaacuggguuacaggagccugagggauggugagaguggagcaaggcacacuuggccuucacuguguggcagggcugggccuggaggugugggggugugggccagagcugaggcauccccagaccagucuuccucuccaugcagagcucuaaguugcgaucucacaagcuuaauacaauccccuuaggagcccugacacuuuagagacuaaccugacuuuugggaaggagacuuugacaagacaaaaugcaucaagguauugguacccagaaugagcaaaacacugaaacccaacucccaugagcagccgcuggacaauccaagucagcaagcgggagaagcaagcagccagggugggcggcagagccauguaauuugacugccaauagcucugagcacgugucucagagaacgggauacuccacguggggugaagacagaacaaaaagccaaggacuggucauaccacggaggcaggugcugcaccaggaaacagagucuaccaggcagaaccuucugccacuggaauguguguaggaggagaugugcucccucagcgaggggcagagcagauccuggguuugagagcuugggauacacaccugcugcuguccagccacgcccuucuugccagcacccucuggcuuuggggagcugggcugcccacagagucccucuuugcagcugcuguucaucaacaguuucuugagcuccguguuuuccucccuagauaagagacaaguggagaugucacaaugucagcccuggguuaagacacuugcaaagccaaggaucugcugucaaaggcacugcugcggugcgaccagaccaaaagggcaucuguaagccacccagaaggugugcaggcugcaugagaauccuuaacagcagaauuucccccaucuguagguugucuccacaccuggcaccuuccaguucuaugaucuuguucucuaagaaagcuccgccccucccuccaguuauagucaaguguccugguucagcugacgcaggcagagccugggcggugcaguaggucaugcucacucaccggcaccuggcacccccccucuuuaacauggaaagagcaagcuucuggcucagagcuaggguugauagagccaucuucacacccaccagggacucaaucccacuggaucugcucucaugguucucuaguguugaguacaggcccugcucugggugagaccuucuuuacaguuuacagcaggaaaggcuaccagcaaaguugagugugggcacgcacaccuaugacuccaacguucauuugggaggcagaagcuggacuauggagucugaggcggccugagcuacgcagugaguucccugggcuauggaaugagaccauuccaaacgaaacaagcagaaauaauaagugaaagugaaacccuaaguucaugagguaggcagugcuggguacucaggauguuugcaguguggacacagcccuucagcuuccauuuaauuacagagucaaauggcuuuucucaggccacucagcaaggacucagauuccuuuccuucggccuggguauccacccccccgccccacagaguuucucuguguagcccuggcuguccuggaacucacucuguagaccaggcuggccucaaacucagaaauccgccuacccccgccucccaagugcugggauuaaaggcgugcgccaccacgccaguguagugagacucuuaggaagucccugccucucucagggaccaucucccuucacguaauuugaguuagucugcaugaucugauggcaaaggcccuuugagauccagcacucacacacuccuguuucccuagagacaagaggcauugauccuuggugacaaguagacccuacggcucaccuaagacacccaaacucagucuugccaaggacagagaggcugggguaaaccuguaaugucuucccacaggucucaguccagagagggacuuccaaagaucccaggaagagcgagcagggaaugauggugaccaccagggggcaggagaauccugagccagcuccuacacaaaugucagcaguugucuccaggggaaggcagcuuucaaugcugucuacacccccacccucaagauaaacacggugcaagggagaaaauaccagaagccaaggagaagagccaugagaucugcugucagaacagagcucucagauguggcuucaucccaggaaccaguguguuacauuauucuccugcccuaucccucugccagucuccaguggccuggacuuaccgcagccucucagcagccagaucccgcuguuccaggcccuuguccagcuuggccuucagggcuucauucuccuggcgcagcugcucacauaaggucugugggguagaugagcagacagugguaaggauuagaagggguacaucccaaggcaugcugacaagggggcucgagcuacagccacuagguccaucccccaggcuuuucuuccaugggaaccagugguaaggaugccugauggagacucagagcuggguccugguccucucaaugacaauccccuccucuucccuuaacagucaucccugccuagacucuuccuccuuggcagcccuccgaggcucacaucucaucucuuucccuaaccaagguagauguccuacauucacugcuacauagaguaugaggagaauugugucaugucacacagggagauuccaaaacugcuggcuuccuuucugacuagcuuggguggauggaaggacagccuugcauuggaguuguugaacucuggguugaaggcugagaaagucgaaaaauuguuauuguuuuucaaugcccaguggauggcccugugccacauuugaucucaaaaaaaauauuuaauuuuuuuucuuuuuuaggugaggucuuacccuguaccccaguugggccugaaacuuccuauaucccucggcacugaaugcccagcaacccucuugccucggccuccuaagugcugggacuacagguaugagucugcaauguuuguugggugaaucaagaaacauaucagagaugcaaugaggaggaaugggauccagcuuccucuacccagaggcugagaaacagagagcggcuguggcccugggcagggacaccagggaacagacuguccugcuccugcccuaagggaaggccacagugacaguucacuuguuaagacuauucuugggaccucuagguaaacgcccuggguacaaaccagaugcuggacaagcucagcagcagccaaagaucaccaccuacucuaucagagagucuaagagcacaccugugagcccacuggaaacauugguuuguuuuuauuuuauguauaauguuuuuccugcaccaugcgugcaguguccacagaggccagaagagggcaucagauccccuggaacuguaguuagagaagguugugagauggaugcugugugggcauuaggcaccaaacccccacccucugcaaaagcagccagucaucucuccaacuuugucuuucuguuguuauuguuuuacuuuguuuucaagacagggcuccucugugcaucucuggcuguccuggaacucacuucauagaccaggcuggccuccagaucuaucagccucuaucuccuaaauacugggaccacaggcaugaguccacugucuggcuucguguuggucuuugagauggagucuagcuacacaguccaagguggccuugaacuugaaauccccuagagcaggcauuauggguagagccuccacuccuggcaugcucacucauucucucaccaacuauguaugaagugccaggcacuggagcaaaaugguggguacgguuucccugugaagacagcacuuaguagcaagacaaacuaagcaaacaaacuaccacuacccaauaaaacagaauugucgugaacuguuaagaaccaagaaaggaauaaacaggagacugauguaagagacuggggacaucagggaacaaagaucuaucugcacgugagugccaaaaggugggugcucagagugaucccagcccugguaccaugucagguauucucucucagggcucagagugggaacuccaaagccuuaguggccucucaaagagguccccucccuggaccuggcucuguaggcucucuaccacauacugccucuccagucuccagugagaggaugcucuguguacuccuggucauacgggcagagcagaacucacccgcucaagguuacacgggguggauucccuccuuucaucaaggucuacuggcacaacugagaccgcagaccgacuggcacagaaggagaagggccuacccagaagcagggagccuuaaugugagagcucuacccagaaggaagggguacucaaauccugagcagggccucaggcagccucauguucaucaucuuugaaaugguuaccaauuaauguaagcggaucauacuuaacugcaaagcccucgaaguuaagauggccugcccugaguagauaagcaucaucaaacgaagcuaacagucacccaucucccagcacuggguucuagauuacacaaaggccuccuuugacgcagugucccaggagggggacacugguaguuccaauccuuacaggacaggagauuggugacuuguucaggaccauacaguaaugaggaucaaccauucucccagcacagggagccuucuaagagggauuugaaaaaggaggcagggagggagagagcguggcuaagggucugagauuuuuuuuuuuaaaaagauuuauuuauuuaucauacguaaguacacuguagcugucuucagacacuccagaagagggcaucagauuucguuaaggaugguugugagccaccaugugguugcugggauuugaacucaggaccuuuggaagagcagucggcgcucuuaaccacugagccaucucgccagccccugagauuuuaaauaugacaaauuaaagcugggugaaguggcucaugucuagaaucccugcacuuaggaggcugaggcaggaagaugcugugagucugagguugggcugggauaugagugagacuaucucaaaacacuuccugcuggggacagagcauacaaagagcugcagugacagcaaagcaagccacagggggugcccagguagcagaggcaggcagaacucugauucaaggccagucuagucuacaugguaaauuccaggcuagcuggggauacaaagugagacucgggucuuuaaaaaaaaaagaaaacaaacaagaacaaagcaggccacacucagcccgccaggccucacuccccaggacacucacugugaaucugcaagaccugccucccauuuccucauuuccuucuuuuucuucccauaaauuccuuacugcagucaccacugugaacaaaaagcuccaaacaggccuaaaauccagccuuccgaaguccccauagcuaaccccuacagugggcaggaggcgcagggagauucuugcuggccucaccugcaggauggaggugcgcugcucauuuuuaugcacuuuggaggccaaccuguugaacucgagggccaugcggcccaggugggugaagagcuggcuguggucuggcuccucugcacacacgcuaaggguggucuccaggcgcugcagguggagcuucagguugcuguccucugggggugggggccccagguccugugggagcaagagcaugaucuucaccaagccuaaggcggcaaugccggccgauucuucuauugcuuccccauucuucaugacucaguuuccccuguggccucuguucagcccagggaaaauuuccaguuacacagguucccuaucuggagcugacucacagggcaggaccuaggacuuccaggccacuggcuggccuaacaccaccaaggccaucuuccuccuacgcugagucuuacugagugcccgagaguagucaguucgcccucccccaggcugggcauccuucagcaguauguguauguauaucacuuccguccuucauugcacagcaaaacugacaggagggaaggcagagagggugucucuaacuguaaugcacugcuuccugagcucagggaggcucuccuuagggggcugugccugggagaggaccaaacaccauguuucuaagaaucacagcucuaauacugcagagaaccccaaccuaguaaacgaagagagaacagccugggcagaguaguucaguacugcucucuccauucccucuagaacacugcuacugaagccacagcccuggucauacccacagcaguccuaaggaucucagugggaccuuucaauccuggcucauagacaggcguuaacuaggccucccaaccuucuccugcccaaggcccccugcaagaccccaggguucuguggaccucauuucuauauauccugaucuaccccaaauguucacacucuucaucaccuccggauccccuccucuaaaauaguucacagacucacccagcaguuccccccacccacccacccacuuccuacccccaaccacaacccccaaguucaggcaaggaaucacccagcagauuccucccaaaccccaauacuucagggaaucagagagcagagccacagggagcuacgguucccucaggcugagacaaugauguauccugacagagaacuugcucauagcagcccagucaguacauggcagaguggcagagccaggccuacaacugggauuuucucacuguaacccagggcucuaggaccugcuagugagcucugggcaacugaaugcucggccuguguccuaucagcaucacauucuaauuaaaaaaaaaagcagaaucagucuccaauugcacgucccuuuccuaccacaaaggacuaggaguggccagggcugaucucuggagguguaucaagugcucagguuucuccaaguagccuacaagcuuccagcaggaguugguguacuccugagcuggcguagacagacuuuaauggaaaagguaaguuaucagcccaugacugcgcgcugaaaccuuucugagcgagggaaccucgccugcucucagucaugucucaguccucagggacagaacaggacgagaugcauauggucccaggagacaaaacacagagcauccugacagggcgauccucucagcacugaagguuaaaugcuggugugagauggggugguguuugcaggugaaggggaggccaaguagagcuggcauagcaacaguuuaauggucuauaguggggcaugcuucaugguauggacuuaggagaagaggcaagagguuugccucacacgaaaacaaagcaaaacagaacagaauaaagcaaacauuaaauaggagggagggaugaggaaaagacaggacuuuaaggucucugacaaaucuugaagaucuuucacagcagcucuccaagucuggcauuuuaagaaagaacagaaggacugcacggcuggacuaagguuaaacacugcaagguaggaauguggauuugagcagccccuccgaagcuggagaaacgcgugcaccccacuugugaacacaaaguguaaccuccgggccaucugccccugggaggagccaaggacaagcacaaaaggguaaaucacucccaccccucccaucagcaccaggccgacccuuuccacaccuacagacccaagaggcugagucacuguaacugacagaaaggugauugguccagaggccaguggggcuggcaaguggcccaggcuuucacaacaguggggugccugugugccccaagcuggggaagucaccagcgggggauuugcauaugagaguaagaagcaccccaugcuauagccccucugugucccccauguaacuacaggggacccaagggaucugagugucgugucacgaaagggcaggugacagacagagaggaaagaaaaggaugugcuggaggugggggcggggaugccugucugcucaccaucauguucguaggguggcugccaguuucgggugaauucugcuccucaguagggaccacuucaaaguccgaggaggcgcccuagguagaaggaaguuaguagcugcccaugauaaacggacccugcccccaaggaagacagaagggcaaacagugcagaguuccuagaggcaauagucacacacuauucaugagaucacccaagaaccacaggacugccaucacccuccuugugaucugaggucauaccccuccauggccauuauuuaucagugaaacaggggugugggucgagccaaccuugaaacaguauuauuuauuugcucucucucucucucucucucucucucucucuguguguguguguguguguguguguguguguguguguguguguguguguguguguguuggaacggaugaggaaaccaaguucacagagucaacacacaagccaagacucugcacaagcuggcagauccugccaaagcaaccaagcuaucuccugggcucaggugccucuugucacccuggcuggcagcagcuacuacagccaccaccaagggaggcccugcaccagccucaccaacucaacccaaaggucaucccaggagaggacugaccugagaacacuaaggccgcucugcaaugugucaucaaccaaggcgcagacuucacuggcuguucaaucagcugaggagcccagaguucaucugaaccuggcucuaagagacccuuaaauguggcgugacuggggcuggggagauggcucaguggguggaacauucgcuacaccagcaggaagaccuaacuugggauuucccagcacccauauaaacagcacagcugggcaucccuaacucacagcucagcacgggaguggacagagacaagaggaucccugggguacuggcuuaucuggagauggcaagcucuggguucagugaagagauguaagggauaaagcaaggagcaggagaccugaugcccuccucuguccucaccagaacacacuccacgcauauaccucuuccuucauaccccaccaaaaaacccccaaaccaaaaacacccuccugaccugcuuucccuguccuggaugggguaggacagaugggagaaaccagcccagcuggccaccagucagagccaccaugaccccaucuguggucucagcuuggaaaagacccaccuucugaccaucugaaggaucuggcccuaugaugccaggcuacacuucuccauugagccugcagcacaugguuucugagcaucuuggaaguaugugucugugcccaguuagugagcauggucacguuagauagcucaggaaaugagagaaaacuccuuguuugaucaggaccuuccuggucaugagaaccaugacuuucaccucaaaauggcaagcugucccaucccagcgcuccagacugauguguggcgggaagagcuuuagguaaccagucacagcuccaaaugcaacuuacauuggacggagauuuggaggcuggcucgggcuucuccauggaguuucccgugguggcgguggcgguggugguggcggcagugcugguagcaggauguaccuggaccuuuguauccuguccuggaaaaucaagacuguggcuaaagaaaccuagaagggaagacgccugaacccagcccccaggaagauggaagcccucugacugaguucccucuugauuuagagaaaagggaggcugucccuuuaagacaagaagucacgugaaaugccuggccuggguaauggaguccagagccugggcagagaccccuuugcagaccuaguuacuaggaaaacuccaagguggucaugguucucugccucagggaucuagaaagaauuuucaguuaaccaagugcuuucuuucggguuuugagagaggcucauguaacauauguugaccucaaacuuggcuucacgcagcucagaggcuggccccaaacucaguaugcagcuaaggaugacauuggacuccuuaucuucuugcuaccaacucccaacuccaggguuacaggcaugugccaccgugcaguuuacuccgagcagcugaauacaugcacacuagugagcauucuacccacugagccuuaacucccuacgguguucucauggcagccucguagcauuccuguuuuaaagaaaggaaaccagggucuggcaaggucaucaacuugacuagucacucugcuagcaacuguaaaaccuggacucaaugcugggcgugcagcacucgggaggcagaggcaggcggauuucugaguucgaggccagccuggucuacagagugaguuccaggacagcuagggcuacacagagaaauccugucuugagaaaaaaaaaaaacaacaaaaaacaaacaaaacaaaacaaaacaacaacaacaacaaaaaucccuggacucaaaugcacucauuuccuuacuacuggaggucacugcugcagaauuaucuccccauggcccugggcaguggguucaagaacgcggcacugacaacaguaccacgggcucugacacauccaccuuucucaucuguccaguaaguaccaugacucucagaaaggaugcucucacaggggccugggaugaguccugaggacuagcagcaggaagugcucaagucuggugugggagaccucuuggucccagaccuugcccuggacuggagacgaacccuggucacugucacccucuccuuacgcagaacucauaggcacugauaaaagcucacaggcaaggacagauucuucucugggccucagucuuccugauuauaaaacagaagggaggaaggggacagaggacuuucaacuccugugccugguggggcugggccugccacauagcaguuguggauuccaugcugauaaaacgcuaagguuuguccuaggugccguggaucacugugauagaucacuaaugccugccagagcaccagcagugcugagucacugcagucuucugcaguccccagaagaucugacuuucuauggaugcuguaaccaaaagauguacacagggaaaaggucugcaugggaauggguaggcccugugguguucagggccugggcaggcuguauucagagaaggcagggcuucuggacucuucugguaccugugagcucagccaggucaucaaaggagaccaaggagggggcagaugucgguggugacagcucgcuguccuugaccagcuccucugccuucugccggagucuggacgcuuccaucugagacuccuccagaagcuccccuagagacaaggcggagaagcacaggauuuauccagcccaaagcacggcucuccccaucccugcccuaaaccuggcuacggacugacuucauuccugcgguggcugugugcaguccaagccugugccaaacaggucaacauaagagucuggcagugggaccuaaggaaaccucccaccucuggacccuauuccuguccacccaucuccacaucuggccacucccaucgccccugcagaaggcaagggguucucaagggacugccugcauucuaagucucaguuucccuuuugcagcaagagaaaggaaaacucccaacucccaccgacugccaaagcaaguggguucugccaagcagggaaaaacgcuuggaaagccagggugccaggccuuccacgccaaggaugaacacaaagaaagugaccuccagauacagugugaggagagugaggaagucagugaaggcccugcaccaaggagaagcaugcagugcagcggucaggggugagcaaggacgggggaggguugggcuggacaauggggaucgcuugagcggaagcuagaggaacaaggccaagggcccugcugcacugagcucugggccagcucugcuccuggccuggcauccaagcccuggguucuggggcugcccuguacauuggcucuccuuaucuugcacacuucauuucuccaacaggagaccauucuaguuccagaucuacaaauugggccuucugcuccucuucccauucauguuuuccuccuggucccucaaggacacccuuuggagagggagaagucagggcuggggaugccaucaccaggcuacagaacugcacacaaaugccaggacccaacgcugggucacagggacagcagcgugacgggcagagguacccgcccgccucugugagggggcuggcguugcaggcugugggaagagggccgacauagggauggucauggucugcuuuaccuaacaucuuuaucccuugcauuuuucccuucagccgaguauucuccuccacuagacguucaaaagcugcggacaccucucccagaggcgugcugcccccugggucguagaucccguaggguccucucccuuccaugaggguggcucaaccccugccgugacggccgccuagcuguagggacaacagcagacaucagagggcuggccaggcccuuaggucaucguuucuggggaugaugcucuaaucugccaaggcucuaaaaaguacuccccaugacccagagcagaauaacucccacagccuggucuaaccgcaguauugcacaguacagcagacaccuccuauguccugcuucuauuagugcaaccagagcagcagccacuucuuuuaggcggugcgcugcacuguggcucauuugcaauggcaguaaaaccaaguguugggugugagaaagaaucugagaaagagucaugagaggcccgaguuccugccugcuugguccuucauaaugcccaucacaauaccaguaaugaacaccccaaacauacagcauuuaaguaaguggcuuggucaugaacuggcuauggggcuaggggagccccucuuccucuccuggagggggaaugaaagccugaaacucaaacaaugaucucuaaggugaggaagaaaccccgguuaggauauaauacggccaaccuccuccucaggucgcaggucaugacugcucugucccaucugguucuaagcgcgagaguuucccagcaaaccacuauguggcacacuuuccgccuuaagcuauuguuuauuugcuucauuucacuugaagccauccugcaagcacugcagucuccugguccugagcagccuucguccauucauuccaccacaacuucuggguuagauaaggcugggucuaaguugggugcuaaguaguagucuggguacagaauaccgaucugggugcuggguaccagucuggggugcugagcauuaacuccaaagagaguuaaucuauggagaaaccauagauucgggggcacugagaucccaauaucaucagcccucaguaaaaacugcuucagacaggaaccucaauggccauguugaccuccacacuguccauuaaagacaggcaugcagcaggguuaaugacagugaugucaccaccauucauuaccugcauguuugucucugaugcauucuguugggugcccagcaacccagcaacgcucauuuuauaaaucaacaacagaggccagcaugcaggcaucagaugcagagcuuugcccggaagggucacccuugcuagauauacaugauggcaauccacagcucccacaauacaggccagaguggcagaguccaaacucauuuguaagguaggcccagaccaucaaauagcuucuugcucagugguucucaaccuuccuaauggugugaccuuuaauacuggucuucauguuguggugacuccuaaccauaaauuuuguuuguuuguuuguuugguugguuuugguuuuuuugagacaggguuucucuguguagcccuggcuguccugaaacucacucuguagaccaggcuggccucgaacucagaaauccgccugccucugccucccaaguacugggacuaaaggcgugcgccaccgcguccggccauaaaauuaauuuuguugcuacuucucaacuguaauuuucuacuguuaugaaucauaauguaaauaucugauauacaggguaccugagcugugaccccugugaaaggucauuugacaugacugcccccaaagggguuaaaauccguauguuaagaacugucacucuagcuguuuccuucaguguuaagaaccuucaaugcuggagauggaaugaaagccucguauaccacuaucaacacagccacacccacagccccaaagucagcagacccccuuuaccaagaguguuggaggaacacacuuggccagaaggaaaaacaaagcuauaacaagugccccacccccgccccaaggcugacaaacaagagcugaacacccacugcaagugguacccacacccugcugagcccugugaaguaaaggacagcugcccacacauccacauaucgcuggcuagguuggacugguuuuuuuuuuuuuuuuaacucgaaaggucagcaugcacugcagaugcacugauguacccuuggcaaaaggagacaguguaggugaagagccagguaggaccagcagacagcugggcgcucagaccucuacccagcaugcucucugcucaccuaugcuugucaccacgugacugcacccggcuggagccagcaucuguccauuagccuaauacuaggcuuuuccagucaccagcacaggauggagggucaucccaaaggggaacagaguucacaaaugaagaaauggaggcuggauacauccuggguggcaaguagcugcagguggccuaguucccagcccccacaccuuaggguccacagcggacucaaaguuauaggacaguuuggucacuuucugugugacuuuuucaguagacggaagcuacagggaagcagagaccaagcccacauuugugccaggcuccuucggaaagcaguuaaguguagagguucaauacacauccauuucaaggcccagagccagaggaacuuaaccuaccucccaagaggcuguguuuaaagcacccagccagaccagccaucacugcugugcacggugccagagugcuaaccccacacuucuaagaucucugcuacugucucccagagacacccagccaaggccagguggcacacuggcaugcagggacuaacaagcaaggguucauaggagacuggacagggcaaugacccccaccauggccuugggggggaagacaagaggugggggaggggccaggcucccuucaggcucugggccuugacauggauguguaucggaccucagcccuugcugcuucuugaaggagccuggcacaaaugugggcuuggucccugcuucgcuaaaguuucuaccuacugacaaagucacacagaaagugaccaaacugucccauaacuuagacucuugagucuccaucuccuuauggcaaccuccucuucugcuguucucccauucuauccacaguucuuccauucuguccaucuguccaucccucccugcuaccccaagcccaguaacagaaguuccaccuacuucuauuuuccccaguaauuggcuguagccacuuuuauuuaaccaauaguuuuaaauuggggagcaagguuuauacaacaaaggcugguguaugugagaauucccucaucugggaacagcuagaucuugggggucagaauuuagcauuuguauacacaccaucagaccaaacccccaaacucuccauucacccgagcacaguaggaggcagccaccuauacagaagccaccauucagcaagggaccuuccuacagggagacaccaacaccuugcccaaaacagagacagacacugguagacauacagccagcagaccuaagcaggccuugggcugcugagaguaagcagcucuucaugccuuucccuggacuagauccggggcuacaugauggaacuagagagguccgguuugaggacagaaaacgaccuacacucacugaucaaccaacaauaccaagcaugcagaugaagggaugcugugauuuugaacucacuauggcuggggagcagcuaggaguaugcuuggggcaggagaguggaccccucccccccgcccccaucccugacccacuuccaggagagcuggaagggucagaaccacauuaaauucacauucagccccugacugucugagucugcauugccauaguaguggcugagaaggugggaucaggcaccaagaacaacgggggaguucccugacuccaaagucaugcuaauuugcauagccacuagcauuuauagaguacuacaucucagacauuguuuuuucaccugacugucccaaaagcccugggaagaaggcauaggugagagacaagauuaccaagcucaguuugggggcuuaagccacacuauugucucugguuucuggcuguauuaggggagaggccuggagacagcacaggucaccuggcacaagggaacagccccaggacaucacuuuaugguagcaaagucucagcagaggcagaguuaugagacaugccaguggguguggucagaacauagggagaaagaaaguucagaacagaaucugccugcucccuccuugguuuuauguccuuggacuccggucuucuuaugcaaggggaggaagccugaaugagacuuagagacgcuggcuaacuagauaaauguggguguuguccaauggccaaaggacgggagugacccaagccucaugacuuagagcaggccaaggagcagagaugcacagccguagaaucaugaagguuccaccuaggaccaggaaaggugagaugaacaggccacacacuggcacggucuuauauauuacaaugcacccugaggccucacccguaccaggcccagcucuguccacccugaagcuaugggaugcugggccagucacucauucauucugagccucugcucucaucugcaaaagaggaauaugaaaaccuacccagggaggggcuggcaagauggcucaguggguaagagcacugacugcucuuccacagguccugaguucaaaucccagcaaccacaugguggcucacaaucaccaguaaugagaucugauggccacuucuggugugucugaagacagcuacaguguacuauguauaauaauaaguaaaucuuugggccagagcaaacagggacugagcaagcagggacugagcaagcaggguugaccggagcaagcagagguccuaaaauucaauucccgacaaccacaugaaggcucacaaccaucuguacagcuacaguguacucauauacauaaaauaaauaaauaaaucuuaaaaaaagaaagaaagaaaaccuaccuaggcuaaggugaagacauuagacagugccucugugcacugagguaaggaguucucauuuuagacuuuauuuccuaaacacgauuuacucaacaagaaacacacuucacaaugaaccauccaauacagcgagcagggagcaggcauucaguaaaagggcaagggggcccucccuccacuaugugcaacugaccuaagacccgccccugacacuccauccuugguuggcuuuuauuuuuauuuugccugugugucauugcucaggagccaucuaccaucuuuuuugagcagggucucucacugggacccucagguucaaugauuuagcuaggcuggguagccaagaagugcccagggaugaugaugacgacgaugaugaugauguccuccuccuccuccuccuccuccuccuccucccccucuucuucuucuucauuuuauuuauaugaguauacuguggcugucuuuagacacacuagaagacggcaucagaucucauuacagaugguuaugagccaccauguguuugcugggaauugaacucaggaccucuggaagagcagucaaugcucuuaaccacugagccaucucucaaacucagucccuuucacguuuauggaccaagcacuuuacucugcuucucccccaggccccugcuauuuauuuauggacuguggugcugggauggaacccacgugcuagcugaguacucuguugcucagugauauccccaguuguucuuaguuuuuugagauggcaucuuccuacauggcuagccucaaacucagaccucccugugccuucugaguccugggauacagccacauccagccaaggacagcgcuggacuggaugcgacugccuccguuucucuagugcuggauccuaggcacguuccaucaugcuugucuggacuggacauuuucaaagguccuuucuaguucuaacaauccaggauuccuacugccgcagcccaccuuucuggccuuaacagagcugucaucgguccccaggucauccucuacagccugagggauucuagacuccucagucuggccaugaauuuauucagggaagcacaggccuugggcugauggcuguucacaggcccaguuucuacaagacaggcaggguuccagcugaagcuggggacugugucccucuagcacagcacauaucccuccccaggccucuccccucuucugugcuacacuacagaaggaguccuuacuguccccaugucacacugccugacacccgagcugggacucaguuggguaacaaugacauacucgaggaugcucaggagggugaauuaaugacacgaaaugacuaguucagcaucaacguguaccagguccuggcugaaccuugacacacauuaccucacccagaguugacugugcuuaucccugcuuuccaacaaggaggccaauccaccugccuaaacaacugcaggggcagacucagaggaguuaagucaucugucugaggacacacagccuauugugauaccacaaauaauccagccuccagugcccagggaggcaggagguagaauccccaaggaaaggccagggcccuggcuuccaucucugucagcccugaccugcagucaucuugggcuggaagcagccgaggagauggggguucuacaagacugaauuugggguggcgaauaagcaagucgggagugggccuaccucuccuuuucucagggaagaugguggacauucagacggagcaugcuuaccaaaagcagccuacaaucuuucagaacaagaaguguguucugcugggagaaaccggcaaggaaaaacucccucgguccuacacaaacaucggucuaggccucaagaugcccaaagaggccaucgagggcaccuacauagacagagaaugccccuacacugguaaugucuccaucugaggucggaucuugucuaguguugugacgaagaugaagaugcaaaggaccauugucuuccaccgggacuaucaccguuacauccgaaaauauaaucacuuugagaagcgucacaagaacaugucugagcaccugccucccuguuucagggauguacagaucggagacauugucacuguuggaguguccauucaauguucucaaggucaccaaggcugcuggcaccaaaaugcaguuucggaaguucuaaggggacucuggccaaugcccuagaacaaauaaaguuauuuuccaacuuacaaaaaaaagagagagagagagugaauuuggcacuuggcacaacgaugccugcacugcucccaauggccuguaugucucaggucccaaggguaaggaacaagaugucacguuucucaugcuagccauagcuaguaaggucuagaagcucaaggcuucccugguggcugaccaggucuuguuccuggcauugcccuaucaccugccaaucgacuacccuagcugcagcaggcccaggacuggacacaacacucagguguugccuccugaacacagggauuuuugcuuccacacuuucauucguauauguauaugcauauuuguugacagagcccuggcauucacauguguuucuuaacaguugggucuccuaaagaaaaaaaguagcugcuauaguuggauagugacugucucccaaagccccaaaugucacaaagcuuguucccagggugccucauucuggcugaguaggugggcaacccugcucuccaccucuccacacgugcuucugcugugcuaugcugucuuaccacaggaccaaggcaaucacaagugacuauggagcagugccaagacugcgcaacaaugcagaccugugcuccuucaagugaucucaggaugacagugaccuuuaucaaugaugucaccaaccagccugugugucugcaggcaugcugagaaucaggaaucaagcccucucauagagaagcaaagcuggaggcuauuucccuucuccaaugugcagagcucaacccacccaaugaaccucuaucaagguuucuagagauuucugcaccagccccaauaggggcuggaugaaaagugggacugguguaugcuucauaagagcaaaaauauccugaguggccaucaaaaggauauugauaaauagacuaaggugccaucaaucuguggaacacuauauagcaaucaaacccaugacauucacugcuuugugaagacacagaaaaaaaugcacauaaaauaaaaagccaaguguacaucacgugugacagggcacauacccugaauauacacaacaaauagggcagaagaaugcaugccaaaccccccugguuaacaacucuagaugaggcccagcugagggcugcugucuucucaagucuuuccuuaacucuguaaggcagaucuagacuccuauacaauaggucuggcagaggggacaacuuucaccuuaggcagagcucauccaucuuuccuuuuuuuggucuuugagacacagucuguucucuuauuugcuaugucuguacuggucgguuuugugugucaacuugacacaggcuggaguuaucacagagaaaggagcuccgugagauccagcuguaaggcauuuucucaauuagugaucaaggaggaaaggccccuggugggugggaccaucuuugggcugauagucuugguucuauaagagagcaggcugagcaagccaggggaaacaagccaguaaagaacaucccuccauggccucugcaucagcuccugcuuccugaccugcuugaguuccaguccuaacguccuuggugaugaacagcaguauggaaguguaagcugaauaaacccuuuccuccccacuugcuucuuggucaugauguuugugcaagaauagaaacccugacugagacaguacccaaggauggcuuaaaccccugacccuuuggucucuaccucacaagugcagguacucacagagaccaaaaagggcaagagaaaaucuagacugccuguauguaccucaggccaggaacaagcacaaagcuugggugcucacacccaacaugaucccagcucccagaaagccaaguccagagggcaaggccuaacccaagacuaguccuccaggaucaaagugggucuuaaaucacaguaucccuucacagucccaaugcuccugucaccagcaagccucaaaggguugauuggcagccuaucuaccacauccacuguccuucauacccacauuccuccccucagcuaaagcccagaacugacacuaggcaucacugagccaggguggccuugaccaucagcugagaggccaacgucaggacaagaggguagccuaucucucagagcccaaaugccacaacuaacuaacuuccucccucccucccucccucccucccucccucccucccucccucccucccucccucccucccucucucccucccucccucccucucucucuuucuuucuuucucuuugguuuuuugagacaguuucuauguauagcccuggcuguccuggaacuuacucuguagaccaggcuggccucaaacucagaaaucugccugccccugccucccaagagcugggauuaagggugugccacagcuauuuuaugcaacccuguaaguccccucucaggggaagaugccagguuuugagaacucuccuuauaccaaauauggugggaagaggacacuggggagauagcucagucaguaaagagcuuaccacacgagcacaaaagccuacguuugagccccggaacacacauuuaaagauggcggggcagggguggggggggaguagugagguggcugaagggggugcuugcucccuaaacugacaacuggagcuugauaucaggcccccauaugauaggagagaacccauuccuuuauaaguuguccccugaccuucacacagauacacaauaaauguaauaauaaaucuaaaaagccagaagccaaacauaguggcucacaccugcaguuccagcaugaaugcaaggccagccuggggacacugucuauaauccaagagcugaggcgguggacgaagggaaauucccagaacugacuagccagccaguguagccuaauuggugaguccuaggccaggaagagagagccugucucaaaaaacagugacuggcagugagccgaggcuagccaggugaaggucagggcagagggaacuacaggcccuugaaucaggggcuccuccauuuuacaagaaucaucucaggguccagugacugggccccagagccagcacucccucauccccacgugccugccaaggcugaggucguguuguguccacccuugugcuuagcagacaaagugccccagggcucagggaauagccuggagacaagguuagugagcgaaggauagccagcccuucagggacagccaucagaaaggacgcagacaguccucagcagucacccuuuccagucucuggugugaucguccuguggaggucacgggaagaacacagagaaauaauuuccuccaacagccugguggcugccuaggucugucuauagcuggagacaugacaccucuccuggguucaagauagacagggagcagaggggcaagccagagauaucaccagagggcacagaaaggccuggcccagcuggagucaauggagaccacccaaugaauggacaagggagggggcauccaauggcuggguuuuaccauuugaagaauucaucuaguuuggauuuuugagacaggggcuggcccugaacucaaaacauuagcaaagagugaucaugaacuucuggcucccaucaccaucuucuuagugcugggaucauagguguuccccaacacaccugacuuaggugauacugggacuagaacccaaguucacucaugguagguaagcacuccacuaacugagccauacccuccacccaacaucugggacagagcaaaggaccaacacagagagggcuuggcacagaacgcaggccaggaaaggguuugaggugaguuauccagaggccugggaagugggguuacuugccgccuggggcuaagacucuaacagccucagccauagccucagccaguaugcagacagaucucccacaaugcugaggggugacacugccaucccuuagagcugcgugcagaaccuaccuggucugcacuaggagcugucagucacaggggaguaggagacaguucuagccucacaguuagcacugagacccaccagcucggcugcagcccagccaucugaguguccagacagacauucccaugccugggaucuuuggggggucuugcccagcccaguuaacagcuccccaacuaagcacaaccuuacacacuaucugcuauguccauccagcccccuaaaaggcccaggcccuacucuguaccuuccaucuuuccagggcccccaucacuuacuucuggaaaucccucguuaucaaucaggugcuccugaaagacuuuauacccaagccacauccacgguggcuagccuguccccuggcuccugaugcugucacaaagagcucccagccaggaggagcccuggaaggcaaaaacaagcucuggcauacagauacagccugaccaccacccagcugaaggcagcugaaacacuuccuccugcgauccauccuagaacucacgguuggagaucaggcgggccuugaagucagagagaucugccuuccucugucuccugagggcagggaguaaaugucugcaucaccauacuuggcucacaaauaaaucuacuuuagaucaugauaaaugaaugaacaaaguaguaacaugacagaaagugagagggcuguguguuuugcauaggaagagcagggaaggcccccucucaggaggugacauuugagcugagacuugacagauaaggaaaaagcagccaugggaagggcuagaaacuggucagggcauuugggauggcaggcauaagggcucagugugagaacaggcugagaacacacacggcugggaaaaagcagguagcagggccugccaaaucacagugggcacagaagggagccagcacccaggggagggaggcauacaaauaaccuuucagagcaccaccauacucaaaccagguccgucugacccagccgggacauccgggccagagacacaguacugggggugaaggaaugagucagacccauggcuuccuggggccccaagggagcugcuacgggcauccagggacaggcacccacacccacaggucacccacguggaggggacaacaugaccagauauauaaaaauacugaaugcucccaucuguugcucccagaggguaaagauuaaauguguccacagaggacuaauaccuaacuaauuucccaggacacagucaugacgacagucuaagccagcagcagaacauagcccuugggacuagggguguacuuuacuugguacagggcuugccuagcauaaaugaagcucuggguucaaccccacaguacccuauaaaccaggcauaguggugcaugccucuaaugccagcacucaaacugaugcaggaggaucagaaguuuugaaggccagccugggcuauaaagaacccuauuacaaaauaaaacaaaauaacaauuuagaacuggccagauagcucagagaguagagguguuugucacagcaaccugaguucaaguccagaaaccaguaugauagaaggaaaaagacaacuggugaaaguuguccucugacuuccacuuggguauggauacccaggcacacacucaccuccaaguacaaaugaauacauguaaaauugaaaucggacagaggguccagcuaaaauaugagacacuaucaggucagaaagaauaaaugacaucaggcaugguggaacaccccuguagugccaguaggcacagagagcugcaggguuaaggucagccuggacuaagaaacucucucucaaaauaaauaaauaaauaaauaaauaaauacgcaaaagaguaaauaauuucugaauguaaaaacuacacauuuaaaaaacuuuucaggccaggcagugguggcgcacaccuuuaaucccagcacuuggaagggagacagaggcagguggauuucugaguuccaggccagccugguuuacaaagugaguuucaggacagucagggcuacacagagaaacccugucucaaaaaaccaaacaaacaaacaaaauuuaugguuaggagucaccacaacaugaagaccagcauuaaaggucagaagccaacuucucaguguaagguuacuagaauuaccauuaugcguuaguuuuacaggccauuuacuagauacaaaggaacgcugagccugcuuagcuagugugaauauuccacucucccaacacaauguccucccucaaggaccaaaaaacaauucugugaguccuccgacaguccacucacaagugugaauuccccucuaccacaccccucauuguuggcacugugaguaagagcugaucaaaucccacucugacugacugugaaaucaaaaugaggcaucgggaauucacacgguucccacacugccauucaacaaggggguggggacggcugcugcagagacuuuugcuucauccacaaaagucccucccuccccuuuaccaaaacaguuccucagagacagcaccaaauucccacccacugccggguacaagaugaauacaggcacagcacaacccacuuccacacacgugaucucacacagaaacauagaacggucccacggugcacggcuguuaaacacagcccaaaguagaaaaaagaaucacuccuaaauuauucccagaaacucacuguaucuacccagcaccugugugcacuaaagccccuuacaaaacaagcuuaauggggauggaacagggggcuuugcagccaacaaccagguuggaauccugacuuugcaauucacuaguugugugauuccaaucugcaaguugcuugguguugcuuuaaauguuaucaaaaacucuauuaguucuuaauuugacccgaccagcccccaauaauuaagacugaauaauuuaagauuaaagagauccgaacagcuccagcacaauuacuggucgaauuagccccugaucuauuuuucuaaagcuagacaggcuaauucucagcuguacucaaguauuuguuguuuugaguuucagcuuauuucugcucuaucagucuguccuucaggggcauuuuacuugacacgugcucccgguccaucaugucuaauggagaccuccugcuuucucuuuuccuccucuuucucuuuucgucuagguccuuaccugcgaccccugaaggugcgccuaccucuauuugaaccaguaauuaucuguagccacuuuuauucaaccaauagcuuuaaauuggagagcaagguuaacacaaguccgggaaauaaccagaucuuggaguucagauuuuagcauuuguauacacagcaccagaccaauccccaauaccuggguuuccucacuugggaggugaagauauaaaguaacauucauggagaaaggcuggccagauggccaguaaagaugcuggccacugagcccgaggaccugaguucgaguccaugaacccacaggaggaaucaaucaggcaagcugucggcaaccuuauuacuugcaaacaauaaacaaacauaauuaaaaaaaaaaaaaaaguaagccgggcgugauggcgcacgccuuuaaucccagcacucgggaggcagaggcaggcggauuucugaauucgaggccagccuggucuacaaagugaguuccaggacagucagggcuauacagagaaacccugacucgaaaaacaaaaaaaacaaaaaaacaaaaaaacaaaaaaaaaaaaguaacggucaugcuuagaaugaaugucagagauggauuagaucagcauuuggcuacacgcuuuuuacccucgcacucgggauacuaaagcaguagggucucuguaaguucgagaucaaccugcucuauauagcgaagcaguguuccauagagagaccuugucucaaaacaagacuauuuggaaaucgaccaauaagcguggguauggugaugauuuucgucauuucgacggacgucugcacaccgcuacccaaaacuuugcucauuggagucagcaagccggucccuaccuagcgccgcaggaggugcgcaugcgcgccugucuggcuccuccggccgggagucccccaagccuggcgauggcgacaacucacugugccgcgacuccagcuacuaggccacgcgccccgcgcaggccccggucuccucccguccgcccaucccccgcagcggccccgcucacccuaggacgagagcuucggggccggggccagacucgcagaaucuaagcuccggucgguaccaggaaaugccagggccacgccacgccccugggaaaguccccggagaccgauguacggucuguccaauggcguugcgcgcugggcgccggggcggggucugcgagguaaacagccgcaguggcuccucuggguggagcgacugagggcucaaacguagggguccuccgggcaaggugaggaccucccagcgggacagcacuaagcguccgcagcgaagcaagcggcucuguuuuaguucccagcugcaggaccugcugucccaguacuucagagacaaccccacacccggccaccccaucccaccagaaagauucauacacacacacacacacaaacacacacacacacaugucuugcacacaugcacguugugcaugugcguguguaugagagagacugacccuggcuuacacgaaguauaguggaaagcauuuaagaaauccaccuagcccggcgugguggugcacgccuuuaaucccagcacuugggaggaagaggcaggcagauuucugaguucgaggccagccuggucuacagggugaguuccaggacagccagcgcuauacagagaaaccuugucucaaaaaaccaaaaaaaagaaaaaagaaauccaccuaacauugacucuggguuccauagacgugaacauacaugauuuugaaaguuggaaagccuugaccuuggaauaaaggccagcucuuuaaacagggaggacaguacguuuuuaggaggaagauugaaacuuuuccuuucagugaaauuguugaaaacgcugacaggucuuccaucuuaaggacuggcaaugaggaucuaggguacuauuucauacaugcucucauuuuauauagcgagacuaucaacugggaugugaauagggacauauguaaguauaugucuuccccagggacccuccguucagugccaccugugucccaguuaccucaaaggagcuggcagauuuucaaaacaacauucuaggucacauuauggaaagacgugugcauauaccuuaacccugauuggaggaagaccaggcacagcaagagaggcugaacaaucacccugaggcgggcugcaggaggaaguggguccuuggucccucccaucaacucgccaaaggucugcgucucucagucucucuuccccacgcuucccaauucaccucuuccuggaauuuucacuuccuaaucuuccagcucuucacuuaauccacuacccagcacugagauuuccuuaaaaaaagucuccaauauuuuccauucugauuacauacuguuuuauaagauauuugaccucagaaaguugggcaucucauucucccaaaugcccuugauuucucuguagccuuuaacccuggcacucaggaggcagaggcaagaggaccacaccaccacauuaaaacauuacugagggcccagugagaugaggcagaguuagguaaaggugcuuggugaucagccugaggaccugaguucaaucccugggacccacaagaagggaggagaaaacugauugcuacaagugggugauucucuugaggugggugggugaggggccucaccauguagcccaaacuggucuagacuuccauccuccugccugagccucaagugaggagaugauaaguuguuguuguuguuguuguuguuguuuugguuugguuuuuuuggguuuuuucaagacaggguuucucuguguagcccuggcuguucuggaacucacucuguagaccaggcuggccucauacccagaacuuucuuaucaauuccagucaugcauucauccauucaagggcauuacccuucuugucccuguaagacuugguuucacuccagaacacugugccaucugagauggcggaaaccuaagcauugcucaaggccacacacauugacacaaccaaaaccagaacacagguccuugguucccgguccugccuaccuuuuaucaguagucagaauugcgcucucucucucucucucucucucucucucucucucucucucucucucucucucucucuuccucuccuucccuggccucaaacuuucuaucuuucuauuuagguugacuuugaacuccugacuuuccugccccuaccucucaugugcugggauuacagacaugcgccaccacugcccuguuucuguagcacaggagagugaacgcagggcuuccagcaugcuuuaacuuuaccuccgcaucuuucucaguuacagaagcucugaaaaaaaaaaugaggauaaguguaucucccccucaaguguuugugaagacaaauaugauauagacagauccucagaacacaguaggcaucuaaaaaaugccagauguggguuacacgaaucgcuagaccucacugcuaaacccagcaacguugccuucucugauuccauccccuagauuugggacauggaucuggugagaggcagguggcccuagccugccauccucugucacccuguagccuggaagggaguuuccaaguugggagcugggugacucaaguagguggcaaccaccaacuccucuagagugucaacaagcacccuuaaaaaggccccaccugggaggagagccacauugccuggguuuuguuuugcuuuguguugaagcagacagucucccauucuuucugccacucccuccucuaccaccucuacuagggaggcuccagaggagccaagggcacacuucuaaaaacauaccuugaaaagacagugucuagucacguggcagaaggaggaaguggaggcugugcuaguaaagcauuuaaaagauaacgugaaggggcggagaaaggacuagagagcaagaacccuugcugcagaagaggaccugcugugaauacagcagcacucauaaaaagccaggugugacugugugugugcuguugggguggggaggguggaggcaggaggauugcuguggcuuaacuggccuagcuccagguucagugagagacccuguuucaaaggaagaaggcaggccaugauaaaucaggguacaugauguccucuuuuggacucuaggcacguguguauccacccacacauaugggcauacaaucagaacaauacacacaaagagagagagagagggagagggagaacauggagugugugcuaggccugcacuuuuacacaauucaucucccauccagucugugaagaucagguagauggaugcucucagaaguucauacagagccaggucaggcucuuaugcaucguaucaccacaucucaccagcuaacaggacacagaacucagaaugccagccuuaaaauggucuucagaaauuaucaaacccccagucuuauucacaauaaauaaugaaacuugcuauugaaauaugaacaagagggaagaaagaugacugcuguuuguggauaggagcugcucuuagggccagugcaagucuaguuauuuucuggcagguaugacccugaauuuuagguuaauacugaugucagugccugggcucccaugcaucucucuuuugauacacaccccaacugauggaaagcacagcuguuugccucuguguguguguguguguguguguguguguguauacucgaguaugcauguguauguggggcagcacacaggugugugggggccagaggucaaccugagugucauugcucaggagccuuccaccuuguauuuugagacaaggucucuugcuaggaccuuuagcucaccaauuagacuaggcuggugccagcaagcccuggagauucgcucaucucuaucuccacucccccuaauccuccacccaugugcugggugggacuaaaguguggaucacugcaaucggcuuuuucuuaugugggcucuggaggucaaacucaaguccuccacuuuacugacugagcuauucuaucaccccuucuuuacuuuuuugagccaggguuucauguagcccagguuggccucaaaaucacucucuagugaggaagacauucaacuucugguuuucacgacucccuguccugaguucugggauguagccccacaucuccuuucaacucuccuggggacuuagcuuugugugugauaggcuacccucugccuacugagcuaagguucauucccaggcuggaaauagaauuuugaaucaaagaaguaugagccuuauugucuuagaguggaagauaaggagccugggcugggggagaguggaccugagaggugggggugggagcauuuagcaauccuggaucucuuccuggacucucagcccgaggcaaccucggaacacaaaacccuguguggauucuagguacuuucugcucuugggugugugauuaucagaaagggagauuugggugaugguuaacagagauaaggaaugacaaacaugugacccugacugaaaugggauuugagugcuggugacgauuacagacggugcuggcccacccuacucaagacccggauuccaucccuaguaccucagagaaccgccugugauggcacacauuuguaauccccacagucaagggguggaggcuagaggaucagaaacucaaggucaggcucaguuccauaggggauuuggggcuagccugggauacaugagacccagccagaagaaagaagaaagaaaaggaaaaaauggcaugucaacuggaugacugccccaaucuuaguucuacagaggcagaagcaucaagaccaagaauccagagccagccuggacuacaugagacucugucucaaagcaaccccuucucaucaaaucauacacaaacaacaacaacaucaacaauggcacuaaauuaacugagucuguaguuucagcuccccucagccuaaaaaggcauuuuuaauucuaccuaccuuccuaggcuaugaaggccacaguuuuuuucuguguucaugcaucaucuuuuacauuuauuuuuauuuauuuauuuauuuauuacaaguguguaucauguguguaugucucccuagcacaugucacagcacauguaauggagcucagaggacuguauguaggaguccugucucucuuacuacaugagucccagggauuaaacucggguugucagacuuagcaacaagcuccuuuagccccugagccaucucugcaucccccagucauccucucaagaggaaggaaagcauuugcauucacaacuugcccucuucccaggacaccucccaccuccugaagucugggcuuugauucugacccugacacucacuccuggucuguaaccuagcuuucuaagcaaggcuauggggacaacagcagggccaguuuguggcacacacagagagaaauggcccuagugauaagaagcauggucauuguggucuggggcagcagggaguguggaucuuccucucucaggggaucucaggccuacugcuggggcucacuuugccuggaucucacugagagcugucugaggagguggccucuggccacggcugcuggcuuccucgccagccuuguccuccucuuucuccuccccggcucuuucuccugugucccuaaccugccuguuauucucugguuucuaggacaaugacaccagggaaauucccagcuccucauacacuggcccugccaggccccucccacggucucgaggaguccugggucuuuccuucucuggcuucucucccucuggcccgccugacuccaaaucagaguaucaagcuggcuccaaacugggauccuagcuugcuccucaucaucuuccuggaagugggaagagauuagucccuaagggaggcagacccauaggaccagaacauugcccaauccugggaagcccuaccaggccccaauagcauuucucucucaaucuaccccauaccuucucaugucuucuagaaucucgccacauuccucccucauucugcaguccagaggucacugucaaaagucagacccagccucuggcccuuaccucccccagccagggacuucccuaggcuggcccucugaccagcuucggaaaaacuggacugcuuauuaucaaaaaaagaaguccccaccaucugccagcccuuggccccacucccagggccucaaguucucggugaaagguucacccucagaaggagccagugggccucagagcaaagaagucuggagacaggggagggguuccuucauuccagugcugaggaggggcucaacagcuauugugucccccagggagcaagauggguuuccaccaaccuuccuuguuuggguuuagacuuccaaacugcccagcucaucccacaccaucccccucaaaauucacauucacacagagacagacacccagaccauccacaaacauaaacacucccauggaccgauauauguaccugcuccugggagccugacacaaaugcaaacauguccucucacacacaagaaaauaugggaacaagaaagagaaaaguccccuucaccccucagagagagggauaguacagaaaaagagaaagucucucuuuccuucccuuuggaaaaguugcagacauucggagagaagauuggucagaacaaguacgagggagagagacagaggucagagggcaaaggaggcucagggaagaacagagacacagaauucaaggcccuaggugggcccaccaagcuaggcuggggagcaaaagaccccagcuggcagagaagaggaggccaagcaguuacugacacacagcugggaaggucugguggccuugacauuaccgugugacgcuccuggaaucugccuugucacaccuaccuucagcccaggucacucauccgagaaugcacgaggugaucugaagaugugcccagugagugcggccaugccucccugugucccugugaagguugcugggcuuucugag

SEQ ID NO: 6006 - RNA, 12943 nt, Mus musculus
cuggcucugccccugcaguaggccguugaggguggggcugaagcaggugguguuuggggcguggccggagaagucccgccuagggccugcaaucucagccccgcggggcggagcgcugagcgcagccaggcugugcauuagcgaccugcugucuuuaaaggcagccgugagucgcauugccuagaccgacacggaggaccaucgccaugcaccgucuaccgcugcugcuccugcugggcuugcugcucgcaggcuccgucgccccugcgcgccucgucccgaagcgcgugaguguccccgauccuggagcaggccuucagcgacaucccgggacugauggguccagacuguccuagaagggcuccucuccuccgaaucguccugucccacccauccuuuccgggugcagagcagugaugcgaacgcucuuguccuaaacccagguucucagucugugacucgcugcauuccgggcccucuucuuucccuguuuucugcuuggcucugaggucuuccugcugguaggaggguugaauguugggcccggagguucaaacuuggcuaccagguuacugagggccagcagugugauuccaaagcaccuagcugugugccacugagacccuccaucuccugacagccuuuuacuucccugucucuaauucccugcacuacagaccacugggaaagggggguucggucauucugaggggaaagcccagucccauugccuuuuguuguggccuaaaagugcagguccuccagacccuuccugccaggaccggcugaaaaaagggggaaaguguuguggacgaucuuagcuuuaguguauaaaauguaugucaugucagcauagggugagggcuuucaugaaccgaggguuugcagaaugcccaaggaauagggcaguuggggccaguauggccuuggccuuguuuggucagaugcagggagauguuacaugugggaggaaggaccuuuugaccucacugucccagaggcuagucagcuugucucuuuuuuuuuuuuuuuuuuuuugguuguuugagacaagguuucucuguauaguccuggcuguccuggacuuuguagaccaggcuggccucgaacucagaaauccgccugccucugccucccgagugcugggauuaaaggcgugugccaccacgccuggcucagcuugucucuugacgucuccuggugugggaauucaggucuugguuccacagccggccuugugagguggagcccaguuagaggcaguaggccugcagaugacauccccauuucuccuguaugcuuugccugugggugccauuccaaacuuuaggggcucagauaggcaauuuggagggacucaggcauuguaggcaccaaccuccuuuuggcuguuaaggacuuuacucaagaucacucagugacauuuuugaaccuuacucuagaggcuuauggucgcagaacuugagucugcagugaccagugagugacugagucuucagaacccuggggucuucuuguaucacugguccugugacccugggcuguagugacucugauaugacuggcuuugugcugggcacuuacuagacucuauguugcauaguaggugucauuuauuauauaccuacugugugcugcagauugagcuuuguacuuuuccucuuuuaaaaaaaauuguuuuuugagauaggaucucuguuguccaggcuagccuaaacucuucuaaguagcuaaugauaaccuugaacuauacugauccuccugucuccaucucccaauuuuggaguaauucauaaggauagcauaaaguucuguguauuuaccuaauugcuuuuguuaguaccccauauuaucagugugcuuguuaaaaccaagccaguguggguccuuuacugugaacuaaauuaggcuuuauuuggguuucccaugaaugucccucucuauuccagcaccugcucugggguucccuauugucaucccugucacaucgucucucucuucucaggcccggggcagaacauuuaaaugagcuuggcugccuucaggcgcugaguccuguugcuuuguguacagacuucuccuccugccaucacccugacagaagauauaguuaugcucacuuaauaaaugaggaaguugaaccuccagggguuaacaugccagaggugucugcuagugagaccagggcuuaauuagcaucuguuagugagagcaguagugguuggugugugauuuuaacccaugccuggaucugccccuauucugccuauguagccacaucuaggcuagggauggcaucugccagguucgagguacauacugcugaucgcuauccucccuuuccccaagagccuggacucagcugcuggaguaccucacagcugaagcugcccaggcccugcuaguggaggaccaccuugugaaaaguccccuacuagggcaggggggaagggguaaugggagaggguggaagagucuaaaaaaggacacucuagaaacuucccugaacccaaaguccuccuuggugugaaucaggcugcugaguuggaaaaaguagccuccuacccugucagcccagguuacuacuuagccauuuuuuuucauuuaucuuaggaccagccacuccucccccaguccauccuucuccaagcgccguacuuucuuucgaagguguucuacugcacauggccaguuugcucucuuugaccuaugagggcuuauaaucaaugagacugcuacccuucuucagcgaggucccucauucaacguguuuagccuguuggccuuucuguaguacuggaaccagcugagcuucuaccucagggccuuugcuugugcucuguguguauugauggcuaauuucucauccugaaagaauguuuuuaagugucaccuuucaaccacccuaaguaagaccugaguuacucuccacaccaccuucaggcacucuaauauguggucgauccuccuuuguucccucccucccuccuucucucccuucuuuucuuuccguuuuuucugcccccuaguacuuggguuugaacccaggacuuuaggcauguuaggcgagcucucuaccacugaguuacacugccagccuggggaacacuuauuuacacuagacuauaagccccacaaggcagggaagaacugcuuccuauuguuuacaaagccucaguccaggcccugaaauagucgcuucacaaauacuuauggaaugaaguuugagcaaaauaccugcugguaccuacccuggcccugccuuucuuagucacaguguggccuuucauuccaggaaucagaagcccaugccaagaagcuugaacauggaguuuaacaggcuuacauggaucucacggaguugguggcaggaaacagaggccagggaggcacauggcuguguuuuagugagccagcucaugcuuugugucugacacaaugucaugaguugucacauacguguucucaccuugcaacaguucugggaggaagauauaaaaugccucuacuuaaaagauguggaaaucagaaaucaggacuccaauuguauguguuccaggcugggauuccaacccaggucuguuugacuggaaccuaggcuuccugccuggcacuccaaagccauaccugucccaggucccugggaugcuuguuuuccaucccaggcugguuaugagcucacuguguguuugaggaugaguuugaacaucagagccgagugcugggauuacaggcaugugcccugugcuggucuugcuggucuuagauugccuuuuguucuuuuuugaagacagggucucacuauguagcccaggcugccuucaagcuugagauccuccugccucagccucccuagugcugggaugacugguguaugucagcaugccuggcuccuuuagugcuguaguagaucauauaggugacugacucuguguuccuuucccauaggacagaggggcucuuacucuugucuccucaacucaacuuggagcugagccgcaaguguacgugcuuggaacccaccuuaaaacuuuugacccaaggcagugccaggccuugugucauaagggucacauacauugccucuggccauagggucacacacacagcuucuugugucauaauuccaaggcuuggcagagagaagcuguggucuagcacggaucagguguucucuggguccggaugguuaugaauggguuaagauggaggccaggcuggcagauuuucuaaggcuguguguggauaauggcagugcuaagugucuuuguaggggguuuuggggguggggcaugugaguguguuuugagagggagagacaggcagacaggcagacaaacagacagacagagguguagaaugaaucccagauccuaagguucugggggcugguggucacauuuguuggaucuaggucacguggaggaagauuugagaaguuccucugcagaggaguggugggugacucagguugugccuauggugugguucacgacaggggaguaagaauguggguguaaggugagaaagucauugcucgucacugagggaccuccuguagaucuuguccugugggucuuguucccuggacgcugaggcuuggguuacuguuguuucuccuuguguucuuucuccuuguucccccuuguugccgaccuaggauuggacaagggguggggcauaaucaggcucaugggcauggaauacaagggugacuuucagcagcuugucuuguggugaccucccaaagcuagcuggagagaaauggguggcagggucagagcucagagaagguacccucaaagcuaaaugaggcuaauaccauuauuaaauagaguauuuucuguauucauugacuuguauacaauguaucuguaucguauccaaucccacauucccuuucaauccagcgcaccugccugccauuuuuaucuucucuuaauaacccacugaguccaauuauugcuucucauaugugcauggguuaggacauggcuaucuaugaguaucacaagcccccaagguauaaugacuccuccucucuguagccaccacugccaauacuuccuuagcuaggggugauuccucucucccucccucccuuccucccucccucccucccucccuucuuuuguagccuaggcugguuuagaaugaccacaucuucccuugaguguuuacauuaugggcuugcacccauacagcuagcuaagucucucucucucucucuccugcccugccccagaacagggucuuguguaucuagacuggccugacaugggcuauguaguugaagaugaccaugaauuccugauguucuaccucccaaguguugccccugccaccacacuggguuugugucaugccaaggauagagccuaagguuuccaauaugccagguagacauuccaccaacggagcgacaucccaacccccuuaguuuuaaaguucaaggucugauauaaugggccuaggcccugcacuuuggcauuuugccugaagaaugggucagacaagugugacuguuaccauggagcucagaggggaaugggcaggccucccuccaacucuuguaugcugaaacauuucuuuuccuccacuucucuccuugcugucucguugucccuagcuuucccaacuugguggcuucuccugggauaacugugaugaaggaaaggacccugcagugaucaaaagccucacgauccaaccugaccccauugugguuccuggagauguagucgucagccuugagggcaagaccagcguuccccucacugcuccucagaagguaagccccaggcuguguggacgauggacggggagugggcagccagcaggcgccauggaaacucaugcucauagauugugaaagacuucagacuuugcagacuuaccacagacuuucccggguucauagagucucagggucaggggauggaagggaaacccaggucagcugggauucacccauucaugcacuuggauauggcggcccaguguucaccauggacuccucuguguuguuuugauguauagccaguagccagggacauaaggcuauuuucuuuuguuuugagacagggucucacucuguagccuaugcuggccuugaacuugugguaggccugccugccgcaguuugguugugggcaugagccgccacaauguggacucucagagcugaaugaacaaugcuguuuccuuuauccauacugcaugcauuuauuuuuuaaaaaauacauaugaaaacaagcagugcuuuguauguauguuuugagggagggcuuuauguagccuuagcuggccuugaacuugcugugagcuccuggcucucuggccuccacuucuugaguacucagaucacagggguacuaccacaccuggaauggaccccggggccucucaugcauauuaggugagcacucugccaaaaccacauccccaacuuuguuucuguucuuuugagccagggccuuccuuagguaguuuaggcugccccacaacuuaauguaaguaccuaaggauagccuugaacuucugcuccuucugccaucaccucccgaggacugggauuacaggcgugugccaccaugaauagcuucuauuaaaugucuucuccuagccuaauuccuuaggagcugcucauuguuggcuguuacggauccucccagaaucuucacucauuguucuaaugagacagcgugauuaauuugggagacgccaugcgggcuagaauuuguccguauaauaaugaucuauucauacucuccugacuauguaccuucacauuaaauguuuuuauuuauuauucuugugucugcauauggagauguggggugaggcccacacgacacagggaacagggacaaguuguagaguugguucucuccuuccaccuuuuuguuggguucuggggcaggaacucggaucgccaggcuuacaaggcaagcaccuuguccugcugaggcagcccgcuggcucagaugcacgcuuuuaaagcucuuuugauaaucaaugcccaaaugucuccaaacagccaaccagguuuacaccuacacugacagcuguguuuucuuccccacacaauuuuugacacuaagaguccgagucuuggccagucucuaaugucaucccucaugagggcgagcgauccuuucacaguucacuugcuuuuuagaucuauuuggggacaucagcuuauucccacccauugcccaacuuugcauguguuuuuguauauuuucuuauuuuauaguaaaggcaucuuguggcacuguuuauuguagcucuucacucucugguuagagucaccaccuuucuaagauguucuuauaugcccugcagucucuuucugguccagaccuauucuggaacacguuuagaucauuuaagagauuuugggagccaagccuggugaugcaugcuuguauauuauagcacuuagggagaaguacaggaaauucaggaggucaagucauguucagucucacggccaguuggagaccacccuguacuguugggcucaauuuucugagucuuaggcaucucuugagcaagaacugaguuaaucaguaauguggauggugcuuuacucagugccuagcacacaggaugugcccaguucgugcuggcacguguugacaugucaaucauugucagugauugagcuagaaggccuggagagaucucagugccucuccaccccugcccauggcuucuccuugcugaucuaguacauuuucuucagcuauuauccaauaggaagaggucaagucccguggauaaaaaaggacagaauuuguccagauuggaaagggagacuggcugcugaacugagucugccaguguugccugaaugcuauucucugcucucaauguugaaucuggagugggugggugugugcacauguguguauguaugccugagcacauguauauacauauauguggugacuagaggucaauguuaggugcaccccucaaccucucuucaccuuagauggggucccauugugccuggaguucaucaguuuggcuagaaagauggccagugagcuccagggucugcccaacuuugcuucuccagugcugagccugugccagccacuacaucuagauuuuucugggauccuggcaucugagcuuagguccucaugcuugccuggcagacacuuuaccaacugagccaucuccuuagcccugagugguuuuaaacuucuuuuuguuuuguuuauuugcuugagacaggguuucucuguguaaccuuaguuguccuggaacucauucuguagaccaggcuggcuucaaauucagagaucugccugccucugccucccaagugcuggguuuaaaggcguacgccacugccacccagcugauucuuagguguuugaacauaguguauauuguugugagaucuagacacagcucuauccauguggcggagcaauggccuguguuaggaagggguugccaagggccuuagcaagugccuuuacagugcaugucuguggacuuuaggaguugguuuaguugugccaggugaacaagcgcugcagccgaggauacaugggauauacuucugagcccugcuggucguaaguuugagauggauaggauuaauucccuaauggcagguuguggcugcugccuagggacuagccuuugacaucacugacuucugcccugggcuuccaaugcugugcugauccugggcuggggaggagcaguugugggggaagcuccauaaacauucaacuguaaguugguuacuucuguuuaguuggugacugcuucaaguuccucuuggggaccuuggcuaaaugaggggaagaagaaugugaagccgcuggcaguagguuuuguguccugaggcuccuaagugcuggccaggugcuaucuuccucagugggaccucacaaaaggcagaaguacugugaaaaccaucccacucuugacugaggaaguagagacugaaggcauuugaccaacucccucaggggcagagcuacucuccagcucaggcccucuggcuguuccucaucugaggagaaauagacuuucuuagcagaugaggccggccagaggaaaggucacugcacaaucaggauggauucagguuagcagagcaggccaccgaggcaagcagcuucaacuccgcacaggauucaggcuguguugccuucaccauuucccggccuugaagaagacagccuguaccucuuguacucggucauuugaagauucaggcagcagucugggacuaguggagucuggaggaaugaguaccauccccagauuuaucucucagaagcagaaccccagccagggugauggcucacaucuguaauuaaucucagcaucugggaggucauggccacugucugcugcacagcaaguuuaagaccagccugagccacauacaagccuaucacaccaagauccaaacaaagaacacaaaggugaaacccccugaucuaguaagguugagacgcagaggucgcucgcaugucugagcugaaaggguucugagccgggcgugguggcgcacgccuuuaaucccagcacuugggaggcagaggcaggcggauuucugaguucgaggccagcuuggucuacagagugaguuccaggacagccagggcuagacagagaaacccugucaaaaaagaaaggauucugagaacugcggcuuccaggcuggggagauggcucaguugauaacaugcuuccugugcaagcacgaggaccuagauucaaccccccaggcaugauggucuacauacucggaacccuaggucugaggaggaagagaugggaggaccccuagcagaccugcugaguuagugggagaccuacuuaaaaaaaaaaaaacccaagugaaugauggacacacacacacacacacacacacacacacacacacacacacacgcacccuccuguaccaugcucaggaaucauguggggagcgcugauuucccgcugaccacucugugcaccuuuuccuuccugguuuuggugggacacagagagacagcuggcaugcacagcagcugguauaguuagucuucuguaugugccagugaaucgggcuuuuugcuugggagucccggcugcuucuccucggucagguaggcagugagaacaagagugggguuaggcuggcuuggcagagggaagcccauucuaggguucucauccagcucggucuggagaggccauucagcuuuuggaaccaacugcaauaaggaccauagaccagucucagagaaaucucccuauccauuuccaucgguuuguuuauuguugcagucuagaucuguagaccaggcuggccuugaacucgcaguuccccgccuuuuccuccaggcuaccauuauuucagauauucauugcuguaccuagcuacauuuccauguauaacuguaucaucugugauacaagagaaaacguaugucaggagcaaccaacagaaagauucuacagcuaagaauggauagcuuagaaggccaccgaggacaugugccacagucauucagcuagugugauggcagugcuuugguuccugucauuggauagcgacaacuggaggaugguguguuggucagagagaagagacauucacauuuggugaucagugcccaccacgugcucagguaagguugaauacugggacucagccagaacaucuccccagcuaaaccuucuguucucacuauacccuggaacaagagacaauggggauggcuacagguucaaggccagccuggucuacauauguagcccccaucucaaagaaucaaaccaguagagguguaugggggauuacucugagauccgucuacaagccuuauugcagcggguuaugagaugaaacuucaagaagcaggagcaggaauguguucacgcugucaccuugaugaauccugugacagguggagcucaccguggagaaggaaguggcuggcuucugggucaagauuccuuguguagaacagcuaggcagcuguagcuacgagaacaucugugaccugauagacgaauacauuccuccuggagagagcugcccagagccccugcacaccuacgggcugcccugccacugucccuucaaggaagugaguaccuggggugucaaggugguagaguggguguggguguggccuuuucauucugcauauuguuucuuuggguauauaagaaccgcuaucuugggagcuggaagccuugguuuauccguguaugaaauggagcagcuuuacgcuuagcugugaccauugguacccuucauacugagccuagaaaagggcuauagcaccacucuuggcucuuagcagaauggggacgggggggagaucacagcuauggcugucagcaauaggccgcccugaccuggcuucacuucuuccccucaggguaccuacucacuacccacgagcaacuucacagugccugaccuagagcuaccgagcuggcugagcacaggcaacuaccgcauccagaguaucuugagcaguggugggaagcgccugggcugcaucaagauugcugccucucucaagggcagauaaccuggcagcagccaccacagaaugaaggggcaccagcacggcaggccucuucuucuguguuccggugcccaggccugccugccucuaacucuauccuccuacgguucucuacccucucuggaaaucauugcaaccugaccugagggaggauggaccaggcccaacaucugaugggcuguaagccaugcuccuuugcaccccuaccaacuuucuaagaauuucuuucguauccaaaacagucaaggaaugggaaccaacauguuugggaauccuaaggucaaaacuggcccaaccuggaccuccuggaguuaugcucaccccacuucuuuguuuuagucaccaacuuuaaaaccaggauaaccguauuaauuucucauuccauccugagccucucuuccugcaaagaggucuagguagucagucuugggucccucuauuaacuucugugauuaacugcauucucuuugcaacuuaacuugucaacacuggggcugacagauccugaagaggcaggguggugugugacagaaaccugugagaguuauuguugggcaugcuccaguaacccuuggcaaagcacagguaccuguagggccaagccgaagaccuagggaggcacagcaaucacuucugggagcgaugcccauuuuuccuuuuuccuuuuuuuuuuuuuuuuuuuuugguaugaugccuucaagaaugggauggcauuccuuauaccugacaagaaacaaccaaaaaaaccaauagcacaugugcucuggugccagguggccagggucuggaauggcauaucuaguucuaaagaggugcaguccccugcaaguuccauguaaggaauguugccagauauuugcaacauuuuucuuccuuaggccccaaacccagccguuuauaugaaauuguagaauuuuuaacuauuggaaacaaaugguuuuuuuauauauacuuacuaugcaggccaaaggggccccacggacucacccagggacauaaucuggcucccagguggcugcuuuuccucacaucuguucaucuucucaaucucaaguuaucuggccgcaucucuucccccuucaaggucaaguccuuggugccuggccucaaagagggcucagccugcacuagagcaggucuacauggcuucugagagcugggcacugugccaacuuccgagccaucaccaccagaguagagggguucacacuggaguagaucccaccuagcagccaccacguggaacagggguccugugaagagagugggucccacaucagguugcaccaugacaacuuccugagccuccucggacagcccagguucuggacuagaagacuggucuggcaauaaaucuuuuuaacuugcug

SEQ ID NO: 6007 - RNA, 3153 nt, Mus musculus
ucucacaaagcuguuguaaaagaaggcucugucugacuugccugcauuaggaacgagaugaggggaacgugaccgcucguuagauaucuuggaugugacaacuugagaugcuuuccagccuaaagguuaggggcuuuggcuuugcucuggucucaacuguggucuaauaugggcagacacuaacagccccagcaucgggaggucugcucuccucccacccacucugcccagaagaccccucuuuaccuguuguaaguuguccgccagaaacaugaaguacacgcugcagaagcccagcugagugacgaucagcaggaagcucacaacguaccugggaaggaagacaaggacaagggaaauaaguuacuguuuaggauggaucucauuuucuuuucuuuucuucuuucuuuuuucuauuuuuuaaaaaaagauuuauuuauuuguuauaugugaguacacuguagcugucuucagacaccccggaagagggugucagaucucauuauagaugguugugagccaccaugugguugcugggaauugaacucaggaccuuuggaagaacagucagugcucuuaaccgcugaggcaucucuccagccccccaccccuuuuuuuuuugauuuccuuuucaaaacaauuauuucugaugguuuuauuuugagaaaugucugacccacagaaaaaguugguuguacaagagaaauuaacagccauaaacucuggcuuuggagaguuaguuuuuugagauagggccuuguggugcccaggcuggccucugauuagccagauagccagugugaccuugaaaaccugauuuucuugccucuacucugauagugcugguguuaccacaaagccagugugaccuugaaaaccugauuuucuugccucuacucugauagugcugguguuaccacaaccacccacauccauuuacucuaaugaaauucauuuguaguuaccuuuggccuugaauugcauucuggguauuauagucacaacacacacacacacacacacacacacacacacacaccccacacuccccaaaaguacucaguucaauucaguucauuucaaugauaauuuccgaagucaugaaauaucuacuugaaauaccauaggcauauuucucuuaguucuuaauagucagaaaucaacuaacaacaaauauguaauuuauauauuuuaauuauuuuacaaauaucucuuucuuugagggggagggcauagucucacauagccaaggcuagcuuuaaacuucauauauagcccagacugccccugaauuauuaauucugcugccucuaccuucuaagugcugggauugcagguuugccacuguaucugacuuaacuuuuauuuuuuuuuuguuaaaaauuuuccaaagcuuuauguuguguuuggcuguaccucuuuugucuuuuuuuuuuccauguggaauauuuuugcacauuuuuugcauuugcacugguuuuucaucaggucauuuuggagaguccaggcuggucuucuuauaaacugucaccauggugugucugugugauuucuuccuccagaagagagucauugggcagaggacaaaggcagugacacuuuguuucucuuucaauacacuggaaacaaaggucuguuguccugggguuuaggcucucccuuuauucacauaccuccucccacacccacuauaaaguuggauccaggcaagccuaugcauugaacucaauuacagcucuuaaauuugaaaaauuacgucauucuuccugcuguggguuuuuguuuguuguuuguuuucugguacugggaauugaacccagaacuucauucuuccugcuguggguuuuuuuuuuuuuuuuuuuuuuucuuuuuuuuuuuuuuuugagacagaguuucucuguauagccuuggcuguccuggaacucacuuuguagaccaggcuggccucgaacucagagauccaccugccucugccucccgagugcugggauuaaaggcaugcgccaccacgcccggcuccugcuguggguuuuuguuuguuguuuguuuucugguacugggaauugaacccagaacuucaugugugcuaggcaggugcucuaccuuugagcuacaucccagcuccauuuuccuugcagguuuuuacuuuuuggagguaacaaguugccagacuauccguccaguugucguauccuauguucugggcugggcugacuuucuugugcaucguuuauguuggucucccacccugaguauuucuugugagccaaucucaggccaaaaggucugauuagaugaaguuucuuugcugauuuuucugguaagagaauuucagaguggaucuuuauguccuccaguguaucacaagacaccugugacaugggcugcuaggugcucagccugacacccugggcagggccaccagggcucucuccuuuauaaaguucaacacugguuuuccaucuaaagccugagcaucagggauuguuaucuauguggggaagagguucuuacucaagccuccgagagccucucagugcacugaaaaagaagaauaucuggugcaagugagacucccuuccguaaauuucuaaauuucugcaguuacugaucuccaaagaaaugggaaaacagaauccuaguggggggaaaguagacauuucgaguucuagucuuugcucugacaauaaauuccuguguggcuuugaaugacuugguugccuucuuugagcuguuuaauuuuccaucucaauaggcauggauacagugauuacacgggcugcuccugcccuacauaucuacugaagacaucaucagacacagauccugaccucaucuggcugauauugagagauagaugccuacagaggagcgugaggagccuguggagccgaggaggcaguguggaaggcaccacagcugcugggguguugacucacugccugaaggacuguccgagaagguugcauggaaggucuugggaugucuuuguuccaccauuaucaaugccuuuuguaccuuuuauguguuauuuuauugugagagcucuggacauccuaucuuucuagggcagugaaaucucaccauggaguccuauucaagguugauaagaugauaagagaugauuaaacagaaaagcauuuugaacagcau

SEQ ID NO: 6008 - RNA, 26089 nt, Mus musculus
cgguuaaugucuaggacucuucagucagcagccucggcucugaacaaggccuggccuguucuaggugauuccagcagcuguuccagcccugacccucaugucuguuuaggcaggagccccagaacagaugagacagguggggccagggugucuggguagcacacagccuaccacaaggcaaggaagggagaaagaaaagacagcuuugguucuggggagaagggggaggcaggccaggggaaggaggagacagaggaggaggagggccuuugaguggaggcggagggugagacagacccugcccagagcuccaagaggcuuccugcugcucgccucuaaaccccuccacauuccugcagcccuucagaccgccagaacucuucugccgccugccugccugccugccugccugccugccugugccgagguaugcaccucccugucagccccugcccuucuguaagcuucaucaucuccucucugccccauccccaugaccagucucagggggaggugagcuggaaaccuguugcucacucacaggggaacuuguugucucuguagcacugcagaaaauagccaugguuugcggggaccgcuuucucuguguucucugguggcagaggcuacuggucuguccucugucacccucggaggcagcugccuccuuuucugagaauccgauccucauuugcccaucaugacugccaacccagagaaaaucuggcuggcagccuguugggucuggcuuccuauucugggagaacagacauccaguucugggucagagcacuguuguccaaaugggacuuugcaagaaggauaaacagaucuguaaacagccaaggcaagacauucccuuuagucaguuccucugggaaggcucuggucccuucaaucucuguccacccccaccccaucaccccguggcauuucagucagucugaaaugccauugucucucccagccugggguugccauuguucccagccuaauucugagagguggucaucacuggcauuaacauugcuucuaccguaucuagacaucugagaaagccaacaauuugauacaauccagagacgacagggaggagggugugauggggaggagggagacagagagauauagcuccaggacacuuuucuugcuacuacugaaucuauccaagacucagccuguugaaagcuugucugcuccaagcuguucuguaaacuuccugugacuccuagaauggcuggaaauaagccucaccuaagggggacaaacagguaucaggcaucugccucagggacagacagcacaccugcagggagggagugucuccacugacaacucuuuuaaguuucuagaaccuuccuaguguagggaguggagugagaugcggacccuacaugagguaacaagcuuuaggcaauuugugggcgaucucacauagccaucuccccugaguguagccuuccuguccuaaggaagagggauagcuuuugggguacccgaauuccccuaagacuucccaagcagggucacuuaauugagccuauaaaguggucuacgaauaagcaacuucaaagagucucuggaauuaguguguguaugugagugcgcgugcaugaguguuucuguuuguguuuaagagaugauggguguccacagcuuuuagguuuaagauauucccaaacagaugcagacccccagaauggugugacgguguaagguguaauucggaaauagaaacaaauuuguauuugccaaggauuaaaccugaaagaagugguugagggaagaguuaacucugguuaacuuagccaucggcugccacaucgacagagcggcacugagggagggggagggggugggguggcucugggagaaggagucagcuuuugaaacuuucuccaagccccacccaccaagaggcucuucucucccgugacucacuccgagaggaaugcgaguugccacggcaaccucccccacccccccacccuagggucucugcguacuggcugggaggggacucugggaacgcucagggaccuuuagguuccaguccccccaaaccgcugccacggcugccgccaccgcaccucaccccugccccagauacaaggaccacagcaaacucuugcccuguccccauuucccacgucccagggcccccaggacugugauaagccucgcuagaucugcccuuugcaggacagaggguuuggaucugugcuuagugucauuuggccuugaacuaaucugucuuccggaacuccgguuuccucccuauuucggguaaaagcagcagucccucggagaaggggcaggaugaaacgggcuaaagcaugcccugggggagcacuuugcaaccucacucccuucuaaagagacuaagauucuuagcacaaaggggauuguucaaaguccuuuuucuucuggcugcuccaacauuugggguccagagaacaucuucuuaguaaaaaguggugacaggaauauuuuuaaaaauacauugcuuaaauucauuucaauuugggggaucuucuugucaguuucucaagaguaaugcauccuccccuagagaaagacuggugaucaagugcuugcugcaucagccugaggacgccagguuuuuuccuuaccccccaccuggggagccagguguggugacccaugucucuaaucccagugcuaccagaaacaggccagucuguagagcucacuuggcugacucauuagcuucggguuaguaagagacccugucucaaaauauaagguagugggguuuaguggcacucgccuuuaaucucagcacuuaggagggagaggcaggcuggucuuugggagguagagaccagccuggucuauauaagugaauuccagacuacugagggauuuggagaaagaucuugucucagaaaaacaaagaaaagguaaagaacaacugaaaaagacauugacuucuggcuuacacacauacacacacacacacacacacacacacacacacacacacacaccauauauacaucacacacagacauggaaggaaggaaggaaggaaggaaggaaggaaggaaggaaggaaggaagagagggaggguauuggucaaaagcauggguuacagcucaauggugacauugggaaagacgcuaaccugucuuagccucaguuucccaaucugucagguggggaugaucugagcuagauguucucugaaugaacccagucccagucacugguuuccuuagaaggagcagcauccugcauguuuaacagcagccuccuuucuugauuuaggagaggaaauaggaagaaggcucgggaggcacuauccucaauccagcugugggcucugcagcccaaugcacagcugggcuugcuauuuccagcggcagcuuuccguguugaaaauaagcuuuaagcagcagaggauacgaggcaaagcauguuugccuguggaagucuuuuaggccagcagaugagucuggggagauaaacuggcaaaugcgaacacauggggcacagaguuuaaauauguagauuuuaccaccagccuagcuaaaaauaagugcaggauguggccacacccucacauucuuuuuccagugauauucucacacacgcacgcauguacacgcacacacaccacacagagggagagagauucuuuaaguacaucuuaaaaaauauuuuaacaauauauuuuuuuuaauuugagcuggguggugguggcacacacuuuuaaucccagcagaggagggcagaucucggugaguuugaggccggccuggccuacagagcaaguuccagcacagccagggcuacacagagaaaccauguuucaaaacaaaacaaaacaacaacaauaacaacaaccagguuuuauuuaugugaauauauguauauauaagcacaaugcauguggaugccuucagaggucaggagggggcaucuaagucucuagaucuagaguuacauacagguggcuguaagcugcccaacuugggugcuggaaacugaacguggcagucucugauaaagcuguaagcacucuuuuuuuuuuuuuuuuuuuuuuuuugguuuuucgagacaggauuucucuguauugcucuggcuguccuggaacucacuuuguagaccaggcuggccucgaacucagaaauccgccugccucugccucccaagugcugggauuaaaggcgugcgccaccacacccggcagcuguaagcacucuuaauggcugagucauuucuccagcuaccauucccuucccccagguacaucuugugaguaugaaaacuccaauccucaccuacuagcagaugacaaaucuggccauuugucaucuauacagacaaaccaucaaggaugcaaaccuuuaaauauacuaucggucacugaagacaccuuuccuuccaucucucuguuucugccucugucugucucucucucucucucucucucucucucucucucucucucucuuucucucucucucucucucucucucucucucucucucucucucucucacacacacacacacacacacacacaaacaucccucccacaccaccaccccgacacagguacaugaaugccuuuuauuuccaagauacaaauguugcaacucagaaagggaaaguagcucccuggagcuuacucagcaggcugguuggugccugcaccgagccuccagaucuuuggaaccuugucagguuuuggucaguuggagcugaccuugcuccguagguccuaaaucauccuuaauacaugguuaacaacacuuccucccucccuuuucugcucuaucccagcuuacauggccuaagacccaacuaacguggcuuauguaugagcgguuucucaguuguuuuccacuggccccuccuuagcuacccuucaacuuaaacugacagaagaggaagcugguaccagcuuucagccaucccuggggauggaggaagcuaccuuugcccuacuguaguguggauacugcuccuucccagccuuguuugcgacuccugcgacagcuggguugcaacaaggccagggccagcaaauggugacuuaucagacgcuguuaaagaaacagcccucuggcuugacuaggggugugucuggcagcaaauuggcuuugcucucaccucccuagccauagauaucuaguagggaauccgugaacagagauagcagcuuuguccuuccaggaaccugauuuaaaguaucucucuggaucauccugugcugcuuguggcaaucacaguaaaaguuuagauauuucugagucuuuggcacagaaaccaccuugcccaaggaauuugagugagcuauuuucuuuaagcugugaguuuuuugucuaaaguguaggcauaguaaagaacuaucacguggccuacuaguaguggcugucagaaugguguucaaaauucugaugucacgccagacuuuaaggagaaagauaauaugauugauuaguaaugucugccacauacacaagagugguguaggaagguuggcaugcuauggauccacuaccuuuggaaucccuuaguccuuuccagauguuacaucuuggauacuuugauguuucuuaucccuuccauuugugguuacuccugaugcaacagggauggcuguacauugaguccccuccuucugccuuuauuuguucuagagaggguugaaaacucagccugggcugccagcaggacccagucacguggucuagagggugcggaggcagcaggaacuccuccagcccagucuagacaaagugaaacguggcacuuuaggagaugcuggaauuucaguggggcuguguccagccacaaagccuggagccuccuccacgcugcccagaaccaauucuagguuuuagcaucugugacacucuaaccguuucccguagcuuugucccuuccaacaagaaauaaaaauaaaaacaaagaaucuggggcaagaggggagauggggcacuccaagauaugcugagcaaacccaggaguucagaauagucagggaccuuaggggcuuccuugccgaggguaccuggcuguucuagagggaaccuagagcuauuucaagguggcuuaugauauuggaguaugcuauguucucugaccccaauucuuccacucugguuauacugcucucugucucucugucucucucucucucugucucucucucugugugugugugugugugugugugugugugugugugugugcuugugugcuugugugcuuguggaagccagaggucagccucaaagguuacuccucaggcucuguccaccuuguuuuugagacagucuuucacaggccuguaucuugcugguucugcaggauuggaugaucugcaaggccuagaucccuccuguuucugccucucuccagugcuggaguuucaagcuugugcugccacgauuggguuuuacaugaguccuggggauuugaacucaggucuucaugcuugccuagcaagaacuuuaucaacugagcucucccuucaauccuuguuuuuguuguuuauuuuucauuuuacucauagaacauaguccaagaugugcagagggcuuugaaggacacugcucuuuuggagcaggcuuucucaacaaguccuucacacuggccgcauuucaaggcucaguaaaccccuguggucuggucuaguggugccuagugcucaggaagcagaggcuggaagaucacaaauuugagaccagcuuugguuacauagugagaccucaucucaccccacccaaaccagccaaauaaaagagaguuggguauggugauucaggccuguaagcccagcauucgggagguggaggcaggaggaucuggcgguugagaccaucuuuggcuacagaucaaguucaaggcuagccuagcccccaagacccuuagggagcucucucagauugcauuucuccacacgcuuuccauccgaguuaggucauccuaggagucugugguccugagccacgcugucuaaaagcccacaguucugagguugccccuggguuuagauacucaguggcgccuucauguccacagggaacucccaggagccccuuuagguuucaagggaagugagcuagggguuggcuguacuuuuccaucccauccuuuccauccaaagagcuagacaaguaaccucugcuucagguccuccuggcagcccagguucaguuuucagcucucuccagaacaaauaaaggcagaagaaagagacucaauguacggaacagggaaagggggcaccaggggugucugcaguuggcggucacaaagccaaaggcaauacaccuccacuucccccaccccaacccccgcugcccagggcauuucuccugccuacaucucaggccagguuggcccaagugggcaccaucuuaaugacuaugcaggagcaggugucugccaagagaaacaucacacagaguugagagaccaugcagauaccugucacucgagugcuggacugcuggucagaggcauggaucuuccuuuccaggcuccagucuucucaucuguacaauggggcagaaagaccugcccucaggcccuucuuggaaagcuggcuuguaaaaucaaugaggauauuuguguguuucccccaguaugcuggagugaguguggaagcucauggcugccuuguacugaugacagagucuuaaccuugugccuggguugacuguugggucuccaacaagcucugaaggguagacucuggccucuuuggccagagguauguuacagaaccucagagaugugucucaugggcaggcggggaauguaauaguuaaggggcuccccgcucugcucacccuaacaucuagaugaacagaauucugggauugguaaagcugcaaagauguggacaaugaucauuuccccugagaguuuguacgucuugccuuucuccuuaccuucaccccgccucugggcuuaaggccaggaagcaccccaggauguagguccugaggacagggcagaaugagaaggcagagcgauggggggcagggcagucucccagaccccaguucccuccuucugcccagaugaagcacccagccuugggacucaucucucuagcucucaaacccgaagcccaugacauauccuagccuggcuaucgauccagaguucugacuccucugcuguugaagccuggccugggugacauuugggcuccugcugccaggcacacuuugaucuuuccauuucaaacaaccccagacaagcccuucauugaugcccccucuuccauuccaucugcccaaagccacacacagaggaugcuagaccuguguuuuccaaauagagaagcaagaagggaaacaagugagccacugugagaggggaaagaauguuccagaaacugccuagaaagggagaacuagguccuucugccagguggggcugucuugaagcaaugccaaacuuccaaaucaauuucuuugauuucuuauaguuuuacuuuauggacacaccaugaaauaggagaugaggcucuuuucaguuuagccuagcacaggacacauuguuauggccucuuccucaacguugccuguuuugcuauucaggucuugucugaaaaguucuguggugcuguagagucagcucagggccucaugcaugcuagccaaauacuauauugcugugccucacccuccgcucaaagauguuuggggaucuuggcuuuuuuuuuuuucuuuauuucuuccaaauacuauugucugagggggaaauguggguacuguaggaggggauaugccaagaccugcuuuucuuguguuuguuuggaguuagggacugagaguuagcauaggcucugcucuucagcugcacuuccaaccauuguuguaagcauucuaaagagcacugucaaucaucucaaacuuaccuccucugacccuguugacugauggggaaccaagguuuagagagaagaacgaauguaacccauacguggagauggugacaauaucgagguagaauaagaacccuggacauugaaucugagcucaguggcuuugucugagcugccaggguaucucccaucaccaagcuuucuuugucaguugaaaaaguugaagaggagcuaggguuggagacgcugagagagaagucuuggggacucaauaaggaagguaucauaauugugccccugacugaaagcucugaaggggcagagggagccagcuugcucuguguggcuguagagacaagauaaaccacaagcuugagggaugcauaucuaggaagaacuuucuagauccguuugguaacagaagccugucuggcuagcaccgggaagcagauguccccaccacaugucccugagucuucagcagaggucugcuccaaagaucccuuccaggcuacagggugagaguucagaguccaacaucugggaaaugaucaggggaacguucuagaucuuagcugacaucccuucugccacacagggacaccucuggagauuuccuuagaggauccaaagaaugcugucccuggggguaggguggcagaaacuugauccuucagguuccuuccuggcaccccagacucucagacuuuuaaaugugugucucauuguuucggauuccuguugacuucucccauugcaggggagggagugcagaggagaggggaagaggaaagggaguugggaggagggagaggaagagggagaagggggaagagaaggaaaagcauggauguggggguggggaggggauagggagcauggggugagguuaaggaauagggaacaaaagucuuagaacaagaggcaucaaaagcccaaacaugacuucuuagccuguugucuuuguccaaucacuuaaaaaagccaaaacugauguacugagaauggagaucucaucucaugaccauauauagaaaacucuguaccuuuauccucaauagaaggaaacuggggauggggcggggagucaagcaguagaaaaaugaauuccaucagcuguugcuugcagcugcaggguuucccuuggaggcuccaggccaggccugcuuuuugcaugaagagguaggacaaggagguacaaagggcgucuuagcucuaaacaagguggcgucuuucucauugucaagagguuaucacacaucuugguugacauuccugucuaagucuaacucaagaagccucucuugcugacucaucuucucuucucuuccccugcagaguucccagcaucaugagggccuggaucuucuuucuccuuugccuggccgggagggcccuggcagccccuguaaguacccgaagaugcugucagaguucuaacucaucccgcuuucuccagcuucucaaccugcucugggagcucaaggagacagcagggaugucgcucaguggguggagugcuuaauuagcacucguguacaaaguccuggguucaauccccggcaucgcauaaacccagcuuuagggaacaaaccuacaaucccagcguuugggagguagagguaggaauauccagaguuuaaguucaucuuuggguagguagugaguuugagggcagccugggcuacaugagauccugucuuuaaaaaaggagccugugcagugguuaagagcaugugcagaagacucaaguucaauccccagaacccaaaugguggcuuacaaccaggggaucugauggccucuucuugaccucuuauggguaccaggcauguauauaguguacagacauacaugcaggcaaaacacuuauauacauaaaauaaauaaaucuugggcugaagagauggcucagggcuuaagagcacagauugcucuuuugaaggcccugaguucaaaucccagcaaccacaugguggcucacaaccauccauaaugagaucugacacccucuuuuggugcaucugaagacagcuacaguauacuuagauauaauaauuaauaaaucuuuaaaaaaguuaaaaauaaguugucuuuuuuuuuuuaagccaacaagguuaggagaauugaaaugagggaagcagcucucuguaaagcuccgagcuugcacacuaguuccggugcguuuagcaggaccuguccucuucagggagggagucagcaacagggaugagggacuguuggugggaaugaagcuggcagaaggaccuagguccagagaaaggaacagguuggcgucugagucugggaaguuagaugguaaguaacugacucuggcugaauucuggggguagaaaagaugcagacagagaucguggcuuuggaggcuguuggagaccagggauacauagggcagcacaguaggaucuuggaguaagacuggagcugggcagggagagggagggguuaccauugggaugaaccagaaacgaccuuuacuccaucuugggaauguggagcaagaagaaagaaacuggaaacauucaaagagagccaaucccaccaaaugagguccuggccucccgccccccuccauggucucacuauauauucuggcuugccucuaacuacccccuaccucugcuucagccucccaauggcugggguuaccugugccagcacuccugguuagcuacauuucaaacugccauucccugcucuguucacuagcagguagauggcagcuucuggucaaacucaucagccaggcagauuuuggaucuuggcugaagauuggugagguuaccuuuaacuuuggaagggguuacagucaaucaggggccugaaaaugucuuguuaccagaccugcucuucucggagccugaaauaucaggagggaauuuccuaauugcaauaaaaugaggucacaugugagaggcagggaggauuggcauuuauuagaagucacagaggguauucauucugucugggucucauuuucuccaucugugaauuaaagggaguucaucugugucuucguuaggguuuuacagcugugaacagacaccaugaccaaggcaacucuuauaaggacaacguuucauugagggugguugacagguucagagauucaguccauuaucauuaaggcgggagcauggugccuuccagggaggcauggugcaggggaagcugagaguucuacaucuucaucugaaggcugcuaggagaagacuagcuuccaggcaccuaguacaagggucuuaaagcccaugcccacaaugacacacuuccuccaacaugaccacaccuacucaacaaagccauaccuccuaauagugccacuucaugggccaagcauauucaaaccaccacaaucugcuucuguuguguuggggacguauugaggcuugacuagcagaaauguuucugucaguaaaaugaggaauaggcaagaugguuugguggaagaucuauaaaagucaagugugauggcucaagccugugaucccaguucuuagaaagcuaaaacauaauuggcaaguucaaggucagccugggcucuguagcgaaaccuugucaaaaugaaaggaaauaauaaaacgcaagcuugcuucagcaauagacugauugaaacuuguaugauaccgagaagacuggcacggccauagugccacaugaagcauucuguacuuuuuuuuaaaaaaaaagaaauaaagauggggccagcaagauggguuggcagccaauccugacgaucugaggacccacaccgcaggagagaaccggcuuccacaagcuccuucagcuuccacacauucuuugugcugugggugcucacuccaucccccacauaaaacucacacacacaaauaaaaucauugugauaacagauuuuuuuuuuuaaaggaaggaaggaggauggagcggcacugugagcuccagccagaggcaucaaagccuucacuccaggcuuguguucccagccagagacacuuccgagaagaggguggccuuggccuugacuaacucccugaaccuugcucucuuuuccagcagcagacugaaguugcugaggagauaguggaggaggaaaccgugguggaggagacagggguacguauguggugugguggugguggugguggugaccccacccuugaucccuuucugucuggucccuucuuugggccauccagacaagugcagugggguuccucauuggaccagggcaugcguucucuccuugugugcauucaagacacagauacuaaccugaguauacacagacacuccucacugucccccaaaccuucaguugagccccaagguucugaggauucauacuucuucuguuaucauccacggucucccuuggcaugaaacaaagggacccacaaagggacccacucaguugggccugucagaccugggggaauugguaugucuucucauccuaacaucuugguagccucugauucauuuuaacggaauuuuggggcucuagaccuuuaauauagacugauacacugaauaaacuaauaauaaauacagaauuccaccaaaaccagcaccuccgcccacacagcugagggcggucuggacccagcccuggaugccccucacuuucuucuggguuucugaagcaucaugcaggccccuucuuccuugcaacccucucccaggucugggguggggcgagaaccccugaacucauuuuuuuucucucccaugccagguaccugugggugccaacccaguccagguggaaaugggagaauuugaggacggugcagaggaaacggucgaggaggugguggcugacaguaagucucuuccaugucacuuggcguaucuggaucacccccagcuguguggguggaggccuaaggacagcccacaggacguuucuagucaggggcaugcauuguggaagcucugguagcuguggaaggccagcugggaacccucaagccagggaagucugggauagaucuaauuuauagccaggccauccaagcugugaaggacagaggaagcuccacaguuuggugucagauucucacagaggucauggucacauccggucaccaagauuccugccccagggcuucagccuggguucaagcuccuccuuuggaguccaucugagcucauuuaauuuccacuuggcccgagggagcagagccugacguaaauucuaauaccucaaguagagagacagugacucagggcuuuagcucacagacugaggcauccguguccaaagccauggacuuuggaauuccacgagauucaaacaagguuugaacccuuugaaccacggcuuuuuaacaagacauuggugcagaugguggccccaaggaaaugacucaguggguaaggucacuugcuguacaaccaugaagacggaguuugaauccccagcauccacuugagcucucaaggggacaguuaaggaugucuggggagaaugaggagggcuugcuggaacaaaggcugggccuggggucuugagucauaucccuuuccucuuccaugcccagccuuuguuuccugucagagcugggcccauugucuacuguggguucuucuuccuguuccuuuguggacaccugauucuacaccauuggaucucacagcucaguugaauucaugccaauagcucuaucuuuuaagucacucuugaaaauacuuugaauccagaaauccagcacugcaguugcucaacagagaacugagaaguugguuauugugucagucacugggggaucuguauguaccccaggucucugagucccagacagagguuccaacccucugagaaguuucuagucucgaccuucucgacugaauccccagacuaagcaaacugcuccccuaaacccgugguucagcauggaggaucaggguugccugaaacucugguucugagaguggaguacaccucgaggcugccagccccaaagucccaucugugugguguggaagcacaugccagccuggugaacugacauuauguucuguuccccagaccccugccagaaccaucauugcaaacauggcaaggugugugagcuggacgagagcaacacccccaugugugugugccaggaccccaccagcugcccugcucccauuggcgaguuugagaagguaagagcuggggccugggcccagcaaagcacaauguuuguuaagaaaucuccggacacggcaaggcuggagagauggcucaguuguuaagagcacuggcugcucuuccagagguccugaguucaaaucccagcaaccacaugauggcucacaacuaucuguaaugggauccgaugcccucuucuggugugucugcagacagcuacagaaaucuccagacaugagggagaagcuccauucuuagaagguccccucccuggaaccagucacaacaggaaaguggagcugagucacaggcaagagccugccuggccccacccuucuagccgccauugagaauuuaaaaaagaguuuacuucuaccaccagguuccaggcucuguguugaacaugaucacugagugccucauaaucucaggaggaaugcacuccaguucauacuuuuuuuuuacacuuuauuuauuuuguaugaguguguguguggcaugcaugcauguggacgucagaggacuugcuugguugguucucucuuuccaccaugaggagaccaggauuccaacucaggucagcugguuuggugacaggcaccuucaccuguuaagccaucucacuaguccuucaauaccuugguaguuagcaaagcuuugggcccacauggggcuuuggggucugcuugaagacugacuagcaaccucaucuccaucacuugagagcugugagauuuuaguuaaagcacugagugucuccaagucuuagucccucacaaccaaagauggagagagaauccugaacucauagugcugcuaugccauuuguuagaggaugccaggugugugacauggaccuagcguuauuucucaaaugucuccauucuaucuccaacaugugugcaccuaccauacauucauccacccauccauauuuucagcaugcaccuguucuaugaauucaucuacccacacaaccauaaauccacccaugaaucuaucugccacuuagcuauccaucaauucaaccauccacccacccacccaucugccucucuacccauccacucauucaucuguucacucauucaucuauccauccacccacccauuuaaccaaccaucuucucaccucacucauccauccauccauucaucuacucacccacccacauagucacccacuuauccauccacucacccacccacccacccacucauccaucauccauccacccacccacccauccauccacauacucaucuaucuauccacuuaaauauuuuucgaauacucaccugugccaaccauugugcuguccaccaucuggcuuagggcaacaaaucucuuucuaguucuuucaaucuaguugugcauuucucuuuucuuccuuuuucugucucuguagaccaaguuggccuuggacugaaagaucugccugccucugcuucccaagugcugggauuaaaggcauaugccacuacuacccagcccacauuuuucaauaucuccccaagacaacccuugccucugggcuuuacauauuagcuucacuuuuaacucuuaucucuucuuccccauuccacugcucuuugaugcugcggucuccccugcaucaauguguaagacuccacacuugcaggucagguccuuccccgaucaaaggcugcuccuaccuguacuccugaucccaguuaacccccagccucucuguuuugcucuucuaugacugagguuuuccagcaggacucaaugagucaauugguccagcugcguuucacccaaguccauauucuggauagucacauagcaggggaagcagggagaggcugaaacauccaggagagucuuccucuaggagaauuccacaggggucuuucaucccagcuccaaacauggggcggugauauuucugcuuagaggaacccucuggaguuagguacuauaugguaccuuuuaccugcugagcuaucuuauuggccuuucaguuauauuugggcaaacccuggugguucaggccuaucacccuugguacagaaagguuggaguaagaggaaaguugaaaguucagggcuuggcucugcugcacagcguguuuaagguuagccuggccaauagagugagaguguucuaaaauaaaauaguaaaggaauaaggauuuugaucaucaauagaacaccuaccuaccuagcacacacaaagcuauuuagcuuuggcacugcaaaaaugucuucaccagggacugaugcuauagcugcuuucugcugaguguggagcacuuccagacucccacuagggacauggguacucugccuacagcauccucugcaagcagcccaugaucagugagcguccuugucaacuagggaacugucaucagcaucaagccagagccaacuuaugcugcauucuuccuuccuuuccuuccuccuuccccucuuccuuccuuauuucucuuucuuccccuuccuucauuuauguguguaugugcccacauguguguaugucauaaguuuggaggcaggguuuuuuguuuuguuuuguuuuuuguuguuguuggguuuuucuucuuguuguuguuguuuuuguuuuguuuuguuuuguuuuuaugagacagggcuucucugugcuacccuggcuggccuagaacuugcuuuguagaccaggaugggcuugaagucacagagauccaccugccucugccucuugagggcugggaucaaaggugugugccaccaugccuagcuugaguguccucacugucugagccaucccaccugccccacuguguguuucagaaggauaauggcuccuggcaugcuguguacuuuuuuccauguacaggugucuuuuccccugucucucacuguucuugaaguaacuuuugugccuuagcccugacucagaugugccuuugcuccaaaaucacccaugaccuccuaugguggaacagcagcauguagagugggcuuuugugccccaaucucuaauccaccauaugugugagaacuuggcuguucucacuguuuguguucccuuguccccacaucugaaauggcaaugacagggaucccaggucaggcugugggaaugaaggaggugcccugugcuuggcucacagguaugcagcaaugacaacaagaccuucgacucuuccugccacuucuuugccaccaagugcacccuggagggcaccaagaagggccacaagcuccaccuggacuacaucggaccaugcaaaugugaguguccucaugccuuccagccuccuucucagggagaugguucugugccccacagugccagcucugugauccuggguaaaucccaucccuuccaugagccucagugaacccauucauaaaauuaauucaggcuuucuucucucuugggaagucuuagccaucauggaagcacauuucagagaagauugcaagagccuaccacuagcaucaagacaaccaaaccaucuuccuuccuuucuuucuucuuuuucugaugaggaugcuccuucauaaggcuaacucaaaugauucauacuucagcacuguagaacaaaaucagugugugaccggggccugcagaauauuuuuaauauuuugaauuagaaugcuuuucaaauagggacauugaugugguuauacaaagaugaagagaggagggauggauacguucuauggauguguagucaggugugcgggaagggggugccucaguggggcccaugcugaggcaucccuuucccccgagggaccagccacacggcaauauaguauagaauagaguuuauucagggaauggggaggggaguugagaggguaguagaggcagacaaagggagagagagagacagagagacagagacagagacagagagagacagagagagaggaguagaggccagccaugagcauguugggggggggggauggggagagaguaagagcaagaaggcaagagcaaaagauaaagagagggaggagggggcaaguagccccuuuuauagugggucccuaccuggcuguugccagguaacuguggggcggagcuuagacagaaugcuaacagacauuucuggagcucaggagaugacucacuaggcaaaguacuuguguaaaaaggcuaggugugguagcacacacuuguagccccagugcugcggagguggagccugggacauuccuggggcucacuggcaagucauucuagccugaucugugagcaccaggccaacaaaagagcaugucucaaaaaauaaguugggugacccuugaggggugauaucugugauugaccucuggccuccacacauguguguaugcacacaugacugugagcgcgugcgcacacacacacacacacacacacacacacacacacacuauauacauauauauauauauauauauauacacauauguauacauguauauacauauguguguguauguauauauauauauguauauauauauauauauauauauauacacauauguauacauguauauacauauguguguguauguauauauauauauauauauauauauauauaucuccaaaauaaauggauaaauaaaauuaaacacuggggguauaccugccauuuucuucaggcucuauuccucuauuggcagagauccuuagcuucuuauuccauuuuauuccuccuuccccuuuucuagaagccugggaaauuugaagagggaagccaggggcucugacuggcccauugcuagugacccaagcuguaaauucugcugacacuggggccuccuccucaucugagucucccaagccauacucacugccugugagacaugagcuguauaucuguagcauguuccacauaagaacauccuuccccaugggcuggggcuauaguuaagugguggaaugauugucuggugugcccaggggccugcaucccaucugcaugcauauugaaccaaacuaaaacaaagaagaguccuuucccagccugagguuuucagcuguaggaagugaggguggugaguuagcccugagcucuuaauguugggguugggauguccaaggggaggcagagauuuagagagccuuagagaagacaggguagaggaagucggugaggagucuuggguuaugaggugaggcauguucuaaggagcucuuagcaaguggcucuugcugcuccugaggccacccaccuccccaguccagcuccgugugaagaucuccacucccagauggcggugguacugggcucagaagagcuuuccuugggcucaaagccaaggaugagcagucaucugauccccccugcauccaaagcugaugcucugauauucuggcuguaagcaagagccuccuuuugcccguuguuaagaccaaugacaggagagcuuggaagagaucuccaggugugacauucugggauguuauguuccaaagacaaggauaggguuauggucucuaaaacgguucuagggguuuugcauguuuaagccuucuccccacugcugcuguguuggaccuauggaugcagguuguuucaaacaccuccuagagguuggccuccaguucugcugggaucaaacccuggccaucgccuagagaggugcgagagcaucugggugggugauagaaccccucagcagguugggugcaagccaggaagcagcaaggucuugagcuuccccgugcagacuuuuuuacuuaugacucuggaaagagucuggaucagagagacagagagaggcaccaaggccaggggugcucaguagaguucucaugggcuguaagacaagaaggagacaguagucagguggcgagucugcccucuggcagguguagguugauuaaucuugccucuugugcccuagacaucgcccccugccuggauuccgagcugacugaauucccucugcgcaugcgugacuggcucaaaaauguccuggucaccuuguacgagagagaugagggcaacaaccuccucacugagaagcagaagcugcguguaagugaccuccucccagcuuggacugcugugccugcuauucaucucccuggaguuugcugauggagaucuagggcugaucucuagaaccuggccccaagguggccuaugccccacuuugcagggugccuucaccauugacaccaggacaaaaacuuccagccaccuuuggaggcucugaggaggucuguaguagacagauccagagcaugacccuauucccucuccuccugagucaacaggccuucucuuuuagggagcauauuuagccucauggcaaagaccuaguguugaguucucggccucuucuaaagucuccauagacagugggggcuuggggcagguggugcuaugguuuccccaucuguguguggauaagcugcuaacaccagcaccucucuccuagccucacugugagcucuggucuuggcuggccucuuguuaugugguagagggggauggacccuuggucaccugcugaucccgccccuacaggugaagaagauccaugagaaugagaagcgccuggaggcuggagaccaccccguggagcuguuggcccgagacuuugagaagaacuacaauauguacaucuucccuguccacuggcaguuuggccagcuggaucagcacccuauugauggguaagagucaggguccucaggaccauaggcucagcgcuguccuggacuggggcugguagggcauucgagggggcaaccuuugcugcuucucggcccaagacuccacggucagcuuagggcugggaggaaguaagcccugagacauguaaugucagaggaagcagucagcagcaguacaaagaauucuucccaggccuaugaaggcaggggcagggggcccaugugggcagagaaaaagagcccagaaacagccuucaaugugacccagagccaaggccuugcucauccuuguucaugcuugugugugguccuucagcugaauagggcagccaccacaacggccaugucucagacuccuccugagguucaguuccauggagcccaccuggccccagaaguuccuaagaauuucaauggcuuccacauuacauauuccugaccugggugcucuuggccuguggucugggcauugugaagacuucagagaguuugaagagcaguaccuaagcugacacugaguaccuacuccucugucacuucuggcuucccuuugcagccaugagaguaagagguccucccuguucaggucccaaagaggcaacucacucacuccuucccggggccguugcugcucuaugcuuugaauaucaaaaacaggugguuacucaggggacaggcaggaccaccucccuggcauaauugggagagagauauuaggccagaaaggcuucucucugagaugcucaucacucuauguccgguugugugcugaccaacccccacccccaauucccucccagugccuggcucuccuaggcucugggaagcucucagcugcuccucucccaagcucuugcaguggcugggauccaacugagugacacggggguauggaagggagaguccugggggacauccggaucccgugugccaaguggccucgagaaaguucgagguggcuugccagggcuggauggcuggggaacgcuccagccuccucuuggucagagcuggagguggccuugcaguggcccgagucuguuuucucacaggaccaugaagguccuggccaucucagauucugugugacgccuccugugagcaggaggcugugaggaacacuggagucagaguguccccugacgucccuuguggguaguuguguucuggggacaacuaauugggauucugaggagagaaaaggaaaagaagcaaagaucaugcccuagggucugaggccagcaggagcacacagaggacagagggagggugacccugaagucacucauugcaugauguagccuucccaucuuaccacccagccaggccugguucagccccucccggaagucagagccaucaccagauuuuguuguucacuuauuuuuagcacuggggauagaaccucucacuagggaauucuaggaagugcucuaucacugaaccacaccacauuccagucccuuacuggaggauucuaguccaauacucuaccacugaacuaugucccccaacccuuuacugguggauucucaagggggauucuaggcaggugcucuacugcugagcuauaucccugcccuauuagaggacugaugggucuuuuaagaccccauuuuaggcuccugcaguuauaucagugugugaacaucaaaaaucuauaguguggucaggaggggguggugcacgccuuuaaucccagcaccugggagacugaagcaggcaggucucugaguuugaggccagucuagccuacuuagagaguuccagggcuauacagagaaacccugucuugaaaacaacaacaaagaaaagaaaagaaagggaagggaagggaagggaagggaagggaagggaagggaagggaagggaagggaagggaaaagagaagggaagggaagggaaaagagaagggaagggaagggaagggaagggaagggaagggaagggaagggaagggaagggaagggaagggaaaagagaagggaagggaagggaagggaaaagagaagggaagggaagggaagggaagggaagggaagggaagggaagggaagggaagggaagggaagggggaagggaagggagaagggaagggaagggaagggaagggaagggaagggaagggaagggaagggaagggaagggaagggaaaagagaagggaagggaagggaagggaagggaaggaaaggaaaggaaaggaaaggaaaggaaaggaaaggaaagaaaaagaaaggaaaagaaaagaaaagaagagaaaagaaugacaaucuauauugcaaucucacagacuuugacguagcauaacugaggugccgaauauauuguuucuauguccccaacacucauccaaguggcccuuacaauggggccuauagacucagaacuggaacaacuucacuuacuucccugucagaugggcuaggaaacugaggcucagaguagggucgugugguggugucuugggucucuccugcaggaccauggcagagcuguggguaaagccaggaucccagcccugggcuccuacuaccggcuucccauacuggacuguuguucucccacacucacacccuucccuacucuucccugccagguaccugucccacacugagcuggccccacugcgcgcuccccucauccccauggaacauugcaccacacguuucuuugagaccugugaccuagacaacgacaaguacauugcccuggaggaaugggccggcugcuuuggcaucaaggagcgugaguguuugggcuuaagaauggaaagaaguguccuugagggaugggauguugucccuuccccucugguggcccauuucccucuccugcucccacucccacugccccccuucucuucccgaccagccccccuccuguuuucaagugguagagccuuauuuuaaccacgccccuucuuccuuugcagaggacaucaacaaggaucuggugaucuaaguucacgccuccugcugcaguccugaacucucucccucugauguguccccccucccauuacccccuuguuuaaaauguuuggaugguuggcuguuccgccuggggauaaggugcuaacauagauuuaacugaauacauuaacggugcuaaaaaaaaaaaaaaaacaaaguaagaaagaaacuagaacccaagucacagcauuuucccacauaacucugaggccauggcccauccacagccuccugguccccugcacuacccagugucucacuggcuguguuggaaacggaguugcauaagcucaccguccacaagcacgaggagauaucucuagcuuucauuucuguuuugcauuugacucuuaacacucacccagacucugugcuuauuucauuuugggggaugugggcuuuuuccccuggugguuuggaguuaggcagagggaaguuacagacacagguacaaaauuuggguaaagaugcugugagaccugaggacccaccagucagaacccacauggcaagucuuaguagccuaggucaaggaaagacagaauaauccagagcuguggcacacaugacagacucccagcagcccgggaccuugcugucuucucgacucuuagggcguuucuuuccauguuuggcuguugguuuuaguuuuggugagccaugggugggccagaacaucacucaacugcaauugggcuuucagguucuugccgggagcucuaggcacugggaggcuguuucaggaaagugagacucaagaggaagacagaaaagguuguaacguagaggaagugagacuggugaauugguuugauuuuuuucacaucuagauggcugucauaaaguuucuagcauguucccccucaccucuccccacccccugccacuugaaaccuucuacuaaucaagagaaacuuccaagccaacggaauggucagaucucacaggcugagaaauuguuccccuccaagcauuucaugaaaaagcugcuucucauuaaccaugcaaacucucacagcaaugugaagagcuugacaagucuuucaaaauaaaaaguaacaacuuagaaacggcuguccugucccgggugaugguaugugugucuuacucuccggugcuucguuuucaggugugcacaaacauggccauacuugugcacagaagcaaacacuccauugugcuuuuauacacacacacauauucacacacucagacagggaagauauggcuccugugagcacuaauuuaacacaugaagaagccaguuccugggcugggauguagcucaguugauaaagugcuuacccaauaugaacaaagcccagguucgaucgucagcgcaaccuaagcuggcuguggcagugaauguuugaaaucccagccccaaggagguagaggcaggacagucaaauguccaaggucauccuuagcuacaagugagcuggagg

SEQ ID NO: 6009 - RNA, 16913 nt, Mus musculus
ggauggauggauggauagauagauagauagauagauagauagauagauagaauaaccuuuucccuuguucugagaggcagucaaucaaucuagcaaaacuuuaaauggcagacaauuccucacauaccaauuuguucuauuuuuaauuuuagggaacuguguguggugacaucgcaacacuaggugcauuaaggccagaagcaagcuguacaucaucaggugaggacucucagugaggcaugucaagggcaaguaaagaaaguugacuucaggagaugaaauaaagauggcuucccuucccccagaauaagucuggggccaucagugcucagcacuagcuccguggcucuugcaucagccucugggacauuucugucauggacagcuagacggaagguccuuguucucuagaaguuauguggaguuggagcaaggaggcagagagugguaucaguucccuuuggggauauagaugcuuucccagaagccucccagccagaacguucugcagggggaccuguuucucggacacuuaugucuuaaccuucuggacaguugaaucuucucacauccaucacacuuuuguaucagggugaaggguuauuagugcuugggacaugguguuuuguaguguagacuggcuuugaacuuucagcaaucccccugcuuccaauucuuuuuguuguuguuuguuuguuuuuguuuuuguuuuggggggguugagacaggguuucucuguguagcccuagcuguccuggaacucacucuguagaccaggcuggccucaaacucagaaauccgcuugccucugccucccgagugcugggagcaaggcgugcaccaccaucgcccagccuauuauguucuuacauuuauuuuauuuuaguucauuuuauuuaagacagguucucaugaggcucagacuggccuccaauucauaaauccccugccucagccucuggaguguagggggaaugcuuguuuuuuuuuuuuuuaagauuuauuuauuuauuauauguaaguacacuguagcuguccucagacaccccagaagagggcaucagauuucguuacggauggucgugagccaccaugugguugcugggauuugaacucgggaccuuuggaagagcagucggcgcgcucuuaauuacugagccaucucgccagccccgggaaugcuuguuuauagacacaugugugccacccuuaccccauccagcuagucuuagauucuuaggcuuuccccuguuagccaacuucuuauaacuuuuauguucaaauuauagcaugguuucagacugaacccauccugacacacaaaauggcagauugccuacuuaguuuagggaucuccucucagccuccagcucaaggacacaaauggcugguagaggagauagauccagucgguugguccuucuggcacucuugaggaagccaaucuucuucaugggugucaguuacccaugcaguaacucgguuuacuggggcugccauaauugggugggaaggacgcagucucauggguuuuuuguuuuguuuuguuuguuuguuuguuuguuuguuuuuugcauagcccuggagcuugcucuguagaccaggcuggcuuugaacuuaagagauccaccugccucugccuccagagggccaggauugaaggaaggcaugaccaccaccuggcccagcucugccucaacuuuucaagcacugggauuacaguugugaauuuaucuacuaugugccuuaaauuuggauuucuuuuuuaauauguuuuuucaggaaagggucucaagaaguccaggaugcccuugaacuuugcagccgcaguaagccuugaacccagaaaucuucugccucagccacguuaguauccgggucaacaggccuggcgcccuaggucaggccacuguaguuuagggacugaguugagugguaagcaagagagauggucccuuuagggagaugccagaucuuuuauucccagagccuuggccuugcauucccuagcccuguuucagaaaugacccagcagaaaacgcaggucuggccuccacaagauagccuuagcuugaccucaaaaaagccuggccuuuccgcguccggaggggcgugaccuaacccaaaagagaggcgggaccuagugaaauauucauaucgaaaggcacgguaagcaagaggaggccagcccaagggaggaaccuagcucuaacuggaccggaagggacagggaauuuagcagauccuuccucaaagggccgggccuugacgaagcuagccccggaagaggcggggcauaaguggagcccagcccuagggcggggccuggccgaaggauggguuggccugagggcggggcuuucaggagcgcucuccggaagcgcagcuuugguguccgggagaggaguuccagucgucgucgccgcugccacugcccgugugugccgcgucagucaugccgguaaguggccguucgacccgcgggaacuucugucuccagcccggaugcacuguuuccgagcccgacgcugcugucagggcgcaggccguggccagagcugcagucguuucucaguuuaccuuccgcacgguccuccggcuucgggacccuccggaaagcugcagagagcaguguagugcagaacacaggccuccggaucgcccuagagagucuucgagaggcagccccauccuuuucugcauaauggggaaacugaggcagggagguagggcagagaacccauauaggaaugcggguaccuggccuuuccacaugcauacccugccgccugcaggcuuuccagagaagcaugucucuguucaucucuccugcccacacugcccugcuuccacuucagcacugggccgacaggguacuuucuuccccaaccaggaaucccaaagcucagagcagaguuuaaggagccgagagcagcgcuuaucuugccuuugaaaucaccccacuccuuugcauggcggcuucuagucucauugcuuaauuuaaaaugaaggccuuacaugaggccuuggcacauuacacaagaagagaagaaaaaccccagugcuugcuggaaagcguuuauuguugggagcuagcuagguagguaggauacaagauggagccagaccaccugggaagugcugggcaaaaccaguuguacuuguuugggggcaagcucuaaucucaacugaguuccggagaugcuggucuagaguuguggaguggagagcauuuuccucccagugccucucaacccagaggucucccaggaguauucuguguuuuagcagcuuaucuucugggaaugaaccugaggcuucuuccugguacaaauccuuaaaccucucaggugucauucuugugguuccugcccauugucuucagacccugucugcacaaagcacagaccaaaaaaaaaaaaaaaacuugguaaaguccauccugccagucaagcuaguccaugugacagacuccuuggugaccucaggauuccagaguggaggcugcccggcugcucuucagagggcagcagugaaggaaaaaaauagcuugagggccucucuguucugugucugccucuggggacacaggauuuaaugggagaugaacaggcaccuuaucaagacaaauugcuaagugcagggagguauuggucaagugcuaccuccaaucuagccagggaaguaagucuuacccaagauaguuugcagaccaaagcuuaacccagaaaccugaaaguuugcccuuggcuugccagcugggcagccucaggcaaguuguucugccucucugagccuuugucuccucaucuguaaaaucaggacugaaaacagaccuuucaggacugagguugguauuaacuggaguuauaucaucauauuuaacacagcuagugacccaucuguccccaaggaguagugacucuuauguugauguaggucgagugggguagaacuggguaggcaggcuuccacuccaauuuaacaugggucucacugguuaaaaguucaagucuuguguccucucuccagccuaggccuuccuacucaugagcugugucuccuggggucaguauuuaaccccggagcuucagccuucugaucucucacaagguagaguuuccuggcuuuuugaaucauuguagcgauuaaaggagacauaaaggagacaguguaacaaggugugagagagucgggcacaucagagaugugcagauacuaguaaacaggacucuaagacaccaguguucaaagacucagcguccucuagaggaauaguguccuccucuuccucuuucuccucccccuccuacucccccucuauucucacucuuccaguucuagugucuauaaaagaaucauaccacuuacuggcuuucugaaguaauuaauauauauaauauaguaauacaacaauauguaguauaacaauauauauuauacuuaugaggauucauuuuguuauuaucguuaccaaacaucaccauagcccagguuggcuguaagugaauaccuagcccaggaugacucuuaaacucauagcaaucuuucugccuuagcuucucaaggguuggguuugcagaagugagcugccacaccuggcuuaugguuuuguuuuguggugcuagguguugaauccagggccuguguauacaauguaugugcucugucacugagccucaaacccaagaccuaaagaaaggauccuggggucuaguggcccuggcgagacacccagaagguggagcaguuuagggaauacccuugugaagacuggaucacccugucccuuaagccaacucugugucaucauguuuaguugcacaauguguaggcagagguagggagcucugagcuggaacaucggccuccuggagcggaccccugaccucugaccucugugcugugaaagaaguccuuuccugccgugguccucaguuuggagcucagauaacuguugacuuuagcuccuugagcagcaaaaaauuauccucugaaacuccauuucagagcuucuucugagaguagcuuguggagcuaugcuaagauuugccuggagcaaagaaagccucucuccccuagggccuucacacccaugaccucaucaccuuagugaauccugagcagaaggaaaugaaugcuucucuuuucaagcuagaaaaauacugcagaaaagggaacaugaggguugcaggaugggucagguugauggccucugacaucccuggcacacacucccacaugcaaauaagugaauaauuguaauuuacuugcuacguacuaucuuguagcuuuaauuuuauuugugugugugugugugugugugugugugugugugugcgcgcgcgcaugccacuuguguacagagaccauaagagagggcuucagauucccugagagugggaauuacagugguaacuguaacauccaacaugguucgggaaacucaggucucuggaagaguacaagcagucuuaacuacugagccaucagucuagcccuauuuuuuuauuuuuugcuuugcuucugagacaggguuuuccuguguauccuggaacucacucuguagacuggacuggccucaaacuuggagaucugccugccacugccuccagcgugcauggauuaaagacaugagcccacacccccccaguuuuuuuauuuuuuuaauuauaugcauauaccugugucaauguguggguauguggguaugagugugggugccugugggguccauaaaaaggcaucagaucccccuggaguuauaguuacaggcuguugugagccugcuaauggggacacugggauccaaacuuggguccuuuggaaggacaguaugaguucuuaacugcugauuccuaaucuucacaaaggaacuacagagggcccaugucuauauuccuaccaucacauagcagcucauagcuagcuuuaacuccaguuccagaggaugcuauauccuccuuugaguucugugagguccugcacauaccuggugugcauaaacucaugaaggcacacacacauauacacauagacauaauuaaaaaaaaaguaugcuggauauagcgaugcaugacuuuaaucccgccucugccucccaagugcuuggauuaaauacuaaaguaauccuaguacugagauggcagaggccugcagaucucugugagucugugaccauaaacgcaguuucagacuagccgggggccugaugccacaaggugcccaaacaugguucauucacaacauugcaugaaauuaccuuucgucuguguacauaaauaugauucauguuuagacucguucuauccccaagacagcucauuauguguaugcgaauauugccucaucagggacauuucugcucccaagcacucagaugaggcucacucagcuuguccuagagauauuuugaugagcuucauggggaaggugggcguugaauuuggauguguuguuggguaccuauuuaugcagugcuuggguuucugaggcgggaagguagaguuugaggcucaguauggacagcauacugaguuccaggcuagucugggcuacauaauaagacccuguucucaaaguagcagcaacaacagcaacaaaacaaggauggggcugggggguggggagccacuguuuuguucuuguuauuuuuguuuguuuguuuguuguuuguuauuuuguuacugcaguuauauuacuggugguugggaucuugggcuggcuguuucuaagcucuuggcuucuuauucagaguuaaaauaaaggggcacguagauuacaaaguagcacggaaacuauucaaagcaaaacaauguacugucucaguaugggaaguaaacccagggcuuuauacaugccaggcaagcaauguaccacugaauuacagucccaggguggaggacuuugaaaaaccuuguuuuucaaaaugaagggagaaauggaaaagaguaauuaucaaaauccaauaacuuucaucuaguagcgcuuagucucauaaucuaaucuuauuaacacauuaaccaucuauugcccuucaauacuuauccccaaaccuagagucaggaccugggaauggcugagcagagugaguaguaggcuuggcuuaggaccuaacagaacaacagugcaggccagaggcuugcccaggcuggugcaguccuuggcuuugaccuuggagacucuguuucucaccagguagaccucuggaugcauacaaaguguccuuucacauagcaacuggcuuccucuagagcagcaguucucaaccuguggguugcacccccuuuggugguuguauaucauccuuuguaucauguauuuacauuaagauucaaaacaguagcaaaauuacaguuaugaaguagcaacacaauaauuuuugguuggcugucacuacaacaugaggaacuauauauauuaaagggucgcagcauuaggaaggcuccccagaagggagcaggggcagaagccagcauugugaccagcuuagucacauaacaguggugguuuagccuuauguuuaauacacacaggcuuauccugaaauguuauggcaugaacucucgagggcaugaacaucaggaggcagggaaaguagagaucauggugggggcugggugccacaugucagauucuguguuugucccauucuucagccccagggaagggagugguacccuaugaguuaagcucuuaggggauacaauuuguggguauuggacccagaugcucucauuuccagauugugaaggaagggaggauuggcacagucccucucugaaagccaaagaccagaaauugucucgcagugagacugaccauugacucacucuaauggguuuaaugccuccucugugccucaugcuguucucaguauuuugggugcagcacugaauugaagcccggucucauaggcacuugccugcuuugacuuguaauagcucagagguuggaggaccucaggaaccuggggucccuucccauccccugcagugcagggagcccaggaagucccuccccuucuuggaacucaggugcugccuuugagcacgaggugcuuggaucagagcagugguggccacauauaugagucaccugcaugcugacauaaucuaugucccuguccagguugcugagcagaccugcagccuguggagagucccucccuggugacuccaauguugaaaauaauguucuaguaaaaaaucaggucccagaucugauaagaauggagccugccugucacuaguggcuagguacucugguucugaggcaaaguccacagcucacaaagcaguaaccucgagggagaacuggaaaagagcuucccacacagcccugcaggugauccuguucaucaugugccagacuuugcaaaagacaucauggagaucaucucuguugggacugccugugauacauggaagcccugcguucccccuccccacuuaccuguugacuagguuggacucacagacacuuccagugagauguguucgcucucucuggcucccugucaacuccugacuagccccugcgacaguguauggguucuucaagggccuagcucaggagcucucuuucuugcagaagcacgaguucuccguggacaugaccugugagggcugugcugaagccgucuccagaguccucaacaagcugggaggugaguggcugucgcuggagaugggauggggagccugucacaugggagucguguucagaugcuugaggccuggaaggaucugcugcguugcagcucagccgggacuaacagugaaacggaaaugugugugcuugugugcacuggcuuacacgggcauggaugccuuuguucugcaaaccccccccccccccuccccagcuuagucuuguuuuugagacagagcucuaguuguccuagaacguaccacauagacugguccuaaauuuaugguaauccuccugccucugccuuccaaaugcugggauuacaaacguggaccaccaugccaccauauacaacuccguuuuguugauucuuucaccgcuccccucccgcacccuuuucuucagggucucgaugcguagcugguggucauggacuccaucaucagccucugcuugaaugccagggacucuuucuuuuaugaaggcaggaaguguuuagaguucaaugacucugcuggauucccagagccugcaggacagagcugguguuuggccacacugucuagcucuggagccuagaggugcuagguaguaugcuggugaucuccagugugacaacauacgcagagugaaaacaaccaggccuggugguacaugccuguaaacccagaaggaucaaaaguucaaggcuagccugggcaauuuaggaagaccuugucucaaaauaaaaaugacggaagaagcuagagaugcagcuccuuaagagagugcuugcauggcguauaugacauucuagauccagcccauaauacugcaagaaaaucaaaucauaaguuuauaaaagcaaagcaaagcucgguguggccgcucacagcuguaauccuagcuccugggaggcagagacaaacaaggcauugccauggauuugaggccagccagggcuacagagugagacccuacuucuacaacuuauaaauaaacaaaaccuagggagcaguaccacugaggggugaaacagcucccacauugucagucuacagagugggacuuuccaagguggaucgggacagaugacgucaaugcccaaggggaagugccuugcccaaguuccacagugagagugagucaggaacuuguuucugagcccugcgagucuuuuuuuaguuuuuuaaaacaggguuucccauuguaguucuggcuagccuggaucuuaccauggguagcucaggauagacuucaaacuuucaccaguccuccugccucagcugccugaguucugugaugauagccaugaaccauccugcccagcugcacuguucauaagaaucggagacacuggagagaaccuggcugcucacuucccacaaagcuauaggcuucccucccugggguuuggcccucccuagauaagaucugagaaugucggcaugugcuggagacacuucagaaaugaaauggaggaugcugaagaaauggcucagugguuaggagcacugacugcacuuccaaccacccuggguucaauucccagcacccucuuggaaguuggaaacuguagcuuuucccuauguguggaugagacuggccugugggcaagccugugguggauuuucuucauugaugauugauguggagggcccagcucgcuguggguggugccaccccguccuuaugggugcuguaagaaagcagggugaguaagccaugaggagcaagccaguaaacagcauugcuucauggccucuguaucagcuccugccuccagggagguccaacccucaccuacccuuccuucacgauggauugugauguggaaguuuaagcaaaauaaagccauccuccccagguuguuuugggccaugguguuuuuaucacagcaauagaaaccuuaacuaagauacucccuuaugccccuacuguugaggaugguugguccaaggguuuuuaaguugcuuagggccuggguagucggacuaagggcugacuuaggcaggaaagagcauugaggcuaaccacagccccuuugugacagccggggaagccaaggccuguaauaguccugaccauagcuacccaggccuuuucauugacacgccauuuuagaggagggcauuguggguuuuuguuucuugguguguguaggaguuggacaagaaaggcaguuuggcgguggcuguaaacaucccacacguuccaggcuggugccccacaguucuauuccaauuuacaaugugguagcuuugcacagguauggccaggugggcuuuagcgcacuggcuauagaauggcaggcagacccgauccucuguccccagaaggauggagucagugagcagauguggggacaccugggaagaauggagagcuguugaagagcaagggacaguuaggcauguuggcacacaccuuuaaucccagcauucuagaggcagaggcagguggaucucugugaguucaaggccagccagccuggucuagagugaguuccaagacaggcaacauagagaaacccugucaugaaaaacaaaaaucaaaaacaaagacuaaaauaaacaaacuaggccugucaucacaucacacuaaaucgggaagcugagacaggaaaaucacaagcucaggccuuccugagugagucugagacauucuuuuuuuguuuuguuuuguuuuuuuguuuuuuuuaauuuugguuuuucgagacaggguuucucuguauagccccuggcuguccuggaacucacuuuguagaccaggcuggccucgaacucagaaauccaccugccucugccucccgagugcugggauuaaaggcuugcgccaccacuccuggcgaguuugagaaauucaaagcuacucugggugacuuagugagaccuccucaaauaaaaaguaucaagagaccuggggaugaagcucagugacagagugcuugcuggguguguuugaugcucuagguagcaguaacacacacacacacacacacacacacacacacacacacacaggcuggggagccccagggcuucaguaguagaauacacaugugagacccaguaccacguugagagacacagagacagagacagacagacagagcacacaagcauuaaguacucagugagaaagggugcuugcugccaaacuugaguuuaauucuaggacccacauagaaggagauaucugacucuaaguugucuuugacuaucauacacgcucucacacacucacacacaugcacacacacaugcacacacacacacaugcacacccccaacacauguaccucacucauuuaccucccucacaugcaugcucauuaugcucacugacacacugucauacauucccugacucacacacauuuauucucccacacacucagacugacacacauacacgcucguauacagauucuuuucacacacuuguucacucauacuugcuaacagagacucacacuuaacacacacucacccguguucuuauuaaaauuaauaagauuuuuaaagaaagcgguuggagagagaagaguacagcugcucuugcaaaggucuggaucccguucucagcaccauaugaugguucacagccaaggaaaccaacgcucucuucugaccuccauggucauugcacaaacgugguacacagauauacaugcaagaaaaacacauacaaaaaauaaguaaguucccgccugagaaaacgccuugaugguuaagaguauguacuucucuuggagaggaccgagcaccacaucugucagcucacaaccacuuacaacuccagacccuacaccucuggccugcagggcaccucuacucaugugaacauacccacacacuggcccaagcauaaacauaauuuuuaaaucuuuuaaauaagauuauaaagaaagggaaggaaggagggcuugcuaaauugggagguugaugugggcaugggaaagugaggugguagugauaguaggauuggggggcgggaagacggaaagagaggaaggagaaaaggagagaagagacucacucgcggggcugaggaaagagguuagaguggagugugcaccugguacuugaggccuuggauucaagccccaucacccaaacgccuuacacauagagaagagccugcagcagagccugccgcgcucacaguaccuaaaacagaaagagcucgccgggugugacaggaauauuaaggaggccgaccucuuuguuccagugaguggaaggguccugcuucccccuccuacaucccaguuugcuucuucccaacaggaguggaguucaacauugaccugcccaacaagaaggucugcaucgacucugagcacagcucagacacccugcuggcaacccucaacaaaacaggaaaggcuguuuccuaccuuggccccaaguagccaggaccugggcgaguccuuccggauauaaacugaagaggcaggugggugaggucccagccauuguugcacaagccuguugcuucuccuggggucccucaucugaaaggcuugagcccagaagcaguucagauugcaauuucuuugggguuuggaaucuuugccuaaauccacccagagggcauccauaauagaaaaaccccaaaccuucucaccauccagcuggcacugucuaguuuuggagcacacugcaacugggguuccuggauuugaggugcucagacuggacuugggcuucucgagagagagguagggggugcccugauauguccagcccgcugccccucucuggaaaggucacaagcacguccucauuguccaauacaagcgagaaguucgggggucuugagggccuccugugagcagacagagugcuguguuauguucccagagucccacgggauucgaggggcaccuugcuuggucagcgugcuuucaguuuagaguaugugacucuucugaaauggugagccucuuacuuuggugaaguggcugucccuucacaguagugucccacacugugucccaagccucugucaucccucuucaugaguucuugcucacccugccuuuccuuccacuuggagccggauguggcgccagcccagccuggugcagagucagugacccaucuaagcuaucuuccuuccauguuaccggucccagggaggcaggaaguggaccagugccagugcccuucugucaggaagcaggacagucgccugcccacccagcaguccucauuguguccaacacccucgcuuccucugcagugugucugacccaugaauuacugcagucacuuuggugguuuguguucucuuuggaacugagaaacacgaggccuggugaaugugagugagcugaccagagccccacgaagguggguggcagaggagggaaggagccaggcagucugugcgaauguguaaaugauaguuacgauagugcugacucuaucagugacccaugagggccccuggcagaggccagcuguaaucaacugggggugagagguuccccuuuguguagaguauccuccuuaaugugagcauuuggaaccuaagccauguguucugugucuaugggacauuccagcaaauuaaaaagugaagacgauccaguucacaggaggcuaaggcaggagaggagaaccaggaagucaaggcuaacccggguuagagagagagacccugacucaaaaaguaaauuuaacaaggacaaugacagaaaaugagggugccugcuacugagccugacaacuugaguucaaucucccaugugguggaaggagagaacugagucccucacauugucuuuugcccuuuacacgcgcacacgcaacacaugcacauccacacacacucagaacacacacacacacacuaaauguagauaaggaaggaaauagaaguuagugcucccugccuuuccuggcccuggacuugguccucucccaggaacgagccagcguggagucuggggcucagcuccgcugugguucgcacagccuggacgugcuuccuguaccugagauuugaucucuggaggacacaaacccuccauucugccccacugccucuccuggucccugugcagccuccuaaaggcucguccccuacaggaugacaacaccagcagcuuuugcugugcuucggaccugcgcauccagcaugguccagaaucccugggguuuguggguggggcccuggccuccaucucuuccaaacaaucuuauuguguuuuggaccuccuuguaaagguuuucuuuauuuuuuaaaauuuuuuauuagguauuuuccucauuuacauuuccaaugcuaucccaaaagucccccauauccacccccccaauccccuacccaccgacucccccuuuuuagcccuggcgucccccuguacuggggcauauaaaguuuguguguccaaugggccucucuuuccacugauggccgacuaggccaucuuuugauacauaugcagcuagagacaagagcuccgggguacugguuaguucauaauguugucccaccuauaggguugcaguucccuuuagcuccauggguacuuucucuaguuccucaauugggggcccugugauccauccaauagcugacugugagcauccacuucuguguuugcuaggccccggcauagucucauuuauuuuuuaaaagucauuuugaaguagagccucccuguauaacccaggccaucuggaaguggcaacaauccuucuguccuaacccuucaaaugcugugaucacagcugugagccccuggguaaucguccagguaagguuguauacgaggugcaggaaaauggcucaguggguaaaggcaccuugggugcaagccuggagaccugcguuugaucucuagaauccaccuaaagguggaaggcgagaauaaaccuguccgccgaccuucacacacagacgaugauaugcauaccaacaccauucuaaugauuuuuuuuuuagauuuauuuauuauuauacauaaguacccuguagcugucuucagaugcaccagaagaaggugucauaucucauuacgggugguuguaauccaccaugugguugcugggauuugaacucagaaccuuuggaagagcagucagugcucuuacccgcugagccaucucaucagcccccgaaaauuuuuauuuagcuggguggugguggcauacaccuuuaaucucagccaagaggcagguggaucucugaguucgaggccagccuggucuacauuguuagucccaggacagcuagggcuauacagagaagcccugucucaaacaaacaaacaaacaaaccaaaaagaacaaagaaagaaaaagaaaacaagaaggguuuguuuaccuuugagaaaaggguuguguuuuugauaagcauggucucuggagaaggacugagaggaaggacgaacagucucuguaacuaaaguggcgccugcuuaugacgagacccuucgagcuuguuccuuguggcuuucguuaucaaggugaaaauguaguugacaugauguaguuuucuguguucauggguugccauucauaagcacuguaugcguucaugguggaacacaaccacaucgguaccuacuucagaacaauuaucugagaaaaaaaaccucauguccgucagcacuacuuccucugauaaugccagucugcuaguucuagagcucacucuguauguagaccugaaacucacagagcuuccccacccccaacccccugccuccggaguacugggauuaaaggagugcaccaccaccuccuggcuuuuuuuaaaaaaaaaaaguuauuauuaacgauuucauguagcucaaguuggccuugaacuccugauccuccugcuucuuacuccaguguugguauuacagaaguuggccaagcccaguuuucagacuuuuuagucugggaggugucaaacauguuuaagcucuguguggaaagguuguuccugccuuucacccaaaauuccacaucugguuacuuuguaacagacucuaaccauacaaaguuucaccuuugcagauaccaguuaccaugggcaguuacagagaggcuguagaacagacugaaaugcaauguuucccacucacaguagguggcgccauugaucugucuuauuuucccuuucuccuaggcuguugaucuggucuccccggcagaucuggaacaccaacugcucaguccaguccagcccagccauggaguuccugcccagacaggccuuccccgcuggcucccugcaagcuuccauguaauaaagucaagcugaguuuguugaugaag

SEQ ID NO: 6010 - RNA, 2648 nt, Mus musculus
ccugguaauagauuuuuaagcucucccuaccuuuagccauguugcaguuucaacuggggcgagucaaagggaaucccaugucgaucucauuuuguagcuguguagaccgcccguuggcucccaggcuauuuuucuagccucuaacagaauucucucuugcucuucgguuguuaaaggcaucuguaaccgcuguugacaguaaucccaaguaggcugaugagagaacauaaggaacuccgccaacccugugaggcguuggggauccugagaaagggggugguuaguuuucuaguuauaaauaccagcagaggaaaaugaccaguacugaaggguuuaaaguuugaguggguccaccagaguccgcccggacucugcucugcaggucccuguggauccauguacucacagcgguccgccucucaacgccccgagggguuugggguucccuuggcggcuggggucgaggcuguggauaaggggaagguuauggacuaggccacucaggaggcuuuauagauuuuagaggagccgauuuagcugguugcuccaauuuaggagaagccuucaauuucucuuguaacaugagagcacaaccacaauuuugagaagcaaaacucaauuuuaacaguguaaacaaucuauuuucuuuaaaaaugaacucuaaaaacauuacuugcuacaaaguuuggcugucuguuccugcacacaaacacaagaagguguagccgccaauauaucucaaagacacuacccuaaaucuuaucuuuuauaaaucagauuucuaggauaagaauuacacagaauauuacccaauucaggcguaucuuuagagaccuguucccauggguugucucauguugcauguuguaguucuaaauuacucuaacccagaguuaccaguuuuaagucaacuuuuuguuaccaauguuacaaauuuuuaaucauaaccaauaacuuaugagccacuaaucuauaaccaagacauauaaaacauauuuauacuuuugaaacuauuuagaaacaaaaaugaaauggccauauacauuugcucauuuaaaccaaacaaaauucuuaauuuuucuagcuguaauuucaaaagaggagcaccuugucaccugaugaauccaauuuuuguaggaaaaacagccaucuguucccuuaccauagaacuuugagaagcugcuggucccuauaagaacagcauuuauaaucagugccuagcagggcuucucuagccacacuagauuccuaacuacaggugcaggguucuaaagaccaauuaauacuguuuauuuuauuuuauuuuauuuuuuuauuaccaaauuaucuccagauagucggagaguacugcuuuucucaaaacccauuuucucacaucucagguguaaacuaucucuagucaggguauaaagcaccuaugagaauuaccuuuguuucucuagauuuucacauagcucuaaacacguacacaaaaacacauaaaacagaaaccaacaaaucuagacacacucgacccuuucuuguccuccacaagcaggcaaaagaauuagacgauguuggagggggaagcuuccgcuucaacagaacucggucccucugaccgauccggagacggccaggcgucccugacucuccuuaccucccagggcgucccccagggccacagccugugguccucuuagcacgucugccgaccacaguccuccgguccuuacggcccaaaaggacagcugcaaauacagacgcgcgcauuucagaaaaccccaucaccccaucgucuacaaacaccgucguccacuucuaccuagacgaccaaaaccagagaaucucacuuguuucucacucugccagguguaaaaccaaagcacgaggaggugggacucgaacccacgaucucguaacccugaaaccaaagcacgaggugggacuggaacccacgaucucgcaacccgaaaaccaaggcacgaggugggacucgaacccacgaucucguaacccugaaaucaagacacaaauuuaauaaacucagauggauccaaacucagacuuugccguguuucagaaacauaggacaagacacaaacaacccaacauaacaagcacauguuccaauguucguuucagaaaacagacacucaaaacagauacaccggccggcacacacacaagaggggauccccauaccuccaagucgguucucgggugugagggguggucgcguuucccggccaacgcaccaaaugaaagacccacaacgugaggacucccccacguucugacucaggagaggcgacaccccaaaaucaccaacgagaaaacggucuuguugcaaauugcaagaggauuuuuauuuaagagcgcucucgggcccacggucauacaccacgcagggguagaggacuguggcgccccgaguagcuggguaaggggguauuuaaaggaagaaaccgaaacucaaggaaguggggagggcguuguuggaagauaccaaagauaccaguuaagagucacaaggaaguguaaaguuacaagagucacaaggaauaccugguaauuguuaacucucaagacagcuucuaagagccccuaacaauagcacauuugcauugcagguucugguaauggccagggugacuuucuuugaauga

SEQ ID NO: 6011 - RNA, 2648 nt, Mus musculus
ucauucaaagaaagucacccuggccauuaccagaaccugcaaugcaaaugugcuauuguuaggggcucuuagaagcugucuugagaguuaacaauuaccagguauuccuugugacucuuguaacuuuacacuuccuugugacucuuaacugguaucuuugguaucuuccaacaacgcccuccccacuuccuugaguuucgguuucuuccuuuaaauacccccuuacccagcuacucggggcgccacaguccucuaccccugcgugguguaugaccgugggcccgagagcgcucuuaaauaaaaauccucuugcaauuugcaacaagaccguuuucucguuggugauuuuggggugucgccucuccugagucagaacgugggggaguccucacguugugggucuuucauuuggugcguuggccgggaaacgcgaccaccccucacacccgagaaccgacuuggagguauggggauccccucuugugugugugccggccgguguaucuguuuugagugucuguuuucugaaacgaacauuggaacaugugcuuguuauguuggguuguuugugucuuguccuauguuucugaaacacggcaaagucugaguuuggauccaucugaguuuauuaaauuugugucuugauuucaggguuacgagaucguggguucgagucccaccucgugccuugguuuucggguugcgagaucguggguuccagucccaccucgugcuuugguuucaggguuacgagaucguggguucgagucccaccuccucgugcuuugguuuuacaccuggcagagugagaaacaagugagauucucugguuuuggucgucuagguagaaguggacgacgguguuuguagacgauggggugaugggguuuucugaaaugcgcgcgucuguauuugcagcuguccuuuugggccguaaggaccggaggacuguggucggcagacgugcuaagaggaccacaggcuguggcccugggggacgcccugggagguaaggagagucagggacgccuggccgucuccggaucggucagagggaccgaguucuguugaagcggaagcuucccccuccaacaucgucuaauucuuuugccugcuuguggaggacaagaaagggucgagugugucuagauuuguugguuucuguuuuauguguuuuuguguacguguuuagagcuaugugaaaaucuagagaaacaaagguaauucucauaggugcuuuauacccugacuagagauaguuuacaccugagaugugagaaaauggguuuugagaaaagcaguacucuccgacuaucuggagauaauuugguaauaaaaaaauaaaauaaaauaaaauaaacaguauuaauuggucuuuagaacccugcaccuguaguuaggaaucuaguguggcuagagaagcccugcuaggcacugauuauaaaugcuguucuuauagggaccagcagcuucucaaaguucuaugguaagggaacagauggcuguuuuuccuacaaaaauuggauucaucaggugacaaggugcuccucuuuugaaauuacagcuagaaaaauuaagaauuuuguuugguuuaaaugagcaaauguauauggccauuucauuuuuguuucuaaauaguuucaaaaguauaaauauguuuuauaugucuugguuauagauuaguggcucauaaguuauugguuaugauuaaaaauuuguaacauugguaacaaaaaguugacuuaaaacugguaacucuggguuagaguaauuuagaacuacaacaugcaacaugagacaacccaugggaacaggucucuaaagauacgccugaauuggguaauauucuguguaauucuuauccuagaaaucugauuuauaaaagauaagauuuaggguagugucuuugagauauauuggcggcuacaccuucuuguguuugugugcaggaacagacagccaaacuuuguagcaaguaauguuuuuagaguucauuuuuaaagaaaauagauuguuuacacuguuaaaauugaguuuugcuucucaaaauugugguugugcucucauguuacaagagaaauugaaggcuucuccuaaauuggagcaaccagcuaaaucggcuccucuaaaaucuauaaagccuccugaguggccuaguccauaaccuuccccuuauccacagccucgaccccagccgccaagggaaccccaaaccccucggggcguugagaggcggaccgcugugaguacauggauccacagggaccugcagagcagaguccgggcggacucugguggacccacucaaacuuuaaacccuucaguacuggucauuuuccucugcugguauuuauaacuagaaaacuaaccacccccuuucucaggauccccaacgccucacaggguuggcggaguuccuuauguucucucaucagccuacuugggauuacugucaacagcgguuacagaugccuuuaacaaccgaagagcaagagagaauucuguuagaggcuagaaaaauagccugggagccaacgggcggucuacacagcuacaaaaugagaucgacaugggauucccuuugacucgccccaguugaaacugcaacauggcuaaagguagggagagcuuaaaaaucuauuaccagg

SEQ ID NO: 6012 - RNA, 1098 nt, Mus musculus
uaucccagcuugcaggaggcuccaaggccacccugagauacauaaugggacauugucucaaaacuuuaauuaaaauuaaucccuuaaaauagagccugcaccacacacggaagcugacauugacaauguggaugagcuagccaugcaugcaaccguguugccuguuagagacaggaggaggccguggaaggaggcucugagaugccucacagacuucgguucaaauccugucucugcugcucacuagcuucacaucuuaguaugcuacuuggcuccccagaguccagcaaaauccauacaggcaagcaucaggcccuccucacaggccugugagucugaaagaagcaagccugaaaugccacaagggcagggaacucgucuguuugcucacugauaaggcucagcaccuagaacccaaccuguuacaaggaggcaaucaacaagcauuaauuuuaugaauggauaacaguaagaaaggucauugucaugguuugaaugggauugggugugucucccagagggccaugcagugcagaugaguucccuaacagugaugagaggauggagccuuaagaggugggacuuaguggaaguaguuaggucauuggaaggcauugccuucagaagggauuaauguaguucccuagggacccagguuaguuccccugagagugucuggccuguucuaaauauagucauucagcagucuucuuugccaaaucugaggugucaggaggaguccucaccagcagccaagcagaggaagcagaggaagccacgugucuuaguuucuuucccauugcucuggcuaaguacccagcaaguaguuaagggaggaggggcauacucuggcucacagaugaagagaacacuauccaucaugguagggaagucucagguagaggcagacgaggcaguugucauaguaugucacugucggaaaguagcgagagacagaugcuggugagagaggagaugcuggugagagaggaggaugcugguccucaguugacuuucucucuuuacucaguccagggcuccaguccauggggugguuagggugagacuucccacuucagugaacccagucuagaaccu

SEQ ID NO: 6013 - RNA, 25799 nt, Mus musculus
uccaaaggggauaagagagauuuuauuccaaaccaaauaugagugacacagacucagacugccuugaaugacauguuccaccauggauguggugaccugaaccuaaaaaguuaccaaacacaagacagucacaaaucaaagcauuugucaaacacauugcugggacaugagguugcagccaagugggagauccuguugagauccucggauguucucugaugacauucuugcccuugggggugaugauggccagccaaguuaauacauuccuaaagucuuuccugaucgucccauaggucuuaagucggaugcagaggaaggugaguaacggcuauugagagaacuaacaaugucacaagaugauguuggcuuuggcucugcaacauucucaccuuccacaaucaggaaguuuuaaggaguccaucagucugcagguuugcuuucagaaaccucaguucacuguuggcugauaggaaaugaauggguugggggaaaggaaguccaggcaaacgcucccuucucccacaauuucugccucagaucucuaauaacuggcaugccaacucucuuguucucaagccauuggcuagaucccgcugcagccucaucccaccccacauccuaaagugcuuugcucagagauggcuccccuuuggucccugcugggcuguuuugguaaaugggaccuuugucagcagaaggacagcaggauuugcuaccauccuaacuuguccauuuguuuccugcacagagggucugaugaggaguuuccagggaccucacugaagcagaagccagcucuugacagagacacacgguggugauuacacgggguguuaggcacgguuucuguggaugguagcuccaaggccccucuugagccccuggcucuuugugucaguuauguacuauuaggggagggcagagaaggagccaggagcaguggcagggugccagucugcugaggcaaaguggggggcucuccuggcguagucagaugguuucaaaauucuucauaucuuggcucccaucagggcucacagaacauguguucccuucucaaauaugaaacuuaagccaagacacuccccacucuauaagggaugccaccgaauggcaugaacuagcagcaugguccugagagauaagggcugugcaaaagguuuccagugaacacugggcuaaugucuggguccucaucuccugucucucuacccaguauggagccaaugugugcuuuuaugccuuccuggaccacaguucacuacuacucugggcagcuuauuccaagugugguguguuuuggcuuuuguuuuuaaccccccccccucuguguguguguguaaaugugaugaagcauaugaguguaggaaggcaauuucuaguguccuccuugccuuucaucuuauuugagacaggaucucugguuuugcugcuuuacagagcaagccaauggucagagcuuccagucacacuucccuucuccaccucccuguggaaucacugggguuacaaacaggaguuacccuucuagcuuuuauguggagauucaaacucaugucuugaugcuugcuuaacaaguacucuacccauugagccauccccucagcugccuucuccuccucccguccuccucuccucuuuucuuccucuuccuucucucccuccuccucuuucuccucuuccuccuccuucuccucuuccuccuccuuuuuuggggucaggcuacauaguccaagcugguccagucuucccauccuuucugucucagauuucugaguuccuagguuauagcuauacccagauggcuucuuacauucucagucaacucugauuuuuaggaagacacuucagauugacucagcagccagccuugguucuccuugccagccugaguucucagcugcaggguuugccccaagacucaucucuuauaugccuaucagcugaggaggucaugaaauugcagauucaugggccagcaagguggcucaguggaucaaggcacuugccaccaaggcuuaugagcugaguuuacuccuugggaccuacaugguaggagaaacugacuucuauaaguuguccuguggucuccacaugcaugccauggcauacaccuacacacacacacacacacacacacacacacacacacacacaaaauaaauuuaaauguaagggugcugggaacauguucacaaacacaggcugccugagcuguuagaccagaguugcacagucagcuagaagaaugcccaaaggcaggagauuuacaggguagaaauauccaaagggaagaccaaagacccagagggacaccccacacauuugucaaaaaucaagccaagcauacagcugcugggguagaagcugucacuugacaaauacccacccauggugucauagcuauauagacucagaugugggucagcaagacagcuuagccaguaaaggugcuugcugucugggucugacaaccuaaauuccaccccaggaacacauaaggguggaagguaagaagcaacuucaccagguuucccuccgacuucaacucuguggcauguaugcucccacacacaucguacgcacacucauaaaaauuaaacuguaaaaugaauaaacaaugaagucccuggcacgugcucucuuugugugcaugcuacgcucacaucuacucaagaaggaaacuggggcucagagagcugaugugaccugcccaaagaugcuguggggcagugccuagggugaacugacucuaccaacccucccacuacuguuggauaacucgcugggagccccagaccucagccccacaaggucuaggccucuuucuuagguuaaacgagccaaagcaaguugcugucauuugacagaaaucauaucuucuucugaaaggagaaaagucucacauuggggcugcuccugaggacacccacccaggugugcugccuaccaccuuuaaagacguguucacccugugaagagcagcagagaccaagcagucgugguaucuagcuuacuccaguagugagauucacccaaaacucuguagggucugagcgucaguggaaacuggggcucacaagucagcauuugaauuaagaaggggaaguuaaauuaagguaauaccuugaacacaauacacguaccgucuuccuaucuugacaaacauguuaugacuuacaagggucaagcugaaauuuacuguuagcaggaucuucuccaugaaaccugacaaggugguagguauguccuaccagcccuggcuccuagcuucucucuucucucucucucucucucucucucucucucucucucucucucucucucucucccccaacagugucucuguguagccuuggcuguccuggauggaacucacucuauagaccagguuguccuugaacuuacagagcacuuucugccuucugagugcugggaauaaacgugugcaccaccagcuccugggccaucuucucuuucauccucaacgcugucgcauaccuugaagauccuuggugcaccaguaugguuucaagucacacacuuggcagccccauucacauuccugaagucagccacacagcggccccugcaggaugagcggagucauguaaugaguccuucuuguccagcuugcucuggcuuggacccugucuaacuauccugcuccccucuauccaucuacaccagcagcuacaccugggggccaaggcaggagagggucaggaugcugcagauccucuggucaccugugucagcauucagcuaggccaucagguucuggugaggugagaagcgucaccucucacagccagugaagccgaaggaaggaaaugaagacuugggcuguugcccagacugcaaacaagaguguguguauucacaagcguguguguguguguguguguguguguguguguguguguguuugggggcgguguggauauuaaaucacauuugcuucccuuaacccuuuaucuuuggauucuuaagauuauguugugagcuggggagguagagggcuugcuagacaagcaugaagaccugaguuugguccccuagaaucgacgauaagaagcagggugugguagcacugauggcugagaguagggguaagaggggaagaauguugagagguguugagaggugagaacagugucccccagaagucuccacgagucacuagagaugccaguacuacacacucagaagaugaggucagcugugagacuggacuggggaggcuagagauggacggcuucaccuccccuguccuaggugugagaagguucuggagugugcagaggcugggccaguuagcuaauggguucacccucuccuucacucauucugguggaugcugugcugguuaugggggaggcuguaauggggagacucagagaugguuuccacccugugggaguucuagucuaaaaagccaggcccacccacauaacacaagcaauuaugcuggcagaugcaauauuacuacugugccaaguauaauaaagggacacuuaguauauaaagggguaugaucugccuugggggcucagaaggucugcccuaugucaccugaccugaaguacaaaggaugaaugagaaaugaaugaucuagaaggguucuggcgagaugacucagcuggugaagugccugaugcauaaacaugagggcuugcauuugauccucagaaccccuguuuugucuuguuuguuugaagauuuauuuauuuuuaugugcauagauguuuuugcuugcauguaggucugugagaaggugacagauucuuuggaauuccagacaguuguaagcugccuugugcauacugggaauugaaccuggggccucuggaagagcugccagugcucuuaacagcugagccaucucuccagccucuguuuguuuuuuuaaagcaggaucuuguggcacauggcuacaauccuaguacuggagagguggagaaagccuggccaaucggugagccccaggucccagugagagcuuuuguucaaacaucaagcugauggguccagaggaacaacacauacaguugagcuuuggucuucgugugugugcacacacuugccucucacuugcaccuucucaaugcacgcuaacacauacacacacacacacacacacacacacacacacacacacacacacacacguauguacagaguuuaaaauaaauaugaaugaaaaauacucaagagggguggcaguuaagccacuggagguugacaggcagagagucaguacauacagagcuccuaaaugcugggcccuucccaggaaugcgugagguuuuccagccuauguaaccagcugagcaauccuagugccugauggggauacacugcuggucagagcccguguacugugagguccuugcaggaccauggagagaugaccgguugggccaggcaggugcuggaggccagggauccuaacaucaagguguuaaaggcacacagcugucuagcuccaaggugaaccacuuccugacagcugauccgaagggcgucuccuugagucuccauuucuuagugccuucccguucucaggggacagugcaccucugacacugcagacugcauuugccaugucugccucccgccuaggccuuccucugcauuaguccuagcacagagauaauuucucaagcaggaggcacgugucugacacagaagcgggcacuauggugggcggggauggauaacuagaaauccagagacagccuguccaucauuugacucacaggugaucucacauaagcaaaugacaguugcuugucgaguuggaacaagaaagggagguuggcgugcgaugcucauagcuccggggguccccccacgguggggcucgacauugcugguaaccaucuaaaacugugggcagaagauggggauucagcgagagaaagcuccaucaaucauacuaagaugucaauagcuccugucugcggugguaaaucaagaagcagaacuaauacaucacccacaggaaccaccggagucgcaugauuacaggcgcaggagggaggggucuggagguggagcccuggugcucaaaucauacuccugaugcucaugagccgcgugaccuuugaccugucacuuaacuacuacucccugccuuaguugcccaucuguaaaugaaacaaagugauaguacccaccucacacaccuccgcaaguccucagggaggcaguguacagccagggcuuagcacagggcuuuggucugugauaaauauacucagcaaaugucagccacacugaguaaaacaguuaaaaaagugauuggcuuccaaggaccaggauguacggagugccuuucguuagagccaagugacuuaauuuuauaacauaugcacaugucagauuacuaaacuaagaauguuaaauugaggacauggcucaguugguauagagugauugcccaguguguacuagauccuagagucaauccucagcaguguacucagggcacaguaacaggaagaacaagcagagucagggauaagggauggcagggggaggguaacucaguagguaagcacuuguuuuucaagaaugaagaccugaguucaaauccccacugccccuguaaaaggcuggguacagagacaggagaggcuugcuggagcucuccggcugccagccuagcucuaaggucagugagagaccuugucucaagggaacaagguagagucugauaaagugggacacuggcugccuuuuguucccgcuugcucuccuacacacacacacacacacacacacacacacacacacacacaccauuaagucauaaacacccgcuucgugugcacacgcaugcagacacacacuuacuucaucgucaucaucugcaggaguccaaggcaugcuuaggcuacaugagaccaaacaaacaugcagcuggguguggugauacauguaauccuagcauucaggaugcugagacaggaggauucuagccuggccugggcuacacagucagucccucucacgugugcagacaugcacacguacacacugauuagaaaauuugguuuugagaugguuugggccugagcagcuuucuuccauuauaccuagaaguauuuguguuaguuagggugucacugcugugaagggacaucaugaccacagcaucuuuuauaagggaaaacauuuaacugaggcuggcuuacgguuucagagguuuagaucauuaucaucauggugggaaguauggcagucugcaggaaggcauggugauggaggagcugcaucuugacccacaggcagcagaaggagacugucuaccacacuggguguaauuggagcauaggagaccucaaagcccucccccacagugacacacuuccuccaccaaggccacaccuccuaaugguggaucucccuaugagccaagcauauucaaacacauggucuacaggggccguaccucaacagucaaugcccuucucuuuuuauuucuuuguuucauucacauaagaacuugacugaccguuucaaaaucauuuggcagaacaucuuaugaggguagaggucaggauauagggcacuacuucucaaccuuaugggccacauaccacaauccauggcauuaugcacaagacagaacaagagaaugcaguuuuucuccucaacauuaccaguaauucucugaaauauuaacaccaaccugggaggggucaguacaguuaaacaugaggcauguuugaaugugagacacugguuucucuagcucuggacucugauuucugagaaagcccauacaccugaaacucaaccuucccaucugggacaguccagucugcagaggagagggagucccugaagccaccagaugccgcuaggaucuaaccacaggcuuuugcaggcaucugaaaucuguccgacagagcaggcccagaaggcuaaggauacauguaaauuuuacuaggcaauaaagucaacauuauuagaucccuugugagaugucggguggaguggaggcccaggugacagugggggauucguugugggcucuacuccuguuuccuaugucuuuaggaggcucaccuugacugugggucuugguaagucaugcugauaaauuagagaaggauuuaacaaaacaacaggucggguggggguagggguagggguggggguggggguggggguaggugaccacaagggaaaccuuguaccccaggacuggaaauguguguuauccaucagcgagccugcuugggagaggaggggcugggaccagagccaagaggagaaggcuuguauguaaaaggcagggugacuagagcuguggccacuugaagggggaaacuugcagcaagagaacuauuugagacauccuggcaccauucugucucccugugugucuccucucuggcuacccuaggguccagucuauuuagaauaugacuccgcccccaaguucuggcugaccagaggcugggaucaaauucaaagcaauccccuaccucugcccccgccccccaagcccugggauuacaggcgugagccaccaccaugguuucuauagcugugucuccauuccucccuaaagcauggagaggcuucacaggagcuaagggggauccaauccaguccaugccccacggcggccuuauaaccaacacuuuaagcagccaggacccaggggccaguuuguaccuccacagaucugaaucugaccucucagauguaucuuccagaaguucuggcacccaacccuggaacaaucacuuuaaacugaagaagagagaauguucugauuggcuaauauggccguuggagguggggaaucacuccugauccagucucugagcugagugagagaggacuugugaaucucaguggaaacugaguggaucagaaggacccauaucugggacugcagugcugaggugccuugggcaauuccugguuaauggacugaggaggaagaaagcugacugcaucguagcaaggagugaagcugcccucugugugggccucaguguccagccucagauuuuaacugccuguggaucuggcucucacuagccauucagauucuuugcuuugcuuuauuugguuucuguuguuuguuuuuguggggaggcuuggugccuuguagcucaggcuggacuggaacuugcuaaguagccaagaaugagugaucuugaacuacugauccccacuaagcccgauaccaggguucacucuuggcaguuaaauccaaacugaccucucuggacucacugaaguuugcuggcagccaccacccaauagaauaguagaugaucuacgguguaaauaacaacagccgccuaggcucucacuugguauagaaggaagguggugaccugagaauggcuuaaucagggcuccagagagccuaacuuacugaccuggggugcagggcuaaguauggugacccucagcacacagccaacagugucagagccuccaagcaccucacacugcagagacucacaccccaagagaccccucugccccacacccuaccacccaucuuccacuggagaauaaccaggggcuggagaaauggaucagcaguugagagcacuggcuguucuugcagaggacccuggguucaguucccagaacccacaugguggcucacauuugguuguaacucuaguucccugggcagguggucuuggguaauauaagaaagcaagccaaucaaacuggaaagcaaggugaugagcagcguuccuucccgaucccugcuucaauuccugccuccagguuccugacucaccuuccccagaggagggaccauaaccuguaaucccuuccuuuccagguugccuuuggucagugucuuaccacagcaacagagaugcaaacuagggcagaguguuuugcuugcgagcuuguauguacacuguguguguaucuggugccuucagaggccagaagagggagucagaucccguggaacuggaguuacugauggucgggagugcugggaaucgcuauaugggggcuggggacugaagcuucugcaagggcagcaaaugccuugaacugcuggguugucucuccagcccccauuuucggucucucucuccucucucucucucucucucucucucucucucucucucucucucucucucucucucucucucucacacacacacacacacacacacacacacaagagagagagagagagagagagagagagagagagagagaauucuauauagucccaccugcccucuauguguaguccaggaugcccuccauguauaguuggacuuccaauuucuuaccucucacucccaagugcugagguuacagauaugcaccaagcccagcugaguaagaaacgggaacuugaaucugcucgaggccuugacaagauuaaagagaguuugaaacagacugaccucgccucuaccucaaggacuucaugucccucugcucagagcucggccucgccaagccuggcucugcaacagggcuucugaagcuaaggggaggacacccagcuggagcagcaugcugcaggcuugcaccugucacccugucccuugaguggcucugucuguuacuggugacaggauagaauacugaggagccagccagccaugaaacaaacagcuccuuaaaggcaugcauagagaagugagacugggaaggaggaggagagacccuggucaggacacagaaugcaaucccuucugaagugucagaaucuguguuucuccuugggcuccaggauguggcagggugugaggaggcaagaugccugccccaaggaucuagguggauacucuguugagaguuuccagugauaaaggaggagauaagccuguggccaagaaagcugugugcuagccgggcauggugcugcacgccuuuaaucccagcacucaggaggcagaggcaggcagauuucugaguucgaggccagccugguuuacaaagugaguuccaggacagucagggcuacacagagaaacccugucucgaaaaaaaaaaaacaaaaaaaaacaacaacaaaaaaaugugaagaggucauguucucacagggacccggagggugagcaccagcuggccaagugggagaucuggcaagcaguugggcagaaucgagagcaaaugcagggucuaggggccagaaaggaaggaucagaaagaagguaucuguagauggguuuaggcaaggaggagagcaaggugcaagccagagcagucucacuugcccugcagcugacacuuuguuucuaggcuccugcagcugacacuuuguuucuaggcuccugcagcugacacuuuguuucuaggcuccuguuggugaugcgcuuucuuuccauccacaguuacgaugcucacauuggucagaaccugccauugguccuuugaguucauuaucucauccaacgagcacuccaggcuuagugacgagacuuggucugaagguaagugcucccguggauuucaguucauggcuagcucaguuuuccggggaaguggcauuuuuuucucugugaauaggauaaaguccagggagcccuccuccugucggggcccaucccacaugguagaacgugaucaaagcgacuucagauuaaagcuggcuucucagacuucucagaguccccauugggggcagauugagcugccgcaagcuuugaucaacaagugacuuuggcuaagucggugagagaaagcucaaauccaauuuccugugggaugcucuagggagcuggaagaagagagggaggagaaugcauugcucauguggaaugcauuccuucccuagugacauuaacggcaugcuucgcccagucaggaauuacugagcaggacaucuaguuggguccuggaucucacaagauguagggagacagugaacucaguaaggaagguccuuggauacuugucacgaaucccucugcaggaagaggcucugggguccugguuagcaguaaaggcaaggcaugugcuggcugagauagauguguuucuaggagacaaggaaacgcugcuuuuuccaaaugcuugggacucguguucuugacagggaggcccagcuucagaccugcucucgagaaaaccaaacaaauggagaugagauuuccgaaauggaggcuagggaagccaucucaagagguagcaccucuggucugguuccugagaaaaugaagagaacccugcaaagguuuagaggaacagaguucuagaaguugucuguuuucccuucuggugcugugacaaaacacugacuaaaaacaacuuggggguuggagggaagggguuuguuuugggcuuuuuacuuccaggucaaagucugucauugcaggaagccaaugagggggcuagggucaggaagcggggaagaaggcugcugguucacucucuaccucacuuuuagccucaugucacucuagcuuucuuccacaacccaggaccuccugccuagggaccucccacugcagguugagcccuccuacaucauuuaauaaccaagacaaucaaaaaguagucugaacaggugagagugugcacacagaagcugacagcuucuggaacaggcgggagccacagagcuucugaggcagcacccuuuucgggcuccagacauccgaccaccuucccagccagaggacagguguccgacuggcccaggaggccucugccucaagaucgacaggagccaucuugguuccaggacucugccgaaaaguagucugcacaggugagagugugcacacagaagcuaacagcuucugugacaggccaaagcaacacagcuucugggaaagguccuguuuugggccuucaucuuuggccagaagggagguccgaaugccagauaucugugcaccuucccuguaagaggagagcuugcuugcagagacugcucugaccacugaaacucagaggagagagcuagucucccaggucugcugauagaggguaacagaaucaccagaggaacaaucucuaaacagagacaacuauaacaacuaacuccagagauuaccagauggcgaaagguaaacuuaagaaucuuacuaacagaaaccaagaccacucaccauaaucagaacccagcacucccacuucccccaguccagggcaccccaacacacccgaaaagcuagacccggauuuaaaagcauaucucaugaugaugguagaggacaucaagaagaacuuuaauaacucacuuaaagaaauacaggagaacacugcuaaacagguagaagacuuuaaagaggaagcacaaaaaucucuuaaagaauugcaggaaaacacaaccaaacaggugauggaauugaauaaaaccacccaagaccuaaaaagggaaguagacacaauaaagaaaacccaaacugaggcaaugcuggagauagaaacccuaggaaagaaaucuggaaccauagaugugggcaucagcaacagaauacaagagauggaagagagaaucucaggugcagaagauuccauagagaucagcacaacaaucaaagaaaauggaaaauacaaagagauccuaacugaaaacauccaggaaauccaggacacaaugagaagaccaaaccuacggauaauaggaguagaugagaaugaagauuuucaacucaaaggaccagcaaauaucuucaacaaaauuauagaagaaaacuucccaaaccuaaauaaagagaugcccaugaacauacaagaaaccuacagaacuccaaauagacuggaccagaaaauaaauuucuccugacacauaauaaucagaacaauaagugcacuaaauaaagauagaauauuaaaagcaguaagggaaaaaggucaaguaacauauaaaggcaagccuaucagaauuacaccagauuuuucaccagagacuaugaaauccagaagauccuggacagauguuauacagacacuaagagaacacaaauuccagcccaggcuacuauacccagccaaacucucaauuaccauagauggagaaaccaaaguauuccacgacaaaaccaaauucacacauuaucuuuccacgaauccagcccuucaaaggauaauaauggaaaaaaaccaauacaaggacggaaaccacauccuagaaaaagcaagaagguaaucccucaacaaaccuaaaagaagacagccacaagaacaaaacgccaacuuuaacaacaaaaauaacaggaagcaacaauuaccuuuccuggcuacacaaacaggacccaacauuuugcugcuuacaggaaacucaucucagagaaaaagauagacacuaccucagaaugaaaggcuggaaaacaauuuuccaagcaaaugguaugaagaaacaagcuggaguagccauucuaauaucuaauaaaaucgacauccaacccaaagucaucaaaaaagacaaggaugggcacuucauacucaucaaagguaaaauccuccaagaggaacuaucaauucugaauaucuaugcuccaaauacaagggcagccacauucauuaaagaaacuuuaguaaagcucaaagcacacauugcaccucacacaauaauagugggagacuucaacacaccacuuucaccaauggacugaucauggaaacagaaacuaaacagggacacagugaaacuaacagaaguuaugaaacaaauggaucugacagauaucuacagaacauuuuauccuaaaacaaaaggauauaccuucuucucagcaccucaugguaccuucuccaaaacugaccacauaauuggucacaaaacaagccucaacauauacaaaaauauugaaauugucccaugcauccuaucagaucaccauggacuaaggcugaucuucaauaacaaaauaaauaauagaaagccaacauucacgugaaaacugaacaacacucuucucaaugauaccuuggucaaggaaggaauaaagaaagaaauuaaggaguuuuuggaguuuaaugaaaaugaagccacaacauacccaaacuuaugggacacaaugaaagcauuucuaagaggaaaacucauagcucugagugccuccaaaaagaaacuagagagagcacacauuagcacaccuaaaagcucuagaacaaaaggaaguaaauucacccaagaggaguagaaggcaggaaauaaucaaacucaggggcgaaaucaaccaaguggaaacaagaacuauucaaagaaucaaccacaugaggagcugguucuuugagaaaaucaacaagauagauagacacuuagccagacucacuaaagggcacagggacagcauccuaauuaacaaaaucagaaauaaaaagggagacauaacaacaaacccugaagaaauccaaaacaccaucauauccuucuacaaaaggcuauacucaacaaaacuggagaaccuggaugaaauggacaaguuucuagacccagguaccaaaguuaaaucaagaucagguuaaugaucuaaacaguccuauauccccuaaagaaauagaagcagucauuaauagucucccaaccaaaaaaaaaaaaaagcccaggaccagauggguuuagugcagaguuuuaucagaccuucaaagaagaucuaaucccaguucuucacaaacuauuccacaaaauagaaacagaagguacucuacccaacucauucuaugaagccacaauuacucugaugccuaaaccacaaaaagacccaacaaagauagagaacuucagaccaauuucccuuaugaauaucgaugcaaaaauccucaauaaaguucucgcuaaccgaauccaagaacacaucaaaacaaucauccauccugaccaaguagguuucaucccagggaugcagggaugauucaauauacggaaauccaucaacguaauccaguauauaaacaaacucaaagacaaaaagcacaugaucaucucguuagaugcugagaaaucauuugacaaaauccaacacccauucaugauaaaagucuuggaaagaucaggaauucaaggcccauaccuaaccaugauaaaagcaaucuacagcaaaccaguagccaacaucaaaguaaauggugagaagcuggaagcaaucccacuaaaaucagggacuaaacaaggcuguccacucucucccuaccuauucaacauuguacuugaaguccuagccagagcaauuagacaacaaaaggagaucaaggggauacaaauuggaaaggaaaagucaaaauaucacuuuuugcagaugauaugauaguauauauaagugacccuaaaaauuccaccagagaacuccuaagccugauaaacagcuugggugaaguagcuggauauaaaauuaacucaaacaagucaauggccuuucucuacacaaagaauaaacaggcugaaagagaaauuagggaaacuacacccuucucaauagucacaaauaaaauaaaauaccuuggugugacucuaacuaaggaagugaaagaucuguaugauaagaacuucaagucucuaaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuagaaagggcaaucggcagauucaucuggaauaacaaaaaaccgaggauggcaaaaacucuucucaaagauaaaagaaccucugguggaaucaccaugcccgaccuaaagauguacuacagagcaauugugauaaaaacugcaugguacugguauagcgacagacaaguagaccaauggaacagaauugaagacccagagaugaacccacacaccuauggucacuugaucuuugacaagggagcuaaaaccauccaguggaaaaaaugacagcauuuucaacaaauggugcuggcacaacuggcuguuaucauguagaagauuucgaauugauccaguacuaucuccuuguacuaaggucaaaucuaaguggauuaaggaucuacacauaaaaccagagacacugaaacuuaaagaggagaaaguagggaaaagccucgaagauauggguacaggggaaaaauuccugaauagaauagcaauggcuugugcuauaagaucaagaaucgauaaaugggaccucauaaaauugcaaagcuucugcaagacaaaagacaccgucaauaagacaaaaagaccaccaacagauugggaaaggaucuuuaccuaucccaagucggacaggggacuaauauccaauauauauaaagaacucaagaagguagacuccauaaaaucaaauaaccccauuaaaaauggggcucagaacugaacaaagauuucucacccgaggaauaccgaauggcagagacgcaccugaaaaaauguucagcauccuuaaucaucagggaaaugcaaaucaaaacaacccugagauuccaccucacaccagucagaauggcuaagaucaaaaauucaggugacagcagauauuggcaaggauguggagaaagaagaacacuccuccauuguuggugggauugcaagcuuguacaaccacucuggaaaucagucuggcgguuccucagaaaauuggacauaguacuaccagaggaucccgcaauaccucuccugggcauauauccagaagaugccccaacugguaagaaggacacaugcuccacuauguucauagcagccuuacuuauaauagccagaagcuggaaaaaacccagaugccccucaacagaggaauggauacagaaaaugugguacauuuacacaauggaguacuacucagcuauuaaaaagaaugaauuuaugaaauuccuaggcaaauggauggaccaggagggcaucauccugagugagauaacccaaucacaaaggaacucacacaauauguacucacugauaaguggauauuagcccagaaacuuaggauacccaagauauaagauacaauuuccuaaacgcaugaaacucaagaagaacgaagaccaaaguguggacacuuugccccuucuuagaauugggaacaaaacagccauggaaggaguuacagagacaaaguuuguagcugugacgaaaggauggaccaucuagagacugccauacccggagauccaucccauaaucagcuuccaaacgcugacaccauugcacacacuagcaagauuuugcuuaaaggacccagauagagcucucucuugugggacuaugcuggggccuggcaaacacagaaguggaugcucacagucagcuauuggauggauuacagggcccccaauggaggagcuagagaagguacccaaggagcuaaagggaucugcaacccuauagguggaacaacauuaugaacuaaccaguaccccggagcucuugucucuagcugcauaugugucaaaagagagccuagucggccaucacuggaaagagaggcccauuggacuugcaaacuuuauaugccccaguacaggggaauuccagggccaaaaagugggaguggguggguaggggaguagggggggaggguaugggggacuuuugggauagcauugaaaauguaaaugaggaaaauaccuaauaaaaauauuaaaaaaauaaccaagacaaucucccaccaaugugccaaccccaaaugcuuugagcuaagaagucucuuggguuauuggugugugugcacgcacaugcauguggaggucuggggacaaguuugauguuucauuacacagacaccuucccccuucuuucuuugcuuuagcugaccagagaguuucuaaggcuccuccucuguccauccccccucaccaccacuggggauuacaggcaugcacuucuguaauccuaguuuuuuaaucaguucuguggcuugguccucagguccucaggcuugugagccgagugcuuuguugacugagccaucuccgcaguccucucaugaguuauucuaagguaagggaagccacaguguuuacaacagugucaugauagauacugcuaccuucaccaugcucaaggguggagaagcagugccauguaacuacaccaacgcugcaaacucaugacagcaccggacacagacaggacccagcauuacucauaacuggggauugauggggauagcccaaauguccaucaacagcuaacuggauaaacaaacauaggguaugcaugugugacuucuccuggggagaugugaguaaaugucugucacagauaggacacugaccacauaccaaagaaaugaugucaucuaagucuacuucaggaaggccagcugacugguuauuugggcuauuuucaggggcaucacaaaaaaagcccauaccaguauggaugauagcucaugcacccuggagcucccuggacacccugaagaaagacagcauggcugauccugagggucuguucuucucaggauuguuucaguuuacauaacuuuggggaagaaaguugacuuaaaaaaaaagauuuauuuauuuauuuauuauauguaaguacaccauagcuaucuucagacacaccaggagggggcgucaggucucaauauggauaguugugagccaccaugugguugcugggauuugaacucaggaccuucagaagagcagucagugcucuuaaccacugagccaucucuccagcccaucuuuuaacuuuuuaaguuucuugagucuugugagacuaguuuacuuccugagucuuagaagcaucccucauccuuuugggugggaaaacacacacacacacacuguaauaaaaaauaauuuuuaaugguuaaaaaugguaaaauuguuauguguauuacagcacacuauaaauuauuuuaaaaaacauuuauuauauauguguauguaauuaaauguacaccugugcaccguaagugugcagaugcccacacaggccagaagagaauaacagaugcccuggaucuaaauuauaggcaguugugagcugucuccugugggugccaggagacaaauaugggucuggggaacugaacccauguucucuggaaggaagagcagcaaguacuuuuaaccauggagguaucucucaguuccuauaagauuauuauuuuuuaaagauguaagggucagauuuauaaacagaaggauggucagagggugcaucuagguaugggugauaagacaaaggucccgaugugggagugcccgccauguucugaugaacagcaagggggauggguuuggggagacuugaaggaagagguggugauuuccuuagacauagagguguacccugacauagacaaagagguuuggggguuuuguuuguuuguuuguuuuuuaggugcaagaauuuguauggucaacaccacuugggggaacauacaaagcuagcagcagaaccaaagaaagaaaggccaggcagagggggaaggaaauauuugaccuuagggaaauacaacccagggacugugacuuuaacugcaaugaugugagugaccuaagaugagauuuaaaaaaaaaaaucacugcucagucugguguuagaccugcaagguuagaauuuagggcacuagucccgggauagugguagccacagggcucaguggcuucgcugcagaagcagaggauagagucaaugcgcgcgcuggcaggaaggcuaguaaagaggaagcaagagaggagggggaggagggggcugccauugggcauccaggagcaagcuguuaaaagacaggcgcgcagcagaggaggcucccacaggcuucaugugagcccaagucagcagcucagaagccagauauuuuuggacaagucaaggcucccuaguucugcuaugcacagccgagcuuucaguucugcgcaccccaccccaccccaccccuccgcccaggcuccagugagaguucugcuuuuccuugcuccucacuccuggcccaguaucggacccacugugggcgcucgcuggugguuugaauucgaaagaggaaaggacacgagguuucgggaacgugcucuggggcacuguguccagaagcaguccaaguccaaguccacuggcuugcaugugcguaagaauagcucucgcaaagaggcuccggucaucuccucgaugguuuugcaaagaacccagacuagugacggaacauccagcacuccacagguuggagagggggauggaaacccagccgcccacugagcgaugcgcaaggugcccucugcauacagguuguggggaguccccaggucaaaggcaggucugguuggcacgucccggggcagaaccgggaaaagaguggacugcagcaucccagcgcagucgguuguagcauguccgcacagucccggggcucucgcuggcugagaacuugcagagagccacgcgaauuccccgggguguucccgaucgcgugcuccgcggccccugcgagcgcccaacucccuaacuccgggacuuuggcaaagcugcagcgggcggggagcaguggagaagcaggacgcaccauuggagcccacgggggguguagcaaucaggagccggggcccucuugcauccuggaggacggagaugcucuaugaguagaugaagaauugaaggauggaggcgaauaggacucaaccgugcaucuguuggcggaaggcgaggugcaggacguggaaugagaugccgagggaugaugggguuggagcgcacccccacggcggugacacgguggaggcgcccggcucccccgccggcgagcagcggaagugccgcggaguuggagcggggccggcgucgcggccgcuacugcuggccgaacugcugccgccgccggguggacgggcggacgcgcaaagccgggggcgggcgcggcggggcggaccggccccgaugaggcgcaaagagaagcggcucuugcaggcgguggcucuggcucuggcggcccugguccugcugcccaacguggggcuuugggcucuguaccgcgagcggcagcccgacggcagcccugggggauugggggcggcgguggcccccgcggcgguucaggugaguagucugcggccgagaguugggaguacucuuucucccacuucgcucccacccugcaguuccuuguucuaccuauccuucgugucugcucugaggcaucccauuuuggggauggcaacaucgaggcuuagggaaggucaaagauuuauccaggcucuugcuccagccuaaaacaguguucaaccccaggcccuuuccuuaguuuaccccuuuccucuuauugccgucuauaauucccggccucuucagcucucucuuuuucggaggauccuaccugcaucuucgugccacccuggauuguuuguucugagguaagaguggagauucugguccuucuugucgguguucuucagauagucucugccccuagccuccacucucgccugcugauucuaauguuucaagucagaccagauccuuccugguuugcugucugcacaggcacucguaggucucccaucuggagcgagcuuucucuucucucuucucuucucuucucuucucuucucuucucuucucuucucuucucuucucuucucuucucuucucuucucuucucuucucuucucuucucuucucuucucuucucuucucuucucuucuucuccuucccuccccuuuucccuccuuccuuccuuccuuccuuccuguguauguguaccuuaccuacauguaugucugucugcaccacacaggugcauggugcucauugaggucagaagagggcacaggcucccccaaaacugggguuacagauggcucugaaucacagugugguugcugggaaucuaaccuggaagaccagccacugcuucuaaacaagugauccaucucucuccccaccucccacaucacccagucuuuauccuagucaaauucugugccucucucgagaauacugagcccaggccccauugaacuugccaccuuugacaugagucuagcagcucugguggaggacucuccaaaugucucagagccacaggugucaaacacccccaggacagaacaccuccagccuuccuucuuuguacuaaugagagauguuucuuguagacaaaauugagauggucugccucuuuaaaguuguauguauguaugugugugugcauuguguacgugcauguguguguguguccacgagugcgugcacuuggaguagcagucuccuggcuuagaugaacucugucacuuuccuccagccaucccagcuucccuaccccagcuccuggcaagcgugggcacgcuacacuugaauuauuccuccagugggacauuuaagaguugcuuacgggauuuucuugguccugugggaaguggguagaugugcgccagggucagccuugacugacugcuggcuggccuugagggaagaggcuggcuucuugagauugaugcuuuaccgccccccacacuccccaccuuuccaguguuagggcuuucuggcuucuugggcaugggagagucuuggucuacagagcggaucaauuugaacuuggcgugucacucugguaacuuguaaaucauccucaaggcccgggugaucugucuaucugguagaucuuacuauugggaaaguuaggaaaccccauuucuaaaucccugcuuccaauucugaaagcuggucuagagcucucucccuuaaacucuuugucugagugggguuuuucugugggaaaccucuuuccucuguuacugcccuguggggcaccagugucggcaggccagacucguguucuaagcucagcuguugacuugcugugcauugaugagucugaucucccacucugagccuugcuugcuccguguguaugauuugaugccaacauucugugaugcugccaaugugccaguggggcagggccacuucuuuuuccuuuccugaggucgcuuauaacaguccuaucuugggaugcucugcugaacacagcccuggccgagggggguguguccagccaggucagacucucccacagaauagcugugagcaguucuaaaauagcccuugacauucugccucugcguggagagaguucugcugugaaggccagagacauccuaauuuucauuuucuauagagccagauguguaacaagaaggucaagguuaacugucaguuuggccuuagcuuucacggugaauuacugacuguacaaaaggcuauugaugcaguauggccaccuuuugagcagagagagagagagagagagagaaagagagagagagagagagagagagagagagagagagagagagagagagagagagagagagagagagaaaggaggaacagcaacugaguaccucuuggaauugcuaccuggacucauugagagggcugguuuacaugcucugguuuuuugucugucucucugggauggcacagagaggaggaagaaauaguuaagaguauggagggcuuucgugcacuuaucauugcuucuugggggucacagaagggaaauauuucccaaggaugggcccugguaggugcagcaggauucagcauucaugggcugccugucugguacagucugccaaauuuccacacagccccuuuguguuccacucuccugcagaugcagaacccuccaaucccucuccugaaugucagcuggccuccaggaaagaagccggcuucucccaccccucucugucaggggcuagcugggaaaccgucuucagcacccagaguuguugggacaccgaugaaccagucagcacucuggcacugucgagucaucuccgugaucuuccugguagaaauaagugcuggucuggaagguagcugaguugauugagugcuugccuguggccaguccucagcgccacaucaaccagccuguggcgcgcgucaguaauuccaguacucaggaagugacaggaagagaauuggaguucaaggccaaccuuggcuacaggagaccuuucucuagaucagcaccuguuggcucuuuguuaccgugagacuuucuaguggcuuuucugugagauggcacaccuggguuuguguaguccucugaugccuugcccuguggugccucauccugguccuguuggagccaccaggcgggacauuugauucauaaagugaacgucaugugcucggagucucgcuggucacauagcuggcucuucugaaagucgcaagauugaguaaggaaagaaagccggccucgaggccauuuuuguuuaaacuugggcuuccuucucuuucccacucccuagccggccugacaucuugguuuaacucuaggauugguuuucaucuugcagagccugggagcugguucucaauaccacaguaggaaucccaagugcagcuccucccacuucugagccaggaagagaacuggcuucucugggucauggcaucuguuugguagagaaaggugggaucauggaauuccagugucuaugacuuuuaaguaucaggucuuuuucucauggagucagagcuaaacuugguucuuagaacaucuggaaaucgauaacccuucccuacccccaccccccgguuucagucuuccugguaguagaagacuuacccgucagcaaguuaaguaccauggcaauguggucuggagugguuuccuuaccuuuccaagguggaguugguauccuuuagacugcuaaucacuucucugucagcuuggccagaugaaaucugaugccacccggggaaggguucuugacuuagcagagcaaaucugcuccugccuccuccuccucuugggccugcugucugccaaggaugaguacagagagaggucug

SEQ ID NO: 6014 - RNA, 12070 nt, Mus musculus
uguuagcaggcuggugccccccccuggcaacuuuggcaugaguuaggcugagggauuucuccaacacuuccaacauggaaccaagaccaauagacccauacugaggggucagggggcgugaaaacacauuguauccagcuguucccuuuugcaaaaaggauacaaugugugagacaaugcuaagacuggguccuuugcccauugagagacucugcccacauggccccccaacuuagagagccuggaaaagccagaagcuaacaacagaacagucuucccuaggagguagugagcucucuguccuuggaggugaccaggugcagacugcuucuuggcugggauggguauaggcagaaugucagcaccaauggagaagcuggacgggaggacucaagacucuuugcaaccuuuggaucccuuggaccacagagagcuuucagaugguaucaaugaggcaacuucuuugggacuaugccagggaccaccugcugcaguggacaagcuauccugccaccacaaaccaggcagucacuugguaaaauauuaacaggaagugugcaaacacacacacacacaaacacacgcaugcacauuaaagcuuugcucuaugagaggcuauuaugaguauagcuacuuauggcagaaacaugcaggacacagaagccaaguuccuucacagagucacaauccccaccuggaauuuugguuuaccauuucucucucucucucucucucucucucucucucucucucucucucucucucucucucucucucucucucucaguuaguuccaugagaugagagaauucugaucauuuguguuguaaaaauuuucaagccccaaaugaauggcaggcuaagggugucuccaugugaccccuucaggguguauugaagaaccacaccaggcuggaucagagacaggaagccauaccacuucugggcuugaaauuccaguucugucaagaagcaccaaguagagagaccaugcugagccaucacagaugagugugugugugugcgcgcgugugugcgcacgcgcaugcaugugugagggaggcaggcauggccggugauaugaaaauacaagcagccuagauaagcacuacucucucaauaaucccugcugcucccuaagccaggcuugggccuuucuugaaggcaguggguucuuggccaugacuaggcagggagaugggaggccagggacugcugcuccaaugacacagcacacuucaugacacagcauguucaaauagcuuugccuuuucucucaggcgaucuguugugaaagggugaaaaugauagcccaggucucuacuucuccaaggcugcuggcaucagaggacaaggauucugaggugggaucuggcuggagggcagacacuccccagcuuggaucuggacuuagaacguggacuagagggagccuaaugccacaucuugcccagaagugagccucuucacaggaaacuagauuuuaaagaaacaaucacauggcuuacaugcuaacaguuuugguuaaaguauuagaaagcuacauuuucuucuugauaagacacuuuccacagggccgguuaaguuaaagauuccauuugcccucagacaccagcuucgccugggcucuccuguuguuuccauccgugguaggagggagaccaacuucugcacggaggcucaggacugcauuuugaguguucuugggagcucagccguaauggaacacugcauguuaguaacacgaagggcccuguucccacuccacagaagcgugacgcucugcuccauagagggaaaccaucacacauuccuccacucacucagugugggguuaguucugcucugagauggcgcucaggcaagccaccugggagacauuaaaacugucagaccaggccucuguucuguuaggacuuaagaaaaacucagaauugaaguggaauagggagaugagacauuuggcccaauacauacaggauaguuggaaauuaggaaucuuucuuauccuccuacacacaccuuuuaccccacaaacugacuggaaauucuauacaauucuuuguacaagagagcucugcuuuccagggugcuucugguuuugagagaacuagauagaagggucugauuugaacaacgacaaaauuuaauacugaaaaaauuaccuuaguaagcauucuccccaaaggaggccgauucugauuuuuuccccugaacuugagguggcaguggcuuuucuugccuagccucaugaucuccugccuccuaggaccaaggagccgagcccagccacacugucuuuccagagcugggcuucggagcuggaucacagggacuuggcagcucuccugcagacuguguacuaaagaccagaaacccgagcccggacgccccaucccugccaucagagcgcucacugccaggggcaugcaggucaugcuauacaccuuacucuggguaaaaugcaaagacugcuauggaaggcuaugguuuuguuuauaguuuaaaaacaauaaaucacuuauuuugugugugugugugugugucugucaggggacagucugcuacauggccaggaacugaacucaggucaucaggcauggcagcaagugucuuugccuacugagccauccugagguucacuguuuucugagauagggucuuuagcccagguuacccuugagcucacuauccugucucauucucuggaauggugggacuaaagcaugcaccaucauggccagccugugaugucuuuguguugaugcuggaaucucaacaguuuugcaggugcaacugugccgagauccucacuugccuggacuucuuguggaggggcagccuguccuccaccucuagugguuaagcagagagaacacaaagccccagucucaguggugggaggggugaagcagaagcugcguagcugcgacagcucuuggccagcacacucugagcguccacuguguacaggucacagggcaaggugggagcuaguguccaacugauuugcuacuaaauggcaaaacuugcaauaaagugacaucccucuguucccagugggcaagggucagcgcaaacaugggccuacucuguaauuccacugucaccgagccacgcugccagggcugggccuugcuugugacagccugggacugcauggugauggccaagaugcguaucacccagcauuucuaggagaacugauuuaaagccuugcugagcacucuagacacgguuuuaaaacuccuuuuauaacacugguuuuuuuuccucccagucugagcagauaucuuaaagucuuuuuacacacaugcuaaccugugagaauauaauccuccugaccgagacauuuacaguauccaucauucaaacuuuauuuacaguagauaugaacaguccuuauuggcugagauguugcagaggccaccugucaucaagcaguacccggcuguccuuucaucacggcccccaccucacacgggcagguggcuguagcucacucaagcugcuugcugcccucugacuucugguccagucugcuccuguuacucuucaccauguagaugaaauaggcaagcgucucuuucucauucacugguauguuccugaagugucggcucacagucuacacaggagaaaagaccaaagucccuuaagcuaugugcaaauagggccccacaucuuacacgcugcaaagagggaagagaagcuacuuccagcagcgauggccuggcacucagacuugccaaggagccguaggguguagcgggccccuugcuccguagcuuagcuguuuuuuucccaggcuaccagaaguacaccacuauggcccaggacggcaccaagguauggauguacuucaguagcaucuagccaucccuggcaugacuucagcuacccugugauguaaggaggcugagacuuccucaguuggccaauugccaccaagccuuucaggcucuggaaguagaccaaaaaaaaaaggcuuuaaaaauuaugucaagcugggugugguggugaaugccugugaucccagugcucaagaggccagacaggucaggaguccaaagaccagccucagugccuugacaacacacacgcacacgcacacgcacacacacacacgcgcacacacacacacacacacacacacacgcacacgcacgugcgcgcgcaacaaaacaaaccaccccaaaaugucaaaugaacaaacagaugugucuggccccaagaauuccucuaaguggggacagacucuccugggaaagacugccaguacaaaggagggcgcucccugcucauggccggacucugcuguugcugucuuagccuuggacaaacacacugccuccucuucccuacucuucuuuguagcuggcaaugguaagcagcaaugcugugcgcugcuguuguaccucucucucgcaggugagggagaggcugaagaguggagacacaucagccagagcccaaagggagccagcgggcagcagcuuuucaguaaaccugcaugcauggagguggucagggcagaagaaaagaccuggaaauaauaaaucucuggauuauguuuuucuuucucugccucucaauuuuuuuuuuuuuacaacaaaagguaggugaaucaagagggaugaggaagccaagugugugucgcguaucuagaagguaagcugaggcaggaggaucaguugaacccagcagcacugcuggaucacacacaagagagggaagggaagaguugcuaacagugacucaccaucacagacagaaaaguaaguuaaaaacucaacaaagaaaaaguguucuugggugccacuaauuauauaagaaaaggcuuccauuaauaucagaggucaagaaagugugugugggggggggagggggggaggaacuuggagguugaagggaaagcucauuaguaggucugucauauaaagaauccugggcuugggcuggugagauggcucaacggguaagagcacugacugcucuuccgaagguccugaguucaaauaccagcaaccacaugguggcucacaaccacugauaaugagaccugacgcccucuucuggcgugucugaagacagcuacaguguacuuauauauaauaauaaauaaaucuuaaaaaaaaaaaaagaauccugggcuuguucuucauuacccaaagagaacucaagcccuaaaccuaaagacacagcagacaaucacacugacacaccuguaaggacauaucaagaaccuugcaaaaaugaugucacgacucagaaccaggaguccucaagcugccacgugacuuuuaaagaaaguccaucccucucugugcauggcuuccuuugggaacuagggcuuucucugcccaugugcagagcucuugaugaccugugggaggaguagcugggacucaggaguguaggccgggccucucugcuuuaccaccuaccucugcuagcugggccuuguugaagccuggucuggucugcagcuuauagugccguuuguaacgucggagcguguucaccugcagcuggaacagaucaaccugggaaagaggagagaguuaugucucagcccacccugccuggcaugcccuagggagggcugaggagggaagaagucagagacacuguccaccaaggacuagggacuggcaaggaagccaaaggcggguguggagagggcucuguguguauggaggagggagguugaggcagaagagaggcaguaguggagaggaagugaggaggaggaggagguagaagaagaggaggaggagagagggggaugauucugagugggcuggggcagcagguguggggugcuucaggguggagcuggagggaauggggagcugcagcacccgcccucuagugagcagacugcgggcagugcuaaaggacaccaguguauccaggaaggccagcugagggaccccugaaggagauaagcuagcguguggcugggcagagcucacaggacagcaguggaggagcaggggugcucagccucagaggucaccuuccugaaaggcugcacagugauccuccugcaggucagggcugcugucucugcagaaagcuggauaagggacaagaagggcgccugucucuuguucagcuaaccuaggaagaggguaagcuaccuacucaugacauacagaagggccagauccuuugguugccucuaccagccuccgagaggcucuugauucaggcaaguggaauucauuugaaggaaaaaaaaaaaaaaaaaaaaaaaaaacgaccaauaugaggguccagaauccuccauucacuucaaaacauucuuagaaaacuuuucuaaaaugcuuggucaaagggauucagucuuuaugaaaugacagcaaugcuacaggcaaaagauaucagaaaguaaggcuggggagggccauagggagagguguggggacacggcugagcuucccaggccucuccacacccgcagaccaaggccuaccuccuucuacucgaagccgugaagugugacgcagcaaaugcucagugcacacugggcacaguuccucgucacaaagcccaagugggaacacuuuggaagggaacgccgauaaccuugaaagcucccuuaguacacauggaaccuucugggcgacaagcugggaugcauggucuuauacagugcucuuuaauuugggggcacaucccaaaggauauguggcaaugugugcagaacauguuugcacugucacaacaaugucacuggccucuagcaaggugugugugugugugugugugugugugugugugugugugugugugugcugcugauccuaucauucucaugaugugccccuccccucaaaugucaaauuucagcacuggcuaaauggcugcagugugucucuggggacaagccuuagcccagcuggugacacugacaagaugaaccuuuacauucaggucggagaaggcagcaagagcugucuagaucacagacugaacauuaacuuuaaaggcaagaucaggguguuaaaagaggcaacaucauguuaagcaccgguugggcucaaaggcaaagcccugcagucuacuacaaagaaggcgagcggagccuguaguaccaccugggaccucggagccucgggccugucuggagagugccaggcaagcaggcagagcagcucaucaccaagcuuucacagucaguguuacugaaagucuagagaacucucuucaaacacaccgcagcaaggcaagcagacaaagaugacugacuaguucugaacacacaauagccagggagaaagcuggagucuggacccacuccucucauucucuggcugggagggaaggagggagggaggcuugggccacucacuaucuauucucccugcucucucuaccagcacucuggccuuuaccucagggaugucagcaucgugcucgggggagucuccgccaucgucacuugccuuccucuuccuuuuauuucggacgcucuggaugaaauuuuuguggaagucgcagauauacaggugccuuaccugauuggaagaaaccuaaagucaguguuaccaaccccauggaaccugugagaucaugagccuucucuuuuggccagguacuagagagagauggaagagugaaaggcagacaacagcuuacaaccauucuauauaggcugcagaagaagaaacauagagggcuggcaguacagcucaguggaaaguacauguucaacuuggauauccccccccccccagccccugcaaacgagccuuacagguacaggaggaauuaugaacuugcaaugggcagagacaggucgcaggacaguggaugguacucacagcgccuacuccuacuguggguaagaccggaaaacuugacuccugcugcuucacaucugauccacaaaggagcagagagagacagaacccucacaaagggggaccacauaaaagagaguggacaucacucugauuuucuaauaaacaccagaguauauuaguaaaggcgccaaaagcagcucagcagugaagaacaggguuucauuuaagaauguagguagcacaguugccuggaggaaccacucaaagacccugcaggacccagggccuguguaauuggccuggguagggacagauggugcacaaauguucuagggagacaucugaacuggaguuugguccuuaaauccuuaaagauaaaaguaagcuggcaggaagucaccaucaaugaauucaggcugcuuuguggagggaacaaugaaaacuguuuaauuugaugauuaucaguuucuugugguuggauuggugagucaugagucauuccgaguuuacacugugaugcugucuuguacacagcaggcgagaaauaagugcugaugcaccaauguaggcccucucauaucuacaaacggccaaaugacuuuugcugguaaaagccaccucuuuuuuuuuuuuuuuuuuuuugguuuauuuuuugagucaggguuucucuguguagcccuggcuguccuggaacucacucuguagaacaggcuggccucgaaacucagaaauccgccugccucagccucccaagugcugggauuaaaggcgugggccaucacugccuggcuggguuuuacucuuuaggacaguggccuauggacaauguccaaaaguucauugccagaguggaaucugacaaaagucauugaaauuugugaacuuguaagagguggcacacgccuucaaucccaguacuggggaggcaggaggauuucuaaguucgaggccagccuggucuacagagugaguuccaggacagccagggcuacacagagaaacccugucucgaaaaaaccaaaaagaguaacacccaggugaaacaagaggacaugugaccucugcuccauuccuggcagcuggcacuugggcugacaauguaaguaaguggcucuugagagagcaaguggugcugggcagugguggcgcacgccuuuaaucccagcgcuugggaggcagaggcaggaggauuucugaguucgaggccagccuggucuacagagugaguuccaggacagucagggcuacagagagacccugucucgagaaaccaagagagagagagagagagagagagagagagagagagagagagagagagagcgcaaguggcuucccacagcauagugguaaacugggaagaaugaguggcagagugggguguuucuaaagcuuagguaggaagaggccagaccagagcagggggcagcaacccaagcgacacuggagccuguuuccuuuaugugauccccagcuucgagcacucuccagaagcaaagaagaaacccaucagcggcaaguuggcuauguacuaauacaguacagaggcagccaguggccaccugaaggggggugcuauaguauuuuaaaagggcuuuugccagauccuuuuaccagacagcuauucucuguccuuaaccauguucaagucuaaucugcuuuucagcaaucucaggacucaggggcuuuugugggugaggugggggccuuaggguggaagcaaaggcucacugugguugucuggguuuuuuuguuuguuuguuuguuuguuuuuucuuuccuguuucacuugcuacaacagcuagacauucuaguaacacagcacuuacuugggacugaauuccugcccaucuguggaaugaaauagaaacuguuucagagauaaugacucuguacuaccaccuugaaauggacuaaggccgcacaucuaaccacaagccuucccaaguacugccuuuggggaugcuaguacagggcagagggggccuuucuuccagaugaugaugaugugugugugagugugugugacaucgacaugcucaacacugcuccacauggcuuccccauggggugaguggauaaauggagucuuuacugcaacaacaaaaccauccagaugugagcacugccagcagcccacacgggaggcaggcaccguuuccauguggauaaacucauccccagucucgggaucacuuucacucccaugugugauuagcaggggacaccugaggguuuagccagcuuugcuucagaguaaucucauucauucauucauucacucacucauuuauuuacugacaagacauuuguaaaaaggaaggucccaaucauaaaaaaacaaaaaacaaaacccagcacgauuucaaaugagcuggauucuacugguugacuaaauaaaacugagugugcaagagaagagucuagaagaaaggaugaugaucuuauuuauuauagacgaaugaaaacuggguguaagguuuggaagcaagccaggcaauaagugggcuuaggaaauuagccagcuuuuaagugcagugugcucuuggcgccauugcuuccuacccccccgcccccagccucaguuucugccacaucagaaguguaaagaucggcucccuuucccgcuaccaagcaaugucugauuuccccaaaccguugaacaguaaucauucaaacuccugaauaugagaaguuccuuaacucagucucaauuccuaaccuggaagcugccacucagggcuugcagcaacagaugucaaacugaaaaguucuuaaccgguuggcaguaggcacaucuugaggaccagaguaggugaaaucacucaggaaguuucuuauaauuagccacaaggcauagggcaaucucauuccauuuuaaauuugcaccucuccaccuccaacggcauuaccaaagaugcuaauccccgcaagaaagcugauuccccgcccccuucaaucacauccacagcaaaucauuuaagacccggccuuggccuuauuucugccacaucucagaaaaacucauucgcugccagcgaagcgggcucuguguugcgcugcagagaccggaggccgcggcagacaggaaagucgcggccaccuugcuagugucugaaagagcgacaaggucccuggagggaggacgaaguuggagaagauccucccgguucccuugucaccucuuuugcccaauucuugcaaaaguaacccaccucucucugcucugcuauucggcgcaacagugacagcuggaaacugcugucgcuuucccaggcagggagagugugccaagcccucccugguuucccagcccacccucggggacgcgggcagcgucgcggagcaccgagcggccuccaagaaccugaguccccuguuuugcacagacugcgcggcgaggcccaccgcgcggagcguccccggggucccuucccgcggcccugcgcuaugccccgagacucacgcucuugucuauguccagcuugaguuucuucugcgagaugcuuuucugcacccucuugcugaaggaggcguugcccgcgggccggacgcagcgcucgccguccgcgaugaggcagcagcucuggccguagcccggggcggcggcgggggcggcagggggcccuucgcggcuguccuccucugugcugaagccguucaucuccccgccccggcccggccccuccgggggaggaccccuguaggccacuccgcggcugcuagccccgcggggcagcucuucgccagccccgcgcccgggucccacggugcgcccugggucaggcgcgcuccgagcuccgcgaggcccggcugcucugugcuccugcagcccgggccccggcggggaugcacacgccgaggcuccggccggggcucacgaggcuucccccgggauccgggcccggccgcccuggggcucccgaggcccccgccggcucccgccugcuccgcgccgcgcggcaaagucuccaccccguggcuccccgcgcgggggcccggccucgaaccugccguguccgggccccgcggugugcucgggccgccccagcgccuggccgcucggcggcgccccgaguccccgcggcagccccugggccgccccggccgccgcccgcccgacgcgccgcaccacaacagugcgcucccccgcccgccgcggcacagcggaagucccgccucugugcgcucaauggucguauucuuuauguaggcggggcccacgucgccgcuggcaguucccauugggcgccauc

SEQ ID NO: 6015 - RNA, 17024 nt, Mus musculus
cucugccagggcguuuuugguuggacggucuuguugcggagggagggggaagauuguuugcuccguagacgcuccccguaaagcaagguaaacugagguaaagccgggaaggggcauuuuuuuuuucgccugguuacaugggauggcugggacucagacgcuggguccgcggaagaguaugcgcuuggagccuggaggcucagauggcccccagggcuggagaggcaagguugggggauagaaggugaauugcaaagccggaccgagggggacgggcuugguagaaaaaggguguggaggagagaggguggggcucagagggaaguuuggaaggggagggacuguggagggaacagggacgcgagcagagucggaccuaaaguccuugaggccggaggaaagaaguugaggugggggacuggucggaucucgggaguguguguugggaaaccagugguaucuuggggagacccaggacgcggaggaggcugcuggccaagguucugaugcugacauccuauguaacuugaccuuugugucuccugcagcuccccagaggcgcaucucccacccucugcuuggacuuagcuuucucuccaucugccaccacagccuggaggcgcuugccuccacccucccgaauggugcuccucuucccaggcgucggcccaggauccaggcccccuuugcuccuugaguuggagcuguugccgcuggggucucuuggugggcuccccguggugaggugugaagaacuuuugcacagacgaagcuuuaguuauaaggaccuccucagcaguucgaagcucagccucuaacugaacgcgaggcccaucugugcugcuucucuucggccuuugagaagagaaagcccuauucuguuccauccaaaguccaggaagccucaaacuggggcccugcucccagcaugccagcccucucuugugcauagggcuuugcccucuuccagccagcauggcugaucucaaaaaggcugcagggggccgggagacuccgcagggggaacuucggucagaggugguagaggaugagggcccuaggagcccggucgcagaggagccuggaggaaguggaagcaacagcagugagaccaaauuguccccuagagaggaggaggaacuggauccuaggauacaggugagaaggcugauggaggaggucagaaguccagaggccagacuugcugaagagcugugggaucaaugaggccuuagacuccucucucacagugggcuggggugggaaagggaagcagacauguacauaaaacguggcgguucagugugacaagugugacaagugcugauggagagcagggacccugccugagugcuuggggcauagaaccacucauuguucuucuuucugaauaagcaaaaagauugcuagcucagguaucuuacauauccuggaggcaagaggagauggcugagacugggaggcaguuuggaggcugaggaaaucuccccccccccccccccaccuuuuaccuucuuagauaugucucucagaaucauuuugaguugugagaccuuucagguauuugaaaggcacgguaagguuugagucuguaaggaaaucaacucccuucccuccuccccaucccccucucuuugagacaggauucucuuguguagcccuggcuguccuggaacuugauuuguagacuaggguggccuagaacuccgagaucugccugcuucugccucccugcuccugggauuaaauuaggugugugccaccaugaucagcaggaaacuuuuuauauugcaaggauuuaucucuguugugauuggccuuuaauauauauuucuggcucuuggaauugugggcuuaccaaaagaaugucaggauaguuuacugucauggaaugugcacagucuaguugguaaaccagagagaugguuguguaagagacucagggaacugguaugaggaagaguggucauuguggaggagauggccugcuaggacaagcuuaguuaucuaucguguuucaggguacugucuaaauggacuguaugggaaaguuucugauaugggcugauaauggcuaauacgugcuguaugucugggguccagggcugcuauucagauagguugcaucugagaugcuguuacugggaacaugauuuagcuccuucuagguagcuagaacaucccagagcuugaauucuugggcuucuccuucaguaaaccuuacuggguagugccagugaauugcaaagaaaguaagucugguccugggguguguguguguguguguguacugaagcucagcuccuuggguuguuugugaccuuauaguggagcauuggcgagcuauucuuuucuggcaugagucaguaauuuauuucugcugugcuucaagaugcugcauugacaacaacucagcuucucucauccauucugaggauuuguccuccacugagagagugcauugaaaaaaagaagucuugggauagauauucaagucacuuaaguuccaugauuugggaauuugugaaaccguuagcuucuuugagcuucuguuugucaguaaagugagggacuugguuugucuggugugcacagcuccuauucacugugcaaagggucuggaagauuacagauagugaguuaagaaggaacucucuguuccuggaugagaagggccuguaaugcacuucuugcaccucccugaaacauccuucauucugcgcaggcaauaccuucucuccugcuaucguucaucaaccucuuguucuguguauuuuuucaguaaucauauaggcgaaggcaguagacugaagaggcacacuuguggcuauggaaauacagucauuugagauaaaaaaaaaugcaguuguguacuguagcgauggcauagauguaacauuucugccaucauaguucugucagugagcucuggcaguguuggaaugucucgggaaugcauaaggucuacuuugccuccagugagcgugcagagugauggggacuagggggccaucgagacccuuguuucucuugccgagcuguauggcauuuauuguaguguuguaggugguacagggagggaaggcucaucugaugacacaggcaugugucgguuggcucuccagacucaccagggauuuagaguuugccguuggaaaagcgucaugaugugaggcauaccacaguuugcagguggaggucacguuugcccuucuguauuaauauucuuuugggugcugaggagaugcguuaguguuugaaguucauuuuaguguugauagugauccacaucacaugccuugaaaaugugcuucagcuccuucagggaguaucuguuuuucuagaucagcauauuuaaugugucuccaucaacagacccaucaagauccacuaaaagacucuuaaaacacauuuucccuuacuuccauuacuaggauaagauugaaaugaaagcccagccagggcuggguccacugggcaagggguggcccagagcucgggcucugaccuauuuuagaguguuuugaauuucucagaaaugacuauccucagggugagguuccacggcugacaggcagguagcucauguugucaucuggugugaucucucuggagguaaagggagacuaggccaugccugccugcaguaugucuuuguuuaccccuucagaaaaggcugagucuccaucagggucucauuggaucauuggaauuccucauauccuccagcuuuuggaaagaggguguuggucaaacgguuugguggugcuaggaugggccuggccucucagguuuucuauguucuccacccccuuuuucuuuuuugugagacaguguuucauguagucuaggguggucuugagcucacuguauagcucaugcugauuuugaacuccugauccuuuugucucugcaucccgagucugaaauuauaggucugugcugccaggauaccuggacacacuuguuuaacucccaauucuucagggugacguugcagccucagaguucucaucuucagguguuggcauaacuaaaacaacagucaucacccuggcccuguugacucaucaucugcuugggccuuucgaugcuuugucaaagaggaccaggagcguccaagaguggaacagaaacauuuguagucaagcacccaugcuuugacucaguggccuggcauucugggaauguguccagagugccccaagaaggucauccuccugcuggcugcuggcuuucugacagacgaugcaugcugacucagaccuuguccuccuugaauuccauuuucaaugagugccaggaguuccuaguggagcaggccaaauggaauguguugcugacuguccacacaguacuuugggugcucagugacucccacugugcccucucugccuuggugcuucagcuuggcugcuucuuccugcuucccuuguucaucaggcuuugggggugugaggggugugggagguguggggggugugggagguguggggggcuucccuuuauccugugagagcuuugggagcaccaggcugaucgaucaucacacuuuuuguuuuuuguuuuuuuuguucagguugaccuugaacuuaauaucucucugccucagcuuuccaaauguuaggguuacaugugggugccacuguaauuggcagcagggauuuuuuuuuucuuuuuaauguuaagggguacuaguuccuauauuuaacuuaaaaaccaaaucagaaaccaaaccaaaccaaaaaaaaaaaaaaaaaaaaaaaaaacccaaccaacacaggguuuuccucuguagcccuggcuggcuuggaacuuguuauauagaucaggguggccuugagcucauacagaucugucugccucugccuuccaagaguugggauuaaaagugugagccaccauacccaguccuauuuuuacuuuuuaaauguuagguggauagcuggcugugguggugcacaguuuugauuacucccccccucccccccccccccccccacacacacacucaggguuucucuguguagcccuggcuguccuggaacucacucuguagaccaggcuggccucgaacucagaaauccaccugccucugccucucaagugcuaggauuaaaggugugugccaccacugccuggccacaguuuugauuuuguuuugauuuuuuuuuuuuuuuuguuuuguucuguugauguuuguuuugaaacaggauuucucuguguagccccagcuguccuagaauucacucuguagaccaggcuaacuuugaacucacagagaucugucuaccuuugccucccaagugcugggauuaaaggugugcaugcagcaggcaaugcuggugcacauuuuuaaucucagcccuagggacacuaagcuaggagacuuaaaguguuuuaaaaaauggccuuugaaaacuggaccauucugugugaguucacaacauuguucugugaauggcucugucaaagagaaucagccagguucauggcucuucugagauaggcuguacccggguucauguccuuguuccugguuggaagggccaaguaaggugagugggagccaacaucaaaucuaugcagaugggcuaagauggugguguugucaucuaauaaugccugucacggaggagcagcaggcagacugggauggugaaggcagagccuggaguugagcaccaguuuugcagaaccuguaacuaaguaccuggaauuuccagauagagagcucuuggcacacccuagacuuuuaaggaguauccucagaucaucagaaucugggguuggauguguuuucuuaggcaggugagaaugauuuguggccagcccccuuuccagcuccaugccacaucacugaaagaggcagggucaucagugggucauuaaacuagcauguccagcgauuuccccugagauuccuccuugccaggacaacauugcaccgggggcuucugagaugacuuggugguuaagagcauauucugcucuuacagggaccugaguuaaguucccagcacccauuugggcagcccauaaucauuuguaacuccagguccagggggauuugauguaucuggccuaugcaagcaccuccacucacaugcauucucccucucacauacucauaguuuagaaaauaaauagauaggaaaacuuguacuauauugggugggaucuggguuucugucguccgagaggugaaaaccccuccugccccuuuaccugguccuuaucuuuaucaugcaccaagcccugauguuucuguguccugcauuuucucccuucuucucucaccugguacacaauaaauagcuuuccuuugccuuacuugucucugcuggaguacuugcccuucuccgccuucucgcuagaaagauaugggucaccaccucugugugcuguguucuacauuccuuuuuaagaugucuuaaacaauugaauaugugcuucaccuguauauauguauguagaccaugugcaugcagugcccuuggaggcugaagagaacauuggauccccuggaaauggaguuacagaugacuguuaacuaccacguggguucagggaacuaaaccuggguccucugcaagagcaacaaguagucuuaaccucagagccaucuagacuccagccccuguguuccacauuuuucuccaaguacugaccaggaaguauguagugagcaugugcugagugaguggcccuccuggcccugggaggagaguccuucaucuccuaggacuccucauugagaggaagagauagaugugcgcuaguggagaguaaggcucagcgccacccugcugucuguaccgcuguauucccggagcuagaguuuccucaucccugcaguggggguuggaguacucaguuaagugaaagcacgaagaucacaugagacuguccuggggccuagacagggugcccucuucuaagugacucacccguucccccgugugcuggggcuuucuguaguugacuugagguugcuuccuucuguccuaacucccgugcuucuuuggcaggaggagcuggaacaucugaaccaggccagugaggaaaucaaccagguggagcuacagcuagacgugagucucucucuccucacagccuuggguugcucucuggagaguucucuuuucguguuuuccuauauugagacagugguagaggaaggggugugucgaagaagugagguucugugaccuguaugcuugcuuuccacauuccuugccaggaggccaggaccaccuaucggaggauccugcaggagucagccaggaagcuuaacacacagggcucucacuuggggagcuguauugagaaggcccggcccuacuaugaggcucgacgacuggcuaaggagguaugccuguguucuaguuuuauuucuguugcugugacaaauaccaugcccaaaaggaccuuagggguggacaaaguuuaugugacuuacucuuccaggucaguccacuauugauagaagucacugcaagaacuccagcaagaccuuggaggcagagccauggaggaagcuuguugcuugcucacuugaaggcauauacccagcuagcuuuccuguagagaccagaaccaccugcccagggaauggugccacccauaguaggcugguccccuuuccaucagugaaacaaucaagacaauccaccauaaacauccacaggccagucugauuggacagucccucagcugagagucccuuuucaggugucucuaggcuguguaugucaaguugacagaacuagggcaguuugaccuuucauuaggaagggaugcacggucugucugucuucagucucuguguggaauggggaauaaaacaccauacuuaaggacauggccaugcucucaacagccugugaguugagguucuuaaaaguuguagggaauguguucauugggccagugagauggcucaguggauaaaggcaccuccugccugacgaucccaggucauucacuggaguccacaugguaaaaggagagaacugaccccugaguauuguccucugaccuccacacgcuugguguggcauuugugcugaggcacacacauacauacacaugcauacaauaaauacauaaauguaagaaaaugucucauggucaagaaaugacuggguggaggcauugguccuguuuagaaauuuuguucagucccacugauagcuuuguucuuucuuccuucuuuuccucuucauuccccucgccugucuuuccuugggcuggaaucaaacccagagucuugggaacagcagacgagaacugugaugcugaguaccacccacaggccucaccugcugauggguuuaaauaguuaggauucaggcuguaccuagcguccccucccucccucucucccuccuuacccccauaucaccccuccccucucucugagacauggucuuucuauguagcacuagcuguaguagagcucucuauguagaccaggcuagccucaaacucagagagaucugacugcuucugccuccagugugcugggauuaaaggcugugccaccauguacuggcucaauaauccucuguuuugauuuuuuuuugccauuuaauugcauuaauauuuacuauuauugcugggaauaggucuuuguuuaucacaaaauaugugacccauaugguuucuacacuauaguuucaccauauuauuacuuacaaugcaaauuucauucagucuagccauuguacacucauauuuugcauaugagagauacuucuuaguaaugugcauuuuuuucagaguuuuacauuuugaaccaauuaaauuugaugaaagcuaguaauuauauauaaauuaaguaauguauagaaguuuaacaaggaggggagagcagauauucuccucccaccccucagcagcccaucccuuagcauccagauauuucuuacguuugcauauaugagagacuuagcuguaagucauauaauuugauaauuagcauccguuugaaagcaaacgcucuuugcucaggaauguuaaaauucuucucgaauuuauauacuuaacuaauacugccaaauuugguaggguguuuguuuguuuguuuguuucuuuucgauagucuguuuauaaaucucuuaucaaccuauaacaaaaacuuugacuugguaauuuaugugucacuuugucaaaugugcaaacuauuucuguuucuagagaagugcagaagauggaugagguucuaugagaaaugugauuucucagcuugaagagcugagaguccuugauucuugguucaugugucuguuuaaagcugugugugcccagcguauguucacaccagcucuagaaacuggugugcuaguugccaggagucuguugcuuuggaugcuaucagcagcuaaacauucagucuucccuuauuacugucucuguauuuugcuuuuuugucuuaaaaccacuuuguuaugaauucuauaaaaauggggucauauaauaugugcugucuugguuccuucaucuuaucuguguaacuguauuaugacauaacaccagagcucuagagagccaccuuuugguaaugaaaugcuuuguggggcuggagaaauggcucagucauuaacugcuuugcuauugaaccauacccuuagcccugugucauacuuuaaaagcuucccuccccuccccuccccuccccuccccuccccuccccuccccuccccuccccuccccuccccuccccuccccuccccucccuccccuccccuccccuccccuccccuccccuccccuccucucuucuucucuccucuucucuuccucuuuuucccuuggcuguccaggaucuugcuguguagaauaggcuugcuuggaccugaacucacagagaucugccugccucugccucccaaaugguggggauaaaggugugagugaggaggcaccaggcccugcuaagccauuuccauuuguaagacguacuuuuuugucacgcuccuauaacuggaagcuggggaucagccucuggguuuugcuuggcuagcacugguugaauagccuaccguaauuucagguugagcauagcauguaucagauguugaacugguaacagguacuauaccugaucuuagccaaugagcugagaagcaggcuuuacuguaauuuugggcuaagaaguauuuuagauuuuuauucagauuuuggaauaugugccuacacauaaugacauacauuggagacagcaauuaaacaaggaaugcauauaucugauaagcaucuuauauauagccugauauaugcaaauauugcucuuauuuuaaaauacucauuuuuaauuauguguauguauauaugugacucugcuagauuucauguggccaccauccacuggcauuuucuuucuuaauauuuacuucuauguuucuaaucuguacaguauugcuuugauggcaucuauccuuaguaugguuugggaaaugaagcugaacuuauaagugggccuuccucuuuuuuuugucuuuaccuccucaagggaucgcagggggggcugggguucccccugggcuucccauccugacgacccucuacccccacaggcccagcaggagacacagaaggcggccuugcgguaugagcgggcugugagcaugcacaaugccgcccgggagauggucuuuguggcugagcagggggucauggcugacaaaaaucgacuggacccuaccuggcaggagaugcucaaccaugcuaccuguaaggugagggugcugucagcagguuccuuucacuguuccuugcucuuccuuuacuccguucuccucccuggcccucucccacuucaggccuccccacaacccccagcuuugguuuccuuuaagguagaucuguccuaugccugccuagcuuggccuccagugcuuccauuauuccaguucucauuagaaagccuccugucuacuccugcuuccucuggguggggccgacccuaagcuccucccaggcaguggcccuggauuuaguacucauacacuggguucagcuuugugguucccuguuccuguuugcagaaaguuuucccuucacggguggguccugcacucugcuaguguguguuggagguauaauuuuuguaccauuuccaagcuccuaaaacuagacugggcauaugggcacaugggcaccugggccugggcuuauucugcccccuucagcauguacaggcccguaucaacuccuggauagugacugugccuuucaguucuuugacugcacagagaagacccuguccuggggugggccuugugaggugaggauagugagagaggcugggguguaaccgcagggaugggagcagcuaugagcuugccgccgccugggagacgaggggccuggagccugcaccuguccccugcucacauaaugcucugggccacacacagauagggaggcuguggaagcuacaagaacccaacaugccucugugccuccugucccugaccugaagccauugucacugagggguuccucaagacuguggugucugcacgguugcaauguguucgaggguguccagccauguuuaggagggacuaggcuggugguggcagcuuuccacgguaucagcagagcugaggggcagguuguugcgguaaaucuccaacccaaauaugccccgaaaugaaaacaccacucaauuaauaugauuacauguugugcaccuagacugggcagaucugcugcuacacuaccaucuuccccauauaagagaccccuuagaacuugagguuucuccaggccaugugcuucugcuccgcuuugcuucuucuuccuccuccucugcauccucucucucccccaccuucccauccaccuuccuuuaucugcccaaucaucagcccuccucuauuuuacagauuaaggugggaagcagguuuacaggaaaucaccacugacucuuuccuuguucgaaaccccucacuggagaauggaauuaacaucaaauauaauuagccccagggcuaucugcaacauuucccccuuucuguccaauuaaaagacuauuuuaucucagauacaauugagcauaacuauuacuauuuuguaauuuauaaaguacaagagaccuaacacccaguccaucaucuuuguuaaguaaauggaaccucugucaucuauccuuaccuaaaagacuauagcucugcaccuggcuaugccuuggcuuuagauuggaugccaucugaaaaccauccucuccaaucuguuccucuccaaguaaaaagccuggguggcuaagagacuauguaguuguucaaccccaucagaaauccaagaaaaacugauauuaacugaaaauauauaggaagccuaacacagcuuccaaaacuuagccaauuuauagagacugcugaucacuuggacagucccuuacuucaacauguuggagcaucggucuucagccuacuggccagggucaucugacagacuuagagaaacagaaauauuaaggacuagccuacucugucucgcagagucaagcuauacuaaccuguaauuguguccuuucuuuggacaguauugucuguagaugaaugaggcaauucuugccuaguggcuguuucgccacaaguggaguagcucaaagaggcucgguuuguucuuugaauccaagacagggaaagcugucuggaguagacuggucucaacaagugaauaaauaacauuaaacgucacauucuguggacuucugacguuuuugaaaaccaacuaucugugaauuaaucuggacugcuuucuguuaccuacuuucaaccauuucugauuaaaauaacugaaaacacccuaacaauaaacucaaagccauggauuuccuauuuggcccuuaacucacaggcuuaaacaucucagaucuguuuauaauaacagcaauagaaggacugggucuaagcccuguacuuaaauauuuuaaguaucaaaggcaaccuauaauaaccacccccagccccaaagccuagggaacugggacgacgacucuucauaacuucuucaagcugaaugugggcguugagauauuuugaagggagugggaaggauagggaaaaugggggaguugguuggccuuaagaaggccacaccaaugauuguauuagucucugaugucuguguccugacuggauccggaugaaaaaccaagacaucaggaguucuggcaggucaguucagcaugucugaugaugaaauucaccaagacuauauguucuguaauauuuaaaucucaaagcaaaauuuuaguaucaucaagauaaccuuuuuguuugauucucuggaaucuaguucucagggggucucccucuaucaaaucugauccauagaacucuggaagguguaaauaccuuaaucaccuuugccaaaaacacaaagacaaaaccuuuucuccaagucagcauagccuucagccgguaaccaggaaaaccuguaguuugcccucugucccagaggaacaauaaaacaaccacaauacucaaaaucacacacauuuuagccucuuuaggccuuucuaauuugucaugucaggauauuaacccaaaauuccugugaagcccauguuagacagaauaugagucuccugcagacuuuaucauacugucuuuaaaacaauugauucacacuucuauuuuccuuuccuuuccuuuccuuuccuuuccuuuccuuuccuuuccuuuccuuuccuuuccuuuccuuuccuuuccuuuccuuuccuuuccuuccccccuuccccccuuccccuucccuuuccuuucuauaccugcuuauaagaagcagcuugucaaaccaggauuuaaacccaaaauucccguggaacccacguuagacagaauaugaguauccuguaagacuuauuagagcaauauaucuuuauaucauccuuaaguaucaaaagguuauauuucucucuuuauaucaaugaaucaccuggucuggaguccuuuguaccuuugucucccaauucuuuauucacagggagaagcugaccugaguugucuguguucccauuuggaggugggggaggcaggguggggagugaaggauacagggaagaaaacauagaaaggcucucucagguguagaugccucugccauucucugugagccccucuaacccagucggcuucagauccauacugcugcagcuuacaucacugcccaagccccauucagggguuggggggugggcagggaauuuuuaucucagguuaguuggauucaaaucaauacguugggcgccauuuuguuucgguaaaucuccaaccccggcaaugaaaacauaacucaguuaauaugaauacaugcugugcgccuagagcaggucguacaaguacacguuagacagugggaagagaggcuuucagaggcauguguuugagaucuguguccaaaagagaugguaaggugcucucgcugcccccaguccuuaucugucuuccucuguagacugcaggaaugucgagggcuuuguagacaauccuguucaggucccucagggcaguguacauauuggcagccuagggcagaucccauuugaaugccagcucacugaugugugucccccgcccaaccugggccaggugaacgaggcagaggaagagcggcuucgaggugaacgggagcaucagcgugugacgaggcugugccagcaggcugaagcucggguccaggcccugcagaagacccuccggcgggccauuggcaagagccgccccuacuuugagcucaaggcccaguucagccaaauccuggagguagcuaaugggggagggugggcagguacagcgagugcuggugugcugcuuuggucaaccuugcuagaccagccaguacuguagccugugcucagaaugacccugcaggagugggaggcgggggugagcggcuugugcccguggagaacacugaugaggaagcaaagguaaaugagaagggugggagguuggaaugggggaaaccagccagcuggggaggaagaguggagagagaggggggagccagaggggugaagaccugggaggagggcucgcuggggcucaggucaggagggacauucagaggacaguagggcuggagagaguauugcaguucagaggugcugaagguguccaggggcucugggguaggaagucuaaccucagggacaagugcugagugggucagaagacaucucauagcuuaccuauuuuuuucugcaggagcacaaggccaaggugacagaacuggagcagcagguggcgcaggccaagacccgcuacucgguggcccugcguaaucuggagcagaucagugagcagauucaugccaggcgccgggguuugcccccgcacccccugggcccacggcgauccuccccuguuggggcugaagcuggaccugagggcauugaggauggggacagugggauugaaggggcagagggcgggggccuagaggagggcagcagccuugggccuggcccaggcccagauacggacacgcuaagcuuauugagucugcgcacuguggccucugaccugcagaagugugacucaguggagcaccugcguggccucucggaccaugccagucuagauggccaagagcugggagcccagagccggggacgccggggaagugacaucggaguucgagggggucggcaccagcgcagugucagccuguagcucuguggccagagcuagcuugauuucuaccaugggcaaucagggcccacaggccuucccuccucaaguccugucugccccagauccuggucugcagccuuccuugggcaggaucagcugucucaguccuguguccccagcuuucucaccguuccuucucucaggaggcagcucucucuuugccuuacccaccuagaaggcuugcucucuggcccugucucuucuccccgugcuggcacucgagucucugaugcucucuugauuuccuauucugaccugacuucuaucugucuggcuuuuucccucagggaacuuggucuagaagacgcaggaggucaugugagaacaugagcauccuagcccaagugguuggacaggcuuucacccguugauuccuggcccugucuucccagaaggcgugcccuagauaugcugcugaguccccggcagccugugcucuuguccugucccagcuugccugugagcaauguguacaauguccaugugccucuggaagacaccaccuucugucagugcaccucuugugaccuuagccgcugugcuguguguccuucauucagugucaggugggggaguugaacccuguuaucaacacaggcauuugggccaacuccaaauggccccugccugugugaugugucuccaguugggcugagcccuuacaauugccaaggugcuagugggucccaauggggucuaugcuggaggguuagagaugggagauucucaaggcugagaccuugccaucccuccuucuccauguguggcgcugggcuugcuuuuucuugguagagguugaacuggagcuuggcacccuccuacaggguggcauuagagaacuuggugcucaauugcucucuauugcucuuccucacaccagaugguaccuacgccaggaaccuuuggagagcgcuuaagcaugggugcaaagccuccuuucuuuuaugagaggaauugacuugaagugagggguuccagccucaaagagcagcucugggugcugguguuccugggcugugugaagggaaaccacaccugaucugggugccuuggaggaguugaccuccugucccaucaggaggaugaggagagcgcgugcccagggcugggagaagagugcccguugucucgcaugggaucucccaauuuucagguuuuaggauggucacaaugaaaaccuguggguuugagguggcuguucaggcagcacagaaacgaggaggacaugacugugcgagugcaugugcuggugcgugugggaaagggucaguccugguuuuauuuaaauaaaauaguuuauguaacagugau

SEQ ID NO: 6016 - RNA, 1242 nt, Mus musculus
acuaauucuucacauaggaaucaauauggaaugagacaugaagcaucagcaugagaccuggaacaacagauguguaaagacaagaaaaguaacuaugcaagccgggcgugguggcgcacaccuuuaaucccagcacuccagaggaagaggcaggcggauuucugaguucgaggccagccuggucuacagagugaguuccaggauagccagggcuaaacagagaaacccugucucaaaaaacaaaacaaaacaaacaaacaaacaaaaaagaaaaguaacuaugcacuccugauuguuuacuucacuguuucuggaaaguggagucuuauacccaacaguuucuucauagccucugugacauuuuuauuccuaagacuauagauuaguggguucaacagagggguaaguaugguguaaaacacagacaccaccauguccuucucagggcuguggagggaagcagggaaaauguagguauaaauagcagcgccauagaagagggugaccacagucaugugggaggagcagguggcaagggccuucuuccugcccucugcugaguucauccugagaacagugagaaggauggaugaauaggagccugaaaugacugucacaggaauaagaaucaugagcacacagcacacauacaugagggucucauagagccaggugucugagcaggagagcuuugucacagcaggggccucacagaagaagugauggaucucccgagauccacagaaugggaaggucauggugacaggggugaacaugaagccauccaaugauccuaggauccaacagguugauaucaggaggagacacacccugugguucaugaggacaggauaccggaguggaugacagauggccacauagcggucauaagacauagcagcuagaagcaaaaauucugaaccuccuagugacauguauaagaacaucugcaucccacaggcagcagcugagaucuugugguuccccaggacgcgguccaugagcaucuugggcacagugacagaaauguacaucauguccaugagggacaguuggcugauaaaaaaguacauggguguguggaggugggugucagagaguaucaacaggaucaggagggcguucccagauaaggacaucaagaaaaccacaaauaugaccacagcaagcagggcaggguguuuagauuggcugaagagucccaccagggugaaauaugacuguccaguauaguugcucauc

SEQ ID NO: 6017 - RNA, 923 nt, Mus musculus
aucaccccauuugucuccucagcgccccaaugaccuccuuguuccucagacuauagaugaauggguucagaacaggggugacgauugaguagagcacagccaccacuuugucccuuccaggagaaugcaaggaguguggcuggguguaggugcagagaccggugacauagaacagacuggccacagucaggugugaggagcagguggacacagcucuacucugucccugcccugaacccaucuggaauacaacaaccaagacccgagcauaggaagcuaggauggccaggaaggggagcaacacaaggacaaggacacucaugacaaucauaugcucauauugggaugugucuucacacacaaguggcaggagagauggaaccucacagaaaaagugguuaaccauccuagacccacagaaaggaaguugaaacacauacacuguaugcgcuaaagcauugauggagcugcugcuccaggcacuggcgaccauggagcagcagaucuuccugcucaugagcacaggguagugcaaggguuggcagauggcuauauaccugucauaggacaugaagcccagcaggagagcuucacacccagcaagacucauaaacauaaagacuuggaucucacauccuaaaacggaaauggccuuggugucugagaugaaguuagcucccaucuugggcacagugguagauaugcacaucaugucaaugauggagagcuggcugaggaagaaguacauggggguguggagucuucuauccagccugaugaggaggaccagugugauguugccuaugagagccacugcaaagaggauggagaugacugugaagaggaagguguccauguguccauacuggaaaagaccaaccaaggugaagucugucccgcagcugugguuuccugucuccaug

SEQ ID NO: 6018 - RNA, 923 nt, Mus musculus
uucauuucauuugucuccucagggcccccaugaccuccuuguuccucaggcuguagaugaauggguucagaacaggggugacgauugaguagagcacagccaccacuuugucccuuccaggagaaugcaagguguguggcuggguguagguggagagaguggugacauagaacaagcuggccacagucaggugugaggagcagguggacacagcucuacucugucccuucccugaacccaucuggauuacaacaaccaacacccgagcauaggaagcuaggauggccaggaaggggagcagcagaaugacaaguccacucacgaggacuguaugcucauacugggacgugucuucacacaccaguggcaggagagauggaaccucacagaaaaagugguuaaccauccuagagccacagaauggaaguugaaacacauacacugugugcacugaugcagugauggagcugcugcuccaggcacuggcgaccauggagcagcagaucuuccugcucaugagcacaggguagugcaagggucggcagauggcuauauaccugucauaggacaugaagcccagcaggagggcuucagacccacccagggucagaaaaacaaaggcuuggaucacacagcccagaaaggaaauggccuuggugucugagaggaaguuagcugccaucuugggcacagugguggagauguacaucauguccaugauggagagcuggcugaggagaaaguacauggggguguggagucuuugguccagccugaugaggaugaccagugugauguugccuaugagagccacugcaaagaggauggagaugacugugaagaggaagguguccauguguccauccuggaaaagaccaaccaaggugaagucugucccacagcugcgguuuccugacuccaug

SEQ ID NO: 6019 - RNA, 1768 nt, Mus musculus
guaucgaggucaaguuuuacugcaaaggugcacaaguuuagggcuuuucaguucgggugcugagggggaaugagaggguacgaacgauacugcucccauggauaagagaggggguaggaaggaaaaaugucaccguagucuguagucacaagcauccccaggauucagggaggaccagaggaagacacaagccaggaggaccaagucguuaaguggguugucagcacauccaacaggggccaggggcuuagccuggcgaaaccugaggagagacuuaguaccagggcuguuguagcagcccaaaggugaggaugagaacuaaacucuagagggaggggaggggaguugucucauccacagggaagaaucagaagcagggucacaaaagcuacgaggcccuagaggggcuguguauuuaugaucagcucugaaggaaagguagggaaagaagacaggaaggggcccaauagcuccugugggccuaaacacugcaagauuguagcucucaggaggagggggcaggugaagagagccagccguagccucaaagaccguggcuggggguguggggggguaccucugccuccaagaguaccagaggggcgccaaauaacucaauagccacuuccgcagacucagggaaguguuugaacugaccgaaugggaaauuuaccuaaugccgcugguggauggggccuggggggcugagaggggaggcgcugagcuauccgugagucagaacgccagucugcugcagauggacuggaggugaaggaugggucccaauauggcucagaccccaagggggugcacagacaggaggaggagccucuucaggucaggacaccauaaauguuacaguuccgaggggaaaaguguccuggcagaugggagccaaagaacagcacaaagucacaccacacaacaaaccucacaacaagagauuuauucggacaaaacacaaguagguagcugccucugcucuggaaagaaguagcaaggagcaacggagcuggagguggacuuuuuaagggguuucuuggggaagggggcgggcacagagcuuuccaggaugaggauuggugggauuugaaguccggaucuuggggcaagcucagggguuggugagauuugaaguucugagcuuaaggguuuuuuuuuuuuuucuuauggggcggagcuuaaccugcaguuuuggccuauagaacguuuuguagguggagccuagugguuggagggccucaggggcagggccuggccacugggugcucuuugaggggcuuauauuuccuauuaauacagucagauuaauuuuucaaugugaauuccaggaaaauuuaaaugacaaugugugucacauuuuauuuguacuugacauucucguuaacagauaguuucuauuugauuucugucagcuucucuauucaaaaguucuggggccaaagaucaaagacaaaacacacacacacacacacacacacacacacacacauacauacacaagaaaacguuauuugaaauuuaaaaauaauugucaucguuuucuuuacauuugugaauaauauauuccuauguacaguucauaauucacaugacauaauucacauaaugaacuaaaugcuaaucucgucauccaccuggagugagcuuuaccuucggacaaggggagcauagcggucaacucauguaaucucagcgcuuuggagcccaggcagagggacugccaugaguucgaggccagcguggguuugucuugaaaaacaaaaua

SEQ ID NO: 6020 - RNA, 1234 nt, Mus musculus
gauagcagcacucugucuuacugucuauaccuguguaucucccuucauuuucucuugucucccugucuuuccccuuugucuguuugucccuucucugcagugaugaugcuggcccagcaggcuggcccccuggagcacgaggcagaaggaaccaccuucuacagcuggccugcagcaccccuaccuacaucccucaggccucugccuggcaccacccuucauccuggacagauccccaucuccaucaacacuugacagccugggaugaagcaucagaggugccccgcuggccaugcacauaguuccauuguucagcaguguuuuucauuuucuuuggggcaugaaugugcucgggcuuguaccuguuccaaauagagaccuaccaguccugggauuccuuucccagugugugccagcccugccugggaccacuuggcagcucggaagccccugcuucuuguuuugccauggcucagcuuaguguggcauucguucuaguauccaggaaccaagccucacaccuuucccauuggugcccgugacaggguuggcucacuagacaucccucagcaagguucugaggcgcaccaguuacagucagccuguguguguuagugccagagaauagggaugcaggagguccugggguuuggcugggaccugaguguuaaugcaguauuccucacccaccagaggaccucuuuccucacuuugggucucacugugccagguccugggagccgccuucugcuucgcuucccagccucucuuccucccagcuugugccccuuugggugucgcuggcauccccaaagugauuucuccuccuucccaccucugauggaagggaccuccuucccugcagaagagcagcaggguggcauccccaggccgccgggugcuucacuucgcuguaguuuuggcuuuugcucaccucauauuuucuccaauaggugaauuucacaaaacuugugacguagcgguagugugguugccugcagcaucguguguguagauaacuaguccaagaaacaaaacccggcagaguggacagacacaggucaggggccaaagacauagauguauuuagguuucggguaacaauguucuguccccagaaggccccagccuuggauguagugaccggccucaacuugacucgcaggugggcuggguuuucagugcugaauaaagugguuugcuccagccucucuguuuccauaccuccuagucu

SEQ ID NO: 6021 - RNA, 13804 nt, Mus musculus
cgaagggacugagagccauaggucaguuaaauacaauuugagcuuaauauuaauaugccucaggccccagcaacacacacacacacacacacacacucauauuacuucuaccugaaaaccuugccaacaagugccugucuaaucccaagccggugucacuuuugcuauuggucauuuggccaaagauuauuguuuuaaaguaucuugcacauuccuccucauuugugucuuucaaagcaagcaagcaagcaagcaaacaaacaacaaacgauuuccuugcuccagcuucuuugaaugugccguccaucgcucacguuugggauacggguucccaccgcagcacuuggcucuccgagggcagcaucccgugauugacagagcgguaucauuggucuggagaacuccuguuguuauuggaccaacauguugggucgcaggugacacacuggcaaacugaagaauuuugcuagugagaaagaaaggaggagaggagaaagaguugguaaagagaaggaaggaaggagaacccaggagagaggaagacaagaaaaugagaacagaaggccaccagagcuagcucaguggguguaaaggaccaagugucacgcccuggaggccagaguccaaugcuaguguccacauaguggaaggggagaagggacuccuacacgucguccucuggacaccaauaaagccauacaacaugaaucaaauguaacuuugaaaaauuaagagaggaaaaugaaaagggaaaagcuaaggagaaauggcuuccucuucaggcacuaaaggcagauacacuuggguuuggcagugaaggugauguugaaacuuuuuguuugugcuuuuuuuuuucuuuauugguucugaagcccagugccuggcacuguuggcugucgguccacacguggaaugaguuucuuuggcauuaauaagcaccuugacaugugggauauuuuuuugguucugcucugcauacagucuuuucuucuaugagcaggcucucacccaaccucgaagcuggguucuuuuuaaaauuuccacaauuaauaaaagugacacacuaucauggcugauauaugacauacacccuugggaggggugggguccccgaaggaggcugacaguuggagcagaaguaacacuuggcauccagaccccagugggauaaagggguugcagaacauggagagcauguuuagaggcuuaccugcgccauugcaccuuugacuuaggagcuacgggaguagguagcaggcgucguuugugaagagcuugcguccucuccucucauaaaaguaggaaccagguuucaugguccuuuguccucugcaguuuccagcuggcauccuuuggacaaaggccuacccaccacuacucuguagccuuuccuccagggacaucucugguguggcauggagcugggcugcuggacagucccucaguucgggguccuguuuucucugauuggacaaccgagggcucuagcugaccacaccaaugaauagggaugugaagcuggcuuguuccucucgccuguguuugcagaagagacuucuguggccaugucuuucuuuacaucagcaagagcggugaaugacaaugagcugcuaagguaaaauuucucaacccaugcaucagcuuggggaaggcucugcaugcaucugaaguuuggugucucugugcaccagccuagcugcuccagccccucaggcucuggugacauuuucucccaugcaagugaucaccuccuccucuugcccuuagauaauuuaugcuucuucccacucagcacaguaauaaaaugucuuaggagcugcugaaggggauccagcggcuuucgagcacuauccagagaagaugcaaaacuccacacucaagccgacuuagaauuuaugagaauauguacuuucucaagagacauagaauuugcaggggguuggguguagggugggccugggggauggaggaggggcaaaggagucacgguggcucuagagggagggcugcugggagugggggaaagggagagaaucaggaaugaaugcagccuuaagcaagaugagaucccaucccaggccugccccaggagaucccagagccugcccugccccaggguuuccugucccaccccgcagggcacacauaaucaaggaaaucacugugguuucuagggacaagagagaacauggcaguaugaacgcucaugaaauacaacaaauuccucaccagggaacaaaacugaacgccucugccaagcgauaggauaaaagacaacuuagggaagugcuggagcagcuggugaagcagcucuuaggcugaaagcaaggcacugaagucaucccaggccucuggacuggauuaauccacuuuuggaagaaugaauuuguggguuaccacuggagccuuucuuguuauaacuggcuagcgcuggcucugucucaccuugggaugcucugaaugcuuugcauaauccccgcagcaagaugcagccccucagcuuugaauuuaccagcuuuaggaguccagaugagcuucucuauacguauaaacuaugcagucuucagucacagcugcagaaaaccacugacaaagccccacuugcccuuggagucuccaucuuucugguagucuccuuacaguccuaaccaucgcuucucuccaccugauagggcccugcugugcacaggacaccaaguguuccuuguccuauccugaagccaaggggcuuuguugcuucucacuugggcuuugucccuuaucuuaacacacacacacaccuaccuuaaucauaauuacauauauguauguauuaugaauguauguauguauguauguauguauguauguauuuaaauucagguauggugauggcaacagagcaggagacuaaucaauaucacugugaaagcugucagaaacaaaaauggagccucucuuugcuguagugaagugacuuccucugggccugacaagaccaucggccaucacggaacagagaugcuguagugaccugaagaauaaaugauauauagguuuauaauaacaguagugaggcugcuaauauucauucauaguaagaggagguaccuacauccccgcugcaauggucuuggggguuccuacuggaguauagaguagaaggcuggcuggaggugggaaccauggggugcaaucuuccugagcuaucccccaugacauaggacuuuuaaauaauauuacuguuaauucacucaugaucccauacauaaccccuucccaugucaugucaguaaucccaauaaauguauugaacuugguggaauuauuucuuugacauagcagugcccuaucugggcaaauaggcauguccucaccucuucccaggaagucauacgauguuuuggccagcacuaaccaaaaauauguaauuguaaagcaggcgugcccaaugaagacaaucucagagacucagaggguacugccacgauauacacaggauacugcagggagguugcccacagcucucucguggccacagaggcuuguuuuggagcaucucgugugaugcuccuucccugcuucucagauguacuugccucagccccccuguuacaguggcuuguguuccccuccugaugugaugcccuuucuaaauacuguucuucacaaaaucucccuuuugguuguuuuuugggguuuuaccaucacaaauacagaaaauuguaucagaccaauuacuuuuauucugauuguaagguaaauggauagauaggucccugucauucaaccuuuuccuuauuguccaggcacuucaauccccugccugucauccaggcugggccugaucccuccacuucacuguccuguucaucaucaaugucagggcucuacgucuauccacuugauagucaaucacucauuuauuucagagcccuauaaugaauucauuucuagucuccugucauucaucuauguagggcuuuacaaacaaaacccccauguacguugaucaguuuaggggauuguuucugaaagauauagaauaaugccaacucuucacauuauuauuguuguuggugguggugauuuauauuuguaaacgccauagguauauuugaauuuuuggauuuuuguucauuuguuugguuugguuugguuugguuuucgagacaagcuuucuuuguagcccugaccaaccuagaacucacugaguagaccaggcuguccucgaacuugcagaaaugcucuugguucugccucccaagugcugggaacaaaagcaugcaucacuacuaccuggcuuuuuaauuuuuaggaucuuaaauaaucuaaugaauucuaaacaucugaauauuuauuuucacaucuaaaauauuuaaaagguaauaguuauuagguaacuggcuugaugcaauauucuuugaaguggaguuuauguuuuauuauuaaacaguuuugggucuguaaagaugguucagcacuuaaguugcucucuuagaagagagauuccagugcccauggauuuccagugcccacguugaguggcucacagcauccuauaacucagguuccaugguauuugauauccucuucuggccuccacagguacccauaggcaugugcagacauacacacaaacacaaacacaaauuaaaucuuuuuuuuuuuaaagaaaaggcuuuaguauaagcuuaagcacaggcuguaagagaggaaagaagaugcugaagagaugauucagugguuaagagcacuugacuuugcugcagaagaccugaggucaauucccagcacucacacggcagcccacaacugucuaucaguccaguucugacaccuuccucuggccucucuggguacuauguauucauguggugugcaugcacgccugcaggcaaaauacucauacacauaacauagaaauaaauaucuuaaaauauaaucaauuuaaaaagaggaagagagaggcuuauguagaagacaguaacacacacccucaaguggguauggaauucucagagaauugcugaauguuuuaacucaaaaggauaagauauuuuucaauguuuauccauagaaucaaauauuaaaggcagcucauaggcuauggauguaucucaguaggggaagguuuuccccaguauaugcaaggcccuucauuugauccccaaaguggaauucugauaagggcaacuaaucuuaaagcuuagccauucacgcugcuaugcauuucuuuccacauaacauggcauuagcagagugcacuuucagguauaccuuggccaugacuguagguggugucagggaugcccaugcucugggccaccuuccagguuacaucguaucuucccacguguccuucauccuugcuucccauccaugcuaugguuuuuguuguuaucuuuguuugguuuggcuuuucuuuuaagccaaggucuugucuuguagcucaaacuggccuugaacucgauuucccugccuccaucucccaauugcugggauuaaaaguacagucauugccuaggaugcauaaugcccuggguuugagcgccagaccucaguaacaauuugagaaccauguuggaucuggcuauggucaguuagaugagugugaaagugccuaaguacaacugauuuuuuauuuaauuaauuuuaauuaauuuauacauaaaugcuauaucuguugaagagguuggcucuaaacccccaaggauaccacaauuuaaggacacuccaaucccucagauaaaauguuucucuuacacacaucacaucucucucucucucucuuacacacacacacacacauacacaauucucuuucacucacagacacagacacacagacacacacuuuuauuuauuuauuuauuuauuuauuuauuuauuuauuuauuuauuuuugagacagggucuuacuauauagcuuugauuggccugaaacucacuguguagacaaacuggccuggaacucacugagaacugccagcucuaauuccuaagugcugugauuaaaagcauguaucauuauacccagcuaaaacaucauaauauuuacaugcaucuuucuauguaauauuuuuuuccuagaugacuuaugauacuuaacaggaugugaauacugugcaaaucuucauucuauugucuaggaaauaaugaccagaaaagggcuguauagcuuuaguacagauguggcugcugccauaguguuuggagcauauaaauggcaacaucacugucuuaguuaggguuucauuacugugaagagacaccaugaccaguguaacucuuauaaagaacauuuaacuggggcuggcuuacauguuuagagguucaguccauuaucaaggcaggaagcaugacagcauccaggcagacaaggcucuggagaaggaacugagaguucuacauccugauccaaggcagucaaaagacuguuucccgcagcuaagagugaggucucaaagcccacggccacagugacacacuuccucuaacaagaccacaccuccuaauagugccacucccugggccaagcauauucaaaccaccacagucacauuuacaguuauauccgcaaucucagucugaagagucacacauugcagauagcugacuacagcuguauuaacacaauauucuuuagagugcuuuccugcaaaacgugcugcuguucugugugcacagugagacucccugacuucauuuuaugucgcuaucuuaauuuggucauacuccugguugacuacacaggcaucugccuaccuagccaguuuuauccugcuucagggcugaagguauagcgauaagucacccuggaaaagccuuuccugacagaccaccucccaaauuaucugugggagaugggcaauuauucaugauguuggggcaguacccugcaggaugaguaaucuuauaggacacagggaguaucuuuguaaggaucuggguuuggagcccgcgacugacaccaucaggacaaaggucgugagcugcuacgggaaccaguguggaagagagcucagcugcucaaucaugggcagggcgaugagcgaauaccagaaccugaaaugagagcgcacagcugcaaggaccuggauggaggaaugcgcagcugccaggaccuggacgucagagcgcacggcagccaggaccccgccccgcgcgcgcgcgugcccggcguuggcgcagucugggucugagucguaggcugaggcucgucggccuugaucuccggccgguccucggcccuucugcgcccucuccgcccgcgcccucgucggcgccgccgcccgcagcccuggcgcuccccgcgggcccagcugaugccaucugcgcccugugucagcgcgcgccccgcgaaccggugcgcgccgacugcggccaccguuucugccgggcgugcguggugcgcuucugggccgaggaggacgggcccuucccgugcccggagugugccgaugacugcuggcagcgcgccguagagcccagccgcccuccgcucagccgccgccuccuggcucucgaggaggcggccgcggcgccggcgcgcgauggcccugccagcgaggccgcgcugcagcugcucugucgcgccgacggggauccgcugugcuccgccugccgcauggccgcuggcccggagccgccggagugggaaccgcgcuggaggaaggcccugcgcggcaaggugcgcgaggggccccugcacacuguccaccuuuguggcuuaccuggagucaggcauucgaucagugugcugaccuccucuucccucucccgcaucccaugggugcccagcacccucccuuccccggggacccugccaugcuaggggcucuuggauccuggaguccgugauucugccuuccuucaucucuauuaucugucucccggacccugcuaugucccucgagcuauuaucucuagcgcaugcuccuccgucccccuuucaucccaggucucuggccuagcugugccuuaucucuauacaaccuuaagacuucuauuuuucucgaauuccccucaagucccgaucccauuccucaaggccucuugcuccuaucccggugugauuucaucggugcaagccccgcccauccacuugcuuauggagaccugagaguggucuuuggucuaccaguuaccauuugcagcccucugaggggcugucgguccaccucauucaggaaccuucucugcuauacucucuuggucauugcacguagcaccugccaccgggcagaaaccgacuauuagacucugugugaagauggguugcagggaucuagauagaguaucaucccugacccagagagagaugucugaauagccagguaggaaagccguggucuccgcccgacaggagagaaaaucguagcuuagcguguuugagggugcuguuauccuuauguucugcaaugaugcaccaugagccucuggaauaaguugugaagaacacuuuugagguggaggccugugguuacauccaggucccaaacugagguagauacacucugucagaacauacugcugggguuguccuaugguuugucguccccuuacuaagacagcaaucuccacaaagaccaagcaggacacagagaagucaggaaagucacugucuuaaaucaagcugacacuaaaggggaccuaccuaaaauccuggaaucacacagcugaccuugaauugccugcuguacaccuaguucugaagagguagaagcacaggagacccuuuuacgaaacaaccacuuuccagcagagaccggacgaguaguuccagucgccagacugcugaucgggguguucaaauccuucuucccaggcucuaaccagcuucucucucccaggagaacaagggcucuguggaaaucaugaggaaggacuuaaaugaugcccgggaccugcauggucaggcagaaucagcggcugcuguguggaagguaagugggcucuccuggauauggggagcuagcagggcaaccaagcugagcugcuggaguuuggcuggcuggacuuggugaguugaguguccguagggcuccucucuucggugugcuuuauauaaggaugauuugugagcuucagguuccuuuucuacacaggacacuuucuaguacucuugauucugaccaaccccagcuguuaccaguagaacauucuguuuucuggcugccacacaauaccacacacaugauugcccuggaggcuggaaguccaacaggcaagccauggcaaguccaaguuggggcuagcuuccgguggccuuucucacuguguuggcacauggagaguggggagggggcucuuugggagucccuuuuacuagagcacugaucccaugucucuuuggugggacuaaccacaucccaaaggcccaccacuuaacaccauugccuggagguuucagcacagagauuuggggacacaagauuugguacuuagcuagccuucaccugauaccacccauggcauuaaacaccaagaugacauuauguuacaguuuguuuguuuguuuguuuuguuuuuagguuacuugucaacaaaaccacacauuaguuuaaacccugcaaacuuuuccuuuuauauauuaaaauucauuauaguucccugcccauuuuuuuuaaaacauaaaaccaaaguguuuuuguagacuacagaaacccugaagcccucagauggucugcgccguaaggcugaaggcaccugcucuaccuuucacaaaaauuggaagacauugaggacaccuaguuuucuacaagcccacagcaguuccaaggauagguucuagaagauuuaaauacgaagauggggguccggucagagggaggagcuuggccagacagcuguuaucuggcuggcauuuauguccuuucagcaaaaacauucuuccuucaggaacauggguguccccugugcuaugugacccagggccaggacgaagaucugagugcaguuaggagugucuguuuccaauccugcugucaagguuaggccgcuagaaguguugcugaggguggcaggaccgaguuuugcucucagguuuaucagaagucauaguagaaaaguggcugguuuaaggcagcucuguguucugacaggacuuuaguccccaagauugacuuugggaagcugugaauggggccuucacguaagcugagcauuguagauguggguuguaugucuaaggccuuaacagucuucagaugagaaauguacucagaaaugagagugugucugguuggugcagugcuuguccagcaugugagaggcucugaauguaaucgugcaaagcaagcaccacagacagacagcaggccuggugcuuacacgugcacuuaguguacggacuucuuucuagucagcucuuuacaaaggaacuuauguuguguuagggaaauuguauccaguggaguggaccugcagcacagggggggaugcagguggcucuguguuagaugaccugaaacacagggaaggagaggaugcagguggcucuguguuagaggaccugaaacacagggaaggagaggaugcagguggcucuguguuagaggaccugaaacacagggaaggagaggaugcagguggcucuguguuagaggaccugaaacacagggaaggagaggaugcagguggcucuguguuagaggaccugaaacacagggaaggagaggaugcagguggcucuguguuagaggaccugaaacagggaaggagaggaugcagguggcucuguguuagaggaccugaaacacagggaaggagaggaugcagauggcucuguguuagaggaccugaaacacagggaaggagaggaugcagauggcaucuguguuaauguugugccguuucauagaaggaucuugagcauccauacacuuuagugucuuggggaugcaguuccuggaaucagucaugaaggacagugcaggggagaccaaacauugccuucauggaaguuuuaaugguaugagaggccucacaagguaaugacccaaagaagcugucgcaucuuacaauacacugagaauauuggacagaaacuagcagguuggaaaaaagugauucauuugggcuaggcggugguggcacacgccuuuaaucccagcacuugggaggcagaggcaggaggauuucugaguucgaagccagccuggucuacagagugaguuccaggacagccagggcuacacagagaaacgcugucucaaaaaaaccaaaaaaaaaaaaaaaaaaaaaaaaagauucauuugggaagcauaaagaaaaguaucuuaacaaagucuguguggcauccuugaugaaaucgcuguguaggagagagguagccuuuguucugcugcuguaacaaaauagccaggacugaguacuguguaaagaaggcaaguuaugaguucuaguggcugaaggucaaagaucagaaggcucugccuacugugucuagugaaugcacccaaggugguucccucuguaacagcuagcugucuugggagccagcugguggcccaugagaccaacauccaucccuucagaggauacacccacaugagugauggagagcugcaaggcccugccaacugcacaucacgacagugggaccaagcuaauaccaccauaagggaugucagaggcauccuuucauguggagauuucacuucuuguuuuggaaaacagggagaguucucguaccugugauuuuaguuuuuaaaguagauuuaauucaaaagucccagcuuauuuugagagcauaauuucuuucagaguagagggccuucucuuucuuuaaacacauuggcagcagguaugguccaguguggaccguugucccuucccccucucacccugcaggggcauguuauggaccgaaggaagaaggcccugacugacuauaagaagcuucgggccuucuucguggaggaggaggaacacuuucugcaagaggcugagaaggaugagggugcuuccgaggaugaugagcuggccgacccggcagaucgcuuccggucccugcugcaggcugugucagagcuggagaagaagcaccgcaaccugggccucagcaugcuucugcagguaccaccugggcagggggugagcaccucuuuccacagcacaucucuagucaacucagccacgguggaagagagacucuccuacaggcaagguucgagccacagcccaccuugccccuguuguggcucaggucugaguaucagagaauaaguaggugguugggaaaaguaguuggaaggaacuuagagcugacgaagcuaggagaugccuagggucucacugggaggguuuuccccaccuuaggcucugugagcaggaguagccaggguauccccccugucaucccucauccucaucucauuccccgagucuuggaccaacaccagaggcaaccugcuuggaagucagccugagcuuguaauggggcaucggcugccaccuguaacugagguauucccuucccacauacccaucagcuguuuggggccuauacaaccucagagacacaggcuuuggaccccucuuagauggguugucaagucaccuuggcucugugugcauuguacgcaggauagcagcacucugucuuacugucuauaccuguguaucucccuucauuuucucuugucucccugucuuuccccuuugucuguuugucccuucucugcagugaugaugcuggcccagcaggcuggcccccuggagcacgaggcagaaggaaccaccuucuacagcuggccugcagcaccccuaccuacaucccucaggccucugccuggcaccacccuucauccuggacagauccccaucuccaucaacacuugacagccugggaugaagcaucagaggugccccgcuggccaugcacauaguuccauuguucagcaguguuuuucauuuucuuuggggcaugaaugugcucgggcuuguaccuguuccaaauagagaccuaccaguccugggauuccuuucccagugugugccagcccugccugggaccacuuggcagcucggaagccccugcuucuuguuuugccauggcucagcuuaguguggcauucguucuaguauccaggaaccaagccucacaccuuucccauuggugcccgugacaggguuggcucacuagacaucccucagcaagguucugaggcgcaccaguuacagucagccuguguguguuagugccagagaauagggaugcaggagguccugggguuuggcugggaccugaguguuaaugcaguauuccucacccaccagaggaccucuuuccucacuuugggucucacugugccagguccugggagccgccuucugcuucgcuucccagccucucuuccucccagcuugugccccuuugggugucgcuggcauccccaaagugauuucuccuccuucccaccucugauggaagggaccuccuucccugcagaagagcagcaggguggcauccccaggccgccgggugcuucacuucgcuguaguuuuggcuuuugcucaccucauauuuucuccaauaggugaauuucacaaaacuugugacguagcgguagugugguugccugcagcaucguguguguagauaacuaguccaagaaacaaaacccggcagaguggacagacacaggucaggggccaaagacauagauguauuuagguuucggguaacaauguucuguccccagaaggccccagccuuggauguagugaccggccucaacuugacucgcaggugggcuggguuuucagugcugaauaaagugguuugcuccagccucucuguuuccauaccuccuagucu

SEQ ID NO: 6022 - RNA, 467 nt, Mus musculus
gaugccugauccuucauuugaaugcaaggcauacaaauauucuugcuacaggggcguccgcguuuccguaguacaacuagacauuaugccugauccauccaaaucagcuccagcccccaagaaaggcuccaaaaaggcggucaccaaggcgcagaaaaaggauggcaagaaacgcaaacggggccgcaaggagagcuacuccaucuacguguacaaggugcugaagcaggugcauccggacaccggcaucucgucuaaggccaugggcaucaugaacucguucgucaaugacaucuucgagcgcaucgccagcgaggccucccgccuggcgcauuacaacaagcgcucgaccaucacgucccgcgaggugcagacagccgugcgccugcugcugcccggggagcuggccaagcaugcuguguccgagggcaccaaggcagucaccaaauacaccagcuccaagugag

SEQ ID NO: 6023 - RNA, 18578 nt, Mus musculus
uauuuucaaaauaaguuuuauuuagccuccaguagauguuuucaagacuaauaaucaaauagugacuaacuagaaacagacaauucaguuauagaugguuuuuggaaacaucagagaucuacagaauaugacauuuaaagauguuuuauuauuaaaaggcuuuuuggcaacaggacccguuuuucuacuucaaagaaaguugagcaucaaagaaucucccuauggaguuuguuucaaauguggccacugccacugugcaagaaacuguccgugcuucaaaugcugacugaaugcuguccggaauggacaaacugggaugcagggaacucaacugccaagcuuugcaagaacaagauagcuaaguccuucaucauuccugcugcacagaaaagucugucaguuauacggugccagagggcugaagacugaaguuccaccauuauacaggaauucugagggacugucaaagcagcuaacuugucaugucuauaguuuuggaacauaugggcugagcacuacaaugguuauuguauauaguuuauuuuguaagaaaaggagccuuuucuuggacuaaaagggggaaauguagagagaaacucuuguucacuguguaaaagcauucaccugucaauaaaaggcuuauuggccaaugagcugaggcaggaaauuagaugggacaucagacagagcaggagggggaugcugggauagagacagguggaagauugacccccgaaugcugauauguacagcagcaaaaccugaggaccagguuaucaaccauguggcagaccuuagaguaacgggaagauuagcuuaugagcuaguuagggaacagccaagguuuauggccuagguaucuaaauauaucugagucucagaguuauccugggagcaggggcugugaggauagacacaagcaugcacaagugcguaacuccagggcucagaaaaggaugcagaguacuacugaugggcaggaugaccucaaggacauggaaaacccugagaguggugaccaagggagucggugguuucccucugcacuuuuacucuguguucauagcccgcagcaccuguuguugcucagagccuccagugccacccucaugucugugguugacugaccccaaugggagacaagauacaugucacaccaugggcacagaagggucacaguggaaacaugugcuaugccaguucaccaucucacuugaguccuggcaugcuaguaacuuuuaacaggaaugggaagugggagggguucuuggggaaggguguuagaaaagaauugaguccacucugagauaagcaggacccuuuccaaaguucccccauuuagcaucuuaucuguagucggucucacuugagcauuugaaucuugacuguauuucaguuacccugccagcacagguauuaacucuuagugccccagggaagccuggguagguggccacgguggugaagcacccugccuucuggggaacuguggcacacccagugucugcccggcuucaagccucuaucccuucacccacauggucacuguggagaugaccaucuggccugacuugggagcccccaagcagaagaauggcagcagcggcccagggaaggcagccugggaaaagcuguguaagugggacccaucguucacgcuguagaaggacaccucuccagccuggaaguccaggaagauccccauguggcugggaggcucugugagagugacuagaguggaauuggguaacagggacagcuguuuuuuccccuuggacagcugcacuacccagaagccguuuucuggggacuuaagcacucuguccuuccgacucacguugucccugcacacccccaaggcccagagugcauccccggugagauucaugcccacuucccaguagugccuuccagaggaaaagcucuucugccccacagcgcacggguaggccacgaaccgguccuugcuguagggggcgcugcccucgggcggugggcucaaguaccgccucuggcgacucucguagaggaggagauagggguaugcugagcugggguccggcaucacauccucugcagaggguccagguagacagagaagaguaggggucauucaaggugaaugagccagaacccucaagaugggcggggugugacagacacaguggcuaaauggcucuuuuccauauccacccaaaagccuccccuccaccaguuccaaccgguugggguuacccaaggguucuacacuacaaauccccguggauauugaugauggugagucaccagggcuaaaugggggcaaacuuauuucagcagucaggcuuagaaagauggugaguacaguuugagacacuaauuucuaguuggaagcgcugguccuguguggcauccggguaaggcagagcagugcccagacaacugggguccuuggagacccgggucuccacuuaccuuggaagcuuuugagcaccucuaucuguccuggaacucugcacaaggucuugauagccgcggggaggaccaccucuggguacugcacgcugaagcucuccuuccuccagggaauacagacucauguccccucugccucuccgugugcucugcccucccccacgucccccacuaccucuauugagggugacaguaccuguucaagguguccuucacauccuguaagcaacagagaggagaguucagagcugguccugcuuguuggugucaaagcuaccucuguugcccgcuacuuugggacauguccucagcuggacagucccuugucagauaacaacuuuguacucuuccuggaagcuucccuuucacuccugcuuggcagacccuaagcauuucccucaguccacggucgcaagccugaggucuggucagcggagaggaggccaaguccugggaaccaugaucagcacuuaagguaguggagacagagggcagaaccccugcuaagcaagcacuaucacugagccacaccacccugcucuuuccccacgccuccucccuagaauccaguaaaccccgagucagaaguccuucacauaccgugcuuuuguguauguguguguguugugauacuguuuaugcgucuggcacagagaaugcuaacacaauagaacagagccaucucuaacagugaaccauggcgagcuugugcucacaaaucauuaagcaaccuuggcccuugagucucacagagcuucacuuaaaggaggcugggccccucccugcuaagcaagcacucuacugcuggcugaucaagcgucucugaggcaacagaacucggcuagccucacugcuccugugaauguuccucaugcacaccugcagagcaccucacaguagcuuugauagccaagacagucacugcugauaacacgaagcauagagauauugaacaaagggaugccucccucccagcccagguggauuuuaucauauuccucagaauagcaugcaguuuaaaacuugaugacuguuuacgucuggauuuucuccuuugauauuuucagguugagcaaaaaugaagccaucuggggauuaagcuguggauaaggagggagcaguuuccuccucugcagaccucugguagcugcugaugcaguuagggugucagggagcacagugggcguggauggcggaggggcugggggugacagccuagggucccuggagauuuucuagaagccagaaucuacagaagcaccccuggccuagaaaacuacaauggcccaccugccuuggcuagcuauguuagguucccagcaacaucagguuggaguuuaauuccuagugucacgguauugagcagagugugggagggcccuuaagaguuaauuaggccacagguccuccauggugaacggagacgagaaaggguguugaagucagucuacccuuguucacucuggcagguguuggcgggcuguuacgucaugucaugucaugagcagaaguggagccgugggcgguagcaugcucuuggacuuccagaacccugggccaaaaccgcuuuuuaagaaaguauuuguugucucucccuuuguguguguguguguguguguguguguguguguguguguguguguguauacuguggacaauguggacuguuugcugugaggcaccguguagcgcugggacaagacaggcuagugaccuucaaauaucagcccagccucauccuuucugucaggcuguguuuguuuugcaagccccugggcugagugcacaucuucaggccacaccccuccucgugguguacccaugggugcacguguucaggccacaccccaccuccugguguacccacggguuuguggcaacacagaaaaucccaaagacaggagcgccucagcaaccucuggccucaccugcagcaucuggaggggcuccugcuggcuccgcuccuccagcugcaacaggaucagguccagggagcggcuuuggugguccagggaggccuugcuguccugcagcuucccuaagguguccucuuccuccuucuucaggaccuggaggauccuccguucuucuuccaccagaaacaagaccaccuucugaaacuccuccaggaugcguucucuccgcucuuucacucucuccugucgaaauggaaugggggaaccccaaacuggcuaugagauggauucagaaaggagggauuuccuucaggguugccacacagcaauucugggacaaccggugaccuagaauucuuaggaaaaguuggggaagccagacuuuugaccaagacucuccacaccaucccuauugcacccuaacaggccuugaguaauaacacccauacauucaaauguccauguguccuggugucagugggcuuagaacaugcaaccucaaagaaagacacaggcaugauucauaaaaaaggacgggggacuccuaaugaccaggcuaaaaugauuuuggaguuacccaugucccuaaagcuguuguucaaaaauaguaagaaaucaagaguuucaaagacagcagacaaacuucuuaaauaccugccccccucauguuuuaugcacuuguuuaucuuuccuuccuucccucugagagaggcuuuucccacauagcucuggguauucugggacugguuacauaguucagguugacucuggacuaacaggccuugcuuuugccuccuugaguucugggauuccaaauaagcaccagcaaagccgcaucccccagacccgagcaggccguuuccugugaagaggaagaagucagccuuugcccaaccuaagauuaccuaagauaaucuaugguuaacaaacuaaugucuuccugaucccacuuuacaagggagauaacuuugaaaugaaaggaccaccugcagccuuucucaguuuuuuaaaucaaagauacagcccacaucuauguuauggaacaggcuucuagaaugaagaaauagagcuauuuaagaucuaaauaacaagauucuuuuaaaagggggcuggagagauggcuuagggcaccuagacauucaccucacauccuuccuaagccauaguuccaggugaucugaugcccucuucuggccuugcuggacauugcauacacauuauucauauauacaugcaggcaaauaccaauacacauaaaaugaggauaauuuuauuuauuuuuuuuauuauacauaaguauacuauagcugacuucagacacaucaaaagagggcaucagaucaccugauguaucuaguguuaaagcacucuuuacgggugguugugagccaccaugugguugcugggauuugaacucaggaccuuuggaagagcagucagugcucuuaccugcugagucaucuuaccaacccgaggauaauuuuuaaaaacaauuguuugaaccauccaggugcaguagugcuugccaguacacauagcuauuggggaggcugaggcaggaggauuacuuaagccuaugaguucaaggcuaaccugaauuuaugagcacccgucaaaaaaauuuuuuaauguguuguuauuuuguucucuggcagacuucagguguucuagcaggcuucaccugaggcucacuuuaaaaauccugcucaccuguuguguuggcucaauuuguaggucaggcaccgaaccugcagaguacaggaacccuuuuccuccuugaagcccugaaaggcacuuuccugucacagaugaggauagguauaggcacacaggguggaacagcagccauugggcaccuaccugccacucaguuaaggucuguuccuccuuggcuugcagugucuccgucuucaucaucuccucccguagauauuuuauguccuccuccaacuugagcuggacacacaaacaggccuccggucagcagaccccaccucugcccacaucuggagugcagucucugcagcuguacugacgaccccagagauccuccuacagacaggguggucuagcuucccauuccagcggccaggaaaugagccucucuugaccugggcuuuggagguuagcuccuggugauguauguacacuguguugguaaacugucuaugcggcuugagcucacugagaagcuggcucuggaagcaggguuagccccacccccacccacucacaucuauuuuacacccaggcauguuugucgaaagugcccuugaaagccccuuguccugagauuggcuucuccccuaacucugauguaacaggucggaguaaaaaacaaacagcaaaauagcccaagaguaaaaauguugugugcuuagaaacaacuauaagacaagccacucccggggcuggugagauagcucaguggguugagagcaccaacugcucuuccaaagguccugaguucagaucccagcaaccacgugguggcucacaaccauccauaacgagaucucucuuuucuggagugucugaagacagcuacaguguacuuacauauaauaaauaaauaaauaaauuuuaaaaaagacaagccacucccaacagagguaacuauuguuuauccugugauguaaaaauguaucuaguguuaaagagaagccagaauuucagucaucagaagcacauugagagagagagagagagagagcucaguuagccaagccaagccaaaccaaaccaaaaagccucugcagcugacugccucaacuugccuagucaauucugcugacccuuauucgaugauguugccuuuucucucuugaucaggcuccucccucaauuguuucugcuggacuucguaaacucauuugauuacacuuugccaucuauguacugacuaucugcuacucacuauguguucuuaccuuugccugccacucguuaguuaauaaacguggcuacuguagaccaucccugggaacauguggaugagucacacaccuauuuuguucuggaggcaaaggauacuuccuccuguuguggcugucucuagacggucccccccccccucuguuagugccagugcucuuauuaugaaaugaagguuuacauugaggccaacuugccugaacuuccacucccccuccuggacuugcaaccccugacccugcguucaccuuauacucccuugcagccucauccagaggcagcacccugugcauccggugcuccugggccucccugcagaccacacaaauggggcucuggucauccuggcagaacagcuuaagggguucuuggugugcuuggcacaggucucgcuucugcagcccagggugcuggcgggccaucucagccacuuuugucaggaggcgguugggccucagguuccucugaggggacaucucccugcacucggggcaggggaaggagcccuucugcuucuucuucccuuucuugaccuuccccuucucccagcucaucuggaugcacucucugcagaaguuguggccacaggcagucaucacaggaucaguaaaguagucaaggcagauggaacauguggccuccucuuguaaccgucuggcaagcuccaccgcauccauggcuccuggggagaaacaaggggagcgcuuccacuguaagcccuuggcgagcaggaucccagaauggcgccuugcucaacuccccuggggccccuguacagcauagcacaagugccuccucugcugauccacagaugggaacaaaagcugcuguccaaauguggaauacaaaggcacugaccaaaugcuagccagaccccugaaccucaguugcuaagcuugggcuuggcgucugggucagcuuaguuacgagcucccuccugggccuuuggggacucccagcuguucugcuguguuugcugucaaguaaguccuaugucugcccuggagccacaucucuacccaaaaggcugcaauagucaagggucagaacuaugucuuuaacucaccccugguaaaacaaagaaacuuagaaaggaauagaaauccuuucaguuaaggugcaaugcagaaaagauacaacaaaacacagauacagggguuccauauagacacauggacacaccagcacauucauacgcaaguacagggccugcauguagacaugcagauacauauacaagcuugcacauggguaaaaauguuuguaacuacacaugcacacauccacacagaaaacgugcaagcccacuuacacaccacaacaaacacaggcaugugaacauggaugcacucugaaggcacauacagcaugcacacgugcacaagaacacacaugcaugcaucccucaaguccaaguccugcuaacgcaggcgguggagacccugaacugccccuaauucugcuucccaagguccuuuuugagaauuugggaaugaggucgacucucagugcuccccaucuuguucucuccucugaauccugaaagccaagcaucuucggauauuccagaguggcugccauguuaauuucaucugaacuuucuaugagcagagcacagggcauuaccuucucccgacccaaucucaagagucucaccaccuagucagaaccaccuagucugaccuagucugaccaccuagucagaaccagggccaaagggcccuggcuucccuagagcagagacagacaucaggguucuugggucaucuaaggucaaugagggcucauccaggagacccacguaaucagagugguccacgguuugaagcuuaugguuugacuuugguggggacaggagaaggaacccccuagucucgacccagacagugagugagcgagcgaauucucuggacggugguuacucacaaggaaggagccuugcacugcgccaggugccaggggcaagugcgccgcaugggggaaaggcuggguuugugcuacagcacuagggaagaccaggagcuggggcagagggccauuguggcgucaacucacgcaggcagguugcuuggcagagaugccgcgggggcggggcugaggcugcuacaccgaagggaggaggcgggggcuucguugcuuaggguggagccagggagaagggggcggugacagaaauauggcuucgcuagaccauauuugugggaccaauaaauagaucaauagggcaaagagauuagguggagacucagguggggaaugcagggaaaauguggucggguuugcauggauugaggcuaggaaaaugaaaagggggcaauuuagaaauuagcaacucaaaguugggagguggugaucccugccuuuaauuucagcacucgggaggcggaggcagaggcaggcucaucucugaauuugaggccagagggaguuccaggacagccaaggcuacacaaacagucuuuagacucacccacccccccauccugccccccucuaccuccccucugccuccuugcccuccccugcucccccaucccugggcuuggagacauaaugggcuucaaaacucuucaguugcauacuuauauuauaugcacacccuaggaguaauuuauguauuuaacauuggcauuaaugagugauuccacuacaaaggagagguaaaguuuucuguguuaaccucacaggcuuauucaggcuauuccccucagcccuccacuaaugcaguucaguuaaccaucucggguuccucccaguuugauuucugaucaagccgguuagucuccaugccggucaucucugaacaccacccuuuuuguauggcucagaagucauacaguacuggacaguaugaaaaaccaaggcucagagaauuaaacuccagcgcaaaacauccuuuugauaagagagguuccuauugcuuacaacucagguugagucaagacaacagcuagacuuucguacccuacaggaaucguuuaagacaggauucucuggauguguccccuggaaauauguaaguuaacacuuuccugacucuuuugcugccgccguuaacagaugggcaaaauuaacuuuaaucaaaggcaguucacugggcuuuccaucaggagaaaggccaacuuuucaaguacaggaauagcuagccuuuuuaauaccaggcauuaugagccuuaaaacacaaaacauaaguaacuugguuacugagcagaugcguuuggauacuaucaacuaugcaaacauagcacguuuacugccgguaggagcuaccuucacuugguaaaaccagucagcaacacaaccaucaucuuguaguacaagggcucaggccacuauaccuaucaagggaaggcagguuagaauaggacggagcugcaagucaaauagcucaaugggcaaggauuagcugcuaagcccucuagacugaucuggggagacacuucgauugccggccaccuugucuucaccuccugaggagacaggacaccuaagucuacguuacagacacuuuuucugacucuguggguggcucugaaaagagccguuggguucaugagcggugccugugggagccuaagcccguucuccgcggaugcgccgagccaacuggaugucuuugggcaugauggucacccgcuuggcguggauagcgcacagguucgugucuucgaacagccccacgagguacgacucgcaggccuccugcagcgccaucaccgcggagcucuggaagcgcaggucggucuugaaguccugggcgaucucacgcaccaagcgcuggaauggcaacuugcgaaucagcagcucgguggacuucugguagcgccggaucucgcgcagcgccaccgugccagggugguagcggugcggcuucuucacgcccccgguggccggggcgcucuugcgggccaccuucguggcuagcugcuugcgcggagccuugccucccgucgacuuccgugccgucugcuuggugcgugccaucuuccugaaucguccgccucccuugcuccucaggugcacaauguggggggcgaguagcacugcuuuuauagacccagcuacauuccuauuggcugcccaccagguggcauuaugggaugcugcacucugauugguccauugggggauugacuuuacacccugccucuuauauucucucugagugguguggacucuggaacuguuaguugcggcucgguaggagggcagcggggucuguggaaaaaacucaagucgcuuucuuggagcuuuuauuguuguuguuaaauaaaaaaacaaaacaaucuugccucgacucccaagacacaaagaaccuucuagaaccuuucugcaugcuuccuuuauauaacaacgaggcauaguuuuccugaguucuggaauacuaaaaaaacauccaccuggucugaggacgccccugggggcgagggcuggagguagcucagcaguuaagcuuaauuccaggacucgggaggcaaaggaugguggauaucuguguguuugagguuagccagggcuacauaguauuaacacuauuuuuuaaaaauagggagggguagagauggaaaaaaauaaagagaaaaacgaaaagaaauugugucguuugcuggaacaauggaaagaacucaagaucacaguguuaaguaagcuggauccaggcaggaagaaaagcauggcauggguucucuagcauguggaagcuagauuaaaaaaaaaaaaaaaaaaaaagcauaaaaauggggucggggugguauuuauagagagaaagggaccagagggaagaggaaaaaaaggggagagcuggugugugugugugugugugugugugugugugugugugugugugugugaaguuaucaaaaugaaacccauuacuaagcacaguuaacguacguuaauuaaaaaaaaaaaaaaacuagaagauaugacucaaagaacaguaguccaugcuuauaacuucaguacucgguagcugaaucagaaggauaauaauuuugaggcuuagaguacacugaaaugacgcuuuaucaaacaaaauaaaacaucuuuagaucugaaagaaaauuaggaaaaaaaaaaaaaaaaggauuucugaagcaaaggcuuucaaggauaacaugggcuguauucaaggauucccccaaaggucacaaucaggguaucaaacaauaguaauaaugauuauuuagaucacgucagaggaugagaaaugucguccacauaauuucaaaaaacgugaguccagaaaaggauagaaaucaaacuguggugcaucuuuacggauuugguuaaaaaauagaacucacugacaaucaugguguuuugcuuccaaacguguauguguaguuuaaacugacgccggugaacgccaaagcggggaaucccgagcccgugccugcggugugcggucgcggguaggcgcuacgccaaccggaggacgugggucguccauugguggugcccaggaaccgggacgucccggcccgcgccacucucuagugccagcuuauggauacagugacagggaaaauagcuucacguucagaaagaaccgaaacucuugccucugggaauguacgacccugugagacaucggcgacacacacagggcuugaaauucugagggagccagggaggaaggagcuguccaucuugcaccucacacagccaauuggaucagucagagcuuuuggacugaccaaucagaaaacgcccccgagcaugcccaugcuccggagccggagagggcaaagcgcgucgcuucuccagcacccaaggccgaggugcccaucagaggacgcgggaaaccuucucuacaccccggugcucacgcucccacacucccgcacccccaaaccucggcaaggccagacuacagcugucaccgcguugguucccgagcugggcgcugcaccuauggaagccacugcuguaaucuuaauuuuuuuuuuuuaauuucuuuuauuuuauuucaacuagacugcgccgagcuucccagagaagucacaccauacaaggcuggauguaaugcagagcagcgucucaaaaucugagaaggaucuucuuuccuuucuggagccuguaguuuucuuucccuauuaaauuucccccauucauuauucgaucugcaccuaugccuugugggaaaggaucaaaugaagguuuaguguuagggguggaagaugggggcgggagcacaacagugggacagcguugcccucucaguuuccugcuacuugccaugggagugcaauuucuucccaucgccagcuuagacagggaagaaauccuuuguuuuaaauuaacuuaacaaauacauaguuagcacuaugugcaaggcauacucaacgcaugcgagugacaguagacauaaauguaugugccucugcacucuuugacgucgaugguagccaguugagcugaucacaacauugcaguuuaucccuaagcaggaaugaagcgacuauguagggaacuggaaagaggaacaggaacagaaacuuagcgaguacuggaagaggaguuuuguuuuuaguuuguuucguuuuugacagcuauccuaacaggagcgaggugaauccucacuauggucugauuggucagcaacuguagcgauuucaaagaucgugugugucuuuacaguaauuccuauuugggguccuuuugcuuuaaaauucgagcuguuugcuauugaauuauagggcuuugcuguuuuagauauuaacucacugaucaaauguauggcuaucucacuucuuuauguguauuuuuuuuuuuuuuuuggucguagcagcucaagacuaaaacagguauauuuuguccguuuuuugagaugaaucauggguguguguuggaacuguuuagagagggaggaaaacuucaugugacccagaugccaguggggacaacaggcugccuuuagcagguggggauaucccucaggugcuaucaugcaguuuggggagaguuacggauuuguggaaacggugguuuuggugcuaucacaagaaaagagggccguucacggucaucagccaaaccugggaugugcagcaaggaggccugagaccccugccuacuacacauccaucccgcuuugccauucauauuaggaaauuagcugucuacacagccugaguccaacuggccuggcaguuguucugaaccccagaauuuagcuugagggacagaauggaaagugcagccucugugguccuugaagcaccccauuagccuacuggagacgcuuucaugacuuuccagcugacccccacugauuucccaguugaccucucccggcucuucaacuuucuugaguuaucucuacugaaugugcaucgagcuucaugacaaugauuuuuggucagccuaguacaacuauuuacccuauaguuacauugcauuguuuacaaggaguuaugguggcauacuaaaacacugagggcauuuguauguuauaagcagauguuauggcuuuguauauaaggauccuggguacccauagauuuuggugccugcccaggcucgggggucggucagagaugagaaccaaucuccuaugaugccaaaagacacugaaauguccucuagguucauccaugugacaacaaauguaauuuuggguucuuuuuuuuuuuuuuaaagcuuauguaauauuuaucuguguauauacugcauuuuggaucugcuccuucacagacacugagguuagucccauguuuagcuaucuuagcuagcgacaguauccacaaugagcaugucaguacauaugucucuuccacauacugaucucauuucgucuggagagaugcccaggaguaggggagcuggacugcauauuagguauauuuugaauuuuguugaggugggagauuacuggacaugugggugagcccacaagaaauagccccacagagcagagacuaaggugggaagcagggcuggaggaaagacccacacccagaagaggaacacgggaugcugcggagacaggcagagagcucccacacacugcaaacacuguuccgagauauuuccgagguuggcucaagcugcauccuucuggaacccugucucuugccuucagcagugcacaggaacacaugcagaguggcugaaaugacucuaauacaggcaugugcucagagacacagugggccagggaaagaccuccauaccuccacacaacacccaugcaggcugaaccuggcaaggcuaucugccaaggccugcucagagcugcagcagagugaggaucagguccccuccugccucuccacauggucucucaugauggcagcugugguacgaggaguuucaccuuuuaccugaggugggucaguuuuacucuagaaaggaaacacuggaccaaauuuuuguccucuuucuguccuuagggcuuccaggcuuccuucauccacccugccccugacccccuugugaguggugagugugcacugcacaccucugcauauaugaaugugagugcaggcacucaugcucucauacauuaaggucugaggacaaucucagguguuggucucaaauuccaaccuuuugccagggucucuuguuagucgcuguuuaugccauagcagcuggccugcgagcuuucagggauuuuccggucuucccuggcagcacuggaauuaguuaaagugcuaaccuggcccugcauuacauggguucuggaucugcucaggucuucaugcgagcacacugagcgcauuucuuaagccuucuuccuggaccacaucuggaagguccaugcuuacucucuccccuccuucagcuccuguaucuuuugcccguucuggacaugaagguucagucaucuuguccagucccuucacugacuaaugcuccgucacaagaacagacaguuuugugcuguuccucagcugaugaauauuuggguuuccucuaccuuuuagguuucaugacugauaacuguuccuccgccuguguagcuuauguuauacacguacucuuauuuuauugggcauauaccuaggaauggaucauggagugcuugaauccagugaacauucucuuuucacauugguacuucccaucuggaaaugauaauccagaugaccagauccuagaucacagcugcuaugauuggaacuuccuuuaauuuuguagacacacucagaaucugugcucucuaguuauucacuagccacauaugacagggcaacuuaugagcugcgucuuuacauuacauuuuaccuaaauggaaauuaaauauuccuuuuggguagugguugugcauuugacagcagccuuagaagagaugagaaacuacccuaguacaccucccuccacgaugccucuauaacaccauuaaauaaaugcuaacauaacccaauuccuaaaaaguuuaaccuccacucaagcguuugagcagcuacaaugaccuaugaacacauacaaacuaaaacuagaacuagagauucuaacuaaaagaacauaaagaucucuggagguccaacccucuggcuuuguuuuacugagaccacccauuugcagauguauaaucuauacgcagucuauugaucacucuguuaagacucaccguuaaggaaaauugcuuauccuuagacaaauggcuuuaagacguugguauuuuaugagcagcucuguaguuacagacggugucugaggagcccaggcuugaacagauccaguuucaguacagucuauauaaauuauauaauaaacauuauauaacugucuucguggccuguauuguuaaauuuuaaauaguguacagcaguuaacagggaagaggcccaauucugugccauuuaaaacgauuuaaagguaacucauuuaacccccuccucucccuuucccaaccacgcuccugauuuaccuguaacucaaccauucgucaugcugcuuaaagaagucacaaucaucuauaaaagcauguccuuaguaugaugcugcuuuaaacuuuaugacaaaggacacugcuguacucucacaccuaguuuaaccagaaccugacaaaucacuuugcuccccaagguuaagcuacuuaaguggauccgauuaaccaguuccaaaggccugcaggaccaccaugcucaucuguaauccuaccacuaagcaggcugaagcagccuagagaccggcuccccacccccacaaaggaaaccagcaaaacuccaaaguuguaaaucgccuuguaacagaacauuuauauaaacaaguagauuugaaauaccaagucuccccucagaaaccuuugaaaaccccguccuaacuggaagacuugaacaugucaauuuaacccaguuucaauagaaacacuagcaucuaaaccagaaccuuauacuaauuucuauuauuaaguauccccuuaauguccaaacacgaacguuaacugcaaccuugugucugacacggagugguggggagaaacucgaacgccuccaacggcccgcaggccacccgcagaugaagccguuggucucccuugagcuccccaagcgccgcacagggaugcaggaaugcacggaaggagucaggagaacuggccuggccaguaacuggcgacaggcucaguguacagcgcuuucuaaugagguuguggguggcucugaaaagagccuuuggugucuguaaaagucgcacuaacgaccgguaggggccucacuugcccuuggccuugugguggcucucggucuucuugggcaguagcacggccuggauguugggcaggacgccgcccugcgcgauggucacgcggcccagcagcuuguugagcuccucgucguugcggauggccaacugcagguggcgcgggaugauucgcgucuucuuauugucgcgggccgcauuaccagccaauuccaggaucucagcagucagauauucuagcacagccgccagguacaccggggcaccagcgccgacccgcuccgaauaauuacccuuacggagaaggcggugcacacggcccacuggaaacugcaggccggcacgggaagaacgagacuucgcuuuugcacgagcuuugccgcccugcuugccacgaccagacaucuuccacugauaaccaaaaguacgcaaaaacagaaaagaaaccuagcgaaaacgaauucguaagcgccagcaagcucuuauauaugaucaggagggaggcuagacugcaccuuccuauuggaugccaacaagaaccaaucagaaaagaacgcggagccuuccuaauuugcauaugccuuaccccgcgaugacguaauguaaaauuguauucaauca

SEQ ID NO: 6024 - RNA, 12332 nt, Mus musculus
agagaaaccacagcggaagcaggaagcuaguuuuuauuauuuuuuagaacccguuuguucuuggguuggccgcuguguaucggggcucggggucggaaucgaauuauagugcaagagaucgcauuuucgccucucuugcggugacaagucuccgcaggugguguccccgcaccccaagauccggaugcugcaaacuuuggccauggguucuguagcuaaucucuugugcacuguguaaaccuuucuccggucaauacaauggccagugagcuuaggcaggaaauuagaaggugugaugccuggaaaagagaggggccgggguggaugccgggaucgacaccgacgcaaguuuggccccagaacgcugauggagauagcagcaaaaacugagaaccagguaaccagccacguguggcagaacuuagaauaacgggaugauuaugcacgaaucaggaaacagucaaagcuuaugguggugaccgucugcggccacaacuucugccgcgaguguaucugacguugcuggggccagcaacuuagaaaaguuguggacagcgagugcuaaacuagaaagccaggcacggcuucucucccguaagauuucccguagcggcgggcugagcgcuugagcggccgucuauaagcaacuggguagcgagccggaacgcacuccagccugcgucugcagcggcccgggucuagcacucccgcggcugcugagucaggcagcggccggccacgagccucuggcguggcccgcaggcgagcagcuucucagagcugcacgaaccaagcgcaguuugcgauccagagcuggggcacauaggccuggcuuucagccgguggcugcagguaaagaccuaaagccauucucgagcagcaggucggaagggccugcagaaagauggaaacaaugggggcagccuccugaacugagcugagggguugaaguuagccaccguagacacuugcuggucuguggagccugcagacgcacuaaagaacaaaaggaacauuuucccgcagcggcuaugggacuaaaaagccccaaacuucugaaccgguaagguauuaaguuugaaaacaauaaaagaggaaagagacuaaauauaaaacaucguagacaaauauaguuuaaguugguaaaucgaaguuuuuaaggagauagagauuaaagggaaaauaucuucuaugauaaaaauggaaagaacucaguggcacagggcaucuagagucuguauaauuuuugcuauaguuaucagcauauaaauaauuuuuuucaguaacgauaacaaauuuucuauaucuuuuuaaagagagaucaaaagaaagcaaacuuagauaaggagaagacuggaagauguagguuacaggccuuagaagaaaaauuagaaaaaaauauaaauaaaaauuaggaaaacucuaaaguaguagagauacgacgagaaagauaucugaaaaaugaagacaggucauagaagagaaauuggaaagauuuauaaauaaaaaugaaaauacuaagauaguagagcuacaagaagaagaaaauauaaaaaauggagaugggucuuaggagaaaaauuagaaaaaaaauuauaauuagaauugagaaagauacugagauagacaggggaaagaaggcuaaaacauucaguaccaccuuggaacaagacugaaaagggcagucuacaucuguuaaaaaaccuaaaaugauuuuccagacuugauaaaggaauugggaggagaugaaagaaauucacaggguuaucaagaauuugaauggcaacuucuagaagcacaggauuuuagaacgcuuaaggaagcaguaaugagcuauggcuuacauucaccauauguaauaacugggccacacaaaaaaaucauauaauuccaaucaaauggagagauuugaugccagccaucuuaaagccuggcccucaauugcaauggcugagguggaaagaugaggcuuccguguggggcagugaaauaggauggaggugcugauggugucggccaucaguuacuaagugaaggacuguucuggauugagaguccagauuacccugacgaugccguccuacaacagagccuuacaacaggguggaguucagucuuuuacaaaggugacccagggcccagaugaaucuuucacuggcuuuuuaccaagguuaacucuaucuccaaauagagcaauaucagauccaacugcuagagagauuuuaauugaauguuucgcuuuuaaaaaugcuaaugcugagugcaaaaaggcuacuggacauaaaagggccagauuuguaccucuuuauaaauggaugaaaacuccugcggauauagaguuuaauacccaaauucaguuauggugggacaaacucagcauacaaagccuguggcugugacugugaauaguuccuaaggauaaauuauucuaugauaguccagggaagaagucuccugugcaguguagaagguguagaagggauggaaguaaggcucaugaauguaggccauccaaagauacucaaggcaauuccuuaaugucaguuggaaaacaaagaggcuuugcuccgggcucuacaaaaaccaacaugagccauucauuuccuguccaccaaggaaagaguauucugaaaaacauucuagccugguaaaacauucuagccugguaggcuuaaaucuaagccugauaggacaagcaacuguucaaaacuuaaguaagccauuuacuauagagcugcucuuauggauaaaacaagagauucuaaagauacccaaaaucagauauuauaacaaacuacuauaaaugauaagaggccaaaauuaaaaucacaguuggguagaggagcucaaaggauuaauggacacaaaaccagagguuacuuuaauagaaaaaagucuuaaaagguuuuaagaaaaaucagaauugucagauguuuuaauuacgauaaauaaggucaaaaggauuauagguaaaguguuccuagaaacaauguuuuucuagagaugauuaaaaaaaaggcucagccuucugaaauacacaaaaaauguggcaaaggcuaacaggacuaacgaugguagcucagcgagagacagacaggguauccccuuguuggggaacacuugggaccugccauuccaucccuucauacagcuuggauggaaguuuauaucacaguuggucagagaauccaaaccaacguauaaagacagacagaugucuuucauuucuucaaagagcaaagacucaucuuucacugauuugugugcacuucacacuuuauguuaaaguggaaauguugauuaccuuugaaaaaccaccagaaaagcagcccugacaagauccaccuugaggacgcugagaugcugaggcacagugagaggacugagacaggcugacuccaugacaggcuucaaacuggcaguucaggagaccaggccuagaucucuguuucucagaacugggcaaaagucaguuacuggaaaauccucuaagccucgggcagccaaucagaaagugccccacccucaguugcugccccccaccuggccugaggcaagggcaauggucaguaacaguuuccaggcuuccccagcaacaguuuccagguuuccccaguaacagucaacacccccccccgcccccccuccacacagcccccagccccaaguggugguucuggaauguccccagauauagagccagugaauuaagauaagguuacccaccccucccuggaauucccccuaaugugcuuaaauagggccugugagcucucuugggcaucuccaucuugauaaacaguagaccccagcaugcgggacuucugcagaauaaaacacucugcuuuugcauuuauuugagucuggguuaucauucuucggcgauucauggacccuuacaguauuuauuccggcaucuugccugguccuaccucagacucccucaaaagucugcauccaggauagcuucaaagagagcuacuucaccccaguuggucagcaucacagacuguugaagcccugaacuuucggcacauagagacaggacagcgacugcuacagcuuucuuaggauuugaccaucuucccagucuucuugguccccaaaaggaaacugccccaaaucagcagauggcaauuuuaagaaagcgaccccccauucccaaaggcagggugauuguuuugguaguuggauaaguuauggguguuugccauuuaagggauguggcuacaaguuguaauggucuuggaucagggaggaaacgauaacgguuagacucagaguuuucucuuucuuuccucgauccuuucucaccguucuaguguugaggaaaaagggggugggaggauagaggaguaaugggaaaaaaggguggaguauuaaguucuacuuuuagaccaaagaguaucagcaagccaaaaaucuuacauugguauauaucuuuguuuuuuuuuuuuuauuuacuuuauaugugugaguacacuguagcuguacagaugguugugagccuucaugugguuguugggaauuuuuaggaccucugcucacuccugucaaccuugcucacucagucccugcucacucuggccuaaagauuuauuauuauacauaaguacagugacuucagacgcaccagaagagggugucagaucucauuaugggugguugugagccaccaugugguugcugggauuugaacucaggaccuuuggaagagcagucagugcuuuuacccacugagccaucucuccagcccuuuaucuuuguauuuuaaugcaaaauugagguuauauuuugcugcaacauacuauguuuucaacucuuauuugcuacugcaaauaauauuuguaccuaggugauuauuaaaaaugaaguauuaaguucccauucucuuaaaagccacuauuacaaacagcuuaggauaauuaauacauguuaauagucaaucaaauguauggucuuauagauaccaguuuaguuauuuucaaaauaaguuuuauuuagccuccaguagauguuuucaagacuaauaaucaaauagugacuaacuagaaacagacaauucaguuauagaugguuuuuggaaacaucagagaucuacagaauaugacauuuaaagauguuuuauuauuaaaaggcuuuuuggcaacaggacccguuuuucuacuucaaagaaaguugagcaucaaagaaucucccuauggaguuuguuucaaauguggccacugccacugugcaagaaacuguccgugcuucaaaugcugacugaaugcuguccggaauggacaaacugggaugcagggaacucaacugccaagcuuugcaagaacaagauagcuaaguccuucaucauuccugcugcacagaaaagucugucaguuauacggugccagagggcugaagacugaaguuccaccauuauacaggaauucugagggacugucaaagcagcuaacuugucaugucuauaguuuuggaacauaugggcugagcacuacaaugguuauuguauauaguuuauuuuguaagaaaaggagccuuuucuuggacuaaaagggggaaauguagagagaaacucuuguucacuguguaaaagcauucaccugucaauaaaaggcuuauuggccaaugagcugaggcaggaaauuagaugggacaucagacagagcaggagggggaugcugggauagagacagguggaagauugacccccgaaugcugauauguacagcagcaaaaccugaggaccagguuaucaaccauguggcagaccuuagaguaacgggaagauuagcuuaugagcuaguuagggaacagccaagguuuauggccuagguaucuaaauauaucugagucucagaguuauccugggagcaggggcugugaggauagacacaagcaugcacaagugcguaacuccagggcucagaaaaggaugcagaguacuacugaugggcaggaugaccucaaggacauggaaaacccugagaguggugaccaagggagucggugguuucccucugcacuuuuacucuguguucauagcccgcagcaccuguuguugcucagagccuccagugccacccucaugucugugguugacugaccccaaugggagacaagauacaugucacaccaugggcacagaagggucacaguggaaacaugugcuaugccaguucaccaucucacuugaguccuggcaugcuaguaacuuuuaacaggaaugggaagugggagggguucuuggggaaggguguuagaaaagaauugaguccacucugagauaagcaggacccuuuccaaaguucccccauuuagcaucuuaucuguagucggucucacuugagcauuugaaucuugacuguauuucaguuacccugccagcacagguauuaacucuuagugccccagggaagccuggguagguggccacgguggugaagcacccugccuucuggggaacuguggcacacccagugucugcccggcuucaagccucuaucccuucacccacauggucacuguggagaugaccaucuggccugacuugggagcccccaagcagaagaauggcagcagcggcccagggaaggcagccugggaaaagcuguguaagugggacccaucguucacgcuguagaaggacaccucuccagccuggaaguccaggaagauccccauguggcugggaggcucugugagagugacuagaguggaauuggguaacagggacagcuguuuuuuccccuuggacagcugcacuacccagaagccguuuucuggggacuuaagcacucuguccuuccgacucacguugucccugcacacccccaaggcccagagugcauccccggugagauucaugcccacuucccaguagugccuuccagaggaaaagcucuucugccccacagcgcacggguaggccacgaaccgguccuugcuguagggggcgcugcccucgggcggugggcucaaguaccgccucuggcgacucucguagaggaggagauagggguaugcugagcugggguccggcaucacauccucugcagaggguccagguagacagagaagaguaggggucauucaaggugaaugagccagaacccucaagaugggcggggugugacagacacaguggcuaaauggcucuuuuccauauccacccaaaagccuccccuccaccaguuccaaccgguugggguuacccaaggguucuacacuacaaauccccguggauauugaugauggugagucaccagggcuaaaugggggcaaacuuauuucagcagucaggcuuagaaagauggugaguacaguuugagacacuaauuucuaguuggaagcgcugguccuguguggcauccggguaaggcagagcagugcccagacaacugggguccuuggagacccgggucuccacuuaccuuggaagcuuuugagcaccucuaucuguccuggaacucugcacaaggucuugauagccgcggggaggaccaccucuggguacugcacgcugaagcucuccuuccuccagggaauacagacucauguccccucugccucuccgugugcucugcccucccccacgucccccacuaccucuauugagggugacaguaccuguucaagguguccuucacauccuguaagcaacagagaggagaguucagagcugguccugcuuguuggugucaaagcuaccucuguugcccgcuacuuugggacauguccucagcuggacagucccuugucagauaacaacuuuguacucuuccuggaagcuucccuuucacuccugcuuggcagacccuaagcauuucccucaguccacggucgcaagccugaggucuggucagcggagaggaggccaaguccugggaaccaugaucagcacuuaagguaguggagacagagggcagaaccccugcuaagcaagcacuaucacugagccacaccacccugcucuuuccccacgccuccucccuagaauccaguaaaccccgagucagaaguccuucacauaccgugcuuuuguguauguguguguguugugauacuguuuaugcgucuggcacagagaaugcuaacacaauagaacagagccaucucuaacagugaaccauggcgagcuugugcucacaaaucauuaagcaaccuuggcccuugagucucacagagcuucacuuaaaggaggcugggccccucccugcuaagcaagcacucuacugcuggcugaucaagcgucucugaggcaacagaacucggcuagccucacugcuccugugaauguuccucaugcacaccugcagagcaccucacaguagcuuugauagccaagacagucacugcugauaacacgaagcauagagauauugaacaaagggaugccucccucccagcccagguggauuuuaucauauuccucagaauagcaugcaguuuaaaacuugaugacuguuuacgucuggauuuucuccuuugauauuuucagguugagcaaaaaugaagccaucuggggauuaagcuguggauaaggagggagcaguuuccuccucugcagaccucugguagcugcugaugcaguuagggugucagggagcacagugggcguggauggcggaggggcugggggugacagccuagggucccuggagauuuucuagaagccagaaucuacagaagcaccccuggccuagaaaacuacaauggcccaccugccuuggcuagcuauguuagguucccagcaacaucagguuggaguuuaauuccuagugucacgguauugagcagagugugggagggcccuuaagaguuaauuaggccacagguccuccauggugaacggagacgagaaaggguguugaagucagucuacccuuguucacucuggcagguguuggcgggcuguuacgucaugucaugucaugagcagaaguggagccgugggcgguagcaugcucuuggacuuccagaacccugggccaaaaccgcuuuuuaagaaaguauuuguugucucucccuuuguguguguguguguguguguguguguguguguguguguguguguguauacuguggacaauguggacuguuugcugugaggcaccguguagcgcugggacaagacaggcuagugaccuucaaauaucagcccagccucauccuuucugucaggcuguguuuguuuugcaagccccugggcugagugcacaucuucaggccacaccccuccucgugguguacccaugggugcacguguucaggccacaccccaccuccugguguacccacggguuuguggcaacacagaaaaucccaaagacaggagcgccucagcaaccucuggccucaccugcagcaucuggaggggcuccugcuggcuccgcuccuccagcugcaacaggaucagguccagggagcggcuuuggugguccagggaggccuugcuguccugcagcuucccuaagguguccucuuccuccuucuucaggaccuggaggauccuccguucuucuuccaccagaaacaagaccaccuucugaaacuccuccaggaugcguucucuccgcucuuucacucucuccugucgaaauggaaugggggaaccccaaacuggcuaugagauggauucagaaaggagggauuuccuucaggguugccacacagcaauucugggacaaccggugaccuagaauucuuaggaaaaguuggggaagccagacuuuugaccaagacucuccacaccaucccuauugcacccuaacaggccuugaguaauaacacccauacauucaaauguccauguguccuggugucagugggcuuagaacaugcaaccucaaagaaagacacaggcaugauucauaaaaaaggacgggggacuccuaaugaccaggcuaaaaugauuuuggaguuacccaugucccuaaagcuguuguucaaaaauaguaagaaaucaagaguuucaaagacagcagacaaacuucuuaaauaccugccccccucauguuuuaugcacuuguuuaucuuuccuuccuucccucugagagaggcuuuucccacauagcucuggguauucugggacugguuacauaguucagguugacucuggacuaacaggccuugcuuuugccuccuugaguucugggauuccaaauaagcaccagcaaagccgcaucccccagacccgagcaggccguuuccugugaagaggaagaagucagccuuugcccaaccuaagauuaccuaagauaaucuaugguuaacaaacuaaugucuuccugaucccacuuuacaagggagauaacuuugaaaugaaaggaccaccugcagccuuucucaguuuuuuaaaucaaagauacagcccacaucuauguuauggaacaggcuucuagaaugaagaaauagagcuauuuaagaucuaaauaacaagauucuuuuaaaagggggcuggagagauggcuuagggcaccuagacauucaccucacauccuuccuaagccauaguuccaggugaucugaugcccucuucuggccuugcuggacauugcauacacauuauucauauauacaugcaggcaaauaccaauacacauaaaaugaggauaauuuuauuuauuuuuuuuauuauacauaaguauacuauagcugacuucagacacaucaaaagagggcaucagaucaccugauguaucuaguguuaaagcacucuuuacgggugguugugagccaccaugugguugcugggauuugaacucaggaccuuuggaagagcagucagugcucuuaccugcugagucaucuuaccaacccgaggauaauuuuuaaaaacaauuguuugaaccauccaggugcaguagugcuugccaguacacauagcuauuggggaggcugaggcaggaggauuacuuaagccuaugaguucaaggcuaaccugaauuuaugagcacccgucaaaaaaauuuuuuaauguguuguuauuuuguucucuggcagacuucagguguucuagcaggcuucaccugaggcucacuuuaaaaauccugcucaccuguuguguuggcucaauuuguaggucaggcaccgaaccugcagaguacaggaacccuuuuccuccuugaagcccugaaaggcacuuuccugucacagaugaggauagguauaggcacacaggguggaacagcagccauugggcaccuaccugccacucaguuaaggucuguuccuccuuggcuugcagugucuccgucuucaucaucuccucccguagauauuuuauguccuccuccaacuugagcuggacacacaaacaggccuccggucagcagaccccaccucugcccacaucuggagugcagucucugcagcuguacugacgaccccagagauccuccuacagacaggguggucuagcuucccauuccagcggccaggaaaugagccucucuugaccugggcuuuggagguuagcuccuggugauguauguacacuguguugguaaacugucuaugcggcuugagcucacugagaagcuggcucuggaagcaggguuagccccacccccacccacucacaucuauuuuacacccaggcauguuugucgaaagugcccuugaaagccccuuguccugagauuggcuucuccccuaacucugauguaacaggucggaguaaaaaacaaacagcaaaauagcccaagaguaaaaauguugugugcuuagaaacaacuauaagacaagccacucccggggcuggugagauagcucaguggguugagagcaccaacugcucuuccaaagguccugaguucagaucccagcaaccacgugguggcucacaaccauccauaacgagaucucucuuuucuggagugucugaagacagcuacaguguacuuacauauaauaaauaaauaaauaaauuuuaaaaaagacaagccacucccaacagagguaacuauuguuuauccugugauguaaaaauguaucuaguguuaaagagaagccagaauuucagucaucagaagcacauugagagagagagagagagagagcucaguuagccaagccaagccaaaccaaaccaaaaagccucugcagcugacugccucaacuugccuagucaauucugcugacccuuauucgaugauguugccuuuucucucuugaucaggcuccucccucaauuguuucugcuggacuucguaaacucauuugauuacacuuugccaucuauguacugacuaucugcuacucacuauguguucuuaccuuugccugccacucguuaguuaauaaacguggcuacuguagaccaucccugg

SEQ ID NO: 6025 - RNA, 7652 nt, Mus musculus
cagugguuguugccagcuacccccacccgguggucagccacagcucugccuugugcaucuccaggugaggcugcuccuggggcagacuuggggguauuaacuggaugugggugugaagagggcaggcagguacccaggcagaaguagccagagagacugggaaguccugggcugccuccaaaacugcagauguuucucuagaagggugagccagaacugccuggacuucaaguggaggcuggggagaccagcaggccugucuagaucccugcugcuccacccccagggacaaucauggauucagacccuagggggaacaauggagcccuugagggccccuccuccaucccccauugugcuugguggcgagagguggcccuagccccacaguaugcccuuagagaggaucagcauccagccggcagguggaggggcucagccgaagguuugcauuuccagccuggagaagguagggaggguacugcuggggcugcagccuggcugggccuugacuggucuguacuccuuacugcuaagguggagguucccagguuccugcauccccucucaggcucuguggggugugucacagcuggugccagaugccacccuggaagacucacugagucucuggccagaucuugucuugcuguauuaagggacccucaggguguccuuuagcuuggcuucagcuggcuuuguggcucuuuugggguaacuaaacccaugguagagggagaugggaacaaaccggagagccuaggguauuuucaguaccucccccagcagcugagacccuucaggccaucuuaagaugggccaguccaccccagccaguuguagugugucccagggaucaguaugggcaccaggcccagucuacucaaacugaagaaacuucauuauccacuugccugcuaccaagcagacccucucagcagcuggaccuacacaaccgcugcuguguuaguguggcgcgguagccagcacagaagucuuugggaugccacagcaguucacucuaagugcuuccuucccaccuaccuucugugucuagggacugcagagagggagauaugaggaugggcagccaaaaggggagauacaggguccaaggacggggagguuggagaagauccguuuuggagggccugcuggcuggaguuggcucuguaugggacaguguggacccagcugggaagugauuucuagaaauggggaggggaaccuggcucagcuguggaggggcuggcaggacuggagagacaaggaccagggugaguaugggcuuucuacaaggaauugggcacacguguguacucugggcaaugccaaaggaaggcauggagagugggaggggguugccuacucaggcuagugccuccguuuuuggaaugcaguuuagcugaagucucaaccuguaggaguugucuagacuuaggguugugacucuuacaccagguaggugcaggcuagcccaucuguuuuucugguccccacagucugaaguugaaguuuugccuucuugaacuuccaggaaugugacuugggugcuggugaagaaggccucacaggucaaagcgggagguugguaguuucugcugggugccauaacucugugguagaguccuacaucuucaacauguuuaaauuuacaacagaggagauaacaguacagaaaagaucccagaggaccucauuucccauuccauacuggcaugaaacacaucaccauaauaaacucuagugcugccucuguuagugaaaagccgcagucuguguguuuccuacauucccuugccccuccugauaccacagcaccucuuagucuccuuguuuuagcugcccauggcuacuaaaauacuacucggguauuuuucagggugcccucuuggaaacuggccuguguuuucucuugcuuuguugggguuauggguuucagaaagaauacuaugggggugaugagccugucuauauaggugcuaucaacagccauaauggugaaucauagggcucaggugucacggcaaagguacaaguccccauuucaugcuguccucugauauguugcuucccacauguggcugcuggagugggugugugcuccucuuaacugugugucccaucucagaguuccucugcacagagaugggaugguucuccagucaucagccugguuauucaugggugcaguuguuaucugggguaucuguaaccaaagcugcagucugugauucuacuuuccuuagucuacugguuaaauuguuacagugucaguguaagcaauccaccuaucagugugugugaguauguaagcacguucuuccucucugagcuuucuccacacucuuguuucccuccuuagccuucugaucagccacuucccccagggauucgcaguuccuuuuauugaaagagaaguuggaaaccagaacccaggaccuagauagggucuuuguuuugugagcggggcuugagaaagggucucaaugacaucagacucgccgugcagcagaggaugaccuugaaauuccaaucucccuaucucugucucccaagcacuagaacuacaggcagcgugaacauacccaugucacaaaugcucgcacuucucacguguuuccacagccagggccuuucagaggacacagccagagaucauacacacaccacagguuuccacgguguaucuguaaaugaccucugugagaguccggguccgccucuaccaugcuaaacacaaaugcauucuagagucccuagcuugagauggugucagaaaaugaacuuuuauagugauugggaagcaucugauaggcagacuaaagaguugaguaugaacgguucucugccugucuguccucccugcuccccccccauaccgugugugcgugugugugugugugugugugugugugugugaaacuuguauggccaggugauuuggcuugugucuaugaagucagggaaaggcagcaggugggagcuccagcacagcagagaauguaguagcaggagccaacugaggacgggcagggcacuuggggcagugacuaggugagacccugauaugugcccuagucagaagucacuggaggagcugagagcauagacacgccugaaagucccagcacuuggcaggcagagggagaaugauggagaguucaaggauaucauaacucuuacaaauugauacaugcggagucugaaguccacuugugcuacauaaaaccuugucuuuuaaaaaaagucauugaagggcaauggggguaaucuccaugugcauucuaagguaccccagugggcaugagccaaguuuauagggagagugaagcagcuaggaccuagaaagcaagugaugaucugguaccaaguugugcagauagcacguguggguggguucaggguuugcugguacacuaagauguucaggagacagcaacacauguaaagcagucugagaguggacaagucccuuugaaggagagauugacauaugggucugacccucuguaguuuaagguaccugcugguguguccgugccaaggcuaggcaagagaguuacaggcuagagguuuaaccggaagcucccccuguacauggcccaagcccaggguccugguucuuccaggucagcucuacaagcauagcacaucuuugugccauucuaaagagugaauagcugugacugcaugcaugcuuugagugacagguccuuccacccagggacagagucagcccagggcuaagcuacagugucuccauuguugccuguacacaucuugacuccagugcugaucagcuacugggacaggaguagguaugccggagagaaauggcgaguugucaagcaaggcuuuuucagagauucgguuguuaaauacuccacacugccaggcagguuuacccagaccauccugugucugcacugguaagccuuaggcuccagugauucaacuuucaggucagggcugacugaagcugagggaagagagcugaaucuacuuuuguguucuuaugugugcaucacaugugugccugagcucacgccucuuuaugaaugagcauuugauuguguaagucuugagucuucacaugugugguugagugugugaauaaauguauaugaauauugguguauaugaauaugugggugccagugugugugugcaugcguauuuauaauguauacauccuugagcauacauuugugucugagugcauuugaauguacaugcauaugaguguacagugugugucugcagauguguaucugugugcauaugaggguagcuguguaugaguguaugugcgugugaauguuugcauauagaacacagacacacacacaugcuuguaugugcaugcauguauucacaugagggugugugucucugauugcacacaugucgucccaagaggggaugcacagaugugaggauguggggccauuuccucaggaaccccuguuguucugcuggcugcccccucuuccugcccugaggggagaggcccuagcuacauaaagagcucuggagucaccaguccugaugcugguccauaccugcugcugcuaccuccaaggcccugccaggggagggagccagaagugucaguguugaaugcuuggaggacuccugccccacacuuucccaggagcagguaguaacuccgugggugcugugaugagggagggggugcacgagggaaccacagggccuuucucugacacauaucuuccagacugaguugagucggucugaauauugucaucucugaggcucacaggcgcccaaguguugucauguauuagucugcagccucaccaguccugcccggacagauccugggacaguccaggggacuaggaccuggggcuagaugaaagagcccuggauggccucuaagcagugggaggggugagagggguuaagggcuuggggaggaucauuuauggaagggaccccagagcugcugugccggguguggaaggacaaaggcuggugcugcuggaauuggaagcuaaagcauuggggagggcugggggccgaagguuugggguugagggaugauagagucucaagccuguggguucugaccacaaaggcugggaugcagcagagguugggaaggccugaguggcuggcaggcuuggggcaaacccuagcaggauggcauccaauugggacugagccgggcuggugcuguccggguuccccaccucugccaauaaaggcagcacaauggcuuuauggcuuuaggggccugagacaaaggugcacuuccuacaaguugaagcuuucuuggagaucuuuaggagagagcagacaggaagggcaggaucaauggaagauucucgguccccaucuuuagcacauaggaugugaaugcagaggcaggagaccucuguaauguagugagcucaaggucaucugggguguuuaaguagacagcugcuggauaagccugcaggcgccacaacucugggcucagcaguucccaguugcgucccuacugaccaccugcaugcaugccuguaggucccaccugcucgcucccaugaccaacaugagcuggagcuuccugacgcggcugcuggaggagauccacaaucauuccaccuucgugggcaaaguuuggcucacugugcugguggucuuccgcauugugcugacagccgucgguggugaguccaucuauucagaugagcaauccaaguucaccugcaacacgcggcaaccggguugugacaacgucugcuaugacgccuuugcgccccugucucaugugcgcuucugggucuuccagauaguggucaucuccacaccuucugucauguaccugggcuaugcaguccaccgcuuggcgcgggccucggaacaggagcgcagacgcgcucuccgacgucgcccuggcacccggcgcuugcccagggcgcagcugccaccgccgccaccuggcuggccggacaccaccgaucugggagaggcggagcccauauuggcucuagaggaggaugaggacgaggagccgggggcgcccgagggccccggagaagacacggaggaggagcgagcggaggauguggcugccaaagggggcggaggugauggcaagacgguggucacuccuggcccggccgggcagcacgaugggcggcggcgcauccagagggagggccugaugcguguguacguggcucagcuggugguuagggcggccuucgagguggccuuucuggugggccaguaccuacuguacggcuucgaggugccacccuucuuugccugcagccgccagccuugcccccacguaguggauugcuucgugucgcggccgaccgagaagacggucuucuugcuggucauguacgugguuagcugucuaugcuuguugcucaaccucugugagauggcgcaccugggucucggcagugcgcaggaugcugugcgcggccgucggggagccucagcggcggggccuggccccacgccgcgcccaccgcccugcgcuuucccggccgcggccgccggccuggcuugcccuccagacuacagccugguggugcgugcagcugagcgcgcgcgagcgcacgaccagaacuuggcgaaccuagcgcugcaggcguugcgcgauggggcggcgguggcggcgguuuccgcggaccgcgacaguccgccgugcgcugggcucaaugcaaccucucggggggcacccagggugggcggccuagcuuccggaaccggcagcgccacgucggggggcaccguuggggagcagagccggccgggagcucaggaacaacuggccacuaagcccagggcuggcucugaaaagggcaguacaggcagcagagacggcaaggccaccguguggaucugagggcccugcggagagcucagggagggcuuggcaugaggauucaguggaaaucuuugugcccucaaccagugaucagugaucagaccucguuaggggucuuuaaaagaaggagcugaagccccuuaggaggugcuggcucagguaccucccugcgggauaggaaggggagugaccagggucuuauaugugaccccugaggguguggggacagagcuguguccuaggaauugacugccccuccaggcuaugcugagcagggaugaccccucugcugggccugccagcccuuccuuccaaggcucucucgcagcuuccccauaggauugggggugucuggcacgaaccuuuuggggacugagcuuauccucacugcagcagcagaccggguuccucugcagcgcccucggcccuuacagagccagagaacucccaggucagggacaggcagcagcacugauuacucucggcccuuggcuccccacuugaggcagacugagcgagacccaaaggaggccuggaccaagaacagcuccucucucugagcugagaucguuugguaugacuuccuucuuaggggacauccuggaaguucuguugugccuugcugcuuagaugcauauagcuguagcccagggcuguggcguuggccauguuggaaaauuagagcucuggggggccugucccuaucuucuguccccuucucccuguuuuaaagccaacuucuagaacaaaggaaguaaaauaaaacuaacuuuuguuuacacucaag

SEQ ID NO: 6026 - RNA, 8355 nt, Mus musculus
cugacuucugauguguuccucucagggucuuuguaaauugguaggguuugagccuagggaaagaaaggaggguacggaaaagggcggaguuuggagaagaaacaacgaagagaagugggcguggucgucggggagaaccgcgcagugcgccugugcaucaucgcggccccccccccccccguugggcugagguguggcugucgcuugggggccgugacaaggcgggauuuaaugugguguagguggggccggcgagggagacguaaugucagcgggcaaaggugggacguggccggcgcuggugcuuugcguacucggugugcguagccaugccgcccuccgguguguuccggugggccggcgcgccgcugugacguaguccugcgggcggucccugaugcugcggcgcccgcuggucgggcuggcgguggccgcccugggucggguccccgcggacggugagugcgcugguggcugguugucuucggagugggacuuguggcagcauauuucccuugcgugccgucuccaucuuguggggaugccgggugaacguguuucucgggaccccagaacgacagggaugggcacgcggagucccagccaccagcagaucggugcagcaugagccuagucugcgcucuuccucuguucccuacccagccggcguccuggguaggcucaagcacauggcuuuacuccugagccauugcgggcguuggacuucagugccugcagauggugcaggcccugcagacuauuaggauuuggcuugucccgauuuguuuuguuuuagaaaaaaauauuaaucugccuuugggcuuauuauucucaggcaucguuuuauccaacguggaagugggcgggguucguucugguggugccuggagguggagcaggugacauuagcuccgcgguaucugaggagagagggagaaagcaaguaaaugacuggucagccuuugauaggcuccaaggagagaaagaagaaugcaguuuguuucugugggugcuccuucaguucaccuugcaggaggucauaggcuaguuaugaaagcgacuacuaaaguuguuucccuuucucgucugucuugacaaacacaaaauauccaggaaacaugauguaauuggaaaagaaaaggcagaaggggaugugagaggaaagagcccaggcgacaaagaaggaaaguuagaguaggguugagcucuugggaggcagccauaugagcaaggcuucuuguaucccugacucuucugguugggacuuaaucuucccugucccauccuguccuguccccauccucccugauugcaugugauggugucugucuuccuuccuuccuuucuuucuuucuuucuuucuuucuuucuuucuuucuuucuuucuuucuuucuuucuuucuuucuuucuuucuuucuuucuuucaagauuuauuuauuaucuauaaguacacugucucuuucuucagacacaccagaagagggcaucagaucccauuacagaugguugugagccaccaugugguuguugggauuugaacucuggaccucuggaagagcagucagugcucuuaaccacugagccaucucuccagccccggucccuaucuuucuugauucugcuucugcuggucccuagucuucccugcccugcccuacccauucccugccuacacguccugggccucaguuuccuuugcucuacccugucccccauccuccuccaccguucagucuucccugacccuguaaagccuuggugucccuucugcacgaucgagcagaugacaaacugugcaguguccuagggucuuuccccuuuauccucguuggguucugagcccuuuuuccuuuauguucccucuaccucaugauuccuggccaaggaaucagcccguuccuuuuuguccuugcugggaagagacacaaacgaagaugggcagcaccaggaaggugcagcaggcuguccgugguuggcugcugcuccuccaccucuuuguugggaggccgugguagguccaucuggcucagaggaauaagauugaaaaugcuuuggcugcucuggcugcugcuguuggaagaggugccuaaguccugggggcucagggcucgggugugucacucaugucugccuagcgcuguuugucuuggaggacuaguaguucuucuccuuccuggaagggccugcucuucaguugacaggagggaggugaugguugugacagauuuccaguccuagaggccugagguauagauuggaagaggauguauaggaaguuuugucuaggacgucccagcagagcauguucccuccagugcuccuaugaagucgcuugaaucuuggcuuguuuuacaauuaggggcuuggggcucuuugucaggcaguugaaguuugggacugggaaagcugaagagauagggguccaaaguuucuucaguggucuccccaaaggaaguugcuucuauccaccacacacuucuguaaaugcuaggccaaagacuauaucuauaauuucugacauaagcuguggcccuguggagauguaguaauggucuugucaccuggcuacuggugagagagagccccuccuucagugggccuggggauuucccagguccauacuaguccugccuggcccacacucuccuugcugucugccacuguaccacacggcuagcuaacuaaggucaucugguguagucuuuguagauccaagcaaguguagugucauagaaggucaccgagggcugucagagauccaugagcuguaugugccaagggauaccugcugggacuuugcagaaccaaggugugaacaggauggcacuuggagagaugucuucccgucacuugugguuuagcaacaagacagaacuuacacacugugacuccugaaagagggcuugggaguuagguaccucaguggggaagcagucugggugugcagcagugugcagagcuggguaggagucagcugucugaugugggucugcaugcacaugcacugcaugcuaguguccuccuuccugcugccuggucauggccuacaggguacaggguuaggacaggugagggcuccuguagucccagaguugaggauuucgggcuggauugugggugacgccagcucauuccuagagcuggaagcagguuauauagccuguaccuauaagcagguuauagguacaggcagcuccauugcugacgggauggcagaucaucuuucccaaccaggcuugucccuaauacauggcuuccuagaggcucuccucccugggauccuuuucucagaagcuuucuuaccuugugcguuuuggaacaucucucuuagcuuugguucuccuguguuuucaaugugugggauacaccuauguggugagccucuccgagccccacgugagcacugccuugagcuccuuugacgcucaagggaaccaacagcuccagaaauggcuguuugcaaagugcagauguagaacccauauuggcagcugcaggucacaaccugugcccucacagggcaucugaggcugugcagcaccuuggggcacucucugccugagugccugauacagacagaggggaaggagcuucgcaggagcugggcugugugguuugcagcgcacacccuaaggccaggccacgguggaagcagcagggcuggcucgaugacuagggaaagggaugccuaugccaaugagaaguugguguugaguugggugggcuggagcccggaaggaaagggcauagaguggucagugugauuggccgguaagcauucuggagaaaggcagaagggagcagauuuauugagaggcagcacuggugauccuugguaaauuucccuaggucccuuuucugucuuuuugauagguggucuuauguucuucucagggacaagugcaugugcgcaugugugcaucuucauuguacguguguggcaugcaugugcaugcacguguacccuacauacaguacuuguguuucugugggauagaaucugauagaauaccagcaacacugcuuuuguaagauuacuucauggccuacauuggggauuaagaacacaauuccucucuaagcuggugcccuuccuguagccugugucuuuaagucaaaggugcuuggguugacagacagcagcuccccaauacccucccuggucucccucugccuagaccucagaagagagcagcagcucaggucucucaguacucagugccgggguggcucuuccuggucucccggugcacucagaugcugaccugguuguuugaacagguguaggcgcagaucucgggagcaggacaaauaacugccccauccuuccugcagagugggaggacagggcugaugucacagugcaggcagggcuggugcccgagggauuuauugcucagaagggcgggguauaggcuuggcagagauuagucccccuagcccucagugcagagcagccauugacucuucccaggcuaccauggaggcugcaacacaucaaguaggugggugccauccuggggagucaggagggccuuuauagacgggguucuugacguguaacugaccugcucagacuccuggcuggaggaccacagcugacagugagguggggcugugucugcucaggcaugagccuggaagcagggggaucagcugguacuaaggcgaugccaucggaacuucaaggaaggaagcgcaagucccagauagccugauggaggagguuccugcugggcuuucauaccuacagcgggugcuccucccuggcagcccggacccauggcccacccugagcugcacucacguugcccuugggaggcuagggggugcucguccaacucuugucagcagauuguccuuccuaaacaagucagagaugguugcgugucuagugggaaguuucccaaauuggcuuggguugaacagacuugaggaugucuguagggacagggacauuccuauuucagacuugggacaccugugggcaggccauuuaagggagucaaagcucaggcagcagugugaagucagauucugaagggcagccucuaugggguggggccagugugcugcauugucugguuccgggucacuuggccuguggacauccugcugggugugggugaggcuggauauuggaauccugucagccuuccugcugccuguguuugccaucuugccaguugacugguguugugaggagaguucacaguauauaaggauguuggccuucacgucacugucuccuauggaacagaaugccagggcaccggugaagguaaccccacucaugucuaugauaucccuccacccacaggcauggcaggaccuaggccaguagugcugagcgggccgucaggggcagggaagagcacucugcucaagaagcuguuccaggagcacagcagcaucuucggcuucagcgugucucgugagugccuccagaccuugaagggcgaggagcucagaggcugucccagcacaggacuguuccuagaguccccagaugcacacaccugaucuagcagaugcucuccucaccuuccucauccccauuacccucucccuucccaggccuccaucuagaguaagcaucuuggccccagugaccucuugagaucuggucugggcugcccacuggcugugagcaccacccguuguuacauaaccagaggacggagcaggccgucaagggaagaccuggguagggggagguuuguagaucccuucagugugugauaauuuuguuuguuuuuuuccuagauacuacaaggaacccacgaccuggugaagaagauggcaaaggugagccggccugcuaauucagggguuuugggcaccagcuaaugaguguugggguggggguagggggaagggguaagguugcuuugugccuuggcuguaacagcuucauccccagcaggagaaucucucuugcuguuggguucacagcuugauuagagucugcaucauagugaaggcugaaccuucuuccugccugguguauggaaccuggccauuuccaauccuucagcaaagacaauggggacagugguaucuguuccagccuagaucuggccauagcaguccuguguaggguggagaggggccaggccaggcagggauggguuuuggguaccuucuggaaagcucucuucuucuccagauuacuacuuugugaccagggagaugaugcagcgugauauugcagcaggggacuucauugagcaugcugaguucucagggaaccuguacgggacaaggugggcugaguuuggugugggcccagcuucauggaucaggguaauuccagaacuguuaacaaaagaaagcacucuagcaugucaccucugaccucacagugcccucccagucucccgccuagggcugggauggcuugcuaacccccuagucucugagcauagcugauaggcuccagggaacaagcaggcccagucaugccccaggcucaucuguccucaagccaucuggcgaggcaaagagccacaugaggcaccucacguggagagguaggcagugccaggcagcccaggcccaaaccuuuuuggcuuucggcuacaggacagguacaaagggcugugaugucagagggccugacaggguugacuauaugcuuggaaguucuggaaaguacagaaggugcuggguucacgagagccucugcacuacccaggccaggcccagaaugggccuugggguggaaagggccgaguuucucugaagcucucgaaagccuuaagaagcuaacaagguuuagcagucauugcauguauuuccugugggcuuaagggccaggucuucucuuguauccacugaacaucuaucugcucacugcccuucccugcucccagcaaggaagcuguucgggcugugcaggccaugaaccgcaucugcgugcuagaugucgaccuacaaggugugcgcagcaucaagaagacugaucugugucccaucuacaucuuugugcagccucccucgcuggacgugcugguggguacuuggugugggaaaccugcagggcagguccugagaccugcagaauacugaccugacaaggaccuguauuucaggagcaacgacugcgacugcgcaacacugagacugaggagagucuggcaaagcggcuggcagcugcacggacagacauggagagcagugagugcagucagaccguucguaccuucugagcacguggccagcccauccaccagaaauuggggaggaccaaggguaaagauggaggggucgagacugcugucugcagagccuuugagaggccacacuuguuuacugacuuaaguguuguaggucucuuuuuguagcuaugcucuugcuucugggucugagcuugguccacauucagacacugucauugagaccguuugcuguuuccuuauguggcaguccaucccaggcagagcugguucugagaggccugggcaggggcagugguccacacuccagaagucaggacuugaugggagcagcccccagcugagguucucuagaagaggggaagcaagaguacuguccagcccuggccauccuaccacagugacggcaacaguagccauagccagauagcagguuguuaacaguggggcaagcccagcaggggccgaagucccaguguuccugaaucugucucuugccucaccccaggcaaggagccuggcuuguuugaccuggugaucaucaaugacgaccuggauaaagccuaugcaacccugaagcaggcgcucucugagguaggcccuucccaucuacccugucuuggggaaguccccugcacaagccauccugugaacgcagcaaacccuguguugccggggcucacacccugcuguguuguaagcagcccuggcuuugccaguugccagaauggucaaguacaggugcaaagccggagucccugggaacccagggaggauaugagcccuagcccucccugguucccugccucuccugacuuucuguuucccuucuuccuuggcaggaaaucaagaaagcacagggaacuggccacgccugaaggccugcuucauuccacagagugaugucuguggucuaaauuugccuggaggugggggaaacuuugccagggcaccaaggacuuguaguagacuuccacuguggaguagaaggagcuacccuuugucugaccacaagguggcucugcaccgugggcugacucacuggcugaaugacuccaaagaguacccauaucuaaucucccuggacuauuuguguuccuuuccuuguuccuucugcuggagcgggacugaccucuuaauaaaguaauuacugaauuauagugucacagcccucca

SEQ ID NO: 6027 - RNA, 1221 nt, Mus musculus
uaaaggauacguuuccacuuuauugugcagcuccccuugggaccauccauucaucccgaguaugaucuuguucugaggaaucugucccaacuguguccucuaaagccaggccaugaccucagggcucauaccaagagccucacaagcuguggcagguacucaacguguucaggaugaagacauaaaaaugaggcugucuuggucuauuugggaugcuagagaguuccaggauggguauuuuuucagacuagggaugaaacccaagaccaucauguuaagcaagugaucugucauuaagauguagcucaguuucuguucauuuugaggcgcagccucaguaaauugcccaguaaagcuucaccugcagagaacacagaucgcucugguuuagggaugcuuuggcuuucaugucacauacgcauauucugucacccagagcauggaagagugaauccauguuucuuuggugacuuuaucugucccucuguuccgugaagguuugccauuauuuaacuuaguuucaacagugacccgggaccuuuggaguuagcauucuuggcuuuccagaaagcaaggggccggccccuccuggugucacuaagguuuuguaguguccccuuccaccgagauuccuucacacgagaguuaucaggugggauagcacagccgccuuuuugaggagcuauugcgcaggcgcacguggcacuaggaugaaggaugcgccagagaagcccugaacgcccuuuagaaagaggaucuugauugauaaggcccucggauacgcagugcgcaggcgcacgggcacguuagcgagagcgcaggcgcgcgcgggggcgcgagagugacgucacggcgugcguccggagugcugcgggaaguccgacuagagaccgcggguacugaaggcugugcaguggcuccagcgccauguucggcuccaaucgcgguggcgugcguggcggacaagaccaguucaauugggaggacgugaagacugacaagcagagggagaacuacuugggcaacucgcugauggcgccaguaggccgcuggcagaagggccgcgaccucaccugguacgcgaaggaccgcgcgccguguaccggcccgagccgugaggaagagcuggcagccgugcgcgaggcggagcgugaggcgcugcuggccgcacuguaagugccuggucugcggggcgaccgcaagccccgagggcgggaucug

SEQ ID NO: 6028 - RNA, 4657 nt, Mus musculus
caggcgcgcgcgggggcgcgagagugacgucacggcgugcguccggagugcugcgggaaguccgacuagagaccgcggguacugaaggcugugcaguggcuccagcgccauguucggcuccaaucgcgguggcgugcguggcggacaagaccaguucaauugggaggacgugaagacugacaagcagagggagaacuacuugggcaacucgcugauggcgccaguaggccgcuggcagaagggccgcgaccucaccugguacgcgaaggaccgcgcgccguguaccggcccgagccgugaggaagagcuggcagccgugcgcgaggcggagcgugaggcgcugcuggccgcacuguaagugccuggucugcggggcgaccgcaagccccgagggcgggaucuggguggcccuggggcggggcuggaugugggcggggcacaggaaagaaggggaccgaggggccagacccuugaugagcauuccugaccuuugcucgcagugguuacaagaacgugaggaaacagcccaccggccugagcaaggaggugagucugagauauggguucgagguccgcggggugguuggggggggguggggggguccgucugucucggccuagaaccuccuaucuuacccugcuuucgcaggacuucguggagaucugcaaacgggaaggaggagaccccgaggagaagggcguggaccggcuccugggcuugggcagcgccagguuaggcuaguuggggaguccaggguaggccugggcggugauugagaacuguccucaaaugcucuguccccugcaguggcuccgcgggccguguggcgcuaucccgagaagacaaagaggcugccaaacuugggcugucaguguucacgguaaacccugucaagcccaaugcacaggauccugggguuuagaggugucugagauguggggcaggauucccuggguguuccucaccacggcuacucaugucauacagcaccaccguguggacagcgaaggcccaagcacugccccaacugcucccaggaagaagccucgcgcugaggacaaggucgaaccggaguaaguugagucugccucccugugcauaaaggggcagacugccuuagcucucuuaguuugacugaaguaggcggaccuccaucucugggcuggagucucaguagcugccauaggugacccagcagggugacgcucaggaccaugauacuggccaguuuggugggaggugcuuguggggugggcggcacacaacuuucuuuaaucccagcauuugguagacagcaggcugaucucucagaguucucacaagcugguacgugugucugguuacuucuacuuuugugucaucucaacuuuguaccuagguaaaauagugaguuccaagcuagacaaggcugcauaaugagaacuugucuccaaggagagaggaggcucaccagguuggcagcauuccagcacucaucuuuguggccauggagccuaauaagcucauuuauaaauaugaacucccgacauguagauauuaucagugcacaauggauccuguucuagucugccuuucccugcugggugagacuaccccacagucgaguagacacgaguccuucaagcucggauccuuuguauuguuucuugcagugcagagagccauaagaaaagcaagaaagaaaagaagaaaaagaagaagaaacacaagaaacacaaaaagaagaaagacaaagaacauaagagggaggcugacagcugcuccucaucucccucuccuccccgguaggcuaggcccaacucuaccugggacacuaaggaaaugggaggcaaagcuagccaggccugguguggugcuuggcagggugagggacccuuuaagugucugguuguccuugucuuuguaggcccagacaccagagacauucugacuucucucccugcucuaagaggaagcgggaacauagccaggacaguggaaggaauccaucccgcagacgacaagacagaagcucugaugacugagaauggcuacaccaaaggacaccagagcccuggaugccaaguagcuaccagcccacucccuaccugcccaacuaacugucccucuguggcugggauaaggcagguggcugcuccccaacaggauccugagccaagcuugcuggaucuuaggaucuaucuugccauuuggaggcaacuacuccaggucauagaguggguccuggguuaccagucuagugguucuaagaggguagugcucuugccuugucccccugccaaggaggaucuaacugcccaggagacugucucugcugccacaggccaggcccuugagguuagggugcguguuacugauuacuccuuuuuuguguguguaucagcccacuuuguacuuaaguaaauguauuuuaaaaguagaguguauauuaucucgcugaggacagguuaggcugggagcauggggcccccuuccaguauauauuaagggaacugggucuagggaccagaauccuguccuugaggcugccuuacaaccauacaaguggccaagaaguuggaagaacaaacuuuugugaucugaaggcaucugcugucucccuaagagguucaacagccagauaauagcaagacaguagaaauuagggcugcuacaguauagaaaguucugauuguaaaagcuauugugcugugaaugcauacuucugggcagaccccaaaauguccugagacucaugcuguugcuucuaugaagaccugugcccugcagguagccaccuaagcaugagagaagacuaauuaucuaagaccucaagggggugaaggucaguccacuuaggcaggggccuauucggaaggaugauaaacuuuggaucuucuaguggucacaccuacccagagauaagcacuccaaggccagcugccccagucugucacagaaaggaaaggaaagaagcacgucaagacauccagaucuuaccagauuacacuagggcuuaaagggcaccuguuucccuguuuccuauagcaugaaaagggcucucaaucucaggaagaagccuggcagugguggcacugacacacaagcccaucaaauaguuaagagacuuuauucuaacagcuauaauuacagugcuugucgaaaugaaaacugaaaacaaguauacaaaacaguugauuacuaauuguguauugaaagcgguaagagguuccacgacaccaaauaaaccaguucugagauuuccccaagauaaauuuaacagcuccagcuucuucaguguuuaucaaaauacaaaagaaaaaaguagaggucgucuuucgauggcaaaucggacccuugcaggcugagggaggaagcuacuucacacauggagaugggggugcuccaggaugugggucuguaauggaccgacccucccaccuugcacgcacuccugcuggugagacccaggccuccugccagcgcguccaagugggcccaagaguaggcuggguaugcaggcugccauugggccuugcacacaccaaguacaagccaggcccugcaccccacaauggcucccagccuacccuagguaaccgugugagcacaaguacaagcacaaugcuauggaaugcaggugacccaaagacaggcgagucacgggggcucuacugugaccaugcagcggauggugguuuguucaucaccuucucuccuguucccacagcgaaacaggugaucugauaucuagcauucaggccauuaacugcaaaaccuacacuaggcauagucuccguucuguguguucaaguguucuuguccuguauuuuuaacuauuuuuaaaaaaugcacugaguuuggguuaaaaaccaaccaccaaauggauaccgacaccagucuacagcccaauggcucccggaggccaggugccccuacacccaaaucccuucucaguacugacaguugaguugauucucuuuuuacaauaaaaaagcuaaguaauauugcauaggaguaccagaaacugccucaguggaaacagaaacuauuuacauuaaauaaaaaccuggcugcaggcugcgucugcacauguacagcacggugcgaugcacacugugaccaacccauggagacagcuucuggcacucaggaccacagagucgcacguuugccacaugagaggaaagcugagggcggagaagaggaagugagggggagggaggggucugguucacuucugguuccggagcugauuagacagccaaucuaguccuucauagagcccguccccgcugguggcacagguggccugaauguaccaguuccuguggcguagagagugcagccccagcuugucugugauuucggccgcauucauggcauuggggagguccugaggaaaaggaagaauuaguggcagggaccacaaacagccaauaacccuggguagccuuucaccccuccucuuucuucccugauacagguuuuccuucagggaaggaccuugcuggugccuaccugcuuguuggcaaacaccaagagaacagcaucucggagcucaucuucagcuagcauccucaugagcucuucacgggccucguucacacgcucucugucauugcuguccacuacgaagaucaagccugaaacauggccacauuagugcacauacug

SEQ ID NO: 6029 - RNA, 4657 nt, Mus musculus
caguaugugcacuaauguggccauguuucaggcuugaucuucguaguggacagcaaugacagagagcgugugaacgaggcccgugaagagcucaugaggaugcuagcugaagaugagcuccgagaugcuguucucuugguguuugccaacaagcagguaggcaccagcaagguccuucccugaaggaaaaccuguaucagggaagaaagaggaggggugaaaggcuacccaggguuauuggcuguuuguggucccugccacuaauucuuccuuuuccucaggaccuccccaaugccaugaaugcggccgaaaucacagacaagcuggggcugcacucucuacgccacaggaacugguacauucaggccaccugugccaccagcggggacgggcucuaugaaggacuagauuggcugucuaaucagcuccggaaccagaagugaaccagaccccucccucccccucacuuccucuucuccgcccucagcuuuccucucauguggcaaacgugcgacucugugguccugagugccagaagcugucuccauggguuggucacagugugcaucgcaccgugcuguacaugugcagacgcagccugcagccagguuuuuauuuaauguaaauaguuucuguuuccacugaggcaguuucugguacuccuaugcaauauuacuuagcuuuuuuauuguaaaaagagaaucaacucaacugucaguacugagaagggauuuggguguaggggcaccuggccuccgggagccauugggcuguagacuggugucgguauccauuuggugguugguuuuuaacccaaacucagugcauuuuuuaaaaauaguuaaaaauacaggacaagaacacuugaacacacagaacggagacuaugccuaguguagguuuugcaguuaauggccugaaugcuagauaucagaucaccuguuucgcugugggaacaggagagaaggugaugaacaaaccaccauccgcugcauggucacaguagagcccccgugacucgccugucuuugggucaccugcauuccauagcauugugcuuguacuugugcucacacgguuaccuaggguaggcugggagccauuguggggugcagggccuggcuuguacuuggugugugcaaggcccaauggcagccugcauacccagccuacucuugggcccacuuggacgcgcuggcaggaggccugggucucaccagcaggagugcgugcaaggugggagggucgguccauuacagacccacauccuggagcacccccaucuccaugugugaaguagcuuccucccucagccugcaaggguccgauuugccaucgaaagacgaccucuacuuuuuucuuuuguauuuugauaaacacugaagaagcuggagcuguuaaauuuaucuuggggaaaucucagaacugguuuauuuggugucguggaaccucuuaccgcuuucaauacacaauuaguaaucaacuguuuuguauacuuguuuucaguuuucauuucgacaagcacuguaauuauagcuguuagaauaaagucucuuaacuauuugaugggcuugugugucagugccaccacugccaggcuucuuccugagauugagagcccuuuucaugcuauaggaaacagggaaacaggugcccuuuaagcccuaguguaaucugguaagaucuggaugucuugacgugcuucuuuccuuuccuuucugugacagacuggggcagcuggccuuggagugcuuaucucuggguaggugugaccacuagaagauccaaaguuuaucauccuuccgaauaggccccugccuaaguggacugaccuucacccccuugaggucuuagauaauuagucuucucucaugcuuagguggcuaccugcagggcacaggucuucauagaagcaacagcaugagucucaggacauuuuggggucugcccagaaguaugcauucacagcacaauagcuuuuacaaucagaacuuucuauacuguagcagcccuaauuucuacugucuugcuauuaucuggcuguugaaccucuuagggagacagcagaugccuucagaucacaaaaguuuguucuuccaacuucuuggccacuuguaugguuguaaggcagccucaaggacaggauucuggucccuagacccaguucccuuaauauauacuggaagggggccccaugcucccagccuaaccuguccucagcgagauaauauacacucuacuuuuaaaauacauuuacuuaaguacaaagugggcugauacacacacaaaaaaggaguaaucaguaacacgcacccuaaccucaagggccuggccuguggcagcagagacagucuccugggcaguuagauccuccuuggcagggggacaaggcaagagcacuacccucuuagaaccacuagacugguaacccaggacccacucuaugaccuggaguaguugccuccaaauggcaagauagauccuaagauccagcaagcuuggcucaggauccuguuggggagcagccaccugccuuaucccagccacagagggacaguuaguugggcagguagggagugggcugguagcuacuuggcauccagggcucugguguccuuugguguagccauucucagucaucagagcuucugucuugucgucugcgggauggauuccuuccacuguccuggcuauguucccgcuuccucuuagagcagggagagaagucagaaugucucuggugucugggccuacaaagacaaggacaaccagacacuuaaagggucccucacccugccaagcaccacaccaggccuggcuagcuuugccucccauuuccuuagugucccagguagaguugggccuagccuaccggggaggagagggagaugaggagcagcugucagccucccucuuauguucuuugucuuucuucuuuuuguguuucuuguguuucuucuucuuuuucuucuuuucuuucuugcuuuucuuauggcucucugcacugcaagaaacaauacaaaggauccgagcuugaaggacucgugucuacucgacugugggguagucucacccagcagggaaaggcagacuagaacaggauccauugugcacugauaauaucuacaugucgggaguucauauuuauaaaugagcuuauuaggcuccauggccacaaagaugagugcuggaaugcugccaaccuggugagccuccucucuccuuggagacaaguucucauuaugcagccuugucuagcuuggaacucacuauuuuaccuagguacaaaguugagaugacacaaaaguagaaguaaccagacacacguaccagcuugugagaacucugagagaucagccugcugucuaccaaaugcugggauuaaagaaaguugugugccgcccaccccacaagcaccucccaccaaacuggccaguaucaugguccugagcgucacccugcugggucaccuauggcagcuacugagacuccagcccagagauggagguccgccuacuucagucaaacuaagagagcuaaggcagucugccccuuuaugcacagggaggcagacucaacuuacuccgguucgaccuuguccucagcgcgaggcuucuuccugggagcaguuggggcagugcuugggccuucgcuguccacacgguggugcuguaugacaugaguagccguggugaggaacacccagggaauccugccccacaucucagacaccucuaaaccccaggauccugugcauugggcuugacaggguuuaccgugaacacugacagcccaaguuuggcagccucuuugucuucucgggauagcgccacacggcccgcggagccacugcaggggacagagcauuugaggacaguucucaaucaccgcccaggccuacccuggacuccccaacuagccuaaccuggcgcugcccaagcccaggagccgguccacgcccuucuccucggggucuccuccuucccguuugcagaucuccacgaaguccugcgaaagcaggguaagauaggagguucuaggccgagacagacggacccccccacccccccccaaccaccccgcggaccucgaacccauaucucagacucaccuccuugcucaggccggugggcuguuuccucacguucuuguaaccacugcgagcaaaggucaggaaugcucaucaagggucuggccccucgguccccuucuuuccugugccccgcccacauccagccccgccccagggccacccagaucccgcccucggggcuugcggucgccccgcagaccaggcacuuacagugcggccagcagcgccucacgcuccgccucgcgcacggcugccagcucuuccucacggcucgggccgguacacggcgcgcgguccuucgcguaccaggugaggucgcggcccuucugccagcggccuacuggcgccaucagcgaguugcccaaguaguucucccucugcuugucagucuucacguccucccaauugaacuggucuuguccgccacgcacgccaccgcgauuggagccgaacauggcgcuggagccacugcacagccuucaguacccgcggucucuagucggacuucccgcagcacuccggacgcacgccgugacgucacucucgcgcccccgcgcgcgccug

SEQ ID NO: 6030 - RNA, 542 nt, Mus musculus
gugauuuucauaggaauguauucauggcucaucugugaauacugaagacaguugugagaggagccagagagaauaggacccagaugacaugauguuccugagagccaaggggcugacacucacuuuggcagcagagccacccaucccuagaaguacaaagagaauggccucugaggagugacaggugagacagugcgacuguaacaaaauguuuccuuugcccugaacuggaccuaaaguacauaauagcauaucauugguggcacaagugugaacagguaaccuacacuagcauggggcuugggugagugacaaccuccggucaaggagagcugaaaguaagguggguauuaacuacuaaagugugaacgagcagaggggaaauggggggaaauuccuaaaaugaaacaaacaaacaaagguuucaaauggacagguguagaugaacaagggcagcaaaccaagacccuuaccggaucaggacuucaugauaaagcugagccgagggagagugguccugugcagugugaugagggcuccug

SEQ ID NO: 6031 - RNA, 12557 nt, Mus musculus
uguuuaguucuuguucagguuccguuucuucagguucuaugucuggcucacaguuguguaugguggcuccgcuguagcuagcguccuuaugaggugcagacgacgacgaugcgggacagcagaaauucggaaauggugagcguuccggccgacgcuggcuacagccaaccaguaccagccgcagggaaggccuccguagcuggugucugcggcccgaucccggugcuguccgguguccuggguguccuggguccccucgcuucccaucugcccucgcggcggccugaccgacucaccucaggacuuggggcgucauggccgacccaccuuaggacuugggacgcuggcuucuugguuguggguucccgcccuucagccauggcugggcuuucccgagucuuggaaaguggggucucaaucuauuuacucuucgccugccugucccacgcccccguguucacagugaagucccaaaauuccagucuuuagggccguccccccgcuagucucaggacaucgaugguugguuaguaggaaaaagccgagagagauuucgucagugcgggcaccguagaagcgggacagaugaagggucuaggacacuccuaccccaauugaucuuuggacaggagcuuuaggcuuaaauagaggaaggccagaccaaaaaaaaaaaaagcuuaaacacagcagccuaauguaaggugggccccgcccaucuuugucuccgcucauuugagaccugaaggggacuagguguuucucuggagauagcuccugcuucugugaagggcuguccuuccaugaauccugggugacugcagguuaaggaccauaacuuaucucugugcccucagcggcagagugaaggccgggaugccaggcggucaucccgccuuuauuuguggcuguauguggauacacacacgugugugggugucugaggaagucagaagacggugucagauucccuggagcuaaagguaugggcgguuaugagcugccccaaagugguugcuggaaacugaacuccauccagcuuucuucaagagcaacaaaugcucuuaaccacugagccaucucugcagugccccccgcccccaacaguuucaguaccaguauuuucaaaugccaacuucuacuguaaaagguuuuaaaagugacaaccauuacuguuuauuuucguugcuaaauaaauagaaauugacacaauaucuuuuucauuuccuauuaguaauggucccagguucagaacugccagaugcugacaaauuucuuauagcugccauauguccuagccuaaaguugaccuuucaucauccacuuagacagcagccugagaucuggggugaaaccucuucgaggagcagcuagaggaccuggagcuggagcaaucgaauaguccucaucucaauaguucauuuuuuuccuuguuuuuuaaauacuuauguauaugaguacccuauuguugucuucaguacaccagaggagggcaucggaucccauuacagaugcuugugagcuaccaugugguugcugggaauugaacucaggaccucuggaagagcaguuagagcucuuaacugcugagccaucucuccagcccccuccuuuuuuuuuaagauuuauuauuauacauaaguacacuguagcugucuucagaugcaccaggagagggcaucagcucucauuacggguaguugugagccaccaugugguugcugggauuugaacucaggaccuuuggaggagcagucagugcucuuacccacugagccaugucgccagccccccccccuuuuuuuaaaggauuuauuuauuguguauacaucuucugccugcauguaugccugcaggccagaaaagggcagcagaucuuauuauagauggguugaggcacaaugugguugcugggaauugacuucaggaccucuggaagagcaggcagugcucuuaaccgcugagucgucucuccagcuccguaguuaauucuuagggacauugucucccucuaagcuuagcuccacuccuaggaaucauuguuuaguuaggugcuggugaaugugggccucagagcagcacuuccugccaucuccagucucucaguuguuaggggagaaaaccuucucucaagggauuagaaagaaaaccuccagcgcgcaguggggcagaagcugacacuguguuugagucaguccagggucucccgagguguggcuggugagguuuucagcagcacuagggugagggaacagccuuuuuuggcacuugauccugacaggucugucuggucuucaggacuugcccccuuuuuuauagucaucaccuugagaucguugcacauuuauuugaaucucagcuuuucaauaaguaugaauuguacucagagcugaauaagguaaauauucuuuugagacaggguuucucuguguaacccuggcuguccuggagcucacuugguagaccaggcuggccuggaacucagagauccaccugccucugccucccgagugcugggauuaaagcugugucucucagcaagguggauauucuugaagcuagcaagaaguaguuuucaacaacaacaaaaaguagagcuucacuuccucugauuucuuuuuaacucuuugcuuccccuagcauaagcaguaacauuucugggauguuuugauuggggcaagucagggggugucauaugggccuagacucacaauugagaaaacuuuaguuucccaucguuguuguaaaaaugaauacauuuccacaaaguacguuagaugaacuuguaaauuacuaaguuggcuuuguuguuguugagauagggucuugcuauguagcauuaacuggccuggaacuugcuguguagaccaacaggugggccuccagcucagaaucgccugucucagccuugagaguacugggauuagaaggaugugcuaccagacuaauauauauaaaacauugucucaaaaaacagaacugagugucuggaggauaggauugaaaaugaucuucuaaguaauucuuuuaucuucucuuuuuuuaaaccuaaguauagauuugucaauuauaaucauguucacaaauagcuaguuuuugcuauaaugcauuauuuucauuugaucuauuuuuauuauuuauuugugugaguuuguuugcaugugucuaaguuaggguuucuacugcugcaaugagauaccaccaaaaagcaaguuggaauggaaagggauuauuuugcuuauccuuuuauacacuguguuucaaugaaggacaucaggacaaggacucgagcagaacagcauccuggaggcagggcugaugcagaggccauggagggugcugcuuacuggcuuucuucauauggcuugcucagccugcuuuccuauaaaacccagaacuaccagccagggauagcaucacccacaaugggcugggcccuuuccuauugaucacuaauugagaaaaugccuuacagcuggaucucacaaugccaauuuuucaagugagauuccuuuuucucuuaugaaucuaacuugugucaaguugccacaauacagccugcaugccaaggugugugugugaagucugagaacagguguagaguuagaaauugaaaucauaccaucagcauuagauagagcaaaugccuuccuuaccuucugaaccauuuuguuagcccaauuaauugauguauuuauuucuuggaacuuucugugggguugaagauauacaccauccugccuagcuuuuauuaauuuuguuuuauuucuugaggcagggucucauguaucccuggcccauuuuuuuuuuuuuuuuguuaaagacauaucauuuauuuuaaauuuaaauuauuuugauuaugugcaugcaagaguuugugcaccaguauugugcuuguggaggccagaagaagguuucagguccuccuggaacuggaguuacaggagcugacagcucccugauugggugcuaggaauggaagaaugaagaacaagggagcccuguaucaacaacccagggaaacugaggaggugccaauagagucgcaaucaaaucaaaagggagcuggagugaugcuuugcuguuaaaaguguauacuacuguuguagaagacccacguuucuggaagugaauuugaugcuuuaaacuuucccuguguacuggcuauacuguauuccacaauuuaaacuuuaaacuuuuccuguguacuggcuauacuguauuccacaauuuaaacuuuaaacuuuuccuguguacuggcuauacuguauuccacaauuuaagauucuuuuccuugaacuagucggguuccuucagaugacucucugucaucuguccacgugugauuuggcacuuugugauuuaauuuccaguucggagguuucuaacagcauuucuguuacugcucacuauuuaaugcuuccauguucauugaguacuuuguguguuugcucacucagaucuggucuaucauuuaguuuugcuguugacuaaaggguuccagaaauaacacugaaauccugccugauguuguugaauaacacuauuaccauuacugcuuuccuguccauuuagagcugucaauuauugauaaagaguaguuugguaucucuaacuguaauuaugaauuucucuauuuugcauuuuaauucuagaaguuuucccuaugugauuagcugucuguuuuauguuacacacauuaaaggcagucagucgcucauuuaaaacauccuauuuagugaguguagcacuuguugacuguggugucugguuucucaaagauaauuaaucuuaaaucuuuuuucucauucucuauuuuugguguuaugguuucuucacugaaaaauggacauuugacaauuguaauauaggacaacugaaaaaucaguuucucuacuuucucugcuaucuggccuugcuuauugaacacuagcuauuuacuuugucuuuguuuuguguguguguguuuaaagauuuauuuauuuuauguauugugugaguacacugucgcuguugucagacacaccagaagaggacaucagaucccauuacagaugguugugaaccaccaugugguugcugggaauugaacucaggaccucuggaagagcaggcagugcucuuaacugcugagccaucucuccauccucccacccccauuccccgcccccaugugugucuuuugagacaggguuuccuuguguagccccagcuguccuggaaaucacccuguagaccaggcuagagccucuaacucacagaaaucugucuaccucugccuccugaaugcugggaucaaagguguggaucaccacugucuggccagccauguccauuuauguaguaaaaauccuguccaaacuuuuucuuuaaaacuaaaaaaaaauuuuuuuuaaauagcaaagccuuauuauguagauaagcuggccaccaucucauagagcucuaauuggcuuugucuacugaaugcugggauuaaagguauguaucaccaugcccagccgccccacccccccagccuccaccccugaacuggaaaguuauagacugcugccuuuaagacuguuagcaugugucuguuuuguuuuguuuuguuguuuuucgagacagaguuucucuguguaguccuggcuguccugaaacucacucuguagaccauagcaugugucuuaauuaggaucuuacugcugugaacaggcgccaugaccaaggcaagucuuauaaaggacaacauuuaauuggggcuggcuuacagguucagagguucaguccauuuucaucaaggugggaguauggcagcauccaggcaggcccggugcaggcagagcugagaguucuaaaucuucaucugaaggcugcuaguggaauacugguucccaggcagccuaggacaaggguauuaaagcccauguucauagugacacaccuacuccaacaaggccucacccacuccaacaaggccacaccuaccaacagugccacucccugggccaaccauaaacaaaccaucacagcaugucagagacagauuaaaacaaagaugaguagaagccucacaaggccuuuucagauuuccauacgcuuacacucacaugacugauauaaaaauuuugaauauugaaauuuauagcaaaguuuuuuuuuugacaguuuuacuuuacucauguuucuguggagggccguguguuuggagcagcccaaagccacuuugcugaccucauuuucccugacucugugaauguuccuggacugaugcaguuugugccaucgcuuuacuguguucccuccaucgcuguugcaguaagaggcaggugcuggcauuaggaagaucuuucugggaucuuguaguuuucugacugucuuauacuuccaugugaaacuuugcacugguuuugaacuccaauaagucagucauccaggaugcuaauuguucuuagucacucuaaaaguuggaauuuuggaauuccucccaaaucuccugauacagcagcaaagguccaacuuagugagcauauccuucuacuucauauacuucuaagaacucugacaguacaguauuaacaacaucacuuugagaagcagacgguaggaugugguuaguaacauggauuggagauguccuauacugugauaaacuagagauaaccagcaagcaucucguacucccuggauucaccaguuuggagggaggguguuuuuacucugcuguugcuuuccugagugccucgguucagugauauuaauacagcugcauguggacaacuaaauacauaagaaaguaaacuguuaggugaccaaaugauggaaugaauauuuggaaaucacaaaaaucacaugaacaucugccuauagauuccuacugguauaagucuuacccagccucuauugugggauauuuuagaacucaguggccuuugacgauguggcuauaaacuucacccaggaagagugggcuuuacuggaucccucccagaagaaucucuacagagaugugauggaggaaguauuuaggaaccugacuucuauagguaagaaugauaauuuuuuucuuuuaaauauacuuuaauuguuuguacauuuguauuuugccugcauauaugucugugugaggguguuagaucuuggaguuacagacaguugugagcugccaugugggugcugggaauugaacccagauccuauagaauagcggucaguggucuuaacugcagagcuaucucuugccuaacauuucuuuacuuaauuacaaugcccugggaauuuuuuuuuuaucaauuuuaacaauggaaaggaacuacuuuuaugaauaaaugggcaugauuuuugguauacagugaaucucaaagcuacuacuaauuuuuugaaguacauaauuaauagugcuuuuuccuuggucuauauuuuagagaaagggugggaagaccagaacguugaggaugaggacaaaaauccucagacaaaucuaagguaaucugaauucauaaaaggugugauguuucuagagggaagcguagcaugucugugaacugugguaaacaaaugaaacagaugagcauacuuuaaacauugauuacuagcuuauuuguacccacccccaguuuaacaguaguuucuuuuuucuuucucuuuuuuaaagauuuauuucuuuauuacauguaagugcacuguagcugucuucagacaccccaggagagggugucagaucucauuauggguguuugugagccaccaugugguugcugggauuugaacacaggaccuucggaagagcacucagugcucuuacccgcugagccaucuugccccaguguuuucuuuuuaaguuaguugauuuucauacaguacuaagaaacuaugugaaugccacuguuuugauaauagauuuggggaagccaugauucagaaacaugauuccauuuacuuucuuauaauuaagacgugccaagacacuuaggcuuucucugaaauugguuauaauguaaguccaagacauuaaugaauagaaguucagcaguaaaccaaccuucacuaugugcuuaccuuuuguacagaagucauagucauaugguagauucuguccaaguaaagaucauaaaaaucaacguggguaaaguuucagugagauuacaaaucuuaaucugaaaaaagaaugugcuuagaaaaaccuucauauguuguucauuccuuaauaggcacaucauagccaacucuggauacaaccuauaugaaagugaagaauccucugagaagccauauaaauguacacaguauaggagcucuuucauuucucuuaugaguauucaaagacauaugauaacggacacuggaaguaagccuuacaaguguaugcucugugggaaagccuuucauuuccccagugaguucagaauccauuuaagaacucacacuggggagaagcccuaugaguguaaagaguguggaaaggccuucagccauuccagcuccuuucgaaaacacgagagaacucacaccggagagaggcccuacguaugcaaacagugugggaaggccuucaauuguucugguuccaucagaaaacaugagagaacucacacuggggagaagccuuauucguguaaacagugugggaaggccuucaacugucccaguuaucuccaaauucaugaaagaagccacacuggagagaagcccuaugaguguaagcagugugggaagaccuucaguuguucuaguucccuucgaaaacacgagagaacucacaccggagagaagcccuaugaaugcaaacaaugcgggaaggccuuuaguuguuccaguuccuuucgaaagcaugagcggacucauacuggggagaagcccuaugagugcaagcagugugguaaggccuucuuuucucucacaaguguucgaacgcacaugauaaagcacacuggaaaugggccuuuuaaaugcaauguaugugaagaaguguuucccuuuuccaguguauuuagaagacaucagucaucucaugcuggagagaagcagcccuauggauguaaacagugcaauaaaugguuuaguuccaacaccucacuucagaaucacagaagaagucacacuggggaagagcccuacgccuauaaacagugugggaaagcuuucaguugucccaguuacauucgaaagcaugaacgggcucauaguggggagaaacccuauccaugcaagcagugugguaagugcuucagugcuuccagcucucugcaaacacacgaaaggauucaugcuggagaaaagcccuauaaacgugagcaaggugcuagagcauucaguugcuccacuucccuuaggagacacgaacaggcucauaguggggagaaugccuaugaauacagugugggaaagccuuugcuuccaguuagaauugauuacuaacugucuugaaguuauucauaacagucuuaugaauguaaauucuggcaaauccuuaguuucucuaacuaagauuuuuguuuuuguuuaaacaaaaaugacaaagcacacuggaaaugaccuuuuuaaugugaauaugugaaaaaaagccuuucacauuucacagccccagcauauuuagagcacaucaaauaaacucucaugcaggagagaaacagugugaaugcagacaaugcgguaaauccuucacuucuuccagguauccucagaaccauaaagaauucauguuggagaguaucccuauuaaugcaagcacuggagagccacugacuacaguugccuugaaaacaugaguaaacuuguacgggagacauguccuuugaguacaaauaaauaugguaaaugucaccguuuccauuugcccucaaagaaacuacuccuuggacagcauaucaucagagugacuguaaagacuaugaaaaaccagugcuuuccuaaucuccauaaaggacacaaaaaagguucacacugaacaguaggaagcccacguuugugagaaaagagguaaggcuucagaugccacagcugucucaggcugugugaaagaacacauacuuagcuaaaacacuaggacuaggaacaugggggaagcacucagauucucaguguuccucaaaggcauaaaaaggaccagaggggaaaacaccuguaggccuaaguaaugugggcaggcuucaauuuuacacuucuuucugagaagcaaggaaacacucugcagaaauucugagcuuaagaacugucacaagaccuucaguuucccaucuucauucgaagugaugcuagaacucaucuagaaaaagacuauuggguacaggaaguacugagcucaugucucuuugaaagguacaugguacacuggagauggcugugcaaugcauugacuuuacaaugcgaaaacauuguuucucugggcuaaagcauggaaugugucuuuuuauauuagauacaauuuuguaguauuuuauugaaacuuuuugcaaacuauucaaagagauuuauguaucuugguauaguauauaauauaguauuauuuaguacauacaguguaugcauguauauacauguaucuguaggauacaguauaguuuguauaugaguaguauauauuauauaacuaguuuauaugguauguaacuaaccacuauuuuacuauaguauuauacuacauggcuaugcuauuggaguuuuaucaguguguagaauaaaguguuucaguuacccaccccagucccugucuguagcuauuucuugcuccaggagcauggcuaccaggauccccaauauucagcaucaacuguuuucaccagguggaaaacagggauggcuuccuuaccaacccauggacuugggacugcagcugcuaucaaaauccucagcaucaacuggauguggugguauaccuuuaaucccccaaauagagagguagagacaggaaagaaagggaagagaaggagggagagaggaagaaagcaagcaagcaaacaaaaccaaccaaaggaaacaacuccacagaaucuucagcauuacccauucucgucccugaggacgauggaagguccuucugcagcccugggaauguggccaucaaacuuuagagcaggucuccagaaaguuaucaauaacaaucuguagacauccuuuucacauccuguacgcuguacauaccaaaguuacaaggccuagcacaaucuuuacucaagggauauaaggucucucauuuuacaacugcaagagauugacaccaugaauccaaauguuaccuuuaaauguuccauaauucuuaggggagauuuucagagacaaagacuugagauuaugaaaagaagaagaagaagaaaaaaaaaagcccugacacuauuugggccuauaccaugaggcuucaagaagauugaaucuaguggucacaacaagugguuaagaaugcuauaugccagccggaugugguggcacacgccuuuaaucccagcacuuggcaggcagauuucugaguuugaggccagccuggucuacaaagugaguuccaggacagccaggacuacacagagaaacccugucuugaaaagccauacacacacacacacacacacagacacagacacagaaugcuauaugcccugauaccuucuucagcucuuauuuaaggaagguaccguuuauguuucaaaacuuagauauucugggcuuacccaugucacacaccagggccucauuucacaggaccuggugaggguuccauggcauccugugacaucaaaacuugagccacuguuccuacaaucccauguaccugcaugcuugggucccagggaagaaguucucacaguuguaaaggaucauggccuauggcaucaccuaugcuuguccuggggugaggccagggauaguugccaguauccuguagaacacguaaugguagaugcugccggaacaccuaccacugcaccagccuguaauuccugugaacacauguggaugccuguguuaacuacauaauuguacaacugcuuuuaugaacuguugugcuuugaacuaucaggaugugcaugcacacugcuuaugaagcaaagaugaaugcacacagacugugcucaguucuaggcaaaguuuagagucucgaggcacccuacaaggaauuguacacugacacaugucuagggcuacagagacagguuaauaugaaagaauacuuccaagaagggaggugggccauagauggguagaaaagucagaggcucaauguuuccacuagccagcaaauuggggucuguauguuauuuguacagugugcucuuguaggugauucaguuucaguugggggugggcuuucccuggucccccucccccuccccccauugccccuguuuguuucuaucacuggcuuauuuuuuauauacuaaucuauauaauuuauauagcauauacuuuguauguucugcucuacuuuccuuccgcaucuucagcaucagcccugaugacuagggaucauagacuucugcauauuuauuucuccaugucucaauggcuuuuuuuucuucaccagcuaaacagaaaaccaccuuaaggaugguauaugggucuaugucuuagucaagguuucuacuccu

SEQ ID NO: 6032 - RNA, 2197 nt, Mus musculus
uuuuuuaaagggugaagcacuccaaugccaauuuauuuuaaucgggcucuguguuaucuaugguuugccucuuucccuuauaaucgcacaaccuuugaaaauuacauaaguuguaaugaucuaauacuauuaauagccauucagaaaaaaaaguccccucccgcccaacaaccauccaggggaaauuuaaaguccucauuagaggccagcucaacacggccucuacccugguagaaauaaaaauaaaaaagaugaggagaaaacaaaucggcuaagagguguguugccagugucuuucaggaguggggcccuggcuguugccuggguggugaaaggcagagccugcagccugcaggacggcagccgggcggccucacagcuacaucuuccucaccccggcacagccacagcccaguuuaggugucuugaaaauccuuuagcaggguucuucucugcugcucugcuaugugcaucugguuuucuaaguccccucugucguagcugucugcacgcucaacuuuccaugaaagguuuucgaucucagcuuccagcugagccugcugguauucaaacagcuucuuccugggaccggauuccauguaguaugcauauggauagguguacugcaggguauaucgacacuuggcuaagagcuuggcggcauucuguagguacugccagucaauccaaguucccagguuguucauaacccucuccugaaucuucucaugaauccgcugguauguuugugccuccagcugcaagcuuuuguugugauuuucccaccucucaaaauagaacaaguacuucuugagggccucccuggccugugcuugcugacucugguugacagugucaggauucuccuuguaccgacuacauucauaguacucacuaccaugcgucuuccagucuccuagacacauccagcagaagucgugcuuacacuuggagcauugcaugugauuacagccuccauucuucucgaugcagauguugcacuugggacagucuuuagugugagcacuaguguaguuagcuguuucggaguugucugcacacuuggugagccauuuccagauuguggugcagucugugggggcaugauacaucugucgacacuugaaacagaagaccucguugcaccgauugcacugcacucggcgggcucuaggcuccuguacccggauaaccauggggcagucugcaccggggcacagcuggaguuggcaauggcucuccacauaguccuuaaagagguagcgccuguauuuaucucucaauucuucauugggaagcaagggaaauacaaaguccucugguguucgaaguggacaauccugagccauacaugagauuccuacacuaacaccaucuuugacaagcacugagcaaugcugcucccaacagcuuuggcaaaacugauguuggcaggccagagagagcagguuuuccuuccacacaaauugcauacacacugcacaguggugagggggaugggcuguggggacauguuuggauggauuagguugaacucgagccucaacaagcagcugagcagaauuagaccuguaccuguccagaaucucugagacuugccaguggaaauuaacuaauauaaguuuugcaacugaaugagauaccuuuaagacagaggcuaagcuggucauauguucauggagggcgcccuaagacuccuuauaggucaagcaagugaacugauacucuucgggaucaaaagcaucagcccccugcugcuccacaucacuggcuacuccacauaguaaguaguccucuauguccccaggguccucuuccucuucuuccucuuccucacaguuugggucauaguccucuucauugcugucagacccuuggcuguucauguccacggacaucuuaacauccagcaaaguugcagaaacaguugcuuuuuucccuacccccaauuuuuaucguuuucucaaaugcauuagcguuuauugucuucuguaauguuuaaagaucuuuccugcagauaucacccaaacugucugucauaggauuuccaucgggagccgcgaccucgcggccgcagagcccaggccggccggaccaggucaagccggaccaaacgaggcugacagaggcguagcggcagcggaggcggccgguggacgcagcucaggcccgcgcagcuuccuccggcagagcccua

SEQ ID NO: 6033 - RNA, 41234 nt, Mus musculus
cucuucccucuccuaagcauaaccuggcccagcuugccccaucugcaauccccgugcuuuccacauggcugcgcuggagagaggacggaucucaccacuuggguccacagaaagcuccugcugucuguuugcucccgcugguuaucauggauguuaggacugucugcccuccaucgccauccccagauggagagaacagaaaacugagaagcggaggagagugugaagccacagcccagggagcaccagacaauaaaagguaagcgcaggcaacaagaccgugugaucugacugagguuuccaggaaaaagcaaaggaugaaaugcuagagagagcugguaauugugugggugagggcuugcuuggcacuuagguucuuaauuuaccacauaaauuuacuucuauuaaggugggcggugguggcucuuuaaucccacuuuaaucccagcacuuggaagacucagaguuuccauauucugagcucacugaauuagccucgauccuagagauguuaccuuugugaucaaguuaugugaaguuucuucccaaaggugaagagagggucagauauccuccugcuccacauaguggguugucuguccccugaccugccuugguuuuuagaaacaggguuucucuguguacccuugcuguccuagaacucucuuugucgaccaggcuggccuuaaacucagagaucugccugccucugccuccucagugcugggauuaaaggcguucgccaucacuuccugcccuuccuguguuguucgggucuggcugcuucucuguuuagggaaaagcaacuaagcacuuuuauauaacggagauauccucagagugugaaugaaaugggcagguagcuucagggagaacggagagggucaaaauuugguuggaacucaaaugcuaaccuauuauccaccuggaauuggcaucaaaucccacaggcugccaaauguggugguguaaggcgguuuaucccagcauguggagaguggaggcuguagggagaguucagaguuacagagagcguucuagaucagccacaggcuaagauucagccucacauaacguccuggguuuagguaucacucuaagguccuuggcugccgcuucuagccaacugguuacaaagucaagcuuucuaacaauucuccaaucucaagcuugaaaauucauaaauguggcucccacagcucagaggagcacuuauugccugcgaggcccgcaccgguggugcaggaagccugucucuacagcgcccucuuuuggaacagcauggauaugguuccugcucagcacaacauucgacuuuuuuuuuuuuaaaaaacaguggaaguagccuaggagcugucuuugcugcucucugcuggucacgaauagaacugccaagaacugccuacggcuggauucugcuaugccucugugauuuuucugacucccuggggaauacuccuaacgggaccccgaaauuugcaucuuuuagucgucuagggcuggaaugaucuugagcucucaaaugcaagauagcaguucucuuaaagccagauguccucugcgguauccaaggaagccaaccaaguucugcuccucugaacccuaaggguuagaugugcuuaugucucacucuuccuccggaaccagccugcuccaggauaguuugcagaagggcacauuccccgcuaccaaggccgccauucugguuccaaagcugcaucauagccguaccaguacuuaucccucaagucugcuuccagagacguacuggcuuugagauggacuaaaucagggugcaacccgcacccuccauagucacaggucccuggacaggcaaggggaugaaucacagaaagcugcagaggccgaccuugggacggaucacccuuagcuuuguugggcuguacagaaaaggugcaaacucuuuguauuaacacccuugguguuacaggcucugcuccacccugcuauucaacucacaauacagaggaaguaaaggauaacuuuauuaguggacaaauguucccguacuugcacguuuuuuuuuuuuucugaaaguaauucauugaguaaaaaguuugaaaggaguaagaccuaagagauuguuaagacugaguuccauauucuggugguuuaaacugacagcucacaaaacuuccaguaucacuaaaccuuacaccgugugagcuucguuuugcuucucagcaucagucucucacagagaauucagcucuaucaguaucuggguguauuucugcauuugccguaaggaauaguggacaaagagaaagaauucuugagccaggcuuuucucuagaaaaccuggguucaauugcaaacaccacauggucacuuaaacaaccaucucugacuccagucucaucuugagcccucuucuggccucugcggguacugcacacacauggugcacauacaugcagguaaaauacccacacacauaaaaguacacuuuaaaaaaaauaacaaaauaaaauaaaauugggaaguguuguguuucaucauaguuucaaucauaggcagauaucaucuaagaagaauacuccuuuuuguuuguuuguuugguugguugguuugguuuuugguuuuuugagacaggguuucucuguauagcccuggcuguccuggaacucacuuuguagaccaggcuggccucgaacucagaaauccaccugccucugcuuccugagugcugggauuaaaggcgugcaccaccacugcccagcagaauacuccuuuguaaauggaucaaaccaugacagguuuuaaaugcucuucauccucaaauauguuuuacugugccaaaacaaacuucacagacauaaaacauaaauaauagaauaugagaaaauaaguucaguagcaguucagcuccucagcagcucagcaagccucuacagccacugggagccaggagccccccaccccuaccccguggucagggccucuauccuguggcccaggaccucgguuuuuuuuuuuuuuuuuuuuuuuuuuuuuuuuuuuugguacacucccggcaagcacugguccuuacuuagcccaagauuucuuuaucuucuauuucccccuuuuugcucuugguguuuagaaacaaucucugcccucaccucacgcucuaccucucuuuuaugaccuuuauccucuugcuuaagauuccccagugcuaccauuagagaaauacacaccauccaaauggcuuucccucuaaagcauucugccuuccugggucauugucuguccuugggccaggaagauaugacugcuuagcucucuguaucuguuuuaguuguaagugagcacacuauagaugaagcucuucaugaaaccugcccaccuccccuggucuggauuacgucacuaccgaguccuuccccagugucuuugccugcccgggaauggcugaugaaaaugggccaaggaugcuaagcacccacguucccgguuucugggccgaggucccucagaguucaucgucuucccuugacuggagcaugauccucuguucccuauuaaaauacaguggcguccuggaggggagcucaagggacaucuucauauaugucaaugccccucgaagcagaggcucuccaccuuuguguuugggaaacucacccaggacugguguuuagcuggggauuuggcuggcauagugggggaggagagugggagccugagcaggaccuccaggaccuaaagaagaaaaggagguaaagaaggggaggagagaggaggugaacccacaggggaucuuacccaaaaaaggaggguguuuuaggacugcaggaccuugcaagccuuaaccaagucuuuuaccacaggacagcccugcugcacuuuaggaaaacccucuuugaagacauaguguuaggggagggccagcauuuacuacacaccucugaggaacuaaugaccuuuuaccagacuguuccaugcuuucuuaauugacagcagagggguugggucugcagcucaguuuagaguacuugcagggagcccuggauucaauccccaguacugacugcauaaauggagcgaaguaguaguauaugucuguaaucccaguacuagauggggaggcaggaagaucacccuuagagugaagccaggcagugguggcacaaaccuuugaucccagcacuccacgguuuuuucaagacaggguuucuuuguguagucuuggcuguccuggaacucacuuuguagaccaagcuggccucgaacucagaaaucugccugccucugacucccaagugcugggauuaaaggcaugcgccaccacgcccggcuagcacucagcuuuuaaagacagcuccaguuacccgacggaccuccuaaggcuugaggcacauacaggguacacauacacacauaccagcaaaacacucagacaaauaaaauaaaucuaaaaaaaauaauaaaaagaaaaagguauuaaaauaauagcaauaaauaaaagaaaguaaaagguaaaacacaaauaagaagaagcacaaacuugggcuggguguggugucacacccuggugaaccagccugccuccaucuuagagaacaaagccaucuuagagacaaguuagguucgucccuguuuaugauuaaaccucuguuucucaaggauugggcugugccccacauguagcuuuaacuacacaugguucuguacugccuguuccaggaaaugacaaccaugcuauuguuucaaaaaguuauuaugaccagcuguugcuaugaccaccuuguggugaccagcuugcugugaccaccuuguuauaaccaucuuguuaugaccacuguacaaaccuguuucaggagggguuuaugacuaguguguugugguuuuguucugcuucugaaacccugccuaugugccuucuaaagcccccauuugaaaauccccuacuccugaaccauaaaaccccuuacuuuacccauauccaaugcuaauaucuugaaucccaccuuuacggagagagaguccauguauaugaauuuuaaaaaccuuacuuuaauuaauugcuugcuuuagcuaauuuggccaugauuugguggccuuuuuccuugaaucuguaggauuaacagccuuuaaucccagcacucaggaggcagagacaggcagaucucuguagugaguucaaggucagccugaucuauauagugaguuccaggucagccagggauagagagaaggaaggaaggaaggaaggaaggaaggaaagaaggaaggaaggaaggaaggaaggaaggaaggaaggaaggaaggaaggacuaaacaaaauacagggucucccuaagcaguucacauuggcauagaacucagugccacaacacagugccaguguguggcacugugugugccugaggaaacacauuuaguauaacuacuacauguauggugugcaucaggaauuuaaaagcauuucaggaagcaacacugagugguuuggggagccaucuguagugggaacauugcagcgaauucuaacaauuaaagacccaaaucccucaaccuuuuuccucaggucacuccccauugcuguucugaauaccuuuuuaaauaugugugccugucuggaguucuugcccauagaaguuuugccauuuauuuguuuagucaggcugacucacacaauauaaagccgaauuucuucucaaagguaaaugaaaggcuugcuuucuuagcaggacuuuccaaccuccagagaaccuuuaacaaaauuguacagggugggagggccuucuguucucaguaaagacaggcaaagcuugagaaagaaaacacacacacacacacacacacacacacacacacacacuugcucuccccauaaaugagcagugcucaguguucugcugggcagguaaccauccagaaacacugaccagaggaacuucucugccaggcacagaggaccagcaagccuucugaaagagaaggggugggaggguaacucuguccccucccuaagucacaggcgcccaccgcugagaucacugagauccuuagagaucagaucuagaacacuccccucagcaaaggaggugagugccuguggcccugcuggggugggguuuucuugguuuggauauucuuguuguuuuuuaaaccugucacacuggaacuguguaagccacgcugcccuagaaccugcagccauucugcuucccaaguguugaacgagagagaggcuugugcuuccacgugcagcuacaaagguuacugaaacuaaagaacaguuuaugucuaucguugagcaucucugaauccccuuuagauuuuuaaaagaacuuucugccaguuguggaggcauacacucguaaucccagcucugaagaggcaggcagagguagaugggugguagugaacucaaggacagcauugucuauauaaauaguuccaggcagccagagcuacacacacacacacacacacacacacacacacgaaagaaagaaaacaacuuucacccuggaaauuauuagauuaggcucagcuccaacaacugcgcaagaaccuggacauuguugaaacaaaaacacaauucucaucucaaaaaguaccagagguaauuuauucugaagcaaaugugacuauggccuaagaacagacuuggguaccccaaauuccauguccaaugugguaacagguugauuuuagauuucuaagggagugggaagagacagaagacagaaagagaccagagucuaaccucaacagauaaaauguguuaauuagcguacacagcaaggggcagccucucucccauaggaaaugcagggccuguaggguaaagguuagcgcagagcauuauggggguggggaguguugggacugaggaaguuguuagaacucaggggucugcuuguggucugcagccuccccuuccugaaauugucugcccaaggcaagacagaccugucucagcagacauuccuuucuggacugacagaaugguugagcaaggucacugugaucucuuaagaauuccauuuauaaagcugaggcgcucuaucugaugcuguuuuuaugguagcugaauaaagaaagccauaaaucaaggcacuucccaauacacuguggaaacaguaaguaagcgaaucagagaaauggcggcuacagacuucagcugcuaucuagggacacucugggcuuugggguuggugaaaacuuaguuuuguuaaugcaccccgaaagguuuuaucuguuauucaucugaccuuaggucagacacggaggugggcaaggaguagccauuuuaagggcuaaagguagcccaagauaaagcaaaauuaggcucugguccugcaacauuccgacaaucagugaugcucuaaucaguuaaucagcauggugacagggucucucuguguagcccuggcuauccuggaacuaguucuguaggccaggcuggccugaaauccagagauccgccugccuccugauugcugggacugcccagcuuaaauaagcuuuuaccugcagacggcuuugcagguucuuaccaagcgaguuacacuuugagcaauuuaacagguuucacggauacagauacugcacgucugugucauuacugggcaaaugggaagauuuacaaagcagaagucauaucacagcgaucuuugaguuaggccagagauguucuucugggcagauguuagucagggucauucuuuuugaacugcccggccgacuuucacucuuccugguaagagggaaagaauuuaaugacggggcagucguggugagcaaauucaaaagggaacacauuguuggugaaucugaguucuaauuguguuagaaguacaacccugguuuccuuauguuuuacaaugucucagaagucuggguagugugcugcuugucuuauguguuccacuugaggcuaaaguuuauuucuguaaaacuucguauuuucuaagcagguuuauugguaaauccucuauaacguuagcuuguuguuuucacuuuuuuuucuucacccacccccacccccaccccuagauagaaggagauguaagacugagaaucauagcuaaguauuuuggucccauaaauuccucuagauaaugugguccugaaccuaucacagccuguuuccacucaguuaugaaguuggaugguggguauuuuaucaguguuaucugucugcuaauagaaacagcaaauuaaaaaaaaaaaaaaaaguaacggaaacagaaaaacugcugaguucaaggucauucugggcugcauagcgagccccaugcagccugcaccccuucccggggcacgugcucucuguuugcagccucccucuacagcccagacagcacuuccggcuucccgggcacgugcucucuguuugcagccucccucuacagcccagacagcacuuccggggcugaagcuuccucucuacuuggaggacuugggaucaaauacgugagacuuguccuacguacugccauuuuguuuucagacuccauuuucaucauaaggugacacuaaguccaaguucucaggcucuagggaagcuuuccagauagcccgccaacuuccuucuucuguucccaaaacgugaucguuccuaaccaggaaagaacaaaagacugacugaugccucacugugauggagcuuggcacaggucuuugugagcuuuaaaacucuauaguguucuggcucggggauacaguuuuaaugccacgaguggaugcuuuaacacugcucagcugaugcccugagucugcccacaguccacagcacacaggguucucucuccaggccuuccugacucuacacuuugcauccuugagaaguuuugacugagcuucugcagagaaagaaauccugaucaucgcaggccuuugugaguguccaggugugugaguuacuuccuuaagugagcuggauccccacacaccucucugccuggguguguguuaucaguucccauucugcaaagaaacagagaugauaauauaaagccagaguggagagucagcucagugcacaugcucagagcuccaucugaaacaaggcaaaaaaaaaaaaaaaaaaaaaaaaaaaaaaaaaaaaaaaaauugaaacagaccaggccaggucauacacaacuaugaccccagaccuuggaagguagaaacaagagagucagaagguuuuaauuggcuuccuaagaccuugucucagacacacacauacaaacaacuucgucaacugcucuauuuuucuguugauacagacaccauggccaaagugacuugagggaaacagauugguuucaguuuacagguucaucaucaaguuaacuaaggcaggagccuggaggcagaaacugaagcaaaaccauggaggaacgcuucucaauggcuuccucccuuaccuggcuuucauauauaguccaggcccaccugccuaggaauggucacccacaggccacaaugaccuaggcccuccuacauauguuaucgaugaugauggugguggugaugaugaugauggcaaugauaaauacccgugggcuuuuggguuggccggucugauggaagcagcugcccagggauaucaaguugguaacaugaucagccgucacuccaccauggcguucaagugucaaaagcagaaaggcgagcugagguacaguaacaucagaaaagccaaacaguggauacguuuagaagucaugagugcagccgggcgugguggugcaugccuuuaaucccagcacucaggaggcagaggcaggcaaauuucggaguucgaggucagccuggucuacagagugaguuccaggacagccaaggcuauacagagacccugucucaaaaaaaccacaaaaaaaaaaaaaaaaaaaagaagaagaagaagucgugagugccuggagguguggagaaaauggcuaugacaaacaggagcugagacugucuuuugcucugugcugagauacucauaccuacaauuuugcuuuauccuaggaaccaggugcuaucucucccccacccccauuuaaggaguugaauguggggguguucuacaccucagacugauagagagauguugagggauaucaccagaggugacugcuuagauacaggaguaaacaaacggaaagucuuuauaagcugguuggagacuacaguggauuuuggggauagcaguguaacccugagucuuuccuagggagagcuuuuaaacacaaaaaagcacacccuggguugacauacuucaguuagcaagagcagauagccagaagcagagcuacaggugccaaaaagcaagcaagguugguauauuuagagacacaguugccagaacugugggcuuugauggaucaggcaggauuuugucagguggugcugugucuacaugccgaguuuuacagccugaauaguacuuccauccuggagucgguugugcuaaggucugaaggccugauccagggacaguaugaucacaugaguaaguggacuggcucgaaaucggcaggcuguguucuuacguggaaacaaacaucagcaugaacaagccaggagaagucuguggaacagcaucgggaauuuuacuggaucccaucacaauuaggcuguaggacacccugagugcacccgcaccgagacugaaucacaacacuguuaggaugggcagucuaggaugggucggcagacaaaaugagggcaagcacuggcugugggguacaggaaaggacauaagucauguucucucagagguuacaagagagaaaaggauuguaagaaacucaagagagguuagagcuaacagauuauauacaucagucaaaaaaugcuaaacaugagggcagguaugcagcugccaaggguguccucuacuucaugaaauacuacagaaaacugaaggaagcugaauagaccagauauuucuaacuuacagugccaaccaaggacagcuggacauacaggucaagaauuuucaaucaaguuuccccucuguaaaucacaugaaaugccauccuacaauaccacaggacccgcauugcucggccaggaacgaaagauuuacaccccacccugccuuuuggguaguagguagacucggaguagcaaaccguucuuucuggagaacagacccaaagucuaggugguaacucuccagcuuccuggagagacaguggugaggagucagugauauaaaugcaaauuauccucuggguauggugaugcgugucugcauuuccaucagugacaggucaacuaaagucccaagccugucuuggguacacaggaagauccuggcucaccagggcagccuggggugcacaggaagaaccuggcugacagacagaacacccaaacugcaggggaggauacagccaccaaaugcugaaaauacuccguagucucccuucugugguaccaucauggguucucucucuuauacacagagagagacacagacagacaguggaauucaggauggauauuugcuuaacucuaacccuaaacucaaucucacacacuaggcucucagucccccacagccacaccuucagcccagcaccagaagcaagcaacagugccucucuaagcuucaguucccuuccagaaaauccagauucaagaauucagcucauauuccuggacccuuaggaaggcccguaaugaucuggauuucuuccucugcagaggcucuagggagggaaaguacagaaaccaggaaguccuggagagaaaagccugugugcuauggucuggggguagacucagcugagcaguguuaacacagccacucuggaaaugaucuggcuuccucaucaaggguuccuuggcuugccugacaccguagcuacuaagcuggacaaccagagaccacccacuucuagcuagcuccacuucucuuaaacaagucucuaaacagcaaacaggacagaguugauucccuccacccccccuccaccccccgccccuuuccugcuuuguaaguuucucaaagcuuccuaacucccugaugccugagggucuauuaggcggacugagagcacuugaggcccugccgggcacugaggagagaaggcuaguuuugccucaaccugaggcagaacagaaagaaaaagugauggagguagcagguguggugguguacaccuuaaccccagcaagaggcaggcggauuucugaguucgaggccagccuggucuacagagugaguuccagaacagccagggcuacacagagaaaccuugucucaaaaaccaaaccaaccgaacaaaaacaaugaaagucugugagagaauggaaaaggucuggauugcugccuucugggaaacuuggggaacugcugauaaagccaaaacgguuuccagagauauugugugucuuccaagggacagcuuguuagacaggaagcaaacugcuuacucaagacccaaaugauauuuaacuuuaaguuacuagccuaacccuuuucuuaaaucuaaguaacccacuuaaauuuaucuuugcagcuuuguuuauuuaauguuuuccaaauuuuuauuuuucuuuaccccgucucccuuuuuugagacagguuuuuuuuucuguauaaacccgacuguccugaaacuugcucuguagaccaugcuggccuauaacuuaaaaaaucugccuugcucugccuccugagugcugggguuaaaggugugcaccaccauugccaguuuuuucauguaucuuucuaauaaucccauugaucaagaucuguauggaagccaggggugauggugcacaccuuuagucccagaacuugggaagcagaggcagccagaucucugugagauugagaccaguguggucuacacagugaguucccggccagccagggcuacauguugagacccuaucucaaaaugaggaagggaaauggagagagagcugggcagagaaacugggcagagaaaguuccagagcacuggcugcucuuccaggggacccaaggucaauuccaaauacccaccuuugcgacucagcauucuguaauucuaaucccagggaggagucugacacccucuuguggccucuauaggcacuguauguacaugauaaauacaugcagauuaaacacucauauaaaaaaauaauaaaaaaccaaaauuauauuaaaaugucucuuuauugaagccgcuaaccucuuuggucugagugaaggucacuaaaggaaaauagaacccuucaggcugcaggaguggaauagaacuguggcucuguccacacaaucagugauaaacuaaugugguuacaaggacaugcuccuaguaauggucaccacaccuucugcuagugggcuguacccuagccuaucaaccaaggccccuccacccaggaccuucucacagcacccacccgcuaaguucuccuuuuggaucucuauguuaggggguccauugucugaauuuccccgguaugagcugaggggucacccugcaugugucagacagguaaacugggcagagacgaaaaugaaaacccagugcucacugaugucguccaccugggucagacuucagggaaucuaacgccgggcgguugguucacugucagcauacuuaaagcacaaaacaauuugggaaaagauuuccaggcaacauucaauccaauccagcugcacaauaaagcuuacgaugugacuacaugugggggccaggggagccguggggagcaggccuggagcaagagucggguggaggccugcccagacccuggaaaucucauccagagauacaucagcaguaguaggauugcaccgggcccgcauggacaggcacacacagaccuuugucaccaccuuugccccacuagaggaggucauguagccgguagccagguuaaacuuccuuuccccuuauaaggucguguccagcagcaccuggaaucccuccguaugcaaaugaggcguccccagcacacuggcccuggacaaggcuguacacucaccuuuaaagcaacuacuuacucaccaaaguuggguuuuguuguuguuguuuuguuuucgagccaggguuucucuguguagcccuggcugucuguaacucacucuauagaccaggcuggcuuugaacucagaaauccgccugccucugcuucccgagugcugggauuaaaggcgugcgccaccacugcccggcgucaccaaagguuuuaaauagccuuuguuccucuaguuaaacgagcugugcaaagaagcaaacacuccaugaagaagcauucugcucauucaaguccguuucuagccaugcucacccauugccugaggucuccaucauaccccuccacccccacucuacugucccguccagucccaccccgcucccaccauucauuccugccucauuuucucucucaggccaccggucugauggaaggcacucaugccugccauuaagggagaguggggcagaguaggaaccacaacuacuuagaaacucuuuuuuuuuuuuuuaaaagauuuauuuauuauuauauguaaguacacuguagcugucuucagacacaccagaagagggagacagaucuuguuacagaugguugugagccaccaugugguuguugagauuugaacucuggaccuucagaagagcaguugggugcucuuacccacugagccaucucaccagcccagaaacucuuuuacaaaguacuuguggccaugugaguggguucuauagggaaaaggccuagaaccuaauguggucucugaccgauagcuuagaggucagcaggccauaaaguacugcaacaucuccccuaaggucuagggaaggaagagucugggauaaucacucuggggaauuugguugaggucagccuccacagauagcaaaagguccaccagguugcccacaaaaugcacucucagauuucaggauggaaugcagauauuuggcuuuaucuccuccacugaggaaauagcccugugugauuaacaaccuggcucucucugugcuuuugugcucccaacaaugagccgucaacaaacucuuaccucccccacaccauggaguaaaacuagaaaggggggggggcaggaggccacaccugcuuugaagauucaacaaugcagacuccuuucaaacucccaggauugcugugcagaguuggaauguuacagauccagagccaaucucaggcugucucuaacaggcacucccuggccaccucagugucugaccuagcaucacaugggaucuuucaggagguaguaacagaccacucacuuccagcaaccuaaaagcuaagaaugccaucaguagcaucugagagagagcagagguucccaucuuccauguuuacucugguuaagauguggagucagcuuaugagccaucuaaagcugaauguauugagaaaacacaguguauauacaaaauggaguuuuauucaggcauccguaaggaaauucuucacuuauagccaaagggauagacaucaaguuaaaugaaauaguaacacagaaggacaaaggcccaccgcauguucucucccagguuaaaagaguaaacugaccugcugagauggcucuguggcaaagacacuggcuagcaagccaggcgaccugaguucaauccccaggguggacagagagagcugaucgcgguaagcuguucucugaccucuaaagugugugugcguacccacucccaccgcauacauaaauaaaugcaauagagccaggugugguggcacaugcuuuuaaucacgcagcucaggaggcagaagcaagcagaucgguggguuccaggccagucagggcuacacagugagacccuaucucaaaacaagucagucuguaagccagcuggagcuuccugggggccaugaaggauguggggagguagguauaugcgugaugacucaacugcaugcgggugucgcuccacagcucaucaauuugcaucuuuauuuucagacuggguaucucaucauucaagcugaccccaaacucgcucacuauauaggagaccaugaccugauccuccagcccccagucccggagugcggagauuacaggugugcaucaccacucgugcuggggauuuaauguagagcuuggugaauacugacaaacacuguaccaacagagcuacauccuuagccaccccccccccccccacacacacacaaacguucuuuuuuucauuagacagggucucgcugaaaucccaggcuauccuuaaagacugguccuccccgcuucagccucuagaguacaaggauuacaagggacaacacuaugcccagcauuuaaugauguguguaauuaauauguuuggggugggggaacaaucugccauugaguuuggccuaacccuguucagucuggccgaggaagcaagcucagucuucuugguuuuuuuccuauuuguccuuaaggcaccuguuacucgaugaccacauauuacuagcauguuuuguuuuguuuuguuuuucgagacaggguuucucuguguagcccuggcuguccuggaacucacucaguagaccacucuggccucgaacucagaaaucugucugccucugccucccaagugcugggauuaaaggcaugcgccaccaugcccggccauuuucuuuucuuuuuuuuuuuuuuuaagcaaugcuauuuuuguuuuauugcuuacauauaacugcacaaugaaaaauuuacauuuaaaaaacuuacuuuauuacaguaacacauguauaagcacuagugagacaaaugaguccccuuugagggaguggggaguuaaacuacugguuaagggugguauuacucuaaaagauaaugaguucuaaaggaggcuggagggaagcaagaggaccaggaggaggggagagaagugagagagaaugaguaugagagcucagguaagaucagugacacuacggaggcagcuagacgcacaggaucacaaacaucagaggaacauguaacuuaaccucuuggagucauacaaaagaauagaaccaauuguauacagcaaggagaacgauaaauacuuugaguaucccguaccugccaaaauagaucagcaaugagcuccagcaaguccuaaagauucaggaccugagguggcuacagcacagcuugcacaugcauccaaaugcgaucccugcaaauguggaagaaucagacacauuguuugggaacccuugucaagaaaaccaguuccgucuauuggaccuaagauauucagacauguacuguggcuuaagaguaauaaaacucaaauuagcaguuucuaaagcccaagauacagguaugauaaaagacacauauauaaaguauuuugauuguaucugccuccauuccccucauuugcccccucccagugaucucccaauuuuucucagcuuccuuuuacuguucgccagucccuggugguauuauuuccuucccuuuucucuguuuuccuaugcaggguagcccuggcuguccuagaacucgugcuguagaccaccagcucuguagaccuugaacuugcacggaugcgccugccucugccaggauuaaagcugugcgccacaccacccugcucccuucuagcugcuuauaguuggguuuucuucuuagguuccucugugucacccccaaguucuaccucagugacccggcuaaacuucuuccuuucccuguuucagagaagagcuggccaaaaggaucuaaaggccaaaguaucuuuucugggaggccaguucaaacuggcuagaucuacgcuaaguuaaggugccaugagucuuuaaucaucuguagcuaagcaaugucuccaaucuccugacaguuaauaauugccaaggaucacaaaaggaauaaaaagggacaucggauuuucuggaaauuuuccagaauccccaggaaaaaaaaaguaauauuccuauuuuguuaguuggugcccccaccuuccuuaguuuuugccccuugagauaagagucuagccugggcugccuugcuacuagacaugcagcacagcccaggcuggccuccagcucuccgucuuccugccucagcuucccaggugcugggacucacaggcaugcacccaggcagucggccccccucaguuacaccauagcuagaguacucccauggccaagggguaggaaguugacuuucaagucuguuucccauucuuggcaagagucaaagucccgggcuggagagauggcucagugguugagagcacugacugcucuucccgagguccugaguucaagucccagcaaccacaugguggcucacaaccauccauaaugagaucugaugcccucuuccaguaugucuggagacaguuacaguguccuuacauauaauaaauaaaucuuuaaaaaaaaaaucaaagucacacucauuuuaaggcugucacucugauggcaacagagauggggggaucauugggaccacagagcaggguuuacaagugucaucagguacuucacccacaacuccugacagaacccugcuuguuacagagugaaaugccuuucuguggcugccccagggccccaucaccucaacuccuucauuucaaagaccaccuuugccaggaugccugacacaccugacuccucaauacagcaugguaacaacucucaggcucugcucagaacucaguccugagguugcuguucugauucaguuuccccguggcuccacugaccagagcucugcucacuauucgcccuuccgauggucaguggggugcacagaugcgcccaggaucuggaugggaguggcaaacugcagcugucuugcagacucucaguacauauucccugaauagccucacaaugaagcagacagcaucagucuccuguaugagggagguaccugaagcacagagaggucacgcaggccuuagaucaccugacugcgccuugaugggugugauuuaacacaggugcuccgauuccagucuauuagucccuauuccagguucuaugcagaagaaacacagaaagaaggcauauuaggagucauuggcggcuucugaacagcgagaggggaccuaaauccugagaguugugagcucagggggagaaacuaaagggaaaguguuuguggggggagaaaaaucccauguaucagccaccuccuggcgcugcauuuuaccugcgugagggcuccaauaagugcgccucugaggaauccaaguauugagcagccaccaggcaggagccuaaacagcagcccuucgggauacacaacuggacuaaucacuaggcuugacuccccaacggggucuuuggucauuccaggcugugcuuccuggcugguguuuuugaaaagggauuggcauggauuuguaagucuagguggcuccuauugcucucugugagccuuaagucccagccuugggugacccuugcuugcucagcguucuucugcacuuggggaacaaucauccacuugacucaccuccuaaugucccaaaaccucgacccuuaacuccauaccuacuagucggaagagauugucccagucccaauuauuagaaggaaacggaagcacgaagucugccggugguggggugucucuaucaaaccaccuucuuuaagggugacuuccuaccauguaccuucgaaagagaaccagaaaggggaaaaaaaaucagcacaguagcucacuucuaggcagauuuuucuuugcuuccucccuuugacaguccggcuccauuguccagcccgagggaacugagggaggauuuggacucuacucaacacaggguagaugaggcaggaauagguuccaaugcccuaguucuuggucaccucucacucuccgugacuuaagucacucuguccuguguuuaugcauuaagccagcgacaagcuccccaacucauacucucaggauuggcaaccuucucucuccguacucaccaggacuauccuggugcucagagggacccagagugcuacagucuuccuuaaacagagaaaucguagaucaucuccaugccacgaagccgcgggccgcugcuucggcgagcaccguggaucgcugggucugcauuucuccaguccuaccgauuuggguggcucuggcagcguuggcuuugaaauggaauugcggcuggaagggauuggggcacaacagcacacacgggaugcaaauggucacugggagauccccuuacaccucaucccuccuccucccaauucuggcauuucgccagcgccgccagaccagcccuucccugcgcccacacaagaggagcagagaagagcaaagccccaagccggccucccuggcugguggccgcgcgaacuggcccccagcgcccgggucccgccggggcgcgcgcgcgcaucccgagcccgcuaggaaggcccacaaagcuaaagcccgggccccgggcccaggccgggagagcacggagcggggcggggcggggcgguccaggcgggccgggggugucggaugucacccccccgcguacaccucggccaggaggcggggaagcgaaccacugagaugaggagaccuccucgguccuagagcggugcaggaagugucccaggggagggagccggagggcuccggccuuuccuuuccgcggcggcccggccuacgcggcccgccaaccgggacgcugcgcagcggugaguauacuguggcccggcuucccaugccccgcugucugaacccggaacccgcuccccacuucccgcgcucugauccccagcccgcgccuggguccugcucccuguucuccucuucccgcguccgggcccagaucccugcucccagagccgcguccucauaggugcccucggggaugaagcaauacaauucucuuccaggcgucucccuucgcucccaagcccagcugaugcauucuagaggaucccgagacaggguuggccuggccagggaccgagucuggcccaugcauuggagccgccucugccaaaacaccagagagaccgagcuggaaggugaggaucugcucgccugcugucccgggcuucgaaggaaagagccagcaaaucugaaagaguggaagcgacagaaaccccauaguucuccuggccuaaaacacccuccucuuccuccuccuccugcucuucauuccuucccugggauccugcgccuucaauaacugcuuugggcaagccccgccccugcgggagcccuccccucccuaacgguaguucauucauaaagcuuccgcucccgaggcuccugcgcgccaggugccagagugacaaagaggcacacgcuugucuggccuagggcucuuugagagcagucccccagcagaaccgggugcugagggugggacccuggacacacuauccuaaguguagaccugagccauucagggcccagcaggugggagacagugggcggaggaagcaggagagagcgggcggggcccggauuggguucuuaauacgggaguaagacgugagaguagucgagguucacagccuguugcuuucagaagcucgcgucgggugucugccuuuacuucggcaaucagaggaauacagaaaaguugagguuccagguuguuauucgguugcuugguggcuuucugguaucgcuugucuuccagcaaaguggugcugccccgcugggagucucuuccaggugaggguguaaagggccaggcagugagcggcccugccugggcuuuuccggaaucccgagagcccaacucggugacuccguuuaccuuuucuccgaguguuccaaagugugggucaaguggagagaccgugauauacugugccccugguguguuugcuggauuguguaugugauagucgggcugaaagccuggcggugacugccuccucucucaugaccaggaagggccacaaugucacuauguguaccacugccuuaaggagaaucuggagaaaacaagggauaggcucagacggaacacuaguagcuuuuuuuuuuuuagccacauuuuuagguacuaaaauauaauuacauaacuacccccuucccuucccuccagccccuuuuacucacacacacacacacacacacacuuaugcacgcaccugcacacuuaacuauauaacaagaacuuaaaaauuuuuuuugagauuuaaauuuuuaauaacauguauaccuguguagauaucuuugugugagucuaugcccuugggugcggugcccauggaggcucgaagagggugugggaaacacuuacaggacuuuguggacagagggaaaaguaguguguacucucaaccaaccacucagcugcuucugcagccccuguguuggaccaggugcguguaaggcuugucauaaagcacuguauggggaagaggcacagucuuagcugcaacucugacacugagcuguacccccaggccuagcauuggugguuuuaaauacaagucuuacuuuaacgcucugaguuccuucuguaccugggaguuuuuguccuugccagcacagagugaaaguuucugucccuggcagagugacauuguuccacgguggucuugcauaacuucccuugcauauuuuuuuuuccuccaguucaauuugugaagaccucaagaacagagacggugacuucgacuccaaagcuucaagauuguggccugcuggggcuauuauccuccaggaggaccuguccaucaaagguaucacaaaccuugguuacacauagaugccuguggccuccuuguucuccugggguacugggaaugccaguguccuguugaaucgccaccacuuuucucccaaaugcccugccuucuuuacugccacauguuaggggacuccucauggagugauggcuugugggaagggucaucuuucuuucgguucccauguguaaggaccagccacaccaacacuucguacauuucccaggaauuccucaaagggcuggucucccaugggcucugccuagcacccccucagaaguggccacaggagaccagagcauugaagccagugauuucuguuuggaaauagggucgucuucugccgcugacccccaucaaaucccaucaugcccacagcccugugcccacgagucuuggcuccaaaggaaagugaggagcccaggaaaaugaggaguccuccuggagagaaccccagcccucagggugagccucccagcccagaguccucucgacgccucuuccgccgcuuccgcuaccaggaggccgcaggcccucgggaggcccugcagcgccucugggagcugugccggggcuggcugaggcucgaaaggcacacgaaggagcagauccuggagcuacuggugcuggagcaguucuuggcuauccugccgugggagauccagagcugggugcgagcccaggagccugagagcggagagcaggcuguggcugcaguagaggcucuggaacgggagccagggagacccuggcagugggugagcaccgggcgucugggagaggggagcccuugcugacccugugagacuucugaccccagaugagaaauucuguccagacccaguuugcuuucuuuccuaagaaagcaaacauuacucucuaugaagucuaaguugagaugauuguuacccaucaaguccauggauggcaagaccagaaagggagaaggccuacacagaucugugcagagccuaugggccgggcuuuaucauacuccucucucucuaccuggcccugaucugcugcuuucugggauugcagcucaagcacugugaagacccgguggugauugacgauggcgacgggccugcugcgccucaggaccuggaacaagaacgaaugucagcagagucccagagcuacccugaugccccgccuggggcucuaguacagggcacugggcuucuaagcagaucaccaggccagccuagcgaagacuuagguaugcagucuguagugugagcuugagaguugaauuauacacuaccagugugcuuggguguugacuaaagugauggccuuuuuacauucuguuuucucgucuccucugaacugugcacgauuacuguguucugggucuuucugcagagcaaccgacacagagucucuugguauugaguccucccagagggaaggccugugugaacagauggugugagauuauauggucuucuuucuuugagaguauucucaguggagacagagaaagucacuguagaaccaggaccuguggccugaucugagcauggcucugucuucuguucucucgaaaccacauuuucuuggcuagguuacucugcagcuauaagaacaucuaaaauccccugggagagagcaguagccucuccugcagauggcuccagugcccuguggcaggguuugaguaucuguuuaaaccauccaacagcugcaaagaggggggaaguguuagacucaaagccugagccauuguuccuuugaguuacaguaggucaucucuagguuccuugagguuugcuuccccaaggccccucaaggcccagggaccccguaucccucuuauaagccuugccaccacaacaguacucuuaauuauaauggaaaaggugcauuuuugagauuuuuuuuuuguuacuucuggcguugacucuguucagugguuggagguacagcucugugguggaccaucugcuuagcgugcacacaccccuaguuccgucuccagcaccuuaucuagacuaaaaacaaaaccugcuucuguuuuuucuuguucuccuuucuuccucuucccaucccuuccucaggcugcccucaaacuggugagucuccuaccucagccuccugagugcugcaguuacaggcccacucaaccauaguuggcaauuagagucuuuuguuuuaaaaaaaaagaaaguguguguguguguguguguguguguguguguguauguguguguauauuuuccugccugccaguguuuacugacuucuguacaaaucagaacucuucugucccucuggcuggaaggaccaucuguguugaugcgguggcacugcccaccuguguucuacacguugaauugcuucuccaacagcaguuaguuucuucucucauggcugugagguugacuggucagccuuggguucuucugagccuccuugaguuagcagacagacaaccacuccuugcuguaucuuccaucugccugucuucucgauaacccuccuuagugacaccaguuagguugaguuugggcgcaugcucaugaacucauuuuaacuuaauugauucuuuagagagccuuccuccaaauacagucacauucugaggugccuaggauuagagcuugugaauuuacagggaccauaguucaaauauaucaggcacuauaaggaaaggaccauucccccaagucaacacuacugugcgagcagccguuauauacauaugagcccuucuaggggagggaugcccagggagaggccugcugugagggaucuucuagaacaccaguuguguccacucagacuuggguugcuuccuugggcaguacucgauacagaauuuccugaugucagcaauugggaagacauuuaacacuaggacgaccuacuagcuucuaacugugaugcucuucugccaaaguagccucuggguagaaugaaacguugauccauccauaauagguggcaggcacuagggagcagaauuaaacuuuucuuccagauauaaauucaguauaugagcaagauugagcggugcuugucaucccgugcugugucacccugugcccgcucugguucuuaggaugugcuuuccauguugcacaggaaagauaggaugccacccuucaugacugagucgcaucucaagugucuauauguuugcuugcauauuuuccccgucugucucgcucugucucucugucugucucucucauguuguuuuucuuuuugagauaggacuuccugacugccaugaaacucucguuauguauccucaaacuugagacccaccuaccucuaccucccacgugcugggaaaaaaauuaagagacaauaugcagcuggaugugaugguacauggcuuuaauauacauacauacugugcacucgugcacgcgcacgcgaacacacacacacacacacacacacaguguuagguuauguugucccuauugaucgucuucuccuuccuuguguucauuucucccccacucuacccuacugcccuccuucccacccagguguucugugucccuguccuccccuauucuuaaccaaucuucucucucguagaccguauuuucuuaucuauccaucugccgauagacacugugauccucugacagcuauugugccugauuccccagggaacgugacagugacuugccccuuugagauuuuauuucuuuugugguuucuagucacaagagggauuguucaguaauaacaguuuuguucauuuuuugaagaccugcuguuuuuccuaauggcugugcuaauucacauucucaauaagguacaggauucucuuuaacugcauccacacuaacuucuuaaacagccuuuuuuggaacugugcaggugacaaguucacaagugguccacaugggcccucccuucacugaacugccaguuuuagccuuuuagccuucauuuaggcuuuuuuuuuuuuuuuuuuaugugaacacuuaauaccggugcaaacaugcuuuguuguaaaugugauagucagaggaugacuuguaggucccugggauugaacucaagucauuguguuagcagcaagugcacuuucucauugagccaucucaccagcccuguauuuauuuuuugagacaugguggucucauccuaaaggcuggccgauucuccugccucuucuaaaggcugggauuacaggccuguaacacuguauucuuagcauauuuagaugcugagacaaguuccuggauuuucagggguugaauaucaaauugaucgggccauccuaaacccagccuucccugagauagccccccauugucuaucugaaaagacuuccagaacccuguggugguuugcaaagugcucauuuuucaaguuauggggagcagcaggaguuuuccuaguuaugcagggcaacaggaguggcucccuguuggcccucucugcuucucucuccuugcacaaucuguagcacagagccagcccuggaagucugggaggcguuggggaccagccuggcucccuuugggacaucuuuuccauuucuuccaguuccgcaagaugcguucguugugcaggagcagagcaucagggaugcccagcccguggccaccugccagcuucccccggugagugauuaccaaaagcugaucucuaaggugccccaugggauaguuuucuaggacucgggccugccugcucuuugccacagcauguagccuuagcccaaagaaccaaggugaacagggaaccaaugggcuuaaagaugcccauugcuucugcuguuuccugaagcucaaagugcugcuugcccgcccacuuuagaaaacugcagauguacauagaaagccacuggaggagacuucucuccuuuucugaguuccuucaguggaagggagaaaccacagcuccuuacuucucaaggaaggaaggaaggaaggaaggaaggaaggaaggaaggaaggaaggaaggaagcuuuaaugaggccaucuucucauuaguagcugcauuucaggaagagagcauagugguugcugcaccguuacaugaccagguguaugucacauggggcuuccauggugugcccugucuguguucccgguccaaguuugcuucaguguccuuggugggaguggguggggucgguggguggggucggggggugggguucagagugggcacagcugggaucuggucucacgaguggcacacuuauuuauuuccuuccuucaucugacugccuagguuuucaacagaccucuuagcuuuccccuuucugcugcccugcaugaugcuacacuguaaaacacacacacacacacacacacacacacacacacacacacacacugugggcuuugcagaguauaggacugccccaguagaagacuguucagaagaggcaaaaaggaacaaccccaucuccagaaugcuuagagcgauuugaaguggguauugaaaaauucgcauacauaaaaugaggacuugggauaagacccaaguuuacacagguaauucauuuguuucauauauaucucauaugcagaugaagguuauuuugugcuguuuguuuuuaagaguuaguuguuuauuugugucugcugcuuacuuucugccaccagucacugacuuugaggcuagcuuggccccucccuuucucucuguagcaucacuuccugugcuguggccugaauguuuggucauuuuccccacccccaacucucuccauuuuuuuuuuuuuuuugagaguuacaggagggagcuuuggggaggucauagcgcagaguccucuaaaugaauuggugcuuucauaaauaggcuugcuugguugguaaaguugucuugcuagcaugaggaccugaacucaucccccagaacccacauaaaagccaggcuaguagcacacauuuagucccaguacuggggaggcagaaccagguagauccugggcucccccugccgacuuggugacuuucaggccagagagcgaccuccaucuaccacagauggcaaaaacucuaaagcuagaugggaauaaggccugaaguuaugcguguggagguuccuguauucacggccacacaugccaaugugugugcauguacgggcuagagagguggcccagcaguuaaggcacuggcugcucuucuggaggaccuggauuugauucccugcaccccuguggcagcucacagcuauuuguaacuccauuuccgugguauucagcgcccucuucuggccuucugaggcaccagcugcucaagcaguacacaagacauacagguaaagcaaccauauacauaaauuuuuaaauccuuuuaauguuuuaaaagaacaaggagguggcacuauaccgaugggagcugaugguggagggcuuugacacauucccagagccaccacggacagacagcaacuggaaagugucuauaggaccagagaccaaggaauccaugagguuuugggaguaggaaaauuucagguuguucacacugaaccuucacugguuguagaugaccgcacaggacaggacagaaacugucaaaggggaaggaggccagucuaagaacaaaagaguuugggguuuguuuguuguuuguuucuuucuuuguuuuuucccuucuuuugggacugauuugaacacuguagcccaggcuagccuugcacucauggcagucuuccugccucgggcucccaggugccaguaggauuauauagugaaggcguguggcaccaugucuaccuccuaagucuugcuccuucucggcugauuguuuucaaaaagcagacuccacuguggccuugagagacccucagcagaggaaaacaacauggggcagauggguuuauuuuccucugcuggcuuagccugaaacugaguuagaaaugacccagucucucucccuucucuagccuaggacuuagaacaucucagaauuuuuuucuaccauuuccucuuuauuuuuaaagguuuauuuuguauguaugaauguauaccacgugguugugagucaccauguggguccccuguaaaagcaaguauucuuaacugcuaagcccucucuccagcccccuccuuguuuuccacaggacuuuuccagagaaagccucccaggugacuacuguauuuuacuauguguguuuaaaaucaucuuguguucagucucauccucuuuggggaaggcucaguccuaggaaguuguuuucuauaaaggaaggagguggacagaccagaucugugauauguccuuucaccucguugccacagugguaggagacagagaaaggggaaggagaauauccugacaccgugaggccuggucuguauuuuuagaaguagcuuguuuuggaaaaguguaggcaggugguugaguuuuuuugagccagcauaaugugguuggaauuugcucugccaauuuacauaguugggagagauaaaacguucagcacuggguuagagagguggcucggcgggugagagcacugacugcucacccagagguccugaguucaauucccagcuaccacaugguggcucacaaccaucaucaguaaugggaucugaugcccuguucuggugugucugacgacagcgacaguguacuuauacacauaaacuaaauaaacuuaaaaaaaaauguucagcacuuagaggguguaacagucaaaggacuacaacauacaacuguuaagccagccuauaauaguuguuauugcuuuuucugaacaaugaaaauauuuaguaaugaacuaaacauucacuaccagacuaagucuggggaaguccgagaggccugggggagcuggguggcuucuugucuaacauuuuccacguggaucuuuguucccacacagcaagauacucauccaguccacccaccuccuuacucugucacugugcacugcaaggcagguccauuguuuaguuacugcuuucacguuggacuguggugaagagucccccauaagcaagcugguggcaucagaagcagcaccgccauugcagggcuuccagagaagcucagggcuccuccugcuccugguaaacacuuggaagaauuuggccaaagagagcccccaacagaaaaguaauugcuuugaucuaagaaggguuugaggugagcacuguuggugucucugagucaguauggauacaggcacacugucucuugugagccaucuuggauugugucucagggcccauggguggccgcuuucuccccaagcaccacggguuuagcguguuguguaugacuugauggugauuaagccugggucaguccuacagcauccagguuugucuggaccuucaucuuaguucguuauaggcuuaguccauugaggcgucuuuuguuuuucguucagugucugccugugugauaauauuguaguuaauuugaggguguagcaagcaugugagugagugaguggccuggauugacuagagcuacugguuggcuaggcagaaggugugagguugguuuugacugguggucccuccgaggaggaggaggaggugccucgcauggcaccgugaaagcuuugcagauggauggcaggcuaagcagucagcucucugugucagggcagaagggacaagaauaagagcccauaagcaccucagcaaccugcaugguagcacacgccuuuacuccacacagcccugcaugguagcacacgccuuuacuccaaguacuugggagacugaggcaggcaggugaauucuggucuauacagugagaccuugucucgaacaacagcaaaaccaaaaggcuggagaaauggcucagggguuagggguacuggcugcucuuacagaggaccuggguucaauuacuaacaucuaucuacauggccacuucaacugccuguuaacaccagucccaagagaucggaugcccuuuuuuggccucaauaggaacugcaugcauauggggcgcagacauauaugcaggcagaccacccauacaacauaaauaaaucuuuuuuaaaaauuuaauuaaaccuuuucuuuuuaguagcuuaaaauaacaaucuaaaacacaaggacauuaacuggcuuaugcagcaaaaucaaaaaauacucucaagaacaaaauuagugucgagacuguacaggaaucaggguguccagcaggaauuagcaguucaaggggcuggagacagcucagcaguuaagagcacuuguugcucuugcagagaacuuggguauaguucccaauauucccauaguuaccaucuguaaccaguuccagaggggcucauggcuucuuuugaccuuugagggcaccaggcacucacaugguacagauauauacauucaggcaacacagucauacacaaaaaaagaaaucuucuuuuuaaaaaaaauuauuaaaaauaaucagcagcuuaugacuuagccagacccuugagcaaaaguccaucuccagccagcacuagcucucugcucagaaagaagcagagccauacucggucggcccagugacaggugacauccaucaggugggagaguggauugcuccuuuugguuuggccacaagaguccucaccaaggauccugguccucuccagggucucaagcacuuucuucugagcucuguucccaguaaaugaaaccaccaaccugggcuuagguagcucacucuccuugguccaguacaaaaggugguuuaccaaagaugguuccucccuuaacagccuuaguaaguucuuggcaacaccuacaaauacccuuuucagaagcuaaagaagcucgggccccaggggaggauguucaaacaucugugcuucccaaagggauguaucugaaauugcaaagaacugaaagucaggcucuaggccaggcaagguuguaaguucccauaaauuuagcggaggcucaauuucauuuguucuuucuaccaacccagaggccuagaaguguaggcacggugagaauguaaugauacuggguagaaccuggaaagccccuuccaccauggucuuuuuuggguuuuugagacaagguuucucuguguaguccugacuguucuggaacucacucuguaaaccaggcuggccucaaacuuauguagcucugccugccucugccucccgagugcugggauuaaaagugugccaccacugcucaggaagggcaccaaacccaaagaagcaggcucuuuccacacucugcccugcccugacuugauuucuugccucugaagucauuaggcauaagugccuguguuacaugccaccuggccgugguaucccaccaucagcuaauacucaggaaggcccugcuccuccucagcugacacagcccugcucuacuuucagaaccgagucuccccauuuaaggacaugauuuuaugcuucucagaagaggacuggucccuucuggacccggcacagacugguuucuauggcgaauucaucauuggggaagacuaugcagucuccaugccuccaaguaagaccuagcucccaugcagccagguauauggaagguggguggaggccccacucugaacgugggacgcuaccugugagguuaagguaccguggcugaaucugauucucuguuuacccucuuaccuugaaaggacuuacucugugcaggacucaguuuccaucaguuuccagucauucuugcucgaauggcccuuucuuucuuauguacccagugggccucagagagaugguccuaagcccuggccugcucuguagcgugccuccuuucacccuaccccaaucugucuguccuuguucuccuuuauagccccacugguaccugccacagcgcauuggccaucccuccucagucuccucugguguugaacagagguuacccacaacagcaggucccuguuaaagguguccuuguccuaccucuuuguuaauagaugagccuccaguucagccaggccacucccaugaagaggagaacggguugcgggucacagaguggacgacagaccuccaggauaaagaaaucccccaggccuccugcuuaggugagugacagucagagguggguggacagcaggguggaaaccgauugcagccagagcaccccagcauuccuccccagcuccccacucuuggcauuaccucagagucuuaccuugacucuggcuucucguagagagugggcaggcgagggguggcuaugcauagagauuguauuccucaaccaaggacuuguagagaaggaaaugucuucugcuaucuagaguagccuuagguuuguaauaaaguccucucuagaagaguggucagaugcauauggcugaggacccggcacaaagugcaacccuuuuagacacugcuagccugcuccccacccacucacaagagugcuuggagaauuccauggggagggaugggugaagauucauucugugugugugucuauguguguauaaccugugcuaugaaguggcguggccuugaacagaaucaacagcaacccuggaccuccauccccucugaccccugugugugugugugugugugugugugugugugugugucugugugugugucugugugugugugugucuguguguguauaaucugugcuaugaaggcacauggccuuggacagaaucagcaguaacacuggaccuccauucccucuggccccucccaucucuguccuguaggcucaacacagucuguuuguggaaggucugugugccgugcagggccuaccauggaagguguuacccaucuguaguagaacuagaaccuacauuaauugaguccaacuucagaaccuagguucaugguguuugcucacuugccuucagguuccuucacucagcagaaugacgccucgugcucgccccagaaggagcgcagcaccugcagaucauagccugccucuuccuuaguggcuucugaguagugauaucgguaugugacaaaucacuuucuccauucucuuuggaaagaccuuuccagccuccagccauuccaaggagaagaaagaaggaagugggaggagcugcaggugccagagcuccagcccugcccacagguggugcucagucagagucccuguccaggugaggagccuggugugcuugguaugaaguggagaacuggggcuggguauuaaacugcccaaggcuccugcugacugcugcccugcucauugccuugcccggguggacugucaaggcuaaccuagcacugcucuguaugucgugagugugccuuuaccugauuguggauaaccagaaucccaagaugaucucauuaagaggagcuucuagaaugcagaagcugcacgguugcccucccucccuguauggagucuugagucauggaaaaguaaccaccagcagaggccgacuaguguccugucuuuaacauucauauuucuagcuucagcugccagugccagggacagcuucugugugcugacuaugagaaaucacuucccagguuuuacugggugugguggucucuucuuuaucuuuuuuuuuuuccuuguuuuuuuuuguuuuuucaagacaggguuuccaggauagccuuggcuguccuggaacucacucuguagaccaggcuguccuugaacucagaaaucugccugucucuaccccccaagugcugggauuaaagcugugggccaccacugccuggcgaugcuggucucuucguuuuuuguuuuguuuuuucaagacaggguuucucuguguagcccuggcuguccuggaacucacucuguagaccaggcugugcuagaacucagaaacccgccugccucugccucccaagugcugggauuaaaggcaugcgccaccaccuccuggcgcuggucucuucuuaaucacugcugacuccuuagcuccagcugaccagcaucaauuguuccaacaaagcagauguuucaguuuaguaguucuggucucuucuuagucacagcuguuucuucccaacugacgagaaccauggcauacaaauggcgcugagcgucugucuuuccccccugaaacauuacaaauguugccucuugugcacugcccugagcugaacguuaguucccucauuaguucacuaagcucagaacacucaguggcuuuuccagcccaaaguccaaaugccaccauaauccuccagagacugugcucagucggucacagcagugacaaccuugcaccaauugauuuuaaucuuucuguugcgaaaaacacaauuauauccuuaguaaauuauaugauuuuuuuccgauuaugugucuaucugugugacuguguacaugugaaucuaguaccuucaaaggccggaagaguguguaagauccccaggagcuggagugacaggccuggauccuugugacugagcacagagccgucucaccagcccuuauacaguuuacuuucuaaagacuguucugauucagcaucagggccuucuuccuguugcucucaaggcgacagaggccaucguauauauauccagagacccagcccuccuagcuucuguacaagguugcucugagacaguaaucauguguccauuauuuaugugaacaccagagcuccuaucagcugugcugagguccugaaagcuggagucacuggcagccauguauuuuuuguaguuuguuugggguucuuauuguuguuuuuguuuucuuauucuuguuguuuggagacagugucucucuacagcccuagcuggucugaaacauguuauguagaccaggcuggcuucacacucagaaagcugccugccucugccuuuccagugcugggaugaagggcgggcugccgccacagccagcuuuuuuuucuuucuucuuuuuuuuuuuuucuguacuguggauugaacccagccuggguuugugaaugcuagaugaguauucugcuaagccauucaugccuaaaaccuaggcuugcuuuuugagcugaugaucgggucagagacuggaggcauaucucauuuagaaccugugcuuagcguguacaaggacaggaauuugguccccaacaucacagaguaggaaaguuuggagcucuagcuccaacuguagcuauugcguauuuggacgccccacccccuuucccuaggguuugguuuuuuuuuuuuuuuuuuuuugcuaaaaugaaaacugacuaaagccacuuaagaaaacacugcccaucuuccaguuccaguuucuuuucuucaguaucuaaauuuucucucuccagauuuuaauuuaagcagcaaaaagaaagaaaacagcaucuucaacauagaacauucaacauuagcaaucucuucagcuaaaucuccuuuuuaucacuuagcuucuugugacagaaugccuagccauggcuuagccacguuccaccacugggcacgaaucaccuuccccuuacagcaggacuucgugcugguuuucaucugagagguuccucccagaagcacuuuaaauaggccuguuucugccagucaccucuucacaucugucaauaacacgcaccguaagccuucucccgguuccaaagcagcuuccgcacguccccaugcuucuaauagcuguccccaugauagaaaagccaugagccugaggcuggcagaguagcucaucacagacggagauuuuuuuuuauuuucuuaaauguguguguauuugcugguagaggucagaagagggcaucaacuccccuagaaaugaguaauaggcccuuaugagcugccccauggugcuguauuuccccucuaagcagcugcuacggccucacacuggccaagcuuuaagcacauaaaaguuucucucaguugcagagaccacuagugcaggaucagggucuccuuaggguagguuucuucccaggucucccucucaccucccaccucuucacugugaccuacagggucucacugcaucagguuuccucuuguagaaacacaaguuguguugggaccuauuagccucauuuuaacuuaccucugucuucuccuauuuaaaaccaguggugugguaaaaggauucauuguuauuuuuuccuguauguacuggugcgcauccuuccugucacccgcugcuccucuuugcaaguagcuuccuuucugcuugagauacugaguauuagaggcagagcuuuguaugugccaggcaagcucuuauacuaaguuaccuaggcuagccuugaacuuccucuguaacccugaugauucuuaaacuuucggguauugugucugguuuuuuguuuuguuuucuuuuuucuacacgggguuucucuguguagcccuaaacuguugaggaacuugcucuguagaccaggcugaccucaaacugccugccucuccuccugggugcuaggaucaaagaugugcaccacuacugucuggcuccauucuuaaacuuucaauccuccugccucagccuccugugcagcuugcauuacagggugucccaccaggcuggcucauuuuucccuucuuaagagguuucuuuucauuuuguaucuguguaugcaggugguugccuguggagaccaucagagucucuggaggaggaguucuagguuguaagcugcauguccuuggaacagaguggcugaccuggaacucacucuguagaccaggccagccucgaacucagaucugccugccucugccucccaagugcugggauuaaaggcaugcgucaccaguguccagcagcagcaagcacucuuuacuaagcugucucuccagucuuccuuucaaaauucuagguucuacauagaagucaauuuggcuuuugaaaagcugucccagauauaguggcacucugcuacccugaggguuacuucagcuguugaguguuugaguuugggggcacagucaguuugguugggacugucauagauauuucaucuccuagugcauaaagaagagaccuuuguagucuacaguagcacuuuuuuguuuguuuguuuguuuuuugucuuuucuuuuuguuuuuuuuugagacaggguuucucuguggcuguccuggaacucacucuguagaccaggcuggccucgaacucagaaaucugccugccucugccucccaagugcugggauuaaaggcaugcaccaccacgccuggcaaguaauauaaauguugaaauuuuucacaggugagugucaguucuuagaauuuuaagucccaguagcucaggaagaaaugguuuugaaagugaaggauuaggggaaaacagcaggaaagccagaaagaaagagacaauugcuaucccaacagccuguacugggcaaccaggcccucaggagucaccaaggaacacuacaaccccagggagucugggcccacaguuaagccuuucuaaguagggucccuaagaucuggacaguuccacugaccauaccgguuuccuguagcaggaggugacccgccagcccucaagagcagucuggaccaggaggugaccaucgagaucgugcuguccagcucuggggaugaggacucccagcacagcccauacugcacagaggagcugaggagcccuccagaagaccugcacagugucccagcccaccagagcaacgcuagugcugagggggaggugcaaaccucacagaaaucuuacgugugcccaaacuguggaaagaucuuccgcuggagggucaacuucauccggcaccugcgcagccgcagggagcagaagccacacaaaugcucagugugcggggaguuauucagugacagcgaggaccuggauggucaccuagagacccacgaggcccagaagcccuacaggugcacugccugcgggaagagcuuccgccucaacucacaccucaucucucaccgccggauccaccugcagccagccagccagcagcccaugaagaagagugaggaagaagcucuggaaacagagggcacgggugccagcgaccugcuggagaagagcaaagccaagcugagcuuccaguguggggacugugagaagagcuuccagcggcaugaccaucuggugagacaccguagacacugucaucuaaaggaugagacccgucccuuccagugucgguacugugucaaaacuuuccgacagaauuaugaccuccuccgccaugagcgccugcacaugaagcgacgcuccaagcaggcucucaacucauacugagcaggguguggccccacaagccagccccugccccagcacagaacccucaccaccugcccuuugcucucagguagugucuaacuucuggugccaugccucuugcuccccagauaaaaagcaguccccugcgcauuccuucuacugugccaaaacccagggaggugauccaaccucaagaccugcaucucuggaucuucagccacuugcucuggcccucaguggggcugggcuacccccaucccaguggugucuagggauggggugaauacaguagggagcuggccaaaagccugcacugacgucuccucagaagucagccuggguuuagucagggugucagccaggggagcaucccacagauccaccgacggccaggccacuggccaucaggaggucacauuuugaaaguuaaugaauuuauccccacaucuucuuugugccccaagacccuucagaaaugugugcuggaaguugccugucaccacucacauuccuucccguccugucuaggagcugagagccaggcccucaaggcucuucugggcaagcccugcccuggaacagaagcuucugugaagucguccuucauggguagagauuccaaggcauuuauuuagcuuccuagcgcugucgucacuaguacuaaacauaggcucuucuaacagcacacagcauugucacaguuauggaauuugcaaagcuagguccggugucagugggcugguucuuuccgaggcuagaagggggaaugaaucauucugggccugauggucacugacacuugucuguccccggggacuuguacaaccaucucuccaucuuugccuucaucuccgcugugucagucuccaagcuuaccuuuuauacaaggaucccagucuuggguuggggcucacccugucuacuguagcagagccccaccuucaucuggaguggccauuuccaaauacagucacauccugagguacuaggagucaggaccucaacacugggguuugaguggacauagccacaacuccaguuaaucccauggugcuguugcuguuccugccucagaugaaccaaugcaaccuugaggcagccauuccuuugaauguugagcucaguugucugcuuucagggcugcuguccucugccagggagaaucuucauccauggccuuuaaguucagagccugagagucugggaguuguuguugcuaggaaaccucaagcaaccaaacacguggucccacacugcccuggcacacugguguuggccaggcucaguguggcugugacuggaccugagagcugcaggcagccagugggcuguaacggcucucagcagauaggagguuugggaaaugaguucaaggccucuggugcucucuguccugauuuucacaugaagaagccucuaguccagacccaaucaaagacucuuaagacuuuggaacagaguuucuuuuucugcucagugcaucacccagaaauaguaaaugcaauaaaaccauuuggucacaccuuggagaagaaauaaacuguggaagcucuuaguuucuaaau

SEQ ID NO: 6034 - RNA, 7997 nt, Mus musculus
ugcccaaagcaguuauugaaggcgcaggaucccagggaaggaaugaagagcaggaggaggaggaagaggaggguguuuuaggccaggagaacuaugggguuucugucgcuuccacucuuucagauuugcuggcucuuuccuucgaagcccgggacagcaggcgagcagauccucaccuuccagcucggucucucugguguuuuggcagaggcggcuccaaugcaugggccagacucggucccuggccaggccaacccugucucgggauccucuagaaugcaucagcugggcuugggagcgaagggagacgccuggaagagaauuguauugcuucauccccgagggcaccuaugaggacgcggcucugggagcagggaucugggcccggacgcgggaagaggagaacagggagcaggacccaggcgcgggcuggggaucagagcgcgggaaguggggagcggguuccggguucagacagcggggcaugggaagccgggccacaguauacucaccgcugcgcagcgucccgguuggcgggccgcguaggccgggccgccgcggaaaggaaaggccggagcccuccggcucccuccccugggacacuuccugcaccgcucuaggaccgaggaggucuccucaucucagugguucgcuuccccgccuccuggccgagguguacgcgggggggugacauccgacacccccggcccgccuggaccgccccgccccgccccgcuccgugcucucccggccugggcccggggcccgggcuuuagcuuugugggccuuccuagcgggcucgggaugcgcgcgcgcgccccggcgggacccgggcgcugggggccaguucgcgcggccaccagccagggaggccggcuuggggcuuugcucuucucugcuccucuugugugggcgcagggaagggcuggucuggcggcgcuggcgaaaugccagaauugggaggaggagggaugagguguaaggggaucucccagugaccauuugcaucccgugugugcuguugugccccaaucccuuccagccgcaauuccauuucaaagccaacgcugccagagccacccaaaucgguaggacuggagaaaugcagacccagcgauccacggugcucgccgaagcagcggcccgcggcuucguggcauggagaugaucuacgauuucucuguuuaaggaagacuguagcacucugggucccucugagcaccaggauaguccuggugaguacggagagagaagguugccaauccugagaguaugaguuggggagcuugucgcuggcuuaaugcauaaacacaggacagagugacuuaagucacggagagugagaggugaccaagaacuagggcauuggaaccuauuccugccucaucuacccuguguugaguagaguccaaauccucccucaguucccucgggcuggacaauggagccggacugucaaagggaggaagcaaagaaaaaucugccuagaagugagcuacugugcugauuuuuuuuccccuuucugguucucuuucgaagguacaugguaggaagucacccuuaaagaaggugguuugauagagacaccccaccaccggcagacuucgugcuuccguuuccuucuaauaauugggacugggacaaucucuuccgacuaguagguauggaguuaagggucgagguuuugggacauuaggaggugagucaaguggaugauuguuccccaagugcagaagaacgcugagcaagcaagggucacccaaggcugggacuuaaggcucacagagagcaauaggagccaccuagacuuacaaauccaugccaaucccuuuucaaaaacaccagccaggaagcacagccuggaaugaccaaagaccccguuggggagucaagccuagugauuaguccaguuguguaucccgaagggcugcuguuuaggcuccugccugguggcugcucaauacuuggauuccucagaggcgcacuuauuggagcccucacgcagguaaaaugcagcgccaggagguggcugauacaugggauuuuucuccccccacaaacacuuucccuuuaguuucucccccugagcucacaacucucaggauuuagguccccucucgcuguucagaagccgccaaugacuccuaauaugccuucuuucuguguuucuucugcauagaaccuggaauagggacuaauagacuggaaucggagcaccuguguuaaaucacacccaucaaggcgcagucaggugaucuaaggccugcgugaccucucugugcuucagguaccucccucauacaggagacugaugcugucugcuucauugugaggcuauucagggaauauguacugagagucugcaagacagcugcaguuugccacucccauccagauccugggcgcaucugugcaccccacugaccaucggaagggcgaauagugagcagagcucuggucaguggagccacggggaaacugaaucagaacagcaaccucaggacugaguucugagcagagccugagaguuguuaccaugcuguauugaggagucaggugugucaggcauccuggcaaagguggucuuugaaaugaaggaguugaggugauggggcccuggggcagccacagaaaggcauuucacucuguaacaagcaggguucugucaggaguugugggugaaguaccugaugacacuuguaaacccugcucuguggucccaaugauccccccaucucuguugccaucagagugacagccuuaaaaugagugugacuuugauuuuuuuuuuaaagauuuauuuauuauauguaaggacacuguaacugucuccagacauacuggaagagggcaucagaucucauuauggaugguugugagccaccaugugguugcugggacuugaacucaggaccucgggaagagcagucagugcucucaaccacugagccaucucuccagcccgggacuuugacucuugccaagaaugggaaacagacuugaaagucaacuuccuaccccuuggccaugggaguacucuagcuaugguguaacugaggggggccgacugccugggugcaugccugugagucccagcaccugggaagcugaggcaggaagacggagagcuggaggccagccugggcugugcugcaugucuaguagcaaggcagcccaggcuagacucuuaucucaaggggcaaaaacuaaggaaggugggggcaccaacuaacaaaauaggaauauuacuuuuuuuuuccuggggauucuggaaaauuuccagaaaauccgaugucccuuuuuauuccuuuugugauccuuggcaauuauuaacugucaggagauuggagacauugcuuagcuacagaugauuaaagacucauggcaccuuaacuuagcguagaucuagccaguuugaacuggccucccagaaaagauacuuuggccuuuagauccuuuuggccagcucuucucugaaacagggaaaggaagaaguuuagccgggucacugagguagaacuugggggugacacagaggaaccuaagaagaaaacccaacuauaagcagcuagaagggagcagggugguguggcgcacagcuuuaauccuggcagaggcaggcgcauccgugcaaguucaaggucuacagagcugguggucuacagcacgaguucuaggacagccagggcuacccugcauaggaaaacagagaaaagggaaggaaauaauaccaccagggacuggcgaacaguaaaaggaagcugagaaaaauugggagaucacugggagggggcaaaugaggggaauggaggcagauacaaucaaaauacuuuauauaugugucuuuuaucauaccuguaucuugggcuuuagaaacugcuaauuugaguuuuauuacucuuaagccacaguacaugucugaauaucuuagguccaauagacggaacugguuuucuugacaaggguucccaaacaaugugucugauucuuccacauuugcagggaucgcauuuggaugcaugugcaagcugugcuguagccaccucagguccugaaucuuuaggacuugcuggagcucauugcugaucuauuuuggcagguacgggauacucaaaguauuuaucguucuccuugcuguauacaauugguucuauucuuuuguaugacuccaagagguuaaguuacauguuccucugauguuugugauccugugcgucuagcugccuccguagugucacugaucuuaccugagcucucauacucauucucucucacuucucuccccuccuccugguccucuugcuucccuccagccuccuuuagaacucauuaucuuuuagaguaauaccacccuuaaccaguaguuuaacuccccacucccucaaaggggacucauuugucucacuagugcuuauacauguguuacuguaauaaaguaaguuuuuuaaauguaaauuuuucauugugcaguuauauguaagcaauaaaacaaaaauagcauugcuuaaaaaaaaaaaaaaagaaaagaaaauggccgggcaugguggcgcaugccuuuaaucccagcacuugggaggcagaggcagacagauuucugaguucgaggccagaguggucuacugagugaguuccaggacagccagggcuacacagagaaacccugucucgaaaaacaaaacaaaacaaaacaugcuaguaauauguggucaucgaguaacaggugccuuaaggacaaauaggaaaaaaaccaagaagacugagcuugcuuccucggccagacugaacaggguuaggccaaacucaauggcagauuguucccccaccccaaacauauuaauuacacacaucauuaaaugcugggcauaguguugucccuuguaauccuuguacucuagaggcugaagcggggaggaccagucuuuaaggauagccugggauuucagcgagacccugucuaaugaaaaaaagaacguuugugugugugugggggggggggggguggcuaaggauguagcucuguugguacaguguuugucaguauucaccaagcucuacauuaaauccccagcacgaguggugaugcacaccuguaaucuccgcacuccgggacugggggcuggaggaucaggucauggucuccuauauagugagcgaguuuggggucagcuugaaugaugagauacccagucugaaaauaaagaugcaaauugaugagcuguggagcgacacccgcaugcaguugagucaucacgcauauaccuaccuccccacauccuucauggcccccaggaagcuccagcuggcuuacagacugacuuguuuugagauagggucucacuguguagcccugacuggccuggaacccaccgaucugcuugcuucugccuccugagcugcgugauuaaaagcaugugccaccacaccuggcucuauugcauuuauuuauguaugcggugggaguggguacgcacacacacuuuagaggucagagaacagcuuaccgcgaucagcucucucuguccacccuggggauugaacucaggucgccuggcuugcuagccagugucuuugccacagagccaucucagcaggucaguuuacucuuuuaaccugggagagaacaugcggugggccuuuguccuucuguguuacuauuucauuuaacuugaugucuaucccuuuggcuauaagugaagaauuuccuuacggaugccugaauaaaacuccauuuuguauauacacuguguuuucucaauacauucagcuuuagauggcucauaagcugacuccacaucuuaaccagaguaaacauggaagaugggaaccucugcucucucucagaugcuacugauggcauucuuagcuuuuagguugcuggaagugaguggucuguuacuaccuccugaaagaucccaugugaugcuaggucagacacugagguggccagggagugccuguuagagacagccugagauuggcucuggaucuguaacauuccaacucugcacagcaauccugggaguuugaaaggagucugcauuguugaaucuucaaagcagguguggccuccugccccccccccuuucuaguuuuacuccauggugugggggagguaagaguuuguugacggcucauuguugggagcacaaaagcacagagagagccagguuguuaaucacacagggcuauuuccucaguggaggagauaaagccaaauaucugcauuccauccugaaaucugagagugcauuuugugggcaaccugguggaccuuuugcuaucuguggaggcugaccucaaccaaauuccccagagugauuaucccagacucuuccuucccuagaccuuaggggagauguugcaguacuuuauggccugcugaccucuaagcuaucggucagagaccacauuagguucuaggccuuuucccuauagaacccacucacauggccacaaguacuuuguaaaagaguuucugggcuggugagauggcucaguggguaagagcacccaacugcucuucugaagguccagaguucaaaucucaacaaccacaugguggcucacaaccaucuguaacaagaucugucucccucuucuggugugucugaagacagcuacaguguacuuacauauaauaauaaauaaaucuuuuaaaaaaaaaaaaaagaguuucuaaguaguugugguuccuacucugccccacucucccuuaauggcaggcaugagugccuuccaucagaccgguggccugagagagaaaaugaggcaggaaugaauggugggagcggggugggacuggacgggacaguagaguggggguggagggguaugauggagaccucaggcaaugggugagcauggcuagaaacggacuugaaugagcagaaugcuucuucauggaguguuugcuucuuugcacagcucguuuaacuagaggaacaaaggcuauuuaaaaccuuuggugacgccgggcagugguggcgcacgccuuuaaucccagcacucgggaagcagaggcaggcggauuucugaguucaaagccagccuggucuauagagugaguuacagacagccagggcuacacagagaaacccuggcucgaaaacaaaacaacaacaacaaaacccaacuuuggugaguaaguaguugcuuuaaaggugaguguacagccuuguccagggccagugugcuggggacgccucauuugcauacggagggauuccaggugcugcuggacacgaccuuauaaggggaaaggaaguuuaaccuggcuaccggcuacaugaccuccucuaguggggcaaagguggugacaaaggucugugugugccuguccaugcgggcccggugcaauccuacuacugcugauguaucucuggaugagauuuccagggucugggcaggccuccacccgacucuugcuccaggccugcuccccacggcuccccuggcccccacauguagucacaucguaagcuuuauugugcagcuggauuggauugaauguugccuggaaaucuuuucccaaauuguuuugugcuuuaaguaugcugacagugaaccaaccgcccggcguuagauucccugaagucugacccagguggacgacaucagugagcacuggguuuucauuuucgucucugcccaguuuaccugucugacacaugcagggugaccccucagcucauaccggggaaauucagacaauggacccccuaacauagagauccaaaaggagaacuuagcgggugggugcugugagaagguccuggguggaggggccuugguugauaggcuaggguacagcccacuagcagaagguguggugaccauuacuaggagcauguccuuguaaccacauuaguuuaucacugauuguguggacagagccacaguucuauuccacuccugcagccugaaggguucuauuuuccuuuagugaccuucacucagaccaaagagguuagcggcuucaauaaagagacauuuuaaua

SEQ ID NO: 6035 - RNA, 120451 nt, Mus musculus
ccaccaccugcuccaauaucaccuccauugugaagaaugaguuaguucagccuguuaaaaaacacaggcugacuucuggaacugccagccagcugagccuggaaucucaggucaaagugauuccuccuuucugucuugccucccucacucuuucccuuuccucuccuccuuagccuccuuauaaaggucucauuacgguccagacuggccuuaaacucuccacccuccuagaucuacuuucagaguucugggaccacauacuccuuucuuguuccuccuccccacacuuacaccugcauaccuugggaacaguucugcaugcucucugcuuagauccauuucacugcugcugggaacaauuugccuccuaaggagcagggguugucccccuccaucccccuccccuccgcccauucuggacuccucugucguuuccuuuccaaguggccuuuugccugggagucuggacaagaguggccuguaguauauaguucaggcccuucuugcagagugaccuugcacaagcuauucgcagugucugagcuuuugucuccucaagcacaaaacggagguaagagugcguacguaacucuagcagaauugggcucccauaauagaauugacaacuccucacggcugcugacaucuucuagucaccucggaaacacuacgucuuauuacuuaacugcuccgcgcgccucaguuuccuuacguaaaaccggaauggucacgggaagguuauggaacuuuaaugaucuaaaacacgggaagcacuugaaacaauuucuagucuuuaugguggcaucugggucgaccacagaccuagcacacaguaggggcgcaggcuagacgaggcagaaggccgcagcgaagagacuacgagaaagacaggggcccgcagggagaccgcggagaucuccggcguccuuccgggagcagcccagcccaacgccgcagcugucaggccgcgggcggcggcgccaguccaccaaaccugaaaguuccaucccagcgccuccaccuucccagccuggacaaguuaccuugcgcccgcugcucccggucccgcccccgucauccauuggucgacggguuucuuuguuagcaggagcgugcgggugccauuggcucgcggggcugccgguugcggugccccgccccaccccgccccuccccgagugcgcgcggcgcccagcucgguucguucgcgguggcggcgggcgccgggugagcgcgacggcuggacuugccggccggcgccuugggggcggccgcgguggagccagcggccggaggccgcguccguccaugggcccacagcggccgggcggcggggcggggcgcgaggcggcgcgcgcgcucugaggccgcggcgagcaggcggggcgcggcgcgagaggggaggccuuuccgggccugcggcggccagcgcaaaaugcggcggcggccgcgcugaguccccgacccccgggagagcgcugggccguggcggcccgcuccgcggccgccuagccgacaugucggcggccaaggaaaacccgugcaggaaauuucaggccaacaucuucaacaagagcaagugucagaacugcuucaagccccgcgagucgcaucugcucaacgacgaggaccugacgcaggugagcugccgcgggugcggagcugagaguccugccugcgagucgugccggggagcgcagagccugcgaaggccaagagagaauaaaaauggagcagggaaaaaaaaugcgugagaguugggggaugggguuggaaugggggcgggaagaguaucgauagagcugggacaaagggaaaauccucaagaaugccgaaaaauaacauccuuucccguucccauagcucugccgugugauucaugcuuguugggugacucaaaaaaaugucugguuucccuggauaggaacaaaguggggcuugcuugccacuugucaguacuacccccccccucgccccccucgcgacuugucuugggacuggacgcagacuuggccaccaaacugucccaggaauuggcauguuugcgugggucaccaguuuccaucuuguggaauagagccugcucuccuucuaagucacugucaccgucagggucugaagagagaugagguguuucucuucagaugggugggucuugcucuugaacugaagguaggaauagcuuuugucgagggguaggggcuucccuucuugguuuugcuuucuggcccaggagaccaagaagaccuguacauucuggggaaaguugguuucccccucugucugcccuuaauuuguuagucaggauuuuggaccagguuagacgcucuuccuaacccgugucaaagucacagucauggaaaacagaguuccagaccuccaagucacagucauggaaaacauuguccuagauugccaaagaccuccaaccccggagcaguguaggagauugggaauuuguguugguacaaggucuccaauuugggcaacuggcccuugggaacugguugcucucccguuucugguguugaggauuccuggccuuguuugcagcacuuugggaaagcacuauauauccugcuccccuuuccccucgcccacuuccuuugcccccugcuugcugacuucaguggaguuccccacacgguccagccagugccaccuaguuguagccacuccuuuuggaaagagcuguuuagacugaaaacauugcuuugaagugcccugguuuggcuguuuuuaaagccuuuaugggcaagcaggcaggcaagcaagguuugacuuguuuuauggggcaaacuagaguggaguaguagggcagggguuauggccucuuucucugaggucagauuuccaauagccaggaagcaaucaggaagcuuaaccagacucuccaagucucagucauugauuugugagaaugccaagggccuuagagaccugucuauuugggaaggguaggacucuugaagagagagaaaugugauuuccucuucucauuuggauccuguucagggaagcaguauaugggauaugcgguuacugcuugugacuuucugaggucugaccuugaaugaggccuuuaccucuguuuuaauuuccguaucaguaaacugguaguggugauaugaaaaacaagaaauauguuuuauugagcuuucccccuuauaguuuaacaaacugaaaaaccacccauagaacagucaacuuugauuuaagaaguuucuggccuugccaaaggcuguuuugagggagguuuguaaguuuccagguuauuugaagcaacugccuaaacuggcaauuaguuauuuaugcuacacacgggcuguuuuucugauucuuaaaugaaugagaggaauuuaaauguuugagucuguuaaaaaaaaaucugucaauuauuaguuuaauucaagggaugaagcaaauugaaaguauuaaacucucaaguuuguuguuuucaaaaugauugcacuuugaaacaggccugagaccuccagggcacuggaacaguaguuccuaaaauacuggguaggguuauuuguguggggagagauuagcccagucuucuagcuccugggaucuuucaggaaggagcugcucuugaaaggagagcggggaggcuggaggcucuugccaacagcauuugucccugcucuguauccgcuucucccagagcagagccuuuugcucuccuuaugacuccauuagaaaaccucagccaauugguuccugucagccucccccaacccccugcuuccugcugccccucccgcccagagcuuauuuuagacuguccaagcuggaggauacaucagccaucaucaaagccacccccucuguaauaguugaggaugugagucuagggaggcagggacagcuucugcucucaaggaugucaucuucccaggagcauacauuccuuucagccuucugauuugagcuuuauuuccucagcuguugguuuuguuuauuuguuuuucccuagagagguagggaaccucuuucaggccugccuauguuguggcaucaaaccagcaaacacuuggaggucaguuaagcuagccacuuccuuucccugaagaaaccccugaaacucagagaagggaaagccuugcaggaguguaacauggacuccugagugcccucguuguccacagcagccaccccaugaguacaucaggaugguugaguuucagaagaugccucaaagugcuguuuggggccucuggaauucagacuaaucugugauaagguaaucagaguucuugucacccaggugaugugcuugcuccaccccuauucccagggugacaguuuucuucaguccucuucucauuucucuucaugggcccaaguaucacuuaaaccauuuuuuaaaaauguaacuuuucuuuacuguguuacggcaugggcauccucuugucauggugcaccaccaccaugacucgguucucuccuucaucagacuuaggucacugggcuuggcaacacaggccuuuaccugcugagccaucuaucucaccugcccucauucaaccuuuuaaagccugaacuuuguguuuguauuuguucuacaguuuacuuauuucugcuugagaaugucuagagcuccuuuucauguaauuaccucuaaaaacaucaaaucguuuuccauaugggccccuuugggguguacuauaauuuaacccauucccucagugauggccaauuaaggcugcugcugaggucuugcuguuauaaauagugaccauagccagcaagaugguaaaagugcuuguuguguaagcccaagccugguucuuccuccugaauccacauaaagauggaaggagaaaccaagccuauaaaguuauucucugacuuucaccugggugcuauggaauguauaaggccacacacacuucauaaguacaccugugcaugcaaacaacacacuaauuuuaaaaauaaaauaaaugcuguccucuuaaaagauuuauuuuuauuaaauuuaauuaucuggaggagugagggugugugugugugugugagagagagagagagagagagauugauugauugauugauugauuugugcauauauggaaguggaagccaaagguguugaaucccauggagcuggagaugccuaaugugggugcugggaauugaacucugguccucaggaaaaacagcaaaugcucugaacccuugaguugucucuccaccccaguuguauuugucuuagcuuuauagugcuuuugauugggugugugcgugcaggaaugcaaauauuucucuggggcagauaccuaaaaauaaaaugguuggauuaacaucaagcucaccaaauuuccaaaacaguaucauaacauuuucagaaauggacauuaccaaauaauuucauucuuuaaugaguuuccuguuaacccccccuuaaagacuugguuuuuaaguuauuuuuaaacacauguaugcaugugugucuuaaugugaaugugugcaugugaguguagucuugaaggaaucuuacauagccaagcuguccuugaacucuguuugagcuguggcauuccuugacuugcugcuccuccugucuccacuuccaaaaugcugggauuaagcauagguaugccauucuucaucgucuguauugaguuauuuuucuuuguccuguggauuguuuguuugcauugcauuguuugcucaucuucacaucaggccuuccccugaugauacguaguuuuuguauaugaugcuuuuugucagggucuacaaacuuuguacagaggguuuaauauaauuuagccuuugugggccauauagagucuggaauuauguugcuguuaugguacauaaugagcuauagauaacacaggagcccaauggaugugguuguagucugguaaaacuuuauuagcaaaaucaaguagcuaccuggcugcauugaccugggaacaauaguuugucacuucuucucccacacauacauggcagauuuuuuuuuccccccugucucucuauguggcuauuuuuuauacaguaguuuuaaaaugaaugcaguugggacuggggccacagaucaugguagaaucaguauaguaauguacagguggaugcaguuaaaucuguuuuccuuuaucauuugcaauuuuauuaauuuauuagcauuauauauauuuaguguguguguauuauuggcugguuuacaguuauuuuuaugcuuaaguuuuuaaauuuguuggacuugcuuuuaggaaaaaucacaaaacuaaaggcagaggaucuagaagaggccaugaggguaguccagaugaugccuaggaagaucuucccauggcaauguuaagaacuggagagaggcaguugagcagauauccugguagagaaagccaggguguauugaauuauccuuuauuaaaaauguauuuauuuuaugugugugaauuuugccugcuuguguauauguguguucccuugggaggcuagaagagaggguaucagaucacauggaacuagccaucuaccuaguugauugcugaaaaccaaucucagguccccugcaagagcucuuaaccccugagccaucuuuccagccccaguuaucuuuaacacaaacagaaagcaaauuuggaguggguuuagguagaaauucugagguaaaucuaaccuuguggggguguaugaugaguguggcuucuuaagguggagccauccaccuagacuagaagugaauguugagcucaguaaaggucugaguguucauuuggguguuugcugaaguuacagaugggagugguuuauguagaggagauuuaagugcugagagacaaccucgauugccaugugcagguagaagagggaagcccugguagaaggagggagguagcuuagagagggcugcucaaugggggaaccggucucucugggagcuccuaguccuucuggucugauuaugucuuuguuaggcucugacuauauccuacugccauggcucaggggcuauagagugggaagcucugauacagaggacggauauuucuguggaauguuuauuccauuaggguucuguuuggucuccuuauuuucuuaguuccaggauacagaauuugucugacaauaucucaggaacaauggagaaaugucuuguucaucuuuauuuuaacuauguguagcuguugcauguuuggcaggggauguuacugaaguuccagauacauacaguccccuuaccaauaaccaaggucaugagaagauucaguaucauucguuauuagggaaaagcaaauaauaauuacagugagauucuacuucauacucacaggggaugauaauaauucuaaggacaaaaacaaaaagccacacuuuaauaaaaguaggugaagucugaagaaauuucaacccuugggcuuugcugguggggacaagaugguugucacugcuauggaaaacaguucaacaauuucucaagaaguuagaugucaaauuaugugagccagcagcuccagaaaaauugaaaguagguguacucuaauauuuguauguaaauguucauggaagcauacauggccaaaagaugacaaaaguuugaagucauggggccgugguggcauccuguggauccauauaguaaacuguacuuugauucacaaggagacagacugagcauagguguacccagggaccaugaugccaagucagagaugcaggagaucgcacaguauaggaaugaugucucuuuuuauauguguauauuuuuauauacuccuauuuauauguauauauuaauuacauacauaaugaccaguaaguacaucaguagaaacagaaggcagauugguggcuguuagaggcuggggcuucaaaggauggugcagacauugacaguaucugguaguuucuggaguauagauuuuuuuuuuucccuuauagggcaagauagcaaauacuuuagcuuggauagggcaacuggcaaaaucaagacauuuuuauaauuuauauaaccauuuacagaauguaaaaaggagcuaggcauagugauacacaccuauauuauguauauuauauacguacuuaggagguagggggagaagaccacagguuugaggucagccuaggcuacagagugaguaaaaacaaauaaauaaaauguaaaagccacagaaauacuuuacaguuuuguuauaagagagugaaaguaugugcauguguguaggggggcggguaggaagauaacuugauggagcugcugcucuccugccuuuauauagaucucaggauugaacuccgggccucagggcuuuugcugcagcagcuuuccacccacugagccaucucgccagccugcccaguuauauuaaucugauauauccaaaagcauuaucauuucaccauguaaagaaguuuaaaugugugcauuucagauuugguucauacagacacauucuuggugucuuagcugugcauagcugcuacccagcagcucuggccauaacugggccuuccagguucuuccauagacgcgggcauggcauguaggaagagagcuuucucuccccucaccucaguguuagccuauagaaagcucugggcuagacaccccuguauuuuucuuuucuuacuugguaccugucugggcccuuucucuugcccuuagugucuuccugccaacuuuugagaguuuuuuuuccuaugaaugucacauuuucuuuaguuauuauaauugauuccuuuuugauauauucaaaaacucacuguggguucugaccccagccuuguuagagacaaaguuuggugacagaaggcagaaggauucuggcuacagcccauaugugcagguuggcuuuuugggaagcgagugaguucucgaguaggccugagugugucacggucucugugcagcacacaguugcugccauuugacugagaccuggcucaugaagcuucuuugaucuuugaucucccaguguuccgcaggugucuuuuagcuugcuucccugggcggaaauuuccuucaaaguuauuuuuuccuugccauccagaaggacagcagcucagagcuguguucucuuugcacaggugugcaaggugacccagaaacuugauuuggggccuuugaucucuggagugggcaccugcuuucugcucauugggagggcaugcuauuggaccugugcagacccugaguaccccuacauagucaucaguguucuaaagcauacugauuugucuuuauuaucuaucugucuaucuaucuaaucauuuauuuauuuaucugcuugccuucauguuuguuuguuugagacagggucucucuguguagcucugacuggcuuggaacuccacuguguagcucaggcuggccucagacucacagagauccaccugucucugccuccugagugcugggauuaaaggugugcaccaccuaaccaacuuaaauguuuauuuuuaagugguugccaagcugcuuaaauuuuuuuaaauuuauuacguuuuucuuugcaugcagcauacgugugugcaugcauauucauucgcauaaugauuuggaauauucagccucggauggaaaacaagucuucuuuauccaggcuucccuuuuuccgucuguaugacauggcugacccagauggauaguuucagacuucuaguaagucccagacuuuuuuaccaaagcacagcuccuaugguacuggcuaggguucugggugacagagggccuugggucaucccugagggccugagaggugauuugagaacugccccagaucuugagcuguuccaguuuccguaguugaagcagcucccggaagugacugccacugcccucuccucuacucccacagugccauuaagcccuucuggaggagguggagagagccaggggguugauuugcuguuuugucucuagagacuggaacuggaaucuuccaaaccacucacugguuuucucagucaaggucacccuaguucacauaaaaccacaguuugguuuugccuggggcugucuuccuggguuuggcucagggauaccacauggccuuggugagugaagcuuguaguggacccaguguauuugacucugcaccuccuucaucgcugccccagccugaguauguuugauuaccugucagauucaugauuccauauggcccaagagauuagaggucagcuugacuggaagcaaccugacuuccaggcagagaaagguacugcgccuggucaucaaguugauccacauugaagcagugacacagaacuuagguccuugugacuccaauuccaguccagcaugggcuaugaacucacuuuccacaguccaggagggccaccuugacauauaaauuugguauuuaucuuuugccugacuugggcaguucuguugucaggaguuggugugcuguagaauaagucacagugcuaagaaggaaggaccuauuccuucccuaccccuucagcccuguuaaguaaaugaguugucuuugcuuaauagauggaacaacuaagagcugugaguuuuuguaccuagguuucaggaaaguuaguaugagcuuuuccagaauuuuauuuggccuccuugcccuugguaaauuaaccuguuaucagagagagauucccuaauuuagggguauuucuaggggauguguguguggaauguguaucuucaccuucugcagcuaugauaagcugcagugaaccucaugucccccaaacaggcuacuggccugugauaauggucacaccuuuagcauaucuaugaacaggagucacugucuuuuccccugaaagaauucagaauugggaaauaaccauguccuugaucuucacagauacugguuuaacagacaaaccagcuccuugguacacucugugcauguaauuucuuacuuucuucuuauucuuacccuggcugaaggggccgugugaaaugggagcagcugcucagagccucaguggaguagagaaagggggucauuuucaagguccccugguuuacacucugagcuucauuguuaggacaagggaagacacgggcuugggagccuugggacucagugaggucaagauaucugccugguuuccacuuugaggaugugcugugaccuagaaaucugacagcugcacugcacguuuccauuuuggugugccacauacgauggacagugggaagagcaguagcaagccuuuagugcagauuccguucacauccaaccuuguuccuguggauugugcaggcuucuuaggguuaagacucuaugcccucagcugaaacuuagggauauuuuaacacccaucuuagaagucuacugaacaauaagauauaaaauacacauacaacccucaguaacugcagggguacgggaggggcugagcucauaaauaccagguagaaugggcacucaguaaacaggauguuuugcaagcacugaacauggaguacagagugaacauguggcacauaggcccugcccuuggaguauacucacuuagcacuuuugucuuuucuguuuaacuaugugacucagccuguccuuaaauucagaauccuccugcuucaguagcuugaauuuugggauuacuggugcaugccaccacaccugguccaucugcccugagugucuacuugacugggccuggcuauauggguagaugccauaaagggcuggaacuaaacagggugcuuagagcuaaaccaggugggagauuuugcugcauaguuuuaugucaacuugucccaagcuaaagucaucugagaggagggaaccucaauuaaggaagugccuccaugagaucaggcuguagguuggccuguaaggcauucucuuaauuagugauugauagaggagggcauaacccaaugugggugggggccauuccugggcuagugggccuggguuccaugagaaagcagacugagcaagccaguaagcagcaccccaccauggccucugcaucagcccuguguccagauuccugcccuguuuaaguuccucccugacuuccuucauugaugaagugauaugaaaguguaagccaaauaaacccuuuccuucucaacuuacuuuuuggacaugguguuucaucaaagccauagaaacccuaagacggagagauuaagacuugagggaccugcuuggacuccguacugaagcugcaauugagaaaaugagcacagauaagggauaucugugaccuucaagagcuaacccucaagccuguugugucucucccggcccaccaguggugagccccuggcccccagugucugucuucuauagcuacucuguaccucgggugcuguuuucacacuggccagagagagcaacaggcucugcuuagucuuguuuguuuguguagguuugguuucuggaagauggcaauaugaagauugaaauguuuugaagacuuuuuauaauacaagaaaugaaagagccagaugucaucagcugagauuucccccucagguugucugaguccucuucauguagaaaguggguagauaacacaggagggagaugcaaaagaaccuagccucaucuaugccauguccccagucugagcuaaacaguugucuuuuaagugccagguaaaaugcugagguagguagcggacagcucuagccauagccaggccaggucagaauugcuggcugggcaagagaucuggccagggugccuuguaggcuguagucuccaacauugaauuggucccucagcuagcauauugucugugcugucucagggcucuuuuagaugcuuagccauauggaauggaaacuacugaaggcucuucccauaagaacguaucaccugggcagacaagcccucuacuuuccaguguaaucugccuuccugccuggaagcuugugaguucucuuuguggaucauaguuagcuggcagcacauggucuuccguggugcacagguguuucugguuugaaauuacaaggguaucaguuugcucuggaguaugucucucucucucucucucucuccccaugauauucauagcugacagaaacuguugucccaggccacuguuaacucuuucauauccacaacauucuuuuuuuuguuuguuuguuuguuuguuuuuuuuuuuuugguuuuucgagacaagguuucucuguguggcccuggcuauccuggaacucacucuguagaccacucuggccucgaacucagaaauccgccugccucugccucccaagugcugggauuaaaggcauucgccaccacugcccggcuuauccacaacauucuuauacgugaagggauaaaggacuagguguggagaagaccugugacuuguuggcaagagcuaugccaaagcauagaccagcucccauccucuugaauagauguagauuagcucucugcaaagugggcaggauagaggauccagucugggcguccuugucuaagugugcuaucucaugccugucuuuccaucaugcuccugcccugguuuuguuuguuuguuugguugguuguuuuuuuugguuuuucgagacaggguuucuuuguguagcccuggcuguccuggaacucacuuuguagaccaggcuggccucgaacucagaaaucugccugccucugccucccgagugcugggauuaaaggcgugcgccaccacgcccggcauuguuuuguuuuuaaugagaaagguggcucugcauggaacuggucaugacuucuguagaaaagcacucgcugcccagaggcugucugacaucucugucauucugcccucucccacaaauggcagccuauucuaauggucuugcagccaugagcaggcugucagagaagagcauuuuaauaacagccucuucccccagcagggccuaggcuuguaggacucucuuagacuaguuggaacagaggggaggagguauagcccauaucuguaggccugccugcuaugugccaaaggugugggaucuguuguauuuuuguuugucuuugaucuuuaagauguaauucauaaaacauaaaauuagccacuugaauucaguugcauuuaacacauucacagugcuaugaaaccagugccaugcuccaguugaaguuguuuucugcaccccagaacaccucauaacugucagcuguccugcaucccacuucguacuccgggugcuuucuacuuugaaucugcuuucuuucacugugggaauuucauaaaauggaaucauagagaccuuucaucggaguuccuugacucaacuaauauucuuaugguuucccuaucuugaguacuauuuagaauuucauucaucuuuuuucauaauucauaauauuucaggauaugacugcacuacauuuuguugauuuauuccucaguuaauggcaucugggucauuucuaccuuuugucaaauggacuagaguugcugugaauauuuguauauagauuuuuauuugagcaucuacugucgcuuuuccaguggaguccugaggguaggaucucuggacugccgcauuucugcuaguggguuggauuugaaucaccccuggggcuagauguuggccugucugucaugugauagagucagccauguagcugccuagagcccaaugagauguuccucuggcuguaaggacagugaacucccagguacuggugcacgcucucagaaaucuugagauuuccacucuuucuacccuuucauuucauuugaguugcugaacuaaacaaacaaacaaacaaacaaacaacuaagguagcuguagggacuguuggcaagagagcucaaggguauaggacuggaaagcuggacagcccaguggugcaggcucacuggagugugagguuacugggggcugcuggaagggacucauguugccuagaauuggaucucagauggucuugggauuuucuggagaggacugagaaggucuuuccucuccagcaagauuauuuggucagccagagccucauagugcaacucugucuuuaaaaaaagagacaagagugaagagguaacuuuggaauucuuggucuaaaaaaggcuauuaaauccuguacuuuuuaagugcuccaguagaggaagagaggauggccaagaugaucaagcaacacuauugacagugcucuuggguucuugaggaagcugggguguacucaugcguauccucaggaaaucuacccuucuugguagcuagaugggacuuuugaagccuaacuaaguaaaccucucuggacucccaucuucuacauguaucacaguucuugugauuauaugcuaauggcuccuguuacaauuucuccuugcuucauucuuuuguuucuccugccuccuucuagaagucuccuuggagagauuugauucugaauuuggucuuugcggcugggcugccugauuugugcuuacccacggggagccucacuggacuccuuucuuuccauccucgccugcccuugcucuguuccuaagaacuaccuccucacacuucacauugauagauuacauuuaucuuuauggucuuagauggucuuaaagauauuuuuauuuauuugugugccuguguuugcacaugugugugugugcacgagugggcauacuugugauguuugcugaugccugguaggucaggugguugugaguaacuugaugugggugcuggaauuugaacucagauccucuggaagagcagcaagcacucuuaccauggagcugauauucuaaguucucuuuuaagagguuuuauuaauagcuacuaaacuuggauacauguucacaaucacaaaggauugaaauaacccuaaggucuaugugaggaaauaguuggucacacagaaaucaguuucugacacaugcuacaauauaaguggaccuugaaaacaugaaguuaaauggaagaagccagacauaagagauaccauguaugauuccauacauacauaaucccagaacaggcaacuccauauagacagcaaguagacuaguaguugccaggcuagaagagauggcagguuuggagaguggcagcuaaagagcucaggucuccuuugggggaugauggcaguguucuaauugguaauagccguacaguacacuacugaguuguacacuuuaaauagguaacuuauaugcaguguacuucuaacuccagaaaauuauuacaagacuauaucuaguuaccaccucuaauucacuuaauguuugggcccacauuaccucuuugucaaaucauuacuacaauguaagauuuuuuucacagugguguggaauuuucccgaguaacuacucugucucccacacagugccagguucuacccauucaugacuaaugagcaucagguaaugggaaagcucugugggggaugggauugcccacuuaugggccaggguaagcaagcaccuguacagugggaagguuagauuuaggaugcucagguguuuggggugcuuaguauguuuguagucuaggaugcuaucaagaggacaaagaguuuaucaagacaggaccuauccuaagccuaggaacaacuguauuugauauuucuuucuccccauauggcuuccugccauuucugucucccaguuccuaccaaagugaaguuaauccucuccaacccauccuuguacuuuuagguuccuguggucauagaagcagcuugcuuuuccacacacagcaugugugcauaccugggugacagcauuaacaggugccuucagacaucaucaguaccccauuugcucaccaguuguuugcuuugucuucacuucuguccagugcugaucuugagcugcucgaggaguagaguuggcuaggcaugcugguccguaccuguaaucccagucuucaagagucugaggcaagagaaucacuaggaguuugaggccagcaaggguuucagaauuagaacaccucuuuagaaaaaacugaaaagagaacuuggggaggugucucaagcugagagcaguggcugcucuugcagaggaccugaguucuguucccagcaaccacaugcuggcuuguaacuauuuguaauuuuagguccaagaguucaccaacuucuguuuuccuuacuacauacauacaugaaaagcacucauacaugaauaaaucacuuuuuguuuugucuuauucuuuuguuuuuuuuagacaaguuaacucuguguagccuuggcuguccuggaacuucacuggagaccaggagagcugggauuaaagguguaugucaccacacccagccacauaaauacaucuuuuaaaaggggaucgagggggauauaggugagacagucuguccuguggguauauuucuucugggaugugugugugcccuauauucuuguuggcccagcacgaccuggacguggcccugagucucaugcaugccugcucagcuuuguacauauucagauucugccucccucccauggaagucucguaaguggcccucugcugucauaccagucccucucuuacaccguggaugacuuugcucccuugcacugaugccuacacaugccuccgugggcuugugucuuggcuuuggcaguacauguuggugacugagagacucuuuggaggagaggagcagguugcaggcugugagauaaggaugggcauggcugaguucugggaccugaguuccugauaucacuccugagagcuucucugggugguaagaaccugggugcccucugcaggaagcucugaaguaguuaucuugguccagagugggaugcauaugcuccuuggaggucuuuccaaagaugacaagcauuuauuuugaagaagagcucacauuuucuguugguccaaacuuaaggacacuggccaugcugguguuggcuggcucugugcaaaggugguuugcacuuguuaguuccuaccccagugucagcuauggggcccaugaaagcuuugaucugagccuuggccuaaaacucuugaguuggaaggggaccuguccugggcaggacaggauccucagagccugccuugugcuugugucagcccucaccuucaggagugggagauccagugggugaaggcuguggcauggagccuguuggauuuggcuucagcuuugcuucugcuacuuccuagcuuuaugaucucaggccaaaaugaucauugugugccaguuuuaucuuguaggaaaugguggcaguugauagguuugcugugaaaguuuuugauauuauaggauucuauagucccugggucaguggcagagcagccacugauggcagaaacugccgccccgaggggaaaaguggacgguagacuccucccaucccccagacuucuucuuccgguugguguacaggcagcaccuggacacuucaguaggagaccaggaaccacagcauucuucuuagacccugcuuuuccuuuugaccuagcaugcagcagugcucugaugccccaaagggaagcauggucugaacucccugucccagacuuugccuuguccucccugagcuauuguaugggcagugcccagacacugccaaaggagaggaagaacagaaccacaaggcaucauaaggugauugagggagauaacuagugguccacuugguaugcccuaagcacagguaguagcagccugucuagccuuaaaaccuagguuuuguccucucaauccuacugaugucaaaucacaugucuaagcugcaagguucgcuugagugucucuguagugcucuaucuuuccugcuacuuuucagggcaggcagguaagagcuuccaugcauguuaccauccccuagaagcuuguuuaggaggugaugagugaggugugaaauaaagucuggggccagaauugcauggcugugaagcaaucagguaauaucuuaucuggcucaaagccucagacagcaauuccaaauucugguaugguuuaagauaaaucuguaucuuuuuggauaguauuaauuccuguuccacagugguucuagcaaguuaguucuccaggcagcagucggggugugugcuguuuucauuggcagagauagauguguucacaacucugcuccagagucuuuccaccacaggcacgggguuuagaaccauccaacccucccaccauccaucauggcggccacaggucguaaugaggacuugacagagugaggccccagccaggacuugaugagugcuccuagcccugucuugcucagaaaacccaggugaccuggaagggauuugauuuacaacgcuuguaaaauuggccagauaacuacuacccaagaaucaucuugguggggugagggauggcacaggaaacauugaacagugugguacucuugagugugacauugucuccauagaagguccgcagaacugagaaucagccuccagacuucaccagaugggucaccuacgcuuuccauacagcuugcucuuuuauccuuuggugguaccgccaccugccacagaagucuuugcucuaaacucaccucauaguugguauccuggucccauagauggaugucuuucagagcugcauggauuuuuuucccuaguaaggaauauuccuggagauggguacugccuagaacacagguguagagugcucugcuuagcugucucuggccuuuuccacuucaggacuccuuuuccagaggcccugguugaauuuaacaccagauguaugcugagugcauauguccugagagagaugaaccuagucuugaggcauccaugauuguguacugauccaugguugcuucguauguaguaggacuuugucuucuaaaugagaaggaaggauaacugaguaguagcaaaagucaggucaaggucauccuaagcuccacaagaaauuccagaccagucugggcuauacaagacccugugucuuuauuuaaggggaggagaaagaagaggaggaggaggggaaggaggaagugguagugguggugaugaugaugauuucaggggcccacaagauggcuccguggguaaaggcuaaagaucuugcugccaagacuaagaucuaaguuugaucccugggacccacaugguagaagagaacuggcuccuacaaauuauucacguuaucuucugaccuauacauggauguacacuugaaaugcuaaagguauugaaggagugugcauaucuuuguaucugugcuguuagagaugaaacugaacucuacugagauucugccugccuucugccacagagugaggaagucauggagccaggauugaucuugggccuuucuggcuaggaccccaggauaaacaaagcugucagccuuugccuguagagagaguacuggaguuucucaaccaucaccaggaauuacccacucucuuugacauucuuuucuccccuuuaaaugauauugaaaagccaggcauggugcuaacacaccuuuaauccuaucacucaacaagaaaaggcaggcaguuaucuguggguuugaggccaguuuguguauucauagugaauuucagaccaccaggaccgaguagugagacccugucucaaaaaacaaaacaaaacaaaaccaacaacaacucgauagguacuguguucuagcauucauguggcaucuuuuuuuuuuuuuuuuuuaagggaggauguaacaagaauugggguuagaaauguaccgcaguugaugaauugcuugucaguguagguuggauuuccaguaccacuacuguaaaaaaagaaaauaaaacaucucgaauacuuguucaugaucccagcaccagcaguuauucaacaguguuuccuuguugauuacuaugucagcaaguuucauaacuguaauaaaauaccugaaacacuugacguauaaagagaagaguuuauuuuggcucgcuguuuuagagguuccagcucacuuaggguuggccauucucauuguuuagaaccugugaugagggagcaggucaugcaggaacaugaggagcacagccgcuuuccuuauggucagaccauugaagcagagcaaggaggggcucgggguccuacugccccucugugggcauaguuccaaugaccuaaggaccauuccuccuaggcccuaccaccugaagguuccaucgucucccaauaacaccuuucugugacuuuaacacacauagaccuuugggaacacaggauccagccugucauuaucuauccuugcauauuuuauaagcaucuucacauccuacccaucuguagucuccuucauuagacucuugagaaaggccauuaggagguuuuaccaaauaucuccagaggguaccaaucacuggaacacaguccauacaagaagugcuggcccugugcauuggugcgggccacaaaacaaaugguuguguaguguguauguacuuccauggagucuuuugggcaauguguuccucucugaugaucgcagagaggaccuugcucugcuuuguguuguguauguagcucacucucauggaagaauucugagugcacuggcagcacucagugucauguuucuugcucauguugccacaugcugcagucggagaaugccaguauuucccaugucuuuggcagcaugguguacacagacaguagcuugucugccuauguguugucuucuugguacuggaugcugaccaguaucauccuugugcccugagggcauaggguggggaaauuggagguucagccuagcuugacaguauuccaggaaggccuuaucaguaauaguccuaacaugccuggggaacaguuccauuucuggcauaguguuacuaaccagaccaagauaucuaucccaggaaucaucuaucuauguguuugcuuuccuccccuggagcuuagcucugcacuaggcagggcuaggggaggauuggauuucuguuccuucaaugcuguuguaagagaaggagcagggcugguaggguuuagagauagggccucagagggagcaggugcugcuacagggcuaauucuucccgagcauccuucuguguaagcccaaagucucaaguauguggaaaggagcugagcagaggagaguugguccuccucuuccuucucuuucuuuguuuuguuuuucaauauaggguuucucuguguagccuuggcuguccuagaacuagccugaaacucacaaagaucuucuugacucugucacaagugcugggauuaaagguauauauauauaucaccaccucccagcaaacagaggauucuuuaagagcaggaggaaaggaaagcucuguaauuauggaucagcccagcauauaccccgaaaguaguugaccuaaaguagucauaggacuuauuguuccccagagguaugcugucuugagggccagcaaaugggacagugucacccuucuucccuuuggaggggcaccagacccuggaggucuugggaguggugacuucauguauuguuuggaugcuguccuuauagucccacuuucucauuccauguccaccuguccucugagggagaguguuaguccuagggggcaggaaaccugguaggaauccugucacuaaugguacucccuccaugcucuuuaagccagagaggccaugagaagccagagucaaacuuguccauucugguuuccuugaggcugauugugugauaggguggcaauguccagaagccagauagugccugaaaaguauuuauuuaguagcuuaauuaugcuuuaugaaccagauuauacccuuugcccuacccauuugaugugguuggacacauuuggucuccuaguucaaccaagauuggcucugggaagaugguuaagagacuugccaccauguagcucuggacugagggucuugaggauugauugcagaguccuuguugacuauaaccaugguucuggggcucuuaacagguucuugccaguguuccacaacuguauggauacaguggaggaaccuuuuagaaacaauagauuuggcuuugcaaaguuuuuaauucuucauugcauuuuuaauuuuguugucuuuuuaagacauggccucacaauguaucccuggcuguccuggaucuuacuguguagacuuggguagccuggaacucaacagagaucugacuaccucucaauccugagugcuggaauuaaagaccugucaccaugcucagcaaucuuaauuuagguaaacuuuuuacaccaagaucauuguagguuauccugcagcuauaaggugacauggugauccugguaccuucacccuccaccaugacaccgcacagcacagaggaguggauggguguauaugucacagaaguugcugaggcugguguaggcaggagcuucgaguccuucccagcugucuuagucaggguuucuauuccaucaugaccaagaagcaagcugaggaggaaaggguuuauucagcguacacuuccacacuguuguucaucaccaaaggaaguugggacuggaauucaagcaggucaggaagcaggagcugaugcagaggccauggagggauguuucuuacuggcuugcuuccccuggcucgcucagcuuguuuucuuauagaacccaaaacucccagcccagucccacccacuaagggcccucccucuuugaucacuaauugagacagugccuuacaacuggaucucauggagacauuuccucacccgaagcuccuuucucugugauaacuccagcuugugucagguugacacaaaaccagccaguauaccagccaugccuucaucugcguccacaauccccgucugcuccucacccaagcaguucaagucuagcuuccucuagauaccucagggagguuugugaguguacccucacggcguaucacugugggauagucucuuucuaccuccugaucucuggcaguccagagaauuguguaugggcguagaucauaccauuccauugcugacagguggcccauguggcccauggaguagggacagaacacaguuuguucagccguuucugcucugcaagucuucuggugugcugucaucauuuguguguagcuuuugugucacaacuuccauuucuuuggaguaaaauauacagcgguauaguuccuagcuuccuauuuauuucauaagaaccugccacguggauugucagugauguuguaugacuacacacuuacucaaugaauuuggcagcauuuagagucuguguauguauggauauggauacacacacacauauacauauauguauauauauauguguguauauauauuuuuuuccuucagaugaacuuuuucuuucugggcugacauuacuuccuccaagagccaaagacccccaacaaaaacccagcaccagcacgagaagccaacuuuuugaauuguuggucaggguuguccaaaacauugcaggcuauugcccuugacuaugucucagaggugacaguuaagucccuauugcugaagaugccaugcacuucagauacagggcccagagagcccugagcuggagcugacgaaagcccccucccugagaggaccaggaagcaccaugcaagcauccaaaggagggaggcuaccaacagaccuacccagcugugaugcccacgaaccacagugauggccagcauggcacaauaacccuaaagguuuagugguggcaagcauauguuauacccaguugggcuuuguccccgaaaggcaagggcugcucgacaucaauaaauguaaugcgccaugugaacaagucucaggaaagaagcugcgaacuguuuagucagugauggaagacauuugacaaagucuaucaugccuucaugauagagcucuagaaaccuuaugaauagauagcacauacuucaaaauaguaagguuauaugcagcaaaccuauagaaaauguuacaguaaauggagacuuacucagggcauuucuuuuaaaauugggaaggagacaaauauauucacucuuucccaucucacuccuagugcuugagacccuggcuguaaagagagacauaaagggcaacaguaggaaggaaaggagucacaccaucacucuuugcagaugacauaauucuuuacuuaaaauacccuauagcaagcuggagagaugguucagcucuucuguagguccugaguucaaaucccagcaaccacaugguggcucacaaccaucuguaaugagaucugacacccucuuuugggguaucugaagacagcuacaguguacuuacauacaauuaauaaauauaucuuugaaaaaaaaauacccuauagcauuuacuaaaaacuaagugacaggguauaaaaccaguguuuaaagaacaaacaguagccuucauuuacacuaauagacuacucuucaagaaagaauucaggaaaaauauuccuuuuaaaauaauugcuccccccaauuauuuaggacuauaucuauagaagagaaagaccuccaauaugagaauuuccaguguuugagacauacucaucaccuucugggagccacuguuuuuaaaggcuuuggaagcugagcauguuagugcauauguauaaucccagcucuugggaagcugaggauggaagauugcagcauuucggaucaguuugggcuacauagccugacccuguuuuguuguuguuguuuuguuuuguaagaaagagaaugcugcuuaaucuuguagccccuucagauccccacuaagaaauagucucugguuuguacuguuguaaguuagaaaagucacugggacagugguauaucccuuggguuuuauaugauaaaaucacaggcaaguguuaguuuugaaucaugucauuguucuaaugauggaggcaagucacuaggugguuagggacaguccuugaggaagggacaugaaaucuuaagguguagguuagggacacaccuuggugguuagggacuguccuugaggaagagacaugaaauccuaagguaagguguagguggcuucacaaaauuguggggugugcaggggaucuaggagagacagcagcaggccucuagcuugacuauggaaaaggguagccgugaggaugugugaggagcuguguguguguguguguguguguguguguguguguguguguguguagaagugccucucuggcacuuuuugugcuuaguuggaagagcugaaggguuaaagaugacuuucagcaaaacuugcaagggauggcugccuccuuugugucuuuuguuucuauagaagguucugcauugucugaugauuuggcccuauguggcuugccuuucagguuccugaugacagguuccuauugggaucagaucagcccuuuaggggcuguccaccacuuuguacuccacagggccagcuuagccuaggguauuugcucucuugcucaucuggcccaccccaacuucuucuacaaaucauagauccuugguacaaauuauagcccaugggaccuuuaucccuaucuuugacuggggcaaaguaccuugaaaacacagccccuucagaggccagauuucuucugccagaugggaaagagaacaugguuuacucagaugcuugcaguguggaguaccagacuuaguucuuaguggugccuucugguagcugaugugguucauagacaucauagcugagugggaauguugguugccuccuucucucgaaacauuuguagcaccuucuaguaccaugcaagagggcuucuuguguaugguauuuauuuguuuuugguuuuuuuuuguuguuguugcuuguuuuuaauuuggugggucuuuggcucuuggagggaauacugucagcaaaggugaggaagauuuauuaagauuauauauuuauuuauauuuauauuuauacacagaauguguauuauagguuuuuagagguaaguagacaauaguuugauuccuucugacuuuuuuggacauuguuguuauuucauccaccuuuuucuguauuuacgucccuucccucucccuaaagaaucucccuuuucuccugucagaccacuuguauuaugguguucccaauucucccuccuucuacauuuaccucccucacucuccuucaagugccccucuucccauuucucagaugagauuacuugaacccugcuacuucccucucuuuuguuccugaacacucuuggcaauagucuccuuuuacuuucccagugucugcaguuacugcagacuauguacucacauguuaagauuuggagcugugaacccccagagagagaacauaaagugggugucuuucugggccuggaauauuucacucaauaugacauuuucuaguuucauucauuuaccuauaaaguucaaguuuuuauuuuuauuuuuuuacugcugaauggcauuucauuguguguagcacauuuucauuauccauuugccaggugaaggacuuuuccuguuuccauucuuaacaguuguacauagagcaacagugaacaucucaaggauauugaguccuuuggguauauaugccaucacgugguaugggaaaguuauaugguaaagcuacuacuagcuuuugggaguucuucacacugcagacuaguggauguacuaguuugcaaucccaccaaaagugaguaaaugaggguucccuuucccccacaucuucuccagcauuucuuuucgguagucccauugauuguuaucauucugacuauagaguaagauaaaaaucucaaaguuguuuugauuugcauuuuuguaauuacuagggaaccauuuuuuccccuucuuugagaccucucuguuaagguuaaaaucguuuuuauaaucugucguuugugggguuuuuguuuuuguuuuuuguuuuuguuuuuuuuuuuucuagacaggauuucucuguguagcccuggcuguccuggaacucacuuuguagaccaggcuggccucgaacucagaaauccgccugccucugccucccaagugcugggauuaaaggcgugcgccaccauccaugccuggccuuuuugugggguuuuuuauuuguucuuuuuuuugauucauguuuuuugagucuuuauauagacugaauauucucugucagauguauagcugguagagauucuuucccauuuuguuggcuuccucuuugcccugcugauuguucucuagcugugcagaagguuuuuaggaaaucccacuugucaguugauggcccuaauucuugaguuaauggggugcuagucagaaagccuuuuccugcaccuagaucaugagggcacugccuguguuuccuucuagccauuuuggugucuuuaguccauguggaguuaguuucugcucaaggugauagauagauacagguguaguuucauccuucugcaugugagcauccagugucauguauugaagagguuuucuucucuccagcaugguuuuggugucuuugucaaauacuauguggcugaaguuacauguauuuauguuugaaucuuugauuuuuauaucauuggucugugugucuguuucgugucauuaccacacuauuauuaacacugugguuuauaauauauuucaaaauuuggaauggcaaucccuccagcauuguucuuuuuguuuacaauuguuugggcugucugggucuuugugguuccauauggauuuuaggauaguuucuuucugcuucugugaagaaugagaugggaauuuuuuaaaaaagauuuauuuauuuauuuuauguaugggaguacacuguagcuguuuucagacacacaaaaagagggcauuacagaugguugugagccaccaugugguugcugggauuugaacucaggaccucuggaagagcagucagugcucuuaacugcugagucaucucucugccuggggauggggauuuugauugggauuguauugaauuugagacuagcgucagguaaauuugucaucuuuuuucaaaaugucaugucugucgauccauaaacaugaggcucuuuccuccugucuuuauccuucagaguuuuaagucuuuauuguagaugucuuacuuccuugguuagguuuauuucuagauguuuuauuuucuuugagguuagugugaaugugggugugccugugaucuccucuguguguucguuggugguguauacaaaagcuacucauuugugcaaggugauucuguauccuuccacauugcucaauuucuuuaucauuccuguaagaauucugguagaauuuuugggaucucuguauauauauguauauauaguaucauaucuguaaauagggacaguuagacuucuuuccuuauguguaucucauuuauuuccuucucuugccauauugcccagcuaguaccucaagcacaguguucaaaaggaguggggaugguaggcaucccuguuucauuccugacuucagugggauugcuucaagccucucuucauuuaggacagugguucucaaccuuccuaaugugaaccuuuaauacaguuccucauguuguggugaucucugaccauaaaauuauuauuaucauuauuauuauuauuuauuauuauuauuuugguuuuucgaggcguguaccaccacgccuggccauaaaauuauuuuuguugcuacuucauaacuguaauuuugcuacuguuaugaguuguaauguaaauaucuguguuuuccuaugguguuagauaaccucugugaaagggccauuggauccccaagaggguuacccccagguugagaacugaugguugaggaugguguugaccgugggcgguagauagcuuuuauugugcugauguauguucccuguagcccuauguucuccagaauuucuaucaugaaggcauguuagguuuugucaaagguuaacuacauauauugagauaaucauguaaauucuuucuuuaaauccauuuauguaguuuagugcauuuacugacuuauauguucaguuauugcuacauuucaaugauaaaaucaauuugaucaugguggauaaucaguuugaaagaauuguguguguguguguguguguauaaauaaguuuuuuggggauaguagccugucauuuucuuuuucuguuacuguguuuuuuccagguuuagguauuagagugauaaugauuucaucaaagauauuuaggaugucccuuauguuucuuuucuuuguuugaauagcuuuaaaacagcuguagaucuucccaccccccuuuuuuaaaguaagaaggcuuuuuauuguuguucguuguccucauuuguugugggucuguuuaaggucuugacuucuugguuuaaguuuuguagucuguuugaaucuagaaaucugucuauuuccuuuagguuuuccaguuuaauagaguacaaguuuuaaaaauauccccuuauaguauucugaauuuccuuggugucugauguuucccuauccauuucugacuauguuaauuuggguccucucuuuccuuuggcuaauuuggccaagggucuguugauuauuuuauuuaucuugucagaaccaacucuuagagucauugauucuuuauauuguuuucuuuguuuuuauggcauugauuucugcucugauuuucauauuucuugcuaccaauuggauugguugguuugguuuggucugguuugauuuggugguuuuuguuuuuuuuuuuuuuucuuugagacauggcuucuuucuguauucuuggcuguccuggaacucacucuguagaccaggcuggacagagauccaccugccucugccucccaagcucagagauuaaaggcgugcuccaggaccaccugguaucuuucagauuuuuuaauauaggcacuuagauuuauaaauuuaccucauaggacaauaugucccagagguuuuauuguauucuguuuacauuuucauuuaguuuuaggacuuuccuuuaugucuugauuucuguuugacccauucaucauucaguaaugaguugcuugaucuccaugaaucuguguguucacuagagauuuguuugcugccaauuuuaauuucuauugcauuguggcaagauagcacacaaggagugaguucagucuguugucauucauaaagauuuguuucaugucucaggauguagucugguuuagaaagccucuaugugcugcuaaauagaauguauauugggggagggggacuggagauauuguucggcaguuaagagcacugacuguucuuccaaagguccugaguucaaauccuagcaaccacaugguggcucacggccauccuuaacaagaucugacccccucuucuggaguaucugaagacagcuacaguguacuuacauauaauaaauaaaacuuaaaaaggguggaauuuucucuagauaccuguuaaauuccacuugauauaucaguuaauucugauguuuaccuuuuuuuuuuuuuguccagaugacccaucuauuagagaaaaugggauauugaaauggaguacucacuauuaaugagaauuaaugugugucucuaaacccaguaauagauuuuuaaugaaauuuggugccucagauauguuugaugaauauauguuuaagauaguaaugccuuuuugaguaguuguucccuugauuagaaugaaagauaccucuuucucucuucugauuaguuuuaguuuaaagucuguuucucauaaauuaauauaauggugcuugcuugcuuccuuccgaucccauuugauaaaguauuuuuaucuauccuuuacucuaacauggugccugucuuaaaauauaagguguuuuuguguuuucuuggcuaucaaugagaagaauaaccuuaagcauuuuccuuaauaucaaguuguuuauuuuugucuucuuuaaacuccuugaauucuuugaugaaguuuauauauauauuuuuuuaaauucuguaucuuguauuucauuugggugauuccuguaggguuuguaggauuuagagagaagguacuggcauaaucuuuuauauuguugguauuuuugugaugagaucugugcacacagacuucuuuuguuaguucugagucuguuauggacaaagcagguuugaggcaaaagagaagauauuuagauguuuugggccuaaagauuggaaauggcuugggugggauaaagucagguagacuuggagggggggaagugggaggagggacuggacugggaugguaugaacaaugugcuuccuggucugagccuggagggugggacuagaccugccuggguggaaagguuggcuauggcauggguguguucugugguuugagggaagguccuggcagaagccuagagaucuuuuguaguacaggcaggggaggccagacuaggcuuggugcacuggguguuggacccaggcuagaucugguggguuguagaaaagguauguuugaggaauaucaaggggaggucucgauaccaaguggggugauugcaaguggcacagaaaccacuuguaggugguuugacuccugggaaacguagagguugacuuaagcaacaggggagguugguuacauuagacagggacaaauaggaugugggacucagcagaagccuagagcuuggguacugcacagucaguggucuaggcugggccacugguuaugggaccugggcuagaucuuguggguuguaguaaaggcauagauagggaggauggggaagaggaaggaggacaauuuacugaguuagacccuacaugaggaugugaguauucuuuuugcgugcuuuuaaauauggcuuuauugaguuagaggccacucuagccuacagagugaguuccaaagcuccauggaaaaacccugucucaaaaaaagaacgaacgaacgaacaaaagaaagaaagaaagacugacuugauugagguaaaauucauguaauuaaaguguuuaaaguauacagcuuauugcuuuggguuauuucuagagauggaguugucaacauuacaacuuuauacccuucacugucuccugacccuggcuagucccaguuccagacuauccaaaaaacugcucucugucccuugagauuugccucuguuaguguuucagguaccagcuucccuaccaacucuuucuggaaccauaauucuuacucuggcccuaugcuuuccuagugcuuacuggaagcccuuucuuagcgaccccagaaaguacuaguagaucuguaauauguguaguccaugaccuugcaaagaaugccuggauagaggcuuguugaguuaauaacugugccaaugagaacuuaaaccagggcaaccuggguuucgaggauacuuguaccaauuacuaaagacaccauuggucccuuuagggaaugucauguagauagauauuccuaauauaaugucauucuaaaguucuacagccauaaacagaaaauaaugccauauaaucauaguggguagccuguugaccagaucccacagguaagggccacucaagauggaggucaagaggggccaggaggaucaggauauacaggguucagggaguccucugguucuagcuccauuuuuuucugugcuguggacagucugcguacaguauucacucaagagguuuauggggaguaggaaauguguucaguuggcugggcacuaguaauguccauuuagcucuugggccuucugccaacacuuacuugugcauuucaucagagcaagguccugucauucuuccagcagcugcuccuaucccacuuacaccucuuuccacucccuuuacucaggagaaaagucagaguuugggggcauuaaggacucugcaaagaagccaaaaaauggcaguauucuuggcuuagccuggaggccaugugacccuccagcaagcaaauugcccucucucgaguaauagauuccacaacuaaaugggguaggaugagggggucucccaaugccuuuuccccuugcaccuggguaaccauuucaucuaccuuguauucuaugaguuaccuauuucagauaguucaugugaacgggauucuguaauauguagucuuguguccagcugcuuucaauuauacaaugcucuagagguuccaaugccuuugugugcaucagaaccugacucugucaugcugugcagucauuaugugggcagacuauagaucuuucagcucuuuaucuguuugugggccuuucaguuguuagcaccuuuggauaacugggagcaguacucuuaggauguugcagggccuguuuccauuuguggacuucucucacguguauguuaccuaacaguggaacugcuggggcucagauagcucaucuguguguucagccuuucccaaacuaccaggcuauuuucuagcugcaacauuugccucuuguuguacuagcuuauuuuguugaaacagucucguucugcagcucaggcugaccuggaacucauggugauccuccugccucagcuucuccagugcugagauuauaggcaugauucaugucaccuaguuucuguugugguuuucauauguauuaucacagaaacuucaugagguggagucagaacuguugauauuuugcucuucaacugcucagugucaaguugaagcccagagguuuccuugcccuugguggucccuaaguacugaugaaucuuaggccagugccaaauuugaucucuuccaggcucugcuuucugucuucaggaugggggaggggguggagcuguguuguuuacacuugauuccuggcacucaguaugauacauucauuaaauaaaaugucaucccuuccuaucuugguguguuuguuagaacuugagagaggcaagagucuguaagaguucuuuugcuuuguagguuuucagauguccucaggguucuguguuucccuaagcauaccacaagauggggaauccugagaccuuuuaaacuaggcaucuguucuaaauacuuagccaguguuggggaauaggagaugacauccuguuuguuaacuuggcucucuuguccuuugguucagugauaauaaagaucugccauccuuuuucucuucuaggcaaaacccauuuaugguggcuggcugcuccuggcuccagauggcacugacuuugacaacccagugcaccggucacggguaagaacaccagagaguauucuuggaaugggaagaaccagaaggagguccauuugagagugaagugguaaaguuagggagggagacaggagguaaacacuggaaccugaggaacagaguccucagagcacggauccaauguuuugugaacuccgaggucucaggaaggucugcuuauguauauauggagucaauggcacuugacuaugguaacaccccuggaggccuggccuauguugggguucuucucuguuugauuuuuguuagcucauuccacugcuguucaauuccucaagcuuuggcugcugauuccugucccuuggaaaucacaagaccaacccauuacauaccauuucccagacuuuguuggaagugauacugucagucucccuguaacccuagguuauuccagaacacauaaaucgacgagcaugcuaugaaaacucuguacuggcugccaguaacaauauagaaaagugaccacauacacuuucuauuccuaaggaaagcuccagcuuuuaagacuccaucgggcauguggaaacaccaguuacuuguauuaggccaucuccugaccacaccuggcuaaugaaucacugcacuuaugucuccaauaucucucuccuaccaucugccccagaaguugaagccuuagagccagcauucuuuagauucuuugaguuagauauugggguucugccaacugagacccagggccaggguaccugacccccaacucugugcucuguugcagaaauggcagcgacgauucuucauccuuuaugagcauggccucuugcgauaugcccuggaugagaugguaaguguccuuaaugcucccuuguccuaguccuggucuuccccaggcuccucugcugugaaacugcuaaccaaaucaugcuggagugcagccuuacuaaggcuucuguuuaagagucuggaaugggccgggcgugguggcgcaugccuuuaaucccagcacuuggaaggcagaggcagguggauuucugaguucgaggccagccuggucuacaaagugaguuccaggacagccagggcuacacagagaaacccugccucgaaaaaccaaaaaaaaaaaaaaaaaaagagucuggaauguuuuaaaggacuuguaguacuagguagaaaguccucuacaaacccagaucaaggcucccccucccugagaagaagcaaugaagaaguaagucacuuuuguuuaagauuagggaaaaugaggagguagucuuaggugucagccgggggcugaagcagaugagcaucuuucugcucuuccacugccuagcuuucuaccuacaccauggguagagcaguugcuggcugcucuugcuccagaggccaaaccccagcuuagccaaguagaacagaaggucucuuucuauuacuaccugugucaccucccuuuucucucaaagagauuucucuuuccuaaaugaagcuuuagauuccucuuccuuugcaauuugaguaggcaaguauguagguggagaccugcugugccucugaagacuagggccgccuggcaaagucuagucaugguguuugcagucagcuggcccacuugcuauacccagggccaguuuccucacuaugaugcagugagacucuggagugugaaauaacugucuccagaaacuuuccagagggucaggacacuagugcuuggagaugaucauuaguguucaugugugccaagcaggccccuuucuuccuaugcuuucugauguggcauuucaguccucuuaucugagaccauuagugggcacaauacuguguugcuucccauccuaccccuacacacuuuccacaguaugucaccucauugguuccuuaagauuuuucucccaucauucuuuuugaugaaccuaagagugaaccacagagguuuugcugaagagccaucugugaggcagagugcuuuacagugagcauggacagcaacccagcuagggacagggacagguagauauacgugaugcuuuucuuucuaccagcuuaggagacaugcagggcagauucugcucuucccuugguguccuucugucuuggcugcuacauuagcagcagcucugggauaggaaucaaucucccauaaggccuguucuugaguccuauaacuaguuaaaaguauuaaaaccuucaaaggucacuggauuauauucucauugagcucaagacaugaacauuugaaaaucaacaccaggguuuuuauuuagguucagcuaaaauccagaagaauucauuauucuauuuguuugguuugggcaccagcacagacugccgcugcuccuaaauccuccugucagucucugagaguugagccagguaugcugacaccuugugggccauaguauuggauauauuaguuugcuuuuuguugaugcaaugaagaccaugaucaaaaacaacuuggggaaaaaguguuuauuuggcuguagguauuggucauaguccaccauugagggaaaacaaacauggaaguuaaucagggccggaaccuggagguaggaauuaaagcagagaucaaugagaaacacugcuuacugauuugaugccaguuuucucuuuuauacagucaaagaccaccugccaggguggcacugcccacagugagcuggguucuuccacauuaaucauuaauuaagaaaaugcccccacagacuugcacacaggccaguuugauggaagcauuuuuuaaaauugugguucccucuucuuaggugacuguaccuuguaucaaauugggggaaaaaaagagcauacaggauguggcuaaggcaaacaugacugugagaaacaaaaaaggaaaaaacuuggcgggacauccaggucuaaacguuauugugcaugggucauuucuagcgcaugguuuacuauguagucaguugaugaguuucugucagauuaugggcaguacauacauauggguaguguacauagcuaguaccuuugagagagagggaagugaccaaaccagcaguggcagccauguugaaaugugucuaaagugucacuuugggcuuguaaguuuccauguugcaucaggaagcucacauaaaagaacacuacaaaggaggccaucagugugaagacgaggcugcaggaguuagucaggguagaggcuagaaaggaaaaggccauuucaguagaugucgggaaagaaguagcaugagugcucuugcggggacugagggugacagaagcuuacccaugcccucuggucugcauccugucaugucaggguuacccuuuguguuuucccugggacaaggagagauguccucucccacuauaucuucugcccauuuggauggacaggguucugaguccagugcuugcucaugcugcugagccucagcccagagguuuucccuuguguucuuucugaacaaggucuuaagaagaguuaguguaccucaaggcuaugugcuuaauguguagugccaucuuugauugaaacaauuagagcagagauacucuugguguauaccagugagaggcugagcaugcauaagacaucuuccacaacaaagaagaaucaccuuaaaguuuguuaguguccagaauaagaauugguuuggcuguuggcuuacuuacuuuuuuugcuaacuuaaaaacguuucauuugcuauuagcacaggacacaggacucaccuaccugauuccuggaguagauggcagguuaggguuauuuuacagcuuuuuuucaucuugagggguuucugugggauucacucacagaacacaucuauauuuccuauggcuuuuacaaugcuuaugaaacaucuccaucugggugcuuuuauccaaaagcaacaucuuugaauagucuaugauggcuucugguccuccucuuauaccuggauaaacuccagcccucacugguagccugcccuucccagcugacuggcuguaagauugaguuguauuuccuuccuuaacacuuagucacagucuguuucaaauugauguuuuccuguuauauauuauacuacccuuucccuucuuuuaaguacuuucuuaccagccagacuaugguuuuccccuguggcuggagguuuugauaauucuuggcuucuucccauguugucuggguaggguucaguagaccaggcauagcaugaugcguggaguuaaggcucaccauuguugagaacuggagagaaagauggguuaguguggucccagaauagucaugaaugugguggcuuugacuagccucuguaaaaaggggaaaugaugauguccagaaaacuugagaacaggugacucucugaugguuacagugugccuucaggagguggguagugguacuagcucugggugccuugggauucuggcuggcucccuggucuuaccauuaccuuuccaggcauagcuaaaauaccauuuacuuuugagaaucucuuuuucuuuggggcggauagguuucuuucuccauauucccaaguaaugugugaaggugaggcagauuucccuaaaaaagaagagaagcuuccagaguguguguugaggugaggggcauaguagcccauagacauaguagagccugaagaggcuaggcuuacuauuuuucaggagaggacaagcaaggagccuggaaagcccacugauacuguccuuuggguguugcuucaugucugcaucuuaaaggaacugauacaagucuacagguuugauuggcaucuggcaggagguucuggccccuguaaugggccuguucucuuccuuugccugaauacaaguaaggcaaacagauggucccaugcuuuguugucuuguauugugguaaaauaugcauaaaauacagcucacuacucagagcacauagcacaaagcaaguaaggcggcagugggugcucacacauacagccaucacuaugcaacuacaugagagcucugucaccuuuucaauagaaguuguugccauuaagaucugacccuuagcuccauucucuugugugucagccugaguccaucaugaaccuuguacaaauugccaucccuuaccagaaauguuugggacagguagugguuaggauauuaguguugguuuuuguuuuuuuuuguuuuguuuuuuuuuguuuuuuuuguuuuuuuuacauucugggguauuuguauaaauaguauuugauaucuuggugauaagagccaagucuaaacagaaaaauaauuuauguuucacuuauaccucauacacugagccugaagguaauuuuguaccaugguuuuuauuucagaucucagacuuuguguaaguggacuuuuuuuuuuuccuguuuuuaagagaugcaggccaaagaucuuuaagaggugggaccaguggucaauuuuaggucauuagaauauggcuaccaaauggauugucgggccuugauuucugcaucuuagagaugugacuacuggcccuuaacacauuauuuuaguuagggguuuauugcuguaaagagacaccaugaccaugacaacuaaaagaaaacauuuaauugaggcuggcuuauaguuucagagauuuaguccaacaucaucauggcagagugcagacagacaugcugaagacagagcuaaaaguucuacauccugacccacagacagcagaaggaaacuguuccacaaagggauggguagcuugagcauaggagaccucaaagccuguccccacagugacacacuuccuccaacaaggcuacuccauaugggccaaacauucacauacaugacucuuggggugaggguggggggaugucuacucaaaucaccacccucacauuccuaccacgauguacuauacuaucuucaccagaggccagaccaauaaaccguuagaacugagucuaagcaaacuuucucuacuuaagaagccagcaagauagguaaaaggcuugccacacaagccugauagccugaguuuagagcucacagaaaagcuagcuaugaugguuaaugccuguaacucuagcaucucauauugaguuggagccagugagccugaaauaugcaguacagugggaggaaaaaaagagacccugucucaaacaagaugaaaguaagguccuuugacuaccacacuagcacacacaaaaauuaaauaaaaaaagaaaaaguagcccauaucaagaauuuuguugcagugucacaaagcucucucauagauguccuucuacuaugggagucuuaaaugaauaccuuaaagagggaagaaauuagcaaagagagggcaagguggguaggcauggccagcuauaagggcucaagucaacuuauguagguggaccacuaaugcugagaaaggagacagauccucugaaucagacuauauucccugcuccuugugucccuuauucucaggaugcuugcugaagcauggagaacucauguaccucugugcauucccuucaggacagcaaguacucgaugacugacugguccugcaugaaacgguguuacugacagugcaccuauguggugaggugggcuuucaaguuucaaacugugcugaaagauuggugaccugaagaacccagugaaguucccuuucugucuuaaggaccauccaguggcuauauuucccaccucaguucuauagguguggaagaaaaggcagaaaaacaguaguagcuauccaccuaaguuagaccauaauuagauucccuaguuacccaucucuccuuuagagaauaccugcaguucccuuucagagaagcuucugggcacuauggagcuaucugccuggcccuuuccuguccuucuaguuuuuagaguggugugcaggugauugggguaguggggacaguuuaugucuuuguuaguuuuugcuggggaaacauggaaaagaugcagugugacuugcaccugaccacugcuuuuaagaguguggguggacuuuaccauagcauaacaaccaagcugugcccugcagacuauaaugauuugcaauugucucccuucuaaacagagaggagugauauuaaagguaguagugucuuuaauauguauuuuauguauguguaugcaggcaucaauagaggccaaagagaaugccagaucuccuggagcuggaguaauagggguuauaagucuccuggagaguauaggacagaguacauugcucugggaacugaagucaaguugucuaggggagcaacuguugagccaucccucuagucaacuugaaccagguuucuuugcuguagagaucuccacuucaagguacaauacagaauaaaaaguaugcuugaugcagagguuaagaaagcagucacugggugugauucugugggaacacugauauuuggagacuagaguauagaacacuguuggaaauggagugacacugucaaaggaauugcacagggagauucacuaggcagagguuauugagccaaacagagagccacgcccaaagccccuucagagcauuuagcacgucccuuaacuuugccugguucucugccugaguugccugcaggaucuuucacuuauguucauguuuucaauaauguucaaaugaccuucuccccuccacuagaagagggcagugucagacucauguggccuuuguagcgaggcaucagcuucuuugcuuucaguucugagcuuaucauagucacaauggagaacuucagagaugugcagcaauaaggaugugucagauaauccuaguugaucacauuugggaaugccuggguuccuuccucauccugugaaacagcauggggaugaaagacagaucuuugaggaucugccucuaacccuuaauguuggaauuaaagaugugugccaccucaccugguuggauuugucccagguccuuccuucuggagcuucugucuuuucugcuuugcugucuuguaccugagaaugccucacuccugcuuuguuacacacuuguuuucuuugugcccuguuuccuagguguaauuauuuuaaagacuaauccuuuuccuugucuacuuugcccugucucuuugccuucucagcuuccuuucuauuggcuuuggcuucagguuuucacaaaugaauagcaaccgagugcauaaacuuacaaguagacgugaccccacaacaagucaccuuaaguagagcaccaacaacagaccagagcaggugucuacuaaauccagacuggcuagccaggccguuaauuuagauuucuuagggagcacugaugagggauuacuugcauaggcagccccuaaacagcagcagcagcagcauugcaaagucccaccccugaguccccuuuuccauuaauaaucuacuucucguaugcgcugguauuucuccuggucacuugcagcggggagaaggcaggaggaagugauggcugaacucucugcugaagauccuuuggcccucccucuaucuuuuauggaguauugauagccccauugacauuacuaaagacccagcuaccucuguauuguuaucaauuaguugccaugguuucuaggccuagauuuucuuuuccaugauguacauaggguuaacauguuagaucuggaggaaaaagguguauuagagacuggccucagacuauaaaugcauacagaauguacacaucuuuauucaccuacaguacuugccugaggagaauugugacccuagcuucuuugaaaggucccaaguguccccagagauaagcaucuggcacauccauucuuuggagaaugauauucuccagaaaacuuuuuaggucuuugugaguuccaggccaacuaaggcuacauggugagacccugucuugaaaauaaauaaauaauaaaggaaguacagagaggcagaggcagagacagacagucccacccugcacuuuuuucuugaacugaugaguuuucccaaauugagcccucucagcucccgucuaaggaugccucugcgcagccgaaggacuugggguaggguuuugaccuuuaggguacagacuuucucugagcugugaauccuuuucccacacuagagccuuucagagaguaaccuuccuguguggccuucagagcacuagcuuucuaauggucuguggcagugugaguccgcugcccuggcugugcuccaaaagacucuucuaccuacuuguaaucccagucacuguguuccaaaguccuaacugacaucucauguccacugguguccuccuuuauuguuuguccuuuagaguuuauaccucgaugaccauuuucaaaaaacugucaguaggccauaaagcuauuacaucagcugugaguaacuggaggcuuuccaugugugucaggaacagugcaaguuguugguauauucugguuucuuacugugagugugccaucacugacugcucuacugucugauccauacugcagccugguuuguguuugggccugugaaggucauguuacuucugugggucccuauagcucuuucuuugcucuugucaagguauauguuaguaugugugaaugcaaauguaccacauuuuugcaauuuugcguccugaauuaaaugcaccuggcuggcuguuccuugccucaguugaaauugcaagcccuccucguuagaagcccagggguuacuugcuauugaaggaggcaguuuaucuaaucuccucugaugaaugagcccuuuuacugaagggcccauucaccuacuugggauuaacaauaauacccuuguagugcccuggacagguccugcuacugauacuucaauaacugagaaauaacagcagaaaccuggggcuuaggccugcccuccuuccagggccguggagcacugguggcuuuuucuuugucucaccuguucucccgagggcucugccuauggccuugggaaacugucagagauuggccuuguuccuucauacauaaggugcugcuuugcucugugccuugaaacguaaaguugggaaaauaaagaugaaaagggguccuugcuuuccagucacuuagucuagccagaaaaauagaaucagcuguccugagguguggaaaauguaagaggugaacaggaaagacacacuugccuucuguuuaccuauagcaggaaccaaccaaccaaucagccaguaagcucuauagcuucccggugacagaagucaaaucaguaaugguggaaguuuugguaagcuggaaacaagguugcuugguuaccaccuagagauaacagucaguucacacaaagaguuugugaacuauuccggugcgcaggcagauguguacauuccugaugccaaaaguaagauuuguuacguauuuaaacuugcuacuuuuuaaaauauuguauucuacaguuugcuguuucauccuaccuauuaucuucauuugcuauuccaucggguuuauuuaugguucuuacaaucucuauauacuuguuuucagguugguugguugguugguugguugguugguuggcuuguuuguuuguuuaaauguagccugagaucaaggacacuacaagaaucaguugauuggcccacagaaucaacugaccaggacucaaguugggcucaaagagaucagggacccuguaugggucugacuuaaguccucugcauauguaguaugguuguguagcuagauacucuugugagauuccucacaggggcgcggggccugucucugauucuucugccugccuuuggcacccuuuuucuccuucugaguugccuuauccagccuugauaugugccuggucuuacuauagcuuguuaugccacauuugguuaauguuccuggaaggauuguucuuuucugaagcggagaugaagccugugugagucuggggaggaaagaggggaagagaaacugcaguugggauauaauauaugaaagaagaauacaugaaaaggaaaaauaugagagccucagagaacauucuuagaaguaggauugcugguauggaaaugugugaguuuugagccuaucagugguuaacacuucaguagcauugcaugacaucagcuaacuggcugggucuccccagcuucucccuuuuccauuuuucucuguauccuaucccaaacuauagugggagacuuuucgagugaggucccuaaaagauguucaguaccaugguugcgaucuuugagaacuggguuauuagaagccuaaagagaacugagaaaucucauuuuagaucuugcuucucccacugucagaagcaggaucaaaggaguucaguuugcugccccuugccacuuuccuguccccugaggcuaaaaggggguuugggugcagguacgaaggcuacuuuauccccccuuuguaaagggaaauggaguaggccacauagcagagugagaagaguccacuuggucacuuacagucuccagacucuacugcucucugccuucagccucuggcucuccaccacccauuuggccuuuuggaauuaggaugaaaaaaaaaaaaaaaaaaacuguuucaggccccagaaggucccugcuuacuuaauucccaugucucuaaaaauaucugagcuucugcuagcccagucuccucccccauauucugcugcucuccccccacccaagacuuaggggaagaaacaagaucucccucauuguucuuuccgagcucagaaaggaauaaauaagaacacugaguuucuaaaguugaaaggggggaaaaacugccuuuguugggccuggaggggcgucacagcaucuaaagccaucccugcuggggacaaguccacauucuguagucccuucucugucacugggaaagaaauggaagggccaagagccuagacuucuucuuucuuauauaugugggauggcaaagggagcuggggccuguacagcaguccaggcugccuagaggagcuguaugugggaauggcguggcucccagccuuugaccacgccuggucagcacaggccaaagggggcugugggaagcggccaaccucaaggcugcuuguggccccgggcgcuuucucaggcauuucuggauugggacagagccucagacaccacucuucccaucccccaauccuagcuuuggauuccugccuaauugaggcuuuauuuaucuccauguuucccagcucuuuaugagacagacaagugggcgaggccuacccggaggaagaaggggaagcauaggggaagaagggcccaggggaggaagaaaauauaaaggucuacucccuucucggaggggcuguccagggaggagcuagagcaagagaggcuucccaguaagguggcugugcagcauugcuucuuagucucauccuacucggaaucuaaaaauagccuugugagagucacaggccugcuugcuugugggagcucugcacaccagaacucagaaaagcuguauucagcugcuagucgaaagccacuggcuaccucucccuuuccuugcaggccagaucugugaccucaggaucccgcagagacuugggguggagaggagugugaacacacccaaaugcacucagcaagcugccauaucuuucuguggaaacagaaaaauccgcuuccuuuccucaucuuuugcccuucuuuuucuuuuucuuuuucuuuuucuucuucuccuucuccuucuccuucuccuucuccuucuccuucuccuucuccuccuccuuuucuuccucuuccuccuccuccucuucuuccucuuccucuuccucuuccucuuccuccuccuccucuuccuccuccuccuccuccuccuccuccuccuccuccuccuccuccuccuccucuucuucuucuucuucuucuucuucuucuucucugucaauauuccuacuuaacuuuugcaagguaaagcagaccuaccucucuauauaggccauuuaagaaaauaaaagucaaacuauauuggauuuggagcaguuguguguaggaggguagaagcacaaaaaaacuuugucauuuugcucaauuacaaaguuaagguauguauuggacacauuuuuuaagacacaaaaacaagagaagaucaguucuccagaaaguccacugcuguuugguuuaauuuuucaagucaacucaaaaggaaagcccuucuaggugucacauucugucccaugacagccugucacaauaguagagauuggaauagacacuuauccuuaggguaaugcacccuccugggggugguucuugauagcuguggguuaguucuuccuaugcacccaaggguccugggcagagggcuggcuaggcagauaaagacaugggugaccuuggaaaucugcaacucccauuccagaaguauucuaacuugagaucuagguugcucagagugccuugcuggcaucaucaaccucucaagccaauuuggcuacaagaagaggucuuggggaccacaggaugccugguaggagaccagucuucuuguuuacuccaggcugggcuuuuucuguuuguggagucaaccaaaacaaaauaaguugaguuaguuugcuuucaggcaauugucagaaaauauuucaguugauuuguggggguuaaauuccaauucugcuuucuguuaacucacccugaggugccuuugugacucacuaaaccuguccuuuuuccuuugcaccaugaagacuguaaggauagccaguuaagagugcagacgguaagccacaauguagcagaguccuguuuccuguccucugaacauucaucugaagggaugaagagaagacaaggauacauacuaucacgauguccugcuuucucuacuugcuuggccauuagaccaaaggaaaggcaaaguaguugauucccuugccuggaauccagugauaccuguucaccggugagcaaguaguuuaagauuuuagcaaugcuacaucuaacuaaaaauuccauguuauuuaaaggauaaaaaccuucagauacauuugacaguaguguaggcaacagcaugaacuccaguuauguauauaguucucuauucuucuauauuauuuuuugagaguagaguuuuggauagaggauuugaaagaucaaaggcugaagagaaagccgggcgugguggcgcacgccuuuaaucccagcacucgggaggcagaggcaggcggauuucugaguucgaggccagccuggucuacagagugaguuccaggacagccagggcuauacagaaaaacccugucucgaaaaaccaaaaaaaaaaaggcugaagagacugcuuuuagcuucuagaacaugaccacugcagcucagaguaauucaacucuccuuuaggccauggaacccugcacaugaccuuggagaaugcacuuauuccagaggacucucuuuucagaguguuuagaccugugagccacuuugggguggauaccuaaaugccccuuguggugagcuguuguggaccagcagcuggauacaacuacucuuccagcccuuccucaguccagcuggcuauucgugcuucagcuuccuuuaugacuucuauggccauuuccaucuuguauguuucugaauugauacuguccacaacuugauacuguguucugagcaaauguacuugagugguacacaucaauaacucagucauucacaggccuggcaugucaccuccagacacucccugaccauucuuuuguaccccucagauuucaucuccuaggagggaggucugauggagcagaucaugggcuaugaguuggucauuuacuugagguggcuaugggcuaaaucacuucuuugccucgcccugggguuuuuaagaguggacuggguauacuuuugaaagaauccugggauaaauuugauggcaaauauagugcuagggaggaggcaacucugggugccucacuggucuuacugaugugcuaggaaggaggucacaauugaugccucacugaucucacuagugugguacugaggaggagaccaugguugguaucuugcaggccucagcagcuuauauaccugguagcuuuuuacuuggucuuccccugcccucagcccugggugcugcuuagaaagaugcucaagccaucucaugggcauuugguugcucugccugugggagugggagccuguuuuaguaagcugccucauuggaggcucacugggguuuacccagauuacuuccugcuuccauccucagccuucuuucuccuuuugcauagaaaaaguugaaguuuguguuauagcacaacaaaucaauuuuuuuuucaggagacagaggccauuauuggccuccccuucaugucucuguuccucuaagaaguuacuagugaccuuuguguuugguguuuauuuuuaauuaccuuuguguggccagcauucucacagaccaguaaacagagcaccuugacuucucaagugaaauugagguuccuuucuguuauuucuguuauuuauuauucagaggucucuaagcaaggucuaagaaaggaccuagcaaauaugaggaccuucuccuauccucagggaauugaugacuguguuaggaaacaggauaccuaaggagagaaagacuuacagccauuguauuagguacaaggugcagccuggcucaguuggcacucuggaggaaugcggugcauuagugaacacaaguggauuggacugggggagacaaagacauagaaguugggauaggggcuggagagauagauagcucagcgguuaagagcacugacugcucuuccaaagguucugaguucaauucccagcaaccaccacauggugacucagaaccaucuguaacgagaucugacacccuuuucuggagugucugaagacagcuagaguguacuuacauauaauaaaugaauaaaucuuuaaaaaaaaaaaaagaaguagggauagauccaaccuuaggaucacauggacuguuuggggaauaaggaggugagaauugucaccuguguguuccugccccucccuaagauaccugggauggcuuguguguaugacccucauacauccucaccuccaugcuagauuauugggagcaagauaauauuuucacagaggagaaaauagguccaacauucuaccuguaggagaagugucuucuucagaccucuagacuggggcuggagagauggcucagugguuaagaacacucucugcucuuccagagcuccugaguucaauucccagcaaaugcaugguggcucacaaccaucuauaaugagauuuggugcucucuucuggacugcaggauacauuuaggcagaaugcuguauacauaauaaauaaaucuuaaaacaaaacaaaaccucuagguuggugagaaguugugcuaauccaucaagucaugcugggagcuccucuguuaaugcacugcaaugcaguaggcacacgcacgcacacgcacgcacacacacgcacgcacacgcaugagaguggguggccaguaugagaacucaagcaaacucaggcuauaaauccuuuauauuuugauccauggaaauaucagagacacaaagggcaccauguagagguccugaggagugagaagagacggagucugacagcagauaggcuuuuaccagauaggccugagucugcucugugugugacuugggugguaaaaggguuuugcuuuuuguuuuuuguaauaauuuucuugaaauuugauucacacagcucacccauuuaaaguaaacacaugauuauuuuaguauauuuaguuauauauacaaguagugcaauuguaacugucauuguggccaguuuaaaaauauuccaucauuacaaagaaaacccugugcuucuaacaguuaacucucuguucucccucagucccaacuuuuuuuuuuuuuuuuuuuaaauuaagucuggcuggccuagaacucaaucuguaggccagguuggucuacuucacaaagcucuuaucugcaucugccuuccaaaugcagcaacuaaaggcauguguuaccacacccagcuaaaacuuauuuuuaaugcugaaaaauaguccauuguguagaugucccaagauuuacuuaucuagucaucuguugauggauaucugugaucccacccuuaggcaccuauaaaucgggcuauugugagcagucacauuacagauuucuguguagacauguuuucuguuuuauuggauguaugucuaaaagugguggugcugggucauagggucauuguauuuaaccuuugaaggagccacuauacuuucccacaguggcuacuuuaugucucauuuugaccagcagaguaugaggguccugucaaggcauauccuugucagauguucagucuguguccauccuccucacuauagccaccacagugagaagaguuggcucuuacuguaguucucauuuaccuuuugcugguagcugagcaagcuucuugguuucuucuugaggaaaccuaagugcuacggaagacugucuaauuuauuuaguuaccugauagucauauagcauuuguuaugucuuaaauguucuauagacauuuacauuagauucauguuaaucuuucugaaauaggccucaauauaaucaucuuauaaauuagagaaacugaaguccagagagcagaaagaagacccccacggccauggugcugugguacauuuuuaugguuauuuaugccugacauguuagacgugaucaacacucucugaauguacauaguaaaacacagaaaguuugguaccacagagauuguggcuguaagaguuuugcugagcugaaucuuugccuguauaagcugcaacauuucccuaagccuagccugggacccaguauggcacuuacuaguuuucccugcucaguugcaguugcucuugccucugagaggugauaguguggcauguagaaagcacagcaaccuuuuggugcuaugugucuaaaguagguguuguuuguuguuuuggccagggagcaaugcagcuacugcuacaaucucacgugacugcccgguuaagaauggcugagauagcuagaagacacuuguguagcuucaccaugggccucaugguugcagugacuacucuggccagugaucuccuuuaagaguugugcugccccuugguagaagugacauauucucuagguccacauacccagguggacagauuggaucugagacuggcagggacccuccuccaggagcugcccuccuuuccagcugugggcaccuauuucugacaaggcuuuccuagggagggagagaauagaggacagucacuuaguuguggcuguuuuggaagcucggguacaagaaacucaauuucugcuuagugcaagcacugugccuaaugaugacuacacucuucucaauguauccacucaggaaugucucuagguuagaagcagcugugcacauugucauccaggugugggaagcugaggcaggacuggguaaaguugaaacccuacaaagaaaaauagugagugugaaggguugcccaaagacacagugcuaacucuguggccugggcgggacuuccuuucaguucacuugacuuuuuuuuuuuuuuuuaaaucuuuaaaagaagucauucucauagcauauaggacuccuuccaccaaaagggagcccuccuagaaauguuuguuuguuuguuuguuuacuuauuuuuacagugcugaggauuaaacucaagcuucacauauacaggcagagccacauuccuagcccuuuuacuuaaaaaagaaaauugugacagucucacuguauaaccuagacuguauaaccucccaguccugccucagcuucccacacuuggaugacagaugugcacagcugcuccuaaccuagagacauuccugaguggauacauugagaagaguguagucaucauuaggcacagugcuugcacuaagcagaaccuaaggcuccagccucacugcucagaccuugucucagucagguuacuucuuguuacugagaggauucgagaggggcaggauuuccagauaguguucccucucaucacacacaguucuggccacaucacuucugucacacaucucugaaaauggcugcuguccuguuagagcaguugucuggcacaccuauggccucccugucucuggcccuucaccaagugguaucugccuucuuuaaggaagguaccauaccuucaccccuucucuccuauucuucagauucaagcuucauuuuguuguuguuguuuaucaugaugaugaggaggaggaggaggaggugguggugguggugguagugguggcggcggugguaucuggcgggcauuuuaggggugcuaguuguucuaagccccuugugaagcccuuucuauuuuaucauccacaaccugucagcuccacacagcuguguuccaucucaaauucucagcccaucuuugcuucugcuucugucaggucaucuugggcccaaaagcugugagugacuucagacagcuggauggucagccuaagaaagagccugcuauaguagcaaggagaggccagggucucagaaguucugaggcauuggcuccacccccagcugagugccagaagcaccacaggaggcuuuuacucuccugaggucccaguccuaacccaggaagugggaagcagccuccguccgggcuucuguguuuaguucuagcugguucugucacucagcaaauacugagcccugugcauacagcuugauuuagcaaacucuuuuucagccguaucagccagucucugccucccuccuaucuaucccaaucuugagacagcacaccaugguuugagucuaaaaggccaugugcuaaguucuugguugauaagacggauucuucuauuauuaaguuuacguuugauagucagucucuuggaaguucauggaaauuuaaaaggcauaggauguaguugaagggagcagguccuuugggcauucccaugaagaccauauccccacuuuccucauucauugucuuccucuuuccaucaugauguuuugccucacuugaagcaauugagucagcuaaccauauauugaaauccucgaaucaaaguaaaaucucuuccuucaaguagaugaccucagggguuuugucacaguaacagaagaacucacuaguuaaucuuucuuguuacucuccuauuuucuucuuucauccagaugucuuggaagugucucaaaaacucauaguaaaagguguaaaauccuuacacaaugauacucuuaugcaccuuugagcucuuacacauacaaggccaguggcaagcucuuuggccagaggagauacuaaacagugauaaaacuacagguuugucucaaaaaugagcagcaccugugagcuggaagacaggagcuguacaugaauguagcaccuagggaaugaauauaguucuuucuugcagagguacauggacagggacugaacaguuuaauaaauaaauggacagugguugguaggaaguucuguuggagccccaagggaaaaagcuaggccauucagucgugauguaguguugagacuugcgugugcuuagucagaaacagacaucauccgaaacacacagaagguagcagguaggauuguacucuggcucuggcagcauguggcuuucuuucuugagcagcuaagagggccuagaagccaagauagccuaugagcaaugagaacucccuccagcugaccagaguuuuuaaugacccucuccagguaagaccccuggcuucuaugaggggcugaucuagagccgggcaaauguugucccagaucauccugagcaccuuguccaggaaguggucugauacaaaacaggagccacuggacaagcuccuggaccuaacgcuggaacaaugugaggaacacaaugaauaacuuaguauuuugguuauaaucagggcuuaaguuaaaugucuaccagucuauacagcuauaccuugaugguugauaaagaaauaaaugggaaaaagaaaaucugugcaaaagaguuucaaauaaccugugcagauuuccccucagaagucaucaugugccaucagucccucuccucuccaagcagacuguuuaguauguagugacuuucagcuccuuucagcuccgggccauagcuuaucacaagacauaccaccaacaucagugagaaguccugcacucucucagguacagugaaaggucugcuuuaccucaguggcuuuccuucuuaagacccagaaccauagucuagucaugagaaaaacagaccccaagugaggaauagucuucaaauacauggcuagcacuuuguaaaacugucaagaucauaaaaaaacauggaaaauuugagaaaccaucacaacuaagaguagccugagguuucaugacgauaugaugugcucuagaacacuagaagaaaacucagaggacucaacauggacuuauguugauuugguguccguauuuguuggcugcuugcaccacccugguaaaagauguugguaacagagccaauucaguaauaaguauguagaaauccuacauuaccauuacaacuuuuaaaagauaaaauaauaacaacaaaaaagaaaagaaagcaguaccagagacucagggaagcagagguugccuagaccuagcugccugaacagguucggaaaagaggcuauuuggaaggacuggcagggguagggcaggggccuagacagcagaagugaucaggcucugaagugaaauccauacaauacacuaggaccucuuuucugcuugugucaugagaggccugccuguggguggcucauggaagaacaugugccaguagggcgggcuacaggcugccaucugugacaguccuugucacugucaaagcaaucauagaacaggcuacagaaucuagauggaugagucacguuugguuuuguaugaguacacugguaccugacugccugcaugaccuaccuuccugcuucuccaggcuuguguggguuucuugcugugacugucuguucucucuaacauaugcugcucccucuugacccuguucugcuugcuugggaggcuuaucucaagaacgcauaguagauacgacugucccucccauucuuguagcaaucuuuuuugaggccucugcugcacuugguaugucuaugugaucugccugacucaucucccaguucagccccaggggucagggcuuuugucacucaguuucuugcugcucuccuggcacugguugccagcaucagccuuggcaugcugcuuuacccucccaguagcuuccuucugccuguagaggagaugaugcuaccucacaguuacagaaauaugacuacuuauggaaucugucccucugcucuccugcucuuggagcccaccucuucauaggacuucauagauuaaucuagcccccauguuacuagcaucuggaggagucuuaauagcaugugucugaccuuuuugccucugucuuaguucugguuuccauugcugugaacagacaccaugaccaaggcaacucuuauaaaggacaacauuuauuuggggcuggcuuacagguucagaaguuuaguccauuauuaucaaggcaggagcauggcagcauccaggcaagcauagcaugggaguugcugagaguucuacaucuuguuucaaagaccaacaggagaagacugguucccaggcagcuaggaggagggucucaaagucuacucccacagugacacacuuccuccaauaccuaauugugccacuuacucccuggggcaagcauauuaauucagcugugugugcccucuuucccucugcacugugcaaaccuaugguggguaccauagcucacucacuauagcucuuggcauugugucuaguggguccuuuuagaguuagugacaugggaacaggccacuagcugcugcaaaugacauucaaacaaguggccauucuacuggugggaaggauauggaugucuucucgguugugcuaagaacuuugacaucuggcucuaggauauagguugcaugcuggucuuaaagaugcuggcuguguuggaagacucaggccuuucaggcgggcagauuuugugugguuuuaccuagcauugccacaauccaaaaauagugguucauaagucagcugcugcugcugucccugguaguaaagguggaagggcaaggccaugcccacuggugguggccugcauucugaauccacuggaagggcguaugcaaggcugucagaacuagacagaaccagaguugaccaucuuauauuagcugugcccagcgccaucugcagaacugccacuuugacauaagggugugcuggccagcaaggcauacuucuuauccuguuucugcuccagcuguguuuauuguuuucaacuugggaaucugaauuggucuaggcucuguauguaugugugugugcaugugcgcaugagugcaagcuucgucugucuaucucugugcgucuguccagaucagauaugcaucacaaaaguuuagcuguucuuauuugcuaguucuguggcacugaguacacucagacugcugugcagccaucacuaccauguccuccagaacacuaacgcccuauucuucucucguagcccuuagcccauucuacuuaaaguuucugugaaucugacuugcuaagccccuuaauuaagugcagcuacaaucugugucauauuguaacuagcuaacuucacucaggcuuuauccauuuuuuaacacuuaccagaacuuuauuuuuuuauaauuaaauacuauugcaucauaugcauguuccacaucuuguucauuuauuuauuuauuuuuauuagguauuuuccucauuuacauuuccaaugcuauuccaaaagucccccacacgcucccccacccacuccccuacccacccacucccacuucuuggcccucauuuaguuuuaguaugaacauaaugacauaugaacauaucauauguaugacauguuaucauauauaauaugaauaccuaugaagaaguagcauugcuucugcuucucaucugguguagauaaugucaugguaaacauggaguguuugguuucccccagugccugauuuuaugugguacuguggggccuagggcuuugcuuauguuagucaggcacgugcugcugauagauguuucauuaauuacugaggagacuccauggcucuuuuccauagcagcugcaccaucauauauuccuguaggugauauaagaaggcucuagcucuucauacauuguacagccucaucagcaucuguugcuaucauccuaacacacuuugcugugguaucuucuguucuggguuugauuuguguucccugaugacuuaggauguugcacauguuuucaugggcuuaucagguguuuagagaaauggcuguucaaaucugcccacuuguuuuuuuacuguaauguuuuugcucuaguguuuuaguucuuucuacaucuugaaaauugaguuuuaguagcuguaugguuuacaaguguuugucuuuuccccuaucccuuuuggaagcaggauguugacauccagcccagcuaccuugacucccaugucuggaguauggguuuauugugggguguuuguuuguuuguuuguuuguuuaacuguugcuauuuguuuugacaggucuuggugacuuaucuuugaacuuucugucauuuugcucuagcuaucuaagugcucugaucauaggccuaugccaccacaucaaaugccucuuuugaacuuacauaacaaguuguugucacauaugguauauagcaaguucuuaagauggucaaguggguaaagaugaucucagcuccccucucuucaacuuuaggacuaaaguaggccuuggcuggguggugagggcuucuuaaaggaagaucacugucaaaggccuuggcuccuuaauagaaccugcgugucuugcugccucaccaguagcuccaaagaaauugagccgucauaacagaugugagaaggaacugcuagggcuugucauauucuuauaugacaagaaagguccuuguuauauucuuuucacucuugcaaaacaaauuuagauagccuaacaaugcccccuggaagcugugggucgguucuguaccuccacauaaagucucuggaccucugcauauaaagcugucugagugggugaagguacccggcaccaguccucacagccugaguucaguucccaggauccacgugggagaaggagagaacuaacucccauaaguuguucucugaccuccaaacuuauacuguguggcaugaguguacaagcacaguaaagaaauguaauaaaaaguaaauauccuuuuaaaguaaaaauauugacuuuuaauauuucauugcauauuaagugugugcacuccuguauauauauguccaucacacaguaaaagugguguuuucuguggaucucagguguuuuugaaaaacccauccuaggccauggaaagauggcucagcaguuaagaaugcuggcaauaucuggguuagugguggcacacgccuuuaaucccagcagaggcuggcaggucuuugaguuggaggccagccagguuuacaaagugaguuccaggacagcuaggccuacacuuagaaacccugucucgaaaaacuaaaaagaaaaaaagaaagauaaaaauaccuugaguucaguacacaccccugggaggccugcucuuuucugaagggaaauggaugaggaguugcaucuaagggagaggugagguuggggauguaaugagugggugggagucguggagggaggggaacugcagucaggauguauugaaaacagaaaaaucaauuuaaaaagaagagggugaggagaaggguggugguggugguggcggcggugacgaugauggugacgaugauagcagcugcucuuuuaaaggacccaaguucaguuuccaccuucugcauggcagcucacaagugucuguaacucuaauucuaggggauccaacacucucacacagagauacaaauaggcaaaacacugaugcacauaaaauaaaaguaaaucauuagaaaaaagaaaagaaaaggucucagaacuuggguaguggguagggucaagcuucacucugacaagcccuucuagacugucagaugugggaaguaguaacucuaucuaugccagggggaaaguggguuucuguaggauuaucuccuuucacauuugaaugaaggaugauaaaccacuauguggccucuaagccaccucugguuccauaauagcagcuacuauuaaccagcuucacuuggcagcuuaucccauuuucuuucucuuuucuggcuuaaacucuuuuccuaaacucuccaggaucaauaacaaaaagggugggccaaguguagugcacacacuuguaauaucaguggucagacgaguaaagggaucagaaguucaugaguugguuuccucagagucuccugcugggguaugauggagaguagcaggaguugucccaacucagcagggucaccuuggccccgacaguuuccuggaugcagugcauacccaggccacccggcagaagaccgaggauagggcuaagcucucaguauacucugccccaucuuugaugagaagcccuuguccugucuucccugcuccaguuugccacccuccuucuuaagugaccaucagcuuauaacagcuuugcucugcuguccuagcucuggcaguauggggaccugagaaggacuggagaccagguggcuggauuuucucucucucucucucucucuccucucucucucucucucucucucucucucucucucucucucucucaacaagaaaauagaaaauuuaggugaagccuugugucuuuggagaccugaguuacuaaccuucuucugccugaauuuagguuacagcauaaauauuuggccuugcuuuuagaacuuggguuucaauccugcauagcuacuuucuaacauauuagcuucucagugucccugcucccugucuguaagguauauauggaaaauggagcuucccacaucuuggggcuguaggcauauucagcaggagguuagggauggggcuagaaccugggguauauuuagggcgaguagcacuucuaccagugugcugugacacuaguacuuauuccuucgaguagcacugucgagagcuguaaagaacuuuucucagcagguugucagugcgaaccuaaccuacugcccgagaguaguaguuggaauuauaugguaacuauucguuuuacaaguuaaggccaauuaucucagcugauuccauuuccuugcuauuguaaaaaggacagggauaaauauaagcaugcagguaucuguaguagaagacacucugugcaccucccugagagugguaagcuggagcauagcaaguucugcccuaguucucugaggagcuuccacauuccuuucuguaguggccgcacucacuccccccagcacuggguugcucucuccccauauccucaccaguauucauugucauuuucuugauuaccauucucacuagaguaacauggagucacagaauaguuugguacacauauacaaauagaauuuuauugagcaaaaaagaaaaaugagauuaugaaauuucaagaaauuggauagagcugggugggaaacauuacuuuuaagugaggugaccuaggcucagaagcgcagaacucuaaggauucucuccugggugcagauccugagcuccagcugcuaaauaugcguguccaagcuggagaaaugugaauaaaacgcagaaagcuagagagggccacuuaggacuaggaaaaaaagauucauuaaggggggaggauggggacaggagcagagcaaaguuaccggagaaauacuagggcacggggcacaguggaggugggcagggaaaggaggggagugcaugaaaucaauaaaaaugaaguaugugugaaaacaccagauggaaacuaauuuuaaaaauaagagcuacaagguggcacaaauggggaaaggugccugccaccaagccugauggccagaguucaguucccaggaugccaugguggaaggagagaaucaucuccugaagaaucauaccuuuggccuccguauguguguuauggccucggugagcucacacgugugugugugugugugugugcacgcagguauucuaaauccacagaaaacucugaaaaaggaaaaauagcuuucauuauaaugcccuuauaaaaguguuauuuauguaacucccauuaaaaaagaagaccagugaaagggagaaggggaauguggaguggagccaggaagaugguccaguggauaaugcacuugccccacaaaugugaggacuugaguucagaucuccagaguccacauaaaacugggguugguaguaucuauccagcacucuuagggugagauaggggaaucccuaucaucuugaaagcaagaguccuuuguucauguccuggugaacaauaaagagacacuguuucaaacaaggugcaaggugagcuagcccaagcacacccaugccuaauacccauguuagugggaggucacucuugcuuuuugguuugguuugguuugguuccagagcuuuucacagcuagaaugaaagucaagucaaacauucagcagcuuugggaauuagucuguugcauuugaaggaguuaaacauauaguucccauuugaacuagcaauuccucaucuagcuauccaccugggagcagugaaagaauguggccauucaaacacaugaauaugaguauccauauauagcaguuuuauuuacagcaguuccaaguggaaacaaccuagguguccuuuggugguaaagcgagaaagcugaaugggacuugucuacaugauagauucaccuggacaaaaguaagcuguugaaacuucagagugcggugaagaaaggaggagcuuccagauacaaaaggcuuuacccugugugugguuccguuuagauaaaguauuggaugggugaugaggcagagggauuggagggagacagagggaaaugaugccuaaaggccugaggucaguaggggugaguauuguacaauucuguaaaugcugaauaaccauugaacuguacucuguaaacagguaaguugugugauauaaauuaugucucaauaaaguugcuauuaaagaggaauuagcugugaaugagaagcuuuaauuugggaauaguuuguucccacuucaugaaaguccugugaguggcuugggcucuaguuaccccuuccuuuugugagguuuccugauuguugauuccugagugugugguaggguccaguaaugccuccugguuagcacggggccagugggggcaucaaaagcaccacucaaaagggaguguuaauuucuuucugucccggcuuaguuugucuuucugguuuuguuuuuugagagacugucucuaucuagcccuggcuagcuugguuggccucacuuucagaaggccuccuuacuuuacuucccaaguucugggauuguagguauucaccaacauacaugccuggcugucuuugccuuuuauugaccauucugaaacccuuucuaaaggaaguagagcugaggucagggagguagagagguugaaggcugaggccauggcuauacucagcuguaagacugcaucuuuggcucauuguccagauuuuaguacugacuguugcugugcaaaauggaggaguugggcuguagggaccugaacaguuuggugacauugaauccuugaacauccugguggccaaucccuugagaagaaaauaaccaggaauuuuguugcuauguuuuaucaucucuacuuaacaucuuuuuguaugauauagugucauaguucauaaucuauucacauaggucugaaauccaucauggccauugucaguguuuuaaucccaaggacugggaaagaguuccagcaguagagaagaagaggcauccuuugcaguuccuuucaucuggucacuacuggcugucggcacagcuucugucacucaguucucacaauccucauagcgauaguuuucugucucagaaauacgaugugucuuguccaugggugaaugaagaacacuuguuucuguauaggaaaggacaguuuacccaaagcagguuuaggagacugcuagagagggccuguaauuaagacucaaguggaauagaagggacuggcauuggaaagaagagguaaggaaaauuaggacccuguccugggcuuccugauccagaaagugagcaggauuuggaucuaggcaagauggggcauuagacuacugucucuguccacugcucccugaaaagaccugcugcucaguugcagaacugccuaugcuacaaggcuaugcuggacccucaugguacccuccccagggugugugcucuugagcucugaggcucaccagaaagucuugugauccagcuuucagccauggggaaggaagcaugggccuuguguggaugagagcucugcuauccuggggcugccucaucccacccccaacaaacucucugaaauuuucgucaucaagcaaguuagaacucuucgaccagccugaugacuuuaauuggaaagggacugcaaaagauuugucuaacaggcacuugacagaugaagcccaugggauaaugauucugagcucaggguggguaccaggccucauacccugcucucagacaaggguacucucagucugguuagcaagauggugauaaaaaugggucuguagaacuacagagggaggcaggccaaccacaaguguccaacugcugcucuaagcauuuagugcuaagaaaggaagcccaccaaguaguagaccuuggauaguuuggugagaaguugcugucugccccaaaguccacccaccuguggcuucuggagcaggcuaugcuaguguuucccagugugaagcaacuggcaugauaggauacauugcagccagucugccuucccagaguauauguguuaaaacauuccagugucuuaaaugguguguauauauuauauccaugugugcauguauguugaccuuugcccuccaagaagucucagcaggauuccuuaaagcccagacagguaugggugagccuuugggucugucucccaaucuuagagcuagugcucaaagauguggcucuauuuaccuaccuccuuacguguuuuuuuguuuguuuguuuguuuuuuuuuuuucuauuuugaaucuacuauucccgaagcuuuuccucacugaucugagacuaggaucuuggcugccugcucucccuagcauuccucacugagcacuguccugaccccuccugcggugcaagccaggacacuguucuccauguagaaaauaaaguccagaggguguguccucuacauaaguccagcuuggcuugccccaccguggauggguggguaggaaguggugcugugaaggcugaggacugaaggcaagggguggguccugcugguggcugugggaccugacacaccaccccuuuugagugacuuguuuuguccuugcagcccaccacccucccucagggcaccaucaacaugaaccagugcacagaugugguggauggggaggcccgcacagggcagaaguucucccucugcauccugacaccugacaaggaacauuuuaucagggcagaaaccaaggagaucaucaguggguaaguuggccagagccacaggaggcacugucuguuugcucacccauuucuggggacuccagggcuucuaggucuuccuuggaacucuucacugauuggucguccucccaccccacaccucauccucacccugugccuccuuggcacucagcacacagugcugcuccugccuuccccucaaguaaaauaagcccucuuuucuaggcuguguaucaggcagccugcguggcggccccuuugagaaacgucccguguagcaccaaagccuccaggugauucacaugcauguauuuucgguccucagugauuaaccccauucauucucuacggcuggaagagggcaggugugucaucaaggcucugucugagguugagggguauaggcuguguauagcacaggguagagggaaguaaggacaugaagccaucugguuuaagcaaguacaaggccauugggagcauugucuuuuucuagcauccuuuaguugcaucucuaguguugcuuuucaggaaaccagacuauacuggccaagagauaacauuugguaggugacugagaauucuccuuucuagguuccuagaacaaccugaaggaguacuuugugugucuuccugaccuuaacccagaacccaagauuuaagaguuuccagggcuucuaaugaacccauccucuauaccaagcaaucugacggucaagaguaagggagcagucaggugugagugaucaucuguacuucugacugcagcuggugcuaccuggucuaauauagcacacauuucccaaguggaucuuccuagagagccucauccuccuagacuuggaucuaggagagggccugaauggcagaugggacugaaaagguagucagaggucucuaggacaagcagggaguaucugaaacuggguugaugaugccauguggcucagagagaugauguuuagcaucugacugauugguccuuugacaacuaccuugggguccuggcucugcucuugagccucucuccuagguuacuucucugucaucuguucugucagcauaccauggaggccugcuagauagacaugguuauuaauuaacugaccaaguuaccagaggcauauaacuucaaaauccuguaugcaggcucauacuccuugggguccacagcuuauacggcagcuugaauuauagcaagucuacugaaacucuuucucuccccucauucuugaaaccccuuuucugacccaagcaguagcuucuuuuuuguuuuguuguguuuuugguuuuugguuuuuugagacaggguuucucugugcagcccuggcuguccuggaacuuacucuguagaccaggcuguccucgaacucagaaauccggccagcucaagcaguagcuucuuuagccuugcccacaugcugggaucuuugaugcccagagacaucagacauggcacagauguuccaaaaccaggugcuuauaauacccucacuuucugucuccucuaaccucggugcccucuccagugcuguuaugguucuucaucuucaucuguggacuccaggcccauuggccuacaugcucuguccacauccaaaaccaguuccuaaggagaaggcacuuucaccaagcagguagggcaucuaccaccuacccagccucccucccucaugccaugagugucuuucauacugcugggacuauauuugacacaacuuuucuaaaggauugguugggacucauuguugcugucuggcucagccagaagauagcauucucuucucucugcccugccaucagcucugcccguuuucucauucucacugauagcucugccuucuggaguuggagaaaauaaguccccaccaaccucauguguacuaacuggcccucuucucuucacuagauuguuauucuuaacauuucugacacaacuaaauauguugggcuuccaugacaaacucacauguagcugaguguagaagcacacgccugcaauuccaacuuuugagagacuggggcaagaggagaguuccaggacagcccaguagccugggcuacauagcaagacccugguuuguuuuaaauggggggaggaaggaagagauagcaauguagaccuguuccaucauggcucagcccugacaacucugaugcuagucauggcaagcuugguagugaccaagagucccaggcuucccuuccucaaacucuucccaagcuucuagcuaacuuagcaaccaaguuccucuugauggaugacuccacccucccaaggcuccuugguguugauaauggcuagagcauaugaaauuuuaagcacuugagagauucuacaaucccugccauguaccccacauaccugagguccuugugggaagauaaucuugauuuaggauucuagugaaguuguaggaaucacucccuucacacacacagccucaaguaucugaccgaaauaucagcugacauggaacaguucuaagauccaggcuuccuggagaaaggauggaguaagaagauaggagcucaaugccccaggaagucugcccaucugcugucuuccagauauaacuccuuccucucauuggggccacggagaggugaccuacaagcaccccuaagacucggagggaacuuguaggucccugggcauggguugagcugaggugagcagcccuuuguucagcagcuaugguuccuacacuuaaacuuggcuucccuagcucccagcucccaagacugcuccaaaaagcaaugcaauguuucucuccccauccugcagcaaacccaaauuauagaggcaccuuaaggagcccuucucuugccccagggguacugauagguauguggauguggccagcaccaucacuacucuaggccuggacccagccuggggccugguguucugugaaguuuagagcccugucucucuugugguuccagaaguuauugcuugucuggaaggaaggcuggcuguuguaccccacuuggcauuagcugaggccagguuucaaaagcaagccuucuucuguguuacagucccucuguccuucugaaauucuggaccugcucucauuuagccacuggucucccuaggauaugguuacauagaguggcagugccagaucuggggucuuaaccuuuugucuauagaucuuucccuagcuaccagcuccaugcuuucuguugcuggcccagaauggcuuucuagaaugcugggucuagugaaggauccuuugcaacuguguagcuuuguuuaaaccugguguguguggcauuuuuccucuguaagugguggucugauuuauuagccucuuacuccugaggugagccaccaugagaacuuugcugauagaacuccaaauuuuuuaccuuucagccagugucugccccaguagcccuaauuggccgccagucauugccugguugugcaaucacuaaauccaaaucugggugggcaguuuuuaaguugagacuagaccaguaauggcacagugcucucccugugucccaggaugccuuuguuagaacagagaagucaucuugcucugaguccauaguggccagggaagcgucauugucucuccuuguccugauacagccagugcuuuuccugacuugugaaaugacacagucucaacagcuacugcacucugaucuggaguaacacccaccuugcucagugucugaccacuggauagguaucuccaaaaagaguaccuaagagccugaggucuuugccaacccagcaaggcguggagucauagguccugaaaggcagggauuuaccugguacuauuucucauccugucuucccaggugguuagagaugcucaugguguauccucgaaccaacaagcagaaccagaagaagaaacggaaaguagagccaccuaccccacagguaggcugggcgacguguccccuaguggaacugggccugggaagaagugagggcaagaggguggagaagaucuggccagggcugagguggucacacuuugcaugccucuuccucccuccugccuguacccuaggagccauauuuaggucacugagcagacuagccugcuagagugcccugggcugucuucaggaggguuugaaccagcaggcaaauagugagcaauagcagcuuagccugugucccuuccccuggcauccaucccaucuacuucugggaacggaagaauggugcacucuucugccacuuccagaggaaagaaguaacccugagcaacagggaaagggaaaccugguaggucccugcccugacuagucccugugugaccagagcuagguagguggcuggggcagacgaaccagguccaguccuucccucccuuccuccuucucugccucccuguaucccucucauccucauucccucccuccuccuagccaguauccugggcucauggcaggaagugcgcugccccuauucuugcuguguucaccacacccuuaggcucuggaagggugaagucaccauucugaauuuccagcaagggccuuuugcuagggugguuguagguacuuaagguucaucuuuuccccucuguaccaaauguugcuuucaucaggauuuuuaccuacguuggacaaaucaagucaguccuaagaaugaacaaaauucauucuugaauguggucuuaugagccucacaaacccagagucuuguggaagcagagaggcagcccaagauaggagccugcgucccugagccaagcagucuuucuagcuucucuagcuucuugggcugcaaaagaaagacagccagaggcugcugaccuggaucuccacaacucuagacuacuguggacaguuaauccuacuaguaggauguagcccaggucugugucuggugaccagcauccauccugcaucucauccuuacccaagaagccccagagggcacccaagccagccuuccccagauaacagugcccccaacuggagucauuuaaaacaugcaaucaaagaaauuuaaaaauguagucaguuucccagaaacugaaaguagagccuuuugcuugggagcagcaguuaaugcucaaaaucucccaagcugccugguuugagagaaaaguccuggcugaguaacagugguuaggguuacgccuuguuuccauggugaugccuuggaagcauugcagcauagagcuucugccuccaaauaugguaacucucuauguaccagagacagccugggucaggcuagaaauuuggguguauccccucccccacaacuuugucucuuccaaaugaagcugcccuguggccaggcuccaacuuucugggccaguagaaagagcccuaugaucccagaacaggaaucaccccuucccugaggauaugccucagaacuagggcacagaguuccuagccuccucugccaguguuauggcaugccucuccccuuccccacagcuaaccucuggugagucucaggaaagagauuuagauugaagucucuggguacacccacacacacuuaagcaaccugcuaucagagccauuuauguggcaggugagcccgaagcucaguuuccaucucucucccauaucucugcacaaagccuagaagaguuucagguuaaaccacucaggaccagaagcuugguuucugcugggcccaagcuaaauucuucagguugaaccuaaagaaacuuagaugauagaggugauguucaccagacauauagguccuugaaaagaaggcuuagaguagaaggaaacaagagucccccaaggcagagugagagcaaguuuccuagcucucccaagagucuguuacucauaugggacuuaggaggguggcuuuuuucucugccagucccacaggcucgaggcccuuggcagagacgugggugagguucccuguucauuucuaggauucaugauuuuuuaaaaguuuuuuuuaaagauuuauuuauuuuauguauaugaguacacuguagcuguacagaugguugcgagccuucuuguuguuguugggaauugaauuuuucaggacuucugcucacucugaucaacucagcucucucuggcccaaagauuuauuuauuauuacaaauaaguacacuguagcugccuucagacucaccagaagagggcgucagaucucauuacagaugguugugagccaccaugugguugcugggguuugaagucaggaccuucggaagagcagucagugcucuuaaccucugagccaucucgccagccggauucaugauggugcccucuacuucaagacuucuuucucacuauggccccuucuccauuuucaugccagagaaauagagaauggcacgcugaagagagggugcggacucccuuuuccuugguucuggaagcccuucucagugccaggguccaucacagucugacagcaugaacauagcuggcuccucaggaauagggcgcaaugaaccugggcuuccauacccuuugcugacccaggcuggcucugugcagucugcaccucuuuguggccacauccaccaaacuagaucuuucauccaccugcucagaagaaaaagaaucuagcccaagaauggggauuuguuuaccuguccuccagaagacagaagagagaacaagcuccuuuggggucagcggugugggucagccccgauuauuugguuugagaccacaugggagugggauguggauauuuaucauccucucugucuuuguggcaagauaguaaucagcuaaaaccacccucuuggcagcccucucuggagauugguugggcacagaaugugaguggguacuacugggcagcugggauugccauccugucuuuaucuggguucaacaucuaaagaguccaauucucuguuuacucagaaacuggauuuguaugucugcugaguucuguucagggccgugccacuuuugugcccugggaaaacugggaagugacuugggcuaccaauaaagaacaacuugugcuugagaacaagguguucaugugacaggugugggugugcagguuucagugagaugcugugugucucagagugaggugcucaaacaauagacauugggauuuucucagaucugggaacugggaaguucaagguuaaagaagcagcagaugugggcccacuuccacaaaguagaucuccuggccucuuucacaggucacuaauuucauuugugagggcuccaccaccuccaccaccuccuccuccuccuccuuccuccuccuccuucuccuuccuccucccuccucuuccuccuucuccucccccccccuccuccuccuccuccucuucuucuucugcuuuccuccuccuccuccuucauuauuauuauuauuuauuaucacuaucauuauuauuacuauuuuuaaagauuuauuuauuuauuauaugugaguacacuguagcugucuucagacacuccagaagucagaucucauuucagaugguugugagccaccaugugguugcugagauuugaauucaagaccuucagaagagcagucugugcucuuaaccacugagccaucucuccagcccuugagggguccauuuucaagacuuaacaaaauccuaagggccccaccuccacaaaucaucaucaaggggauaggauuucuaauguaaaugagcaacaacugucaggccuuagugucugucuuauuucaguaguucuuucacaucaucccuuguguuccauuuaagcuaagagugggaaaaaccacagggugcugugcaauucacuuucuacauuuuccccaaugaucuugauagcagugggccuggcucagaggaguguguuccucuuuugucuuguccugucccccuuuguuuaugucucaaguaccuaugaguauaggaauggcagacuccuaugagcuuaccccuaguaauugggcugauauucuaggcacugucuggcaguauacagagagagcuuuuagauacuuggugacauggcucugguagaaaucaagaaccuuuccucugcaaggccucuuggacaaggcacuggugggugcaugacuucucaucccccaacacuguuuugauguuuuuauaucccuuguaauuuagcagccagaaccugugugcuagcuugggcuaugugcucauaugcuaccacccucacugcucucucucuaggagccugggccugcuaagauggcugucacuagcaguaguggcggcagcagugguagcagcagcagcauucccagugcugagaaaguucccaccaccaaauccacacucuggcaggaagaaaugagagccaaagaccaaccugaugggaccagccugaguccagcucaaagucccagccaaagccagccuccugcugcuugcaccccacgggaaccaggacuagaaagcaaagaaggugaguagcagcugaucagccugcggaccuccuuguuguggugaucugucuugcucugcuggagugggccucuguccaggaaauaggacgggacacugggcaugugauacagggcccuagcuagaggccugucauggguccugaacucuuccucccucugugcaucgugcagcaucaguucugggcagcacuggccuggcaugacuaguuccuggccuaugagauucagcuuggcuucucuaccucaccugugaaggagaaagguguagcaccuacuccauuggccucaggugaucuauaaacacgauucuuucugccucugugagaucucuguuccuguaccacagguuccuaccucauuagcucuuagaaccugcuggguugggugcuuccugucuuuagagggauagcaguuaggacaucagugccccucucuccucauuguuaccaucuuggucagcuccuggcuaagaagacgggccagagaggacaccauugacaucaccaugcccucuccacuuagaaugcugugcugcccuagcagaguuaguccccuucuuugccucucucaauuggaguucuuuagcauacacaccugucuacauuuacaguccaggugcucuacagcaugccuauaaaaggccuccucccugcuucaaaaaaaaaaaaaaaccuaagccugaaaaauguccuuuugguugguuucuuccuguggucugguaagaaaccauugguuaggauggaauccugcuucccuaccagaacuguacgaaagucccugccugcaaagugaccagacuggaggaaaggguagggaguaaaggcaauggagaugggugguccauuucugcccacaauuuucuccuuuuaccucuagcccauucauagcuguggggugugaguauggaggguguugaggcagcuucugggugaucaugugugggcuuuuggaaaguucugaugacagaacugacagcagucugagcaagcuuucucuugccuucuagaugaaagcaccauaaguggggaccguguggaugguggucggaaaguacggguagagagcggcuacuucucccuggagaaggccaagcaggaccugagggcugaggagcagcugcccccacuacucuccccacccagccccagcaccccacacagcagguaugguuguccuggaucgcccucacaggaacucagccacccccuucacuccccaggucuuccagccccaagccgaauggucuacagcaucugcccugccagccugggugaggccagcaggucaccuaaccacauggacuccagcagugcugggggguggggaacagagauacuggggagcaccuuugccuuuaaagccagcaggcaguaugccgcccuggccgacgucccuaaggccauccggaucagccaucgagaagccuuccagguggagagaaggcgguuggagcauaggacucgggcccggagcccuggcagggaagagguggcccgucuauuuggcaacgagcggagguaaggagggcacuagagggcuaaaaucauguauguacucacacaaguguacuucaggaacaugauuucuauucaguguguggagcauuuccucucugggucccagucugugguacuaguucucagcuccuggcagccagauacaggacuaagugcuggcuuauguagguugugcuucccagauuaggcccaguguggcugagucuuaggcuucuuggccuucucucuuauuagagagaacuucuauucucugagaagacucagagcugcagauagggacuaggcccuccucaugcugacaguucugcaguugucagagggcacugaagagauuccaagauacaggaaagugagggggcagcauagauccuucccaccaagaugcaagaggcagccagaaaagcugcugugugucucagcugccacuuuuauaaaaccucuggguuuugcugaaaggcuucccaccaguggcagagauagaguacuuacugcuggaaagauaaggcccuaccugcuuuucuuuugccccaaaguaccaagcuugaggacuagggaauguucuacccgugagucccccucugauucucuaccauaucucugagcuguguuuuguguccaggccagguuucuugcuuaacaccagacagguuucuaaagauccauggcugcccccaggagaguuuaaaagcacaucugugugcuuugcugugggugggagcacugcuuucauuagcuuuacaaagaaguccucuauucagaaaggcaacuccagaaauaucugcagugucuucccugcccugagugcaggcugaaguucagucagguguugagggcaggaugagauuagggaggacuuucucuuguccccuuuucucaacucaguuaguugacacccaacccagcuuguuucaaauggccuauggacccucaggaagacaguggacacuaagugcucccugguauuccauauaaucgucaaucuucacaguccaacaguggcucaggaaagcaccuguuacucuuacccuugcuucaaggaugugaaaacuugggugacccccaucccucauggugaauaacagcuagugggugggccuucagcaggaagucucugauucuaugauaggaaccagcaucagagcuccugauguccuucuaaagcauguggguagcagaaaugaaaggucuuguuaaccauuaaggaggccuucagggugggcaggggcagguuugcgcuggcugcugagcaggcuaauucugaugguuccaaaauggggucaacuaugcuuuacguuuaguggcaggccagaguuaacauuuugcccaccugcuuggcuaggcuccuugucagagauguuaauuuugaaugcauucuugucuaccugccugagauagaugcagucucuaggcuuuguucuugcauguucuucaccacuauggggaugauucucagcugguguuggugccuggacuacuucugcacauuaacccuguaacuaucccuuccugaaugaucuugcugguugguguugcucuuugaggacugcuaucugaggcccaaguaguccaccuggugcuggacuggauccuggucucugauaaguuagagugacaagaugccaguuacuuugcauugaguuacuguagccaagacagaccugccacacaguaaggaaguugaaaaccucaggguuacuuuuggaaaacuucaguaagccaguaagcaacccuaccugaguaccagcagcccugagcuuggaauuugcucuugagacuucugagccuuugaaggaguucuuauaggagguucuuagaccugugucugcuaaguguggagauccuuauaacacuuuuagugacuaacagaaagcuaauggaacucugaccucuccaccuugucagaguagcuugagugaagcuacucugucaccucuauuguuucagaaacaccaacuuagccacagagaacuagcuauaugcagagguugcccaagcuccuggucucaucaugucuuggcagcaucucugucaagcagcuauagcaaguccccccaagcaaguaguuucucaugcuaacuacucugcuuggaacccuauaaaccuauauuccauggugccagucuggccuggcacagcccuccuacuauccuggggccuugaaguacucuagccagauacagugcucucagcccgagaagaaacagcggcccugggauggugguguccagcucuucugcagcagucuagcuauacaggacaccuuggcugcacuuaaaagauuuuccucuaccuggcagccagcagcugcuuagcucacugcuuucccagccagucuccucaccucagccucuauaggcacagcaagcuaacccagcaccagucuucuaacgaccccgaguauggaggcagaacacacacaagcccuccugagcccuggcugccuuugcccucuuaccucccuugaggaaaggaacuguuaaggaagauuuguagugaccucugaaaagagagguuccuggguucuaggccaugacuuccucuugccuauuagagauuuuaacuuucugaaagggaccuuuaucacuuccucucagcuccacaccacugguucagaaugcaugccacgcccacgcucauugugagggaguaggcugucccuaggagagcaggccuuagguuuggugagaagagaccauccucccagcagguugaaaucagcucucagagcccagguaggcagcccaagucuucugccuaaucccucaaggggacuccuuaggcuaugugguaauuauggguuuccucucuucagccauuaccuugggguuugcugcuuuaaaucuuagauaacuuugauuuaucaugauuugaauuuuaaaagcagucuuuuucuguucauucauuucccagccuuauuuucuuucaggucuugcccucuccacccucugcuguguucgcgccuccuccaccugcuucgcuuccaucucagcuccgucgucccagccacagaccgccugacaaggccgcuggccuuucacaugaaaucaacugcuuuguuuuauuuugauuuugauuccuuuuaauguuagcagaaacuguuaauucaugggcuuuuaucuugcuaaauuuugaacacccuacuguggggugcauuauaacuagagggugcaauguuugcggagguggugguuguccuucauuguaucugacucagggagguuaccaagguguaccaagcuguaugaguccaauguuggagcagggccagugcaggcccaguguggaaagguucuauggcuguuccagcccagcgugaaugggggaaaguggagcucaaguagacugaaucugugcccuaaguccuaucaguacuguguaagcagugccucacuuguuuaacagaaaggcuaacacuggagcccagugagguaggccaggugugcaagcugacuacaggagccccuacuggacuugagacgaaguccaccuugggaacggggagacucgaguucagcagcuucauguccucuuuuguaggaggucccagguaauugagaaauuugaggccuuggacauugaaaaagcagagcacauggaaaccaacaugcugauucugaccacuccaucaagugacacucgucagggccgcagugagagacgggccaucccuagaaagcgggugagcuccaguguggggccaaguggggccuuuggcagcauggcuugggucuggggaacacagugccguacauguucugagucccauacauaccagggacauguuucuucugggccucuacucuguuccuuuccaguuagccucuugagcaucagccugucuuccacaucucccuccuacagcguuagccuucugugccacaaggugcuucaaugaguuuuagaucccaguuguaacuagcacaauuucuucccacugaggccacccaggaacaaagccgaauaugauaccuuuuuccuucuuuuguuuuuggaguggcaagcuguacccucguuucucugcuuagccuacaagguccaucagaccucagccguccuccuccuccuccuccucccagauuccuccagccuuuugcccaccugccucuucuguggccugcuguacccaagaucuucuuuccaguuucuuuguugcucacgaggugccugcugucugucuucuguaaccugagaagcugcaaaauugggugggaccagugauaaccaggcauccaaagaaaaggcugcucuacugaccaaagcaugccaggacaugggucaucccagaaccugcuguggggccuagacagcacugccccacucaaggagggaugaacuacccaacuuguuguccccaugcgugcccaggcugccuugagcuguacugauggguggcugcucucugccacaggacuuugccagcgaagcccccacagcuccucucucagaugcuuguccccugucuccacaccgaagagccaagucauuggacaggagguccacagaauccuccaugacggugagcccaggccacgugccaaguucucuggagaucugugccacuaccacugcugcuucuggccacucugggcucuguccauuuaugucuuuauguccacacuggcccucccucuguaccacccuuaugccugugagugccccacccacuggucugcaacccauuggcaacugaccauucuucccucuccuggguccaccaggacugggggcuguguggcacccugaguagcagcacauggaggucucugcacaggcggcugcacaaggccacugcggguguaaagccccaacuugaccucuacugucuugcuuuugguguuuauuuuuguggcacuuuggaacaggauccaugugguguugacaguuugucccauuugaggguauguacaggaaugaagcugcagacaaaguucggccugguuccucagcacagccuacagccuuccaggagacguggcacacuuaccagcucucaucccccagccagagcagguucucuaucagcucagcugguagccacuauuccuggcaaccaccagagacccagagaggaacgagccacagggaccagcuuccaccauuccuugaggcaggcacaacaaugauaaccacagcagaagguuuaagaaucuuucauagagcagcagcucagcaggcagugagcgggccuucaucccaagucuccugaagcaacagcugugcaccaucaaaaggggacuucccuuuguacaggucucagggcuggagcaugcuaaaguuugucuccacugcuguugguucuucaaacaauucuuguggaaggaagucuugugaaggaagcauggguuacagaaggcuccacaaagggaagccucauccuucuuuguucaguuguggcauggcaagagccugcuguggccucuccacaauggagcagggacucccaggaugccuguccugguuggugucacuucucuggaucaaucccuguccuuggaguaaucaaaaccaguuucugaucaggacagcuguggaagagaccuaagagcacuggggaccacagaagggguagcuggggucuucaaagccuguccuuccggguauacuuguagcaaaugagaacuuuguccccagcggaaugcaggaagcuccucacuagagcagcacccacucagaccugcugaugguccugaccuaccuuccuguguagggaauaaaacagaacuucuuccugguauaagaguaaccuuaaaguuggacaagguuguugcuacugcuuugucuaccccggacaugguuugccucucaggcuuguccuucugcagccucagcugaagccuuuggauuccccuuucagcagguguccccguguacuuaacaugccuggggacucuccaucugggcccaugcuaugacccaaggcagaaugagcaaagcccugaauaagccaggauagagaccuuagaccagcagccaggcagccugugcuccauggcccagguuugucccucaacuacuuucucagggacacaugccucugggcaagagaguaggcaggcuugucuggaaggugguggaaacuguuucugcugcugcuucaucuacauagaaacaacccuguuaagcauaguuguccaucacuggggaacccagaugguuucccuugagcuccucucuuuuuucuuucucagccugaccugcugaauuucaagaaaggcuggcuaaccaagcaguaugaggauggccaggugaguguguguguaagcgcugaggccuggaggacuggggagcagaugcaagucccagcuugucccuggugggguuggugagcccugauucaugcuuuuggccugcagacaaccuacaacauccuacaguuccugccuaugauugcuccuaaaaauucucuuagagucugugcuuccucagagccuauggcugugggguggcuuguguuuccaugcaaggcagcuauacauggcagacacauaaggcugcaaaacccuuguguuagaccaucucaucuuuaagggcacccuagaauugugaauuguaaauauuaaguccaaauaggaagaauuugcaagccucaccuuagccagaagcacguuaggcccuugccuuagaagccuauagaaacccagucugcucuccuagcuccguuugccuugggagacugugccaaagcauccccucuucuccuucuuccacccuauuuaaugcccuugccuuuaccugaagacucaaguucccuuccucagaacgaagauugggacuuuugcagguuaguuuguaccugcuggcacagugugcucacacuggugugucagccaagugacugugccucucagcaccuuucacagccaccguucugugugauggacccagaacugucugcagucucugcaguuaggauggaggccugcgaagcaccaucaccaaccacacacuggggcacagagcuggccaaggcccacuacucuccacugccucauugcugcagugcaucuaagcagggccucccugaggccaugagcgcauggcugccugccagaacagcccucuguugccugcuuuaccuguaucuccaggugcuagacucagcuggggucagggagggacgucagcuguguuugcaggguaguuggauguuuuaucuuucucucccuuaguggaagaaacacugguuuguccuggcagaucagagccugagauacuacagggauuccguggcugaggaggugagaacacuacaaggcauaaguggcaucuaaaaguccagggcugaagucugugaaaagguagccuacugccuugggugucaugguuucagucuacugggacaguacaugcagaugggccagcuuugauggcagaacuguugcccuccucagauauuauggucauucucuaaggacuugaguucgguaucuugaugcagugggcuuugacuacuuuguuuucuauauucuuuuaagaacaaugaaguugggcuggagagauggcucaacaguuaagagcacuggguuuuguagaggaucuggguuucuacaccuacauaaagacucacuaccaucuguaacucgaguuccaagggaucuggugcucucuucuccacaagcuccagguacacaugcgauacauaggcaugcgcacacgcaaaauacucauacaaguaaaccuaaaaaaugaaagaacaaugaaguuagcacucugggugaacucaggucuaguuuugucuuugguuuucaacaaaaaaaaaauugugguaaauugagucacuuaugucuugguuaacuuaugucuugcugugccuugugguagaggaacuuauauucaauaaaucauuuuuuguguguacuaggccguggggggaaacacuugccaugggacacuagugggugucagaggacagcguguggaggagccaguugucucaucuccuaccacacagccagcacuuuaccaaaugagccauuuccucaccacuccuagaagaccaaccagaagggcucuuuccuucaccuacaacaaagucuuuugaacaaccugacaaaucucuguccugcuuuaccccugcuaacuccaucugggguccuucagaaucaccauccauccucacgaaccucacauuugccauuccaugcucuuaagucgggggagggggguggaaggaacagaaucucuuggcugguuuauguauuuaaauuccugagaucggccuccaagaggaggcuggugaugagauaggcaggguacacuuugagcaaagguagaccuaguacucaaaacuuucuuugugugugccacagcauggccaacguguaggaguucucgccuucuccagggauugagcucagaucgucaggcuuagucacgagcauguuaccuguugaagauacaaguguucagugaaauguguugugaaagucaaaacugcuagagcuguguuuauauaacacggauggcacaaaagcagaaguacauaaaacugccagugccuugacaacaggccagagucagauuauaccaacagucaacaggcuuguauugcccuacaguuaaugauauuuaaaaacaauaaaauagguuccugguauuuuuaaguugcagcauuugaaugccauucucuauaguguucuuuuuuuuuaacuuuuauuauuacuauguucguguaugugcacacgugugugcaugaucuucuauguguggguacaaacaugucacgacucucuuguggacaucugaggguaauugugauguugauucuuuccuaguaucuuuaaauguguucuagggauggaacucaguuaucagaacuguguagggagcaucuuuguugaacauccccuuuuuaauggucuuuaagugggaaauguccaucagccauucagcugcaugccaaagccuuaccgaagaaguuacugaguuaccaacugaacuucaaguaauaguccacuucuuuguggacuauuacuugaagagacagcugacagauaaacucuggucacucaauuuugaguuugggaggcauuuucaugaaaacaaaccaggaaucuauuucuucaagaacaauuuauugccaguaaugaauagaguuugaacuuucaaaacaaacaauaaaaaauagcaauuuggguuagaaaguuagaucagcaguuaagagaucuugcugcucuuauaguggaccacauaggguucacaacccauguaccuucaguuccaggggauccagugccaccuacuggcaggcacuacucacccauaauacgcauauaggcauacagauaaaacauucacacauauaaaaagaaauacuuucaaagaauagccuagucugggcacgugacacaucuauuauuguuucugcuacucaaggcacugaagcagaggaaucacuugaauccaagaauuugagaccaacuuauacaguauucagagaccuugacucaagaagagaaagugaaaauguuggaagguuuuguucaucaucuuagcagcuucuauuaaucugcaaguucugcuggugacauaggcagggauugcauagauuuugcuccugcggaaugaauucuauagacauuugguauugucugugaccaauuauaaagcuacagaauaagccuggcaaaagagcuguugaaaggauagaagaacccugauuucuuuuuucuuuuucuuuuuuuuuuuuuuuuucgagacaggguuucucuguauagcccuggcuguccuggagcucacuuuguagaccaggcuggccucgaacucagaaauccgccugccucugccucccgagugcugggauuaaagucgugcgccaccacgcccgacuccccugauuucauuauuaacagcacaggacacucacuugauagaacugcagauuccacgcugcaguuaagcuuuaagacaugacuacucaucaagacagaccagccagccaaguccuugaaaauucucccuuucccaucucuguguuagaucacuuucucuucauauauguuagccaaaacgguaccugggaaacugacugagaagcagaagagcccagcauccucucccaggacagguguagaggcugcagaagugugaacacugccacucuauagacagugacuguggcuggagcagauuuugauuauuuuuuaauuuuaauuuaaauaugaaguggguuuaguaugugauucaaacuagcuuuaaacuugaagugcucuucucaaaccucccaagugcucaaauucuagaugugaacugccauauccagcuuuuauuaaaguuuuucuuaagugaauaauguuuaaauuuucuauuuucaauacagaaaauaucaucaauaguuaaacuuaacauaaacaaaauucuuaagaguguguccuagucuguuuuguuguuguuguuguugugauaaacacaauggccuauagcaguuugaagaagaaaggguuuauuucaccuuacagucuauaguccaucacagagggaagucaggucagcagcugaagcagagacgggaagacugcuacugccuugcuugcucucuauggcuggcuugcucaguuuuuuucuuauacuauccaggaccaccugccccagggucaaaaugcccaugguggacuaggcccuucuacaccaagaaaaugcuccaccagcuugcccagaggcaaucccucaauuaagguucuuuuuuuuuuuuuugacccuaguuuaugccaaguugacacaaaucuaaccagcacagagggucuucuuacuuuuuaagcauguagaaggauuuuaauaagaaaacauuuggggaucacuguagaauuucuuuggcuagauacacagagaaauggugguauugacaccccaagggacagcgcuuguagaaugguccugucuaguccuguaaagacaucacagaagcaugcucacucgggcguccucucuuccuggaccuccucacgcccucucauuuuucucugcaggcagcugaccuagauggagaaauuaacuuguccacuugcuaugaugucacugaguauccaguccagagaaacuauggcuuucagauacaugugagucuggggauggauggaguugccagcagaguuauaucuuaccacauguggucaguguuccaucuucccuauuaguggugauaucucuauccuguggcuacugaccuguacuccugauacaugguauggacaaaaaaaaaaaaaaaauggguuucuauaucuuuucccccaaggccuuuaaaaggcuuuguugcggaaauuguucuuuuucuuuucuuuuuauacuggaguguaggaccauuggaaggaugaagaguguggagaauaaaagauaagggcugcuggaaucagguuaaggggcuucuaguacauuugccugcuucagugaggcuucauagcuucauaaugguuauagucaacuggguuacucuccuuuuauuugguauccaucucuaaaccuggguucaagguuguuauuuguucuuucugauguggcacucuguuccuuauaucaucucgucacuaucaccaccaaauguggggccuaggcagaccacaguagcucucuagucacccagaauucuggacauguacugugcaccuauguggaggcugggccauuguucucccugcucccagccaguuuuguguccugucccuagggcuagccaagaucuuugaagagaagaacacaugugauagucugucuaugugccagcaaguagcaagugugcacugccuuguuuaggggacauuuaguucaccacuccccaagguguggccguauuagccugccugucucaagcagguccuauacaacauuccucgaaaaaucaccuagccuagcccucuuccuuuugggacuuuguuuauuuuagagauggaggcagcagucaccccaaugggcugaccacuaaugguuaguauuuuuuuguguagaccaaggagggugaguucacccucucagccaugacaucuggcauacgacggaacuggauccagaccauuaugaaacaugugcucccagcaucugccccagaugugaccagguaagaugaaggccuugcuaauugcccuaggguaccuggcauuccccgaggccugagcccaacuacacuccaacaugaauuccuuuccuccuggcccacugucagcugguuccauguucccugugauucuuugcuuuucuuccucugcugaccuuccuuacguugagcuggccugauaagccacacaggucacucucaugccuguucucagaguggaggucuuugucagcagaguuuagcccucagacuggguucaggcuccacugugggccuucgcugguagcugcacucuagcucuggguggaagcagaguuuugcuuuaugucuacuguaguuugcacuguuguuuuucacuucuucauuagagucguacaucugccugguugguaacauaaucgggagauacuucugucucagguggguccugaagcccacauuugaaaacucuguucccuuguguuaaugugcuauuguguguauuucuuagaacaugcagaauagaaaggggaggcauucuauucugaagauucuagaucucccaguguucaucuucaggacaacccagaggcuccaugugugacaagucuuacuguucuucacccaggucucaccuugaguacuuucugccucucuugguucauguugcugccaaguaugguuuugggaucagagguuucgguguauguuggccugugacagcauuggcuguaccuauucuuuccucaacgcucugucugucuggcucuauuucuuguugaaugagcaggaaaggaagccugaccuccugucuucaguccccuuccagggauuguuauauggucguuucuuuacucgucaguaaacagcauccugacugcugcaguacaggaccagugugggucugcaaggccuacuuuuauccauaaaauagcccucugucacucuucaagaacugugcuaggggguuagacagauggcugcucuuucagaggacccagguucaagucucugcacccacugaguuccaggagagccaacauccuuuucuggcccccauagacacugcguguacuugauacacagauguacaugcaggcaaaacacccauacacauuaaaaaaaaauuuuuuuuuaauuucuuuuaaaaaaaacuguugaaaaugaacaguggccucccuacccccauggcuccuccagucaagagaagagcccuauagcaaagugaaagacaccugagcugcucuucugagguggcaugcagagggagggagggaggguugaaaugucuagggcuggugucgagaacacucacuugugcauguuuaugcuauguuccauggaaggacugaggcccaaggcaugaaccuaaagacccuguaucucucucucguccacuggucuuccuggcuagaaucuacuuuauaguuuaaugugucuucaagcuuauaugaugccucuacacccacuguuuuuuagccuguguuguucuguuuggcccaucagaagguauuagaagcaaggacagcagugucagagcucucuucucauuucugccauguugucuaugcugagaccgucucacaugacuacaguacuucuggguugggacauccucccccaggagcauaacuguugagaagcauaacugucccugcucccaggugucagugucaacuccccacauagaccugagaugucaccaauuuucucaaaauuccaccaaaagguccacucaggguuguuuugguuuucccugugcaaggaucucacuauauugcucagguuggccucucccucugccauccugccuagccuaccaugugcugggucauauagacacauucaacucauuuuuaguggaccguugugagcucuuugguuuuuacugcuugcuucuauaacaggugacccaagggaaucacuuucucuuuugaugucccuuugacaaucuccuuuguugguccugacauaaauacaagugcuccuuggcucuuuccccuugggccauccuaucacaaagucugauacuucugauucuguuacgacuuggacgagaccagggcuaucuagcagucacugggacuuaugcccaaugagcccaguuagccccuuuccauaaugccaauaguaaugucuuaccccucucuccugcuggaguggaggccucuuccuuggggaagacugggaagagacagcuauccuucaugcuaaccaacuccuguugucucuguguaguuugaaggacuaacaggauugauaugcauggcugugccccuagucaccuccuuccucaaaguggugggcauuaugcuaccuuccaucugauugugugggcuuacgacuaccugagucacuuguccccuugaccaacagauagucacaaccucacucugaccugucaugccuggagucagaguuaaguuuugaaaucaaaaugagggugucuccuguuuauugaaaucccugaguccuucugagaagggcuaguucucaaucauucugucacugcauaguguaggguugcuucauaaccaaccucaccaagggucuggauaguggauaggccugucucucuccugggacuaauaaaaguccauuggcuuuaucccugucauccaugauaggacugccaugacauucccugcauacaguguuacuccauuuuuaaggaugaaaacugaagucucaggaauagcggaggcucuuuucccuucccauccccaucaacuagguuugaguucuccaagggaggaccaaguacauguggagcacucuuccauccacacucagaaggcacuuuggugugugggcuggcugacccugugaccuucuaaaguguccaagcucccugacagcuccuguguuuccuuacugccccacagcucauugccugagggaaagaauaaaagcacaucuuuugagaccugcucaaggucaacugagaagcaagaagcugagccaggagagccagauccugaacaaaagaagagccgugcucgagagcggaggcgggagggucgcuccaagaccuuugacugggcugaauuccgcccuauacaacaggcccuggcucaagaaagggccagcgcuguugggucuucugauucuggugacccugggugucuugaagccgagccaggugagcuggagcgugaacgagcucgacgucgagaagaacgccgcaagcgcuuugggaugcuggacaccauugauggaccaggaauggaggacacagcccuacguauggacaucgaccggagcccagggcugcugggaaccccugaccucaagacacagaauguccacguggaaauugagcagcguuggcaucaaguggagaccaccccucucagggaggagaaacaggugcccauugccccucugcaccuauccuuggaggacagaagugagcggcucuccacacaugagcucaccucucugcuagagaaggagguaauguggggcagcucccucccugcauguaaaaaacuguucaauaaaagcacauauucuuuguacuaugguaaaauagggauguggccuggggcuauggugagauccgguugagcaggcauuagauggaggcauucuaacaucuuguauagaaccauauaagcuagcucuuguguuauagcauaggauucucaucaaauauguccaauuauaucugcacauauauuuaugucaacagugaauucugugaccaaagaaguuacaggauuaaucuuuaaaugcuucaaaauccaaaagacuuuuaguugucacccugacacaagcagaaaauucccugccaugaaguuuuguuuuuauauaaaauuacuaaauacuauaauauagugggcuggggguauggucccaguguuacagcaucugcauaauccauaaagcccuggggguucaaucuccagcauggcaaaacaaagcaaaauguucaaaucacauguacaaaccauaacaugucuaaaguaaagauguaacaugguugaaguucauccuuauguuuggccuacaauguauacaguuacuccuacaauguauacaguuacuccuacaauguauacaguuacuccagaaucauuuuaaaaggaaaacaagaaacccuaaaaucuagaauacucaagugaacuauuugagaugugugcucagccugcauaggguuggguuuugcccguuuuugagcaucuuccucagcagauuucagguguagucuuaugcucuuuccguaacagccgauugaaguucugccacuucugccuguuuugccuuugguuuuguuuuguugacuguaugagccugauagaugguuacuagcacuuuggcuuuuccauuuucugugcccuuagguaaaaugaaauuaaguaaucuucuaaacuaucagaaugagcccucuggccuguagacugcauaccgagguguuuguuuuucgagguaggguuucuuuguggaguuccuggcuguccuggaacucaaucuguagaccaggcuggccuugaaucuacagagaucugccugccucugccucccaagugcugggauuaaaggcugugccaccaaugcccaguggaauucugaauucuuaacugaauaauagucugggguucaguguuuaacaucccucucccucucauaaaccagaaaucuaggguagcccccauacaguagagcaucaguaaggauuucagaauuugggggaaggguagauggugacuuugaguugaaaagagagcugggugugguggcgcacgccuuuaaucccagcacucgggagacagaggcagguggauuucugaguucaaggccagccuggucuacagagugaguuccaggacagccagggcuauacagagaaacccugucuugaaaagaaaauaagaaaaaaagaaaagagaauguagaucaguuacagguuuccauguuuaauuugaggauauacuagaacuuuaugugggaucuacgcuguaaacuuggucaaaugggauauucaguagaaacugaauguucuguaggaccugaaaaggggaccuacaugcuaggccaaggacccacccacaaucuuucuucugauaaaaaugugcaucguucuuuucucaaugaagcacagccaccuccccagauaagaacgugacacaugggccugcacauuacaacugccaacaaaugcagaaacuuacugggcuaggcagggcuuaccuaaagcaaaaacaggaaaugugcaccuuggccaccagagaagagcgauggugcugaugucgugcacaguucuauauauaugcuguguauccaaugagauguccgaugccagugaacaauccccauuguugucagcugcuuuugcuuauugucaucauguuugugaaguauguguauguguguuuucaccaacagcuggagcagagccagaaagaagccucggaucuucuagagcagaaccggcuucuacaggaccaguuaaggguggcccugggcagagaacagagugcccgggagggcuaugugcugcagguagggugggcagcugccaagucagcagugcacucaggggcuuccaugugaaaguugugcucaggcccacaggcuaggaaugugcaaacauggcaaagcuauggucagucaacagagaccaaggcucuuagugccgugguccuugcuguuaggacacugauuuggggaaauaugucccaaaucucuacuacugaggauuuucuuuugguuaugaaaucauuuugugaucucuucuuugggcuuucuagacauugugcuuuugugaaaacccauguauuuguaugucauuucucauuguuuucaccauagugagauugggcccaaugcacauacugaaaaaacugggccauacagcaggccaagugccaccuuagagccaacagcaagguaguauagagcuagaaaauuauaccaccagccaccuacccccauuccuuuuuaacuagucuaaguuucaggaggauauauggccaccuagcuaauuuaaccaaccaggagcaggguaaaagugguggcaacuaggugcugagcugauggcccacggccaguguccuucuccucaaggcaucuuccagaacucugcugcacucggauuccuaggguaccccugauguggauagccuggggugaggacaggcguugggcuuccuaggacccacgcuagcucugggacaugaaggaggugaaauguuguccuggguacugccaugguguuggggaacaaaaaugugacggagaauggaauagguugguagaacugaacugaagcucucagcaaagaccaaagauaagguacugguuuaagauugcuguuacgggcccagguucuagucucaacucuucccacugaucccagaaguacacuccuuuccauacaguagcagccuucugccuguguaauguagaacuugcucuccaaagaccuucagcuuucaaagaucuguagucucugccaaguugcucgcugacaugcccacaccuuuguauacuaaccuuaaucuuugucaucaaguugcuaguggaccuggaguccuucacuccccucaaccaaagaccuacuuuaccuucauggcuaucccucacacugcuguuguguucuggcuuaucuuugucccugaucugacauuauuguaccaucuucccuuccagccaacucacuguuguccuacuucagaccuugccuggaauuggccauggccaggcaucucccuucuacacagcccacucagaaagccuuuaggguauucagaccaugccuaauuaaaggucauuuucuuaagccuguuuugguuccaucauacaagacuugacuucauacuuggugguaaagacaccacuaaggagcuuugcacauugcuaacuuguguaucuaucauggaccuucgugugcaucuacacucaauagccuugcucagcaugggggcagcuuccugcugagccuaauaauacccaugagcuucaaaaugcuuacagucaaaagugaaagggggaaaggggcuuugcgggcgcuugaggguucagugaugcaagcucgggguagggugcugugcuaacugcugggagggcugcaugcuuuggugaaugugguguggaacuggaaccuaccugagugucacaucuguggcuuccccaccagcagacugagggagccugggcaggccacauucuaggugaggcuggccugacuuagcuguauugucuccucuuuauacucauuaguucugucucuugugugucucucaguauggggaguuuuguguuuuauuuuggguuuugcauguuucacucuuauuuugagcuuuaugaggguuuguuuuauuacauuuugcuucaugaucugcauuccccuuguucugucuucuugcagguagagauuaguuuucuccuuacgguggaggccugacuacgcuuucuaaaggaaauguccaauguuacuuugcugacaucucucgaguaguuaccugccuuccuucucuuccugucacagaaggaagugacgucacuuucuugugccuuaggccuugugcugcuuuaaacauguggucuagaacugcauacuuuguuuugcaaaaucaauuauuugguccuucagccucuguuguacuucucaguguguuccauuauucagcuuuauuugguuuauuucuucuagacacuguucaguuagagcuguuuuauugguguuuuuguccuguguucuguuuauguggaagcagcuauauuuacccaaaacaaaacaaacaaaacccacauuaauuugaauuuuuuucuuuaaaugaagaaaaaaaguugugcaaaggauuaaaggcaaacccacaaaggagcuuuucuaugauugauccuggccagaggugugacacucagaacaggguggccugaguguuacuaaccaguauuuaaucgguuuuuuuaagacugaaguggccaccucuccaucgggugccuggcagaggcuccauagagucaaccaagaccugcaaagugagcuggaagcucagugccggcggcaggagcucaucacacagcagauucagacccugaaacacagcuauggggaggccaaggaugcaauccgccaccaugaggcugagauucagacccugcagacgagacuugguaaugccgcugcagagcuggccauuaaggagcaggcucuagccaagcucaagggugagcugaagauggagcagggcaagguucgugagcagcuggaggaauggcagcacagcaaggccaugcugaguggccagcugagggccagugagcagaaacucagaaguacagaagcccggcuguuagagaagacacaggaacucagagaccuggaaacacaacaggcauugcaacgggaucgacagaaggaggugcagaggcugcaggaaugcauugcugagcucagccaacagcuggguaccagugagcaagcccagcgucugauggagaagaaguuaaagaggaacuauacauuguugcuggagagcugugagcaagaaaagcaggcacugcugcagaaccugaaggaaguagaggacaaggccagugccuaugaggaucagcuacaaggccaugugcagcagguggaggcccuccagaaagagaagcugagugaaacgugcaaaggcagugagcagguacauaagcuagaggaagagcuggaggcccgagaggccaguauccgccaguuagcccagcauguacagagccuccaugaugaacgggaucucaucaagcaucaguuucaagagcucauggaacguguggccacauccgauggggauguggcugagcuccaagagaagcugaggggaaaggaaguugacuaucagaaccuugagcacucacaccacagggucucuguccagcuacagagcgugcgcacucugcugagagaaaaggaagaagagcugaagcacauuaaggaaacacaugagagaguucuggaaaagaaagaccaagaccucaaugaagcuuuaguuaaaaugauugccuugggcagcagcuuagaggaaacagaaauuaagcugcaggaaaaggaagagugucuaaggagguuugugagugauucuccaaaggaugccaaggagccucugaguaccacagagccaacagaggagggcaguggcauuuugcccuuaggcucagucaccagaguauuuccuggcuuuccucacucucagccagaggaugaagauccaagugcuggccugggggaagaagggagcagugguagccucagcagagaggaaaacaccauacucccaaagucagcugauaugcccgagagggaggggcaucugcagagcacaucuaagucugauccaggagcuccuauaaaaaggccaagaaucagguucuccacaauccagugucaaagauacauacaccccgaggggugugcaaaggcauggacuagcagcacaucaucagauaccagccaggaccagucacccucagaggauaguguguccucagaagcuaccccgaacacacugccagcagcugcagaugcugaaaccuacaucucuauaauccacucucuggagacgaagcucuaugucacagaggaaaagcucaaagacguaacugugaggcuggaaagccagcaggggcagagucaggaggcauugcuugcacugcaccagcagugggcuggcacagaggcacaguugcgagagcagcuccgugccagccuguuacaggcuagcgcucuggccucucagcuagagcaggaaagacaacagaaggccacaaacauugaacaccacccuggggagcuggaagacuuccaagccaaaaauagccaagcccugacaugcuuagaaaacugcuggaaaaagcuaaggucuuugccaugggcugaccaggaggagggccaggaugcaugugcagccucccuggcuaacauagagaguaugcuugugagugccaucaaggcccuucaaccaugggcuuccccugcagagagcaggacgcaggcugagcaagagaaggagcaccccauagaaagugguauggcagccccugugcagcagcccugucagcccaucuugaaugagcaggaacacaggaagcugcuuucugcucagauaguccuggaggccucacucaucaaccagauagcugacucucuaaaaaauaccacuucagaugucuaugguguucucugugagcuuacucagucaggggaguggccacugaaggaagaaagugcugcccccucugcuggggcuccaguggagaucugggccaagaagguacuggugaauggugaguucuggagccaggucgagucacuaaguaaacaccuagggacacugggagaagaaacagccugcacaucaggagacaggcagcagcauacuccccaaagucuggcugaugccacauggauucgugcagagcucagcuaugccacacaaucaguaagagaauuguuccaccauaggcugcagagcauacaggagacccuacaagggacccaggcagcccuacagcagcacaagugcaugcugggagaaaucuugggagccuaccaaaccccagacuuugaaagaguaauacagcagaucuuagaaacccucaggcauccaacuggcagggaggaccagguacagacauccugggaccagaacccauuaggagagauacugaggccaggcacagauggcucccaagagccuuugcaggcuuugcaucagagcccugaaguccuugcugccauucaggaugagcuggcccagcagcugagagaaaaggcuagcauccuugaggagauuucagcugccuugccaguccugccuccuacagagccacuuggggguugccagaggcuucugcggaugucccagcaucucucauaugaaucuugucuagagggccuuggucaguauucuucauuacugguucaagaugcaauuauucaagcucaagugugcuaugcagcaugcagaauucggcuggaguaugaaaaagagcugagauuuuacaagaaggccugucaggaggcuaagggggcuucaggccagaaacgugcacaagcaguuggggcccugaaggaagaguaugaagaacuucuccacaagcagaagagugaguaccagaagguuaucacccucauugaaaaagaaaacacugagcucaaggccaaagugagccagauggaccaucagcagagaugucuacaagaagcagaaaacaaacacagugagagcauguuugcccuacagggcagguaugaagaggagaucaggugcaugguggaacagcugagccacacugaaaauacccugcaggcugagcguagccggguucucagccagcuagacgccucagucaaagacaggcaggccauggaacagcaucaugugcagcaaaugaagaugcuggaggacagguuccagcugaagguucgggagcuacaggcuguucaucaggaggaauugagggccuugcaggaacacuacauauggagccugcggggagcccucagccucuaccaacccucacacccagauuccucacuggccccugggccaucugagcccagagcugugccagcagccaaggaugaggccgaguccauguccgggcugcgagaacguauccaggagcuggaagcccaaaugggugucaugcgagaggagcugggccacaaagagcuggagggugauguggccgcccugcaggagaaguaccagcgggacuuugagagucucaagguccuuagcacaauuuauuuuucagagccacuucucuuuagugaugcaagaaaggggacauucugugcaacugaggucuuggauuugggauaagagauaguucuuaacuugcauucagcugcugcucaagcagaccugaguaacguucucgugcgccucuauuccugacccagaagggacacuagcaagaaagcaucccugugggaaaggagaguagggucuucccuugccuggcacggacacccuucaccuucuuacccucauagaaccccuucugacuucaacguugagguaucaguaugaggacugccucacaucucacccaccugagucuucucagagagcaggguuuggacaucaccacacagggauauuuguaaagcggugucaagggguccuuuccuauccuagcuucccaaggcagaguuggccuugugaugagcacugagucugagcaggcuucccacagucucccaggcugccugucaugcuucugggaacacuccuuuaucuuagacuguacggugugugacugccuagccauaaucaugaaaggucuuaaccaucuuuuagaauccagagguggucuaguagcugugucuucaucuucuuccccacuggaagguggacaggccccaagggugccuguuccagcugucuuuuugcaggccaguguuccugccacagugucugucacagcuguagcucaucagggcaucuaugacuguuucucaauacgccgacuccacacugaagggaauuaaugggacauucaggcuggagcuuuucguccucgcucccucugucugacacaggacagguugaugauacuugaggcacugguucucagcauuguuuuccugauuucugucuagaccuuuaaaaaacauuaagcauuguaaggaaauagcaaauuguguauuaagugauccuguggagagcaugcaccaccaucaccugcgucucuuugcagcugcaggagucuccacggccuggcaacuucauagucaguuagcaggccgucagaaugguuaugaagaauaugagagaauaccuuagaaaugaaaggcacagguuaagaggaggcuuugggcuugacauguaugucugugcccaagaacuugaggcccucuguugggcuuguggcacagcugcacagcagacugucuugagagcggaacagggaacaguuuuucucuggguuucuguccagaucaggaagccugggcugcugccacugccucacaccacuuaacaugaguccacaucuuagucccugaagaacuuguuaugauucuagagaugauuuaaaaacuaaaauuuggagcuggagagauggcucagcauuuaaaguacuuagcagcaaacaugaggacagaguuugaauccucagguauaaaugcuagguaggcacagugugaugugguccccuuauaaugcuagcaugaggcagauggcaaugaaggauucccaaagaaagagagauaguaaaucugcaagcucuggguccggugagaacuguaugaggugcaagugaucaaggcagaucagcauucagugccagccaucagccauggcuuccgugaacauauaaacaaauacacacucaacuuuuuguuguuuguuugacugcuuuuuagaaggguuguuuuuaguuguuguugcuauuguuugauuuuuuuuuuuuuuuuuugguugguugguuaguuuuuuaguuuuuuucaaaacaguuucucuguguagcccuagcuuuccuggaauuuacucuguagaccaggcugaccuccaacucacagagaucugccugccucugccucccuaguguuaagaguaaagucaugcaccaccacuuuccagcacacucaaaaauuuuaaauugguauauagagugacaauuaucaaauguaauacauuuaacaaugaaacaaccuaguuguuaaggauacauuaguaucuguuauaggaauuuugaacccuaucugcauguauuccaagauguucaaaucaaaauaaaacggaagagacuuccuauagggcaggcauccauuauauggaccuuagaaccugaaauaagccaaaauuuaaaaaagcacuaauagacuucgacaagcagaaacuuccacagcaaacagucuaugauaaguuccauuuaaacugcaggcacacuaaacaggcuauguagagaaggugacugguacagcacacacacugcacucagccucagaauggaagcaggaauguaaaggugcugaauagaggcucuuggaaacgacccucaguaaugugaggcucaggaaacaauaucaaagccuaaugauuggaugcuugguguucuuuauugaauccagcaaaaugauggggugggaacacagaguuagaauaacauuucuucaguuucuuuaaaucaugagaaagcuuguuuugcccagaaguggcuaucacaagguucuaaggaaugacccacagucaaaguagcugugagcugcagauggaacagggcaugcacuacugcuugguuggggagggcagcccuaacaggccaggccuggggcuccauggcuuugaggaauggggaaugagucccccuaggacucauuaucuauucugcuuggaagguaguaagguucucaguggguagccucugcucuccuuuaaaagagagaagggagaaggcacaggcuggcaguaaagauguugguuccgcucuggcucgugugaggacauccuugagguuuagaaaacagccgaggcuccucagcucccagaaaucagcccuguuuccccagcccacagaagaugaaccucacucucuccaccuagcacauuuguccgagcauaucugcuacucuaaccaauauaugugcuaccugguugugaugccacacagucccaggacaaagcuacacacagccuagguacuugaugcuagaaucacaagccacaucuugagaccauauaauuuccugaaccaagcagguggcuaccuuauuuauuacacaggacagccacuuggaagcaaagaaaaaccaauaagcccucuuccauucugcaggcuacaugugagcgaggcuuugccgccauggaggagacacaucagaagaagauugaagaccuacagaggcaacaccagcgggagcuagagaagcugcgggaggaaaaagaccgccuccuggcugaggagacagcugccaccauaucaggugggacuaaguccacgagcacagguuucccaugucuugggcugaaccuguaguucacaagaggauuggccuuaacauugcuuuucccuaagauuuaacuucuuagugggugguggugggcagcaucucuauccuuggccauccuuaaacucgcuauguacaugaggauaaccuugaacccacucuccuccacucacuuccccgugcuggaguaacagauaaaagacauguaccgucccacccugugaacguauugcuggagauuaaacaugguuccaugcaugguacuaguccaaaucagugccagccauagccuuaagcuucauuuuggagagagguauuugaagauucaaagugagucaaggacuagcuagagaaaucuauugagagccuccaaacuaaaagcuagugccccagcuauuugugacauugcagagaugguccccaauaggcgucccucacuuggaguaaucuucgacagagcauggauauacucuaacacagccccugcaaguguuucucacccaugucauguugaaguuucaguggcuuauguuaacagcaggggaaagugaagcagcucucagacacuuaauuuguaaacucaugugugaagagagcauugacauuuaccuaauuacuguagaguuuuucugauagcaaauauaacauaccuguagccagggggaauuaguuugugaauuuuuucagccuuuaucuaucccagagagggaguccuacugcugcugaaaucagagucaacaggggacagacauuacauuagccuaucauuggccuuguggagggauaaucuaguagagacacugccacuuguagcccuagauuuuguugcugaagguugguuauguccuuccugcagccauugaagccaugaagaaugcucaccgagaggagauggaacgagaguuagagaagagccagcggucucagaucagcagcaucaauucagacauagaagcccugaggcgacaguaccugugagucaccaacccugugagagcccugugggagagggcuacuuuaccaagucuaagacagcuuuaaggaugcucuuggggaggcgaggagaccuugguucuaacgacaacccacacuacuuugcucucaagacugagccuuaagaugcagauaaacaaauguaacaagugacauuuuaaaaucauaacuuaagcuagacaugaugauauuuguaaucccaguacuuaguagccugaggcuggaagauugccacaaaucugaagccagccuggacuguauauggagacccuauucuaaaacgaaacaaaguacuuuguacuuauuaggguugacugcagacaucaucccccaauuuguuuggaccacugcuacuauaucagcaccuuaaaaggaaccagggucuagcugguguuuuaugcuugguauaccacagcaguuuguguuaaaaguagccacagcugggcggugguggcgcacaccuuuaaucccagcacuugggaggcagaggcagguggauuucugaguucaagaccagccuggucuacaaagugaguuccaggacagccagggcuauacagagaagcccugucucagaaaaccaaaaaaaaaaaaaaaaaaaaagaagaaagaaagaaaguagccacgguguucuaggauucucaugaacugacuacacacguagcacaaagugcagcauggaaacaccuugugacguuuuccucgguaggagucacuucggggaggggacccuuggguuaguaccagaaguaucuauggauaagacuuugcugaggucucuggaguguucuggggcuaaaagcaacaacucaagaaguccaguggucaggcuuccuggacuggaggcucaucuagaagguccuucucgacucuucuggccauggggugcugagaagagucccuccaggacugguuuccuguugugccgagugucugugcuuugaaaugauacacugcccaaguggugcucuccaccuaugaccucucagaaacacagcucugcugucacacugguucugcccccuaguagcaucaccagugugccagcuguggcuagcccagaaaagauagagucauuucugcaaagugucccagacauucugugggcagacacugugcuaucacugucuagccguccggguccugcagugggggcagggcugagcauccccucucucugcagggaggagcugcagucagugcagcgggagcuggaaguccuuucagagcaguacucccaaaagugccuggagaaugcacaccuagcccaggcgcuggaggccgagcgucaggcccugcggcaaugccagcgugagaaccaggagcucaacgcccacaaccagguaaggccaaaaagcuaagccccaccuucauuugggcuacuggccaugauacuaccacaucugcccuuccugagacuuaagaaucuggugacuucucugaaucucuaguccucuaguugaaguaucucagaguuggggucucuguccugcagugcugggcuuacucucucacauuuguuucuauaagucauguucuuaaaauuuagugcuccuuagaaaauugggguucacuagaaucccagaugagugggauaugauacugaguucaauauaagcucuucuaucaacacccuauuuuugccugcuccgucugucaugcuugcccucugugccuucucaaaccacacugcacuguggguguaacuacuugggagucacugaaccacugcaguggcuugaagaagagcacuuaccagucagaaaggcgugagaaauuggagggacagaaguagaguaaucuuugggagcucaagugggaaaagauaacacugcccacagcagaacgauuuuaauuuuaagauccauggaaucuucgcucuagagacacaauuggcauuuugcugcuaugaguucugaaucaguucugaauucagcugaccaaacauagcaaauguuccagggaggaaaacagucauuugcaguggacaucuacuauuuucuuaucccuccucccugcauaauacguuacagcuaaggacuuaggaauuguguggaugguacuggguauuagacauaauguagagacagccuauuguauaugggaggauuaugcagauauuguaugccauuuguaaugggacuugaacauccacagaauuuggugccuaauagaggucucagaaccaauuucugacagguuauaaguccucacauagccucacaaccuauaugaacagcuuuuauguauccuuaaaugucuaccuuaaacauagcacugaacaugcacaaggcuugggggcuccauucuuaggccucuguacgcuacugguuaagaagugaccuucucuagugucuuaugcaacuguguguggggauggucacuguuguguugugcuguugucccccaggagcugaauaaccgccuggcugcggagaucacacgguugcggacacuacugacuggagacggugguggggaguccacuggguugccucucacacagggcaaggaugccuaugaguuagagguacuguaagaagcaaggcacugccuuauucaggagcuccugggucauacuaaagcucuuuaucuuagagucauugagggaccagauuuuaagaaaaggccagaaggguacaguucaauagaagaaugccugcuuacaugcaaaacucuggguucaucucuagcucuguagcagcuacaagaaaagaaagcuucaagcuaacuuuugaaagcuaugggaaggcccaaagucauugguuagcugacaaguacccugagguccacaggcagaaacaggggucccucuagaugccaugaggaucuucagggcuacaggaauccugcuguucucagauucuauuaugacuuaacuucucggaguccaggauguuuguuuucaaucacaacagcucauucugcaguggcaagcacauguacucccaacugcuuaggaagcugaagcaagaggauuccagagaaggcuagaaagaaaaagcaaaagcaaaaaacaaccguugaaagagggagagagaaaggaaagacucuaauucucacauauuagaguucucaacauguggguugagagucccccuggggcacacgucagauaucauaccuauuauauauuuauauuacaauucauaacaguagcaaaauuacagauaugaaguagcagcaaaauaauuuuaugguugagggucagcacaacauguauuaaaggguugcagcauuaggaaguuugagaaccaccaaaugaggauguagggcauccucaagaggaccccaguuagguuaagguuuuccuuuauaggugacucagacaagugaacaagaggagcuggcuagggugggcagaaauuccuauaggaacaguguaucuagaccuugacagcuacaucuccgggagcaagcaagucaguagugggaacucaguguaguccucaugccucuggacuagcaaggcuaacaguauuuuccccuuuccauuucuguagaagcacugagcaguauuuaagucguguguucuguuuagugucaguaaggguuggcucucuuccccgaaauguacaaagcaacugucugccagccaugcucuguauaugcagacuacaggauaccugguuccugagagucaguccucauuuucccucuucuuauaggucuuguugcgggucaaagagucagaaauccaguaccugaaacaggagaucagcucccucaaggaugaacuccagacagcccugcggguaagggccaaggguguggaggcaggacaaagaggggugaaagcugagaggucugaccagguccugcugggcucacuuuuucauggcaggacacucuacaagauugcaguccuaaagucagguucccuuaaaauaccagcgucugagcauaugccucagaaguagggcagucagaaggaagccucuagucaggcgguggugggucuguguuuccaugcauuuggauagguacaguaacacagagugcuaugugggugaagugaggcuuggucugccauuuaggcuggucuaguuggacccaucucaaaggaauuucuggagucagaaaguaaugauggaauccuuggugugaucaggucacuuaacaaaucuaaaaccuagaggcucucccugacugacuuccacaaggaacuguuagacagucaggaccacagcaggcuugcccccuguagucaucuacuuccugcaucauguuuucuuuaguguucagucuuugccucagagagggaggguacagggccauuuccgagugagucugacacccugucugcagccgccacucacuugugccuuuaucuguccaggauaagaaguaugcuagugacaaguacaaagacaucuacacugagcucagcauugccaaggccaaggcugacugcgacaucagcaggcugaaggagcagcugaaagcagccacagaggcacugggcgagaaaucuccugaaggcacuacugugucaggauauggugagcgaucugggugcuccucgugaagauguuuuggcacuugaaucaaacccaaaaaacugucuugagccaucccaaaucuccuuuaggcccacaugcacgggcucccccgcgagcugcuccucccauauccugcagcuccuuuacacagagcugcuuccauagaaacaaggggucauacuaucuguuucugaaaaacuuaagcagguagggggaguucuugcuaguuccuuaaucuaaauguuuagccauaaaaucuuugagggccacaggcaagcagaacagaaggaaccuacagccuguucaagaacaacaaaacugaccuguuuuugugcuggcugaaaagauccaggcacggacuggagagauggcucaguaguuaagagcacugacugcucuuccagagguccugaguucaaaugguggcucacaaccaucuguaauggggguccgaugcccucuucuggugugucugaagacagcaacaguguacucacauacaugaaauaaauaaaucuuuaaaaaaaaaaaagaaaagaagaagaagaagaauuauuggagaaaauauccagguauugugcagcacagcggggaaagaggcugcugagccacguacuguuggauucuuucugauaacugacgaguucaucuuaacuucaucaugacccuuucuuuauaaaagccccgcaaacugaaaaucuguucaaauccccuaauaucccuguaacugaacauuccuucagcaaauucaggaacaguauccaugacagcauucaaaugugccugcugggacaguccucuguguugcucaugggacacagacacggcuguucuggaaggcugcugacaacagcacaguuuacagucuagcucacuguaaaacggugaucaccauggucacuggguaggaagccaagaagcugaggcauuagagggaggaaguguguguucuuuuguccugccgugauaacuaaccucggaagaguauucacagaguacugcaucuguagacaagugccacacauugccgagugcuaagcaucauccauggacagccgugcacacaacaguccacucagcggugcagacugacugugggaagacagggagguguuuuuauguugauguaaagagaauuuuuugagauuugaguaaacaaggaaagccccacacccugacauacuuugugguauggcccaguguacaccuuugucauuuguguuuaagacauucuaagagcuguuuucuugauggguggauaaugaaaagaauauggacugauuccuuuugauacuaguccugugucagaaaucagcuagagauaaugaggccaguugguaugcccagaagucaaggucuaauuccagaguaggagauccuauccuuuguuaacaguauuauguguguagcuuaaaccccagugggaacccagugcuccagugcuugguugguuauuggauuuaggaaauguaugggugcacuaugcuagugaacucagaaccucccauauguucuguuugguucacaagauuguagaaagcaaaaguaaugagucuuuuuguuccuucagacauaaugaaaucuaaaagcaauccugacuuccugaagaaagacagauccuguguuacccggcaacucagaaacaucagguccaaggugagugagguccagcuuauagaugaggugggacuagaugaugcuggcaagaucaaacccaguacaggcacuacagugcaggcccuagcccagccauguagucacaauguucagaugauucuaguggcuucaagaaccauguuccaugucagcagaaccaucucagggccagggcuucaagaagcaagacaugaagagauucgugucucauacgaaucuugagccucucagaaggugggguaaaucugaccucuuggcuccacuguaugucuguucacugcacaucucuguaaucacacugacgcugccaaccuuggagaaaugaagucaaggaucccagugugcucucagauggaugugucuggggggugggggagagggccuggccagcgugcugcauuuagaacugauugugugugugucuuauuuuuugcucuuuccucugacaguccguaauugagcaggucucaugggauaacugagucgcgcccgcuuccaaguccccugucguauagguaaaccacuucucacucugcccacugcccucacaggcggcucugcaugcacucucacaccuccauagcacaucucuauguaauuaucuucacucaucuuucucugacaaacacacacccagucuacaugagaucucaauaacuguccuggaaguuggcacucuaaccucuccacagagcugagccugcccaaggccuccucaucuugacgggugggcacaauccagcaugcauacugggugacuugcacgacacugagcuccugucuccugucuuggaaacaaauugcagggagauaguagauacccacugagucuggcaagcacugcacucucaugaaagaccucagauaaccaggugguaacaaggcuguuuuggggagaccccugcagauagccaggugguaacaaggcuguuuuggggagaccccugcagauagccaggugguaacaaggcuguuuuggggagaccccugcagauagccaggggguaacaaggcuguuuuggggagaccccugcagauagccaggggguaacaaggcuguuuuggggagaccccugcagauagccaggggguaacaaggcuuuuuuggggagacccugcagauagccaggggguaacaaggcuguuuuggggagaccccugcagauagaacagaucccaguugugcuguucuguguggaacugaucaauacugcauggguagagucuuagaaauuauuuuguuccuaaaggccugucaaccauucacacagggauaaacacgaccugcuuuuguuuuucaugcaauacaaaagugugucuccccguagaagguaguagaguuggccauguggaguucagugccaggaauguugugccccaaggauacauguugaccuuuuuuauacagugauaacagcuuaagggcccuggccugguuggucccaccggcaguaaguacccaggcgugccaguuccuacucuacaugagucucucuaccuuccagcaagacagaagccagcaagggcaaucagcuugaacuuagaggaaacaagguugccuuagagaagaguauugaaaaagcccaaggauuuuaacauuggcuuuuuuaacuaaucuguuuuguuuucuaguuccaagcuaacuuauaugcuaaugugguuuaagcauauuggagacuacuuucuccaaccuaagguuaaacucagcucuugcccagaagcccucagaaagcacaguggucacuaugaacaaguggcuuuugggucagaauaagaaaggauauccagggaugggcaccaugaagaagauauguaaugaggugugccaucuacuugugaacuuguggggauacccagcacacggcucaguaacaagggacuggguagugguaaugcuaggaacagggaggcucuguucuagcaagaucccuauggcaaagacagccuugagagccauggagggcucuuguacuaagcagggucacuagucacacagugcuagaguagcucuguguucuuggagucacuagagcccugguaggugggaaaggacauugguuuccagaggacaccugacccucagaacaagcaggagggcagagaccuugagcuguuucucacgugauuuuucaggauuugcauggggacccaguuccauuguugugcucuguguccaaccucagcacacgcaugcacaaaguggggcccgagauggcagugcaugugugcugccuuugugcgcuuggagcgucccaggagcccuguuaagagagagaccugugcugggucgugauugggaccucccucacaugcuguaucaucuccugccuuggucagcuugcacagcagcagcauggccucuugagauccauagcagagaggauucuccucggugugaucaugggauggguguggaaggcugagcccugaagguaacuggcugcaccugaggccagaaaccucagagaaaugacacuucucaggguucaccucuaagggacaguaggucuugaaugcucuguccugagaaugguagugaguacagugaguaggcucacacuuccucugggcauccauugccauguagggccacuauggccauucagagccugcuccuuccacaugaggauuuuccuccauccagcacauggaacccaguccuagagcacauucuguccaaccaaaggagucucaggacgccugauaauaaagccucagcuagaacagaacauuuacggcagugccaaaaccccacuccccgggggugcuugguuuggccaguugcugagugguaagccaaaagaccucuguaacaucuuuuggaagucuggcugacauggaacuaccugaacucuggaggugagacuucaaagauaccuugaagcagguguuggucacacuguucacacacaugaucuguuaguaaaaaagacaguguguacucacucaagcacagccuuagcuaugugauagccuaacucaaaaaacgaaaguuauuacggggaaucugaugauaaggacacuaaccgcagcacaguuccuucuucauacccugcaggaggcugggccucaaccuuguggagcacugacugccccucuccuaauauaaccuguguuuacagcgaggcugagccugacaagguugauugccaacaagaaucaagguugaccugaccaugcuaaaaauauguugauugccaguucucuaagaacuggaguuccuuuuuucuuccagaaaugaaaacuuaggggaagaggaaagauauuuaagagaaaugugguaaauauucuguuccccaguuaguaaaauguuuuuugccuuaaaaaacaauaccaagaucacaggaguuaagucaugcguguguguguguguguguauauguguauguguguguaauguguugauagcucuaucugguggucuguuggggauuccccuugucuuaaagcaguaaguucauaaagacaaaggaaugagacaugcacauuccauauauaggaagaaugauaggugcccagguuuccaguccuccacccaaguguuucgugguuuugucugaagaaccaacccuaagcuagaacugagcuaugacacauggucuuguuucucuuuauuauuuuccccuuucucacccaaguacauuuuuacaggaaaaagcaaaucccagucacacuacuucuccagggauucucucagggcuucugcccucgcaugcccacuaaucucaggaucccucgccugcaccugcuacugaagcccacuacgccugcugcaccaacaccuaacugcuccuuccucucugucuccaccagagucugaaggaaggccugacggugcaggagcgcuugaagcucuuugaauccagggacuugaagaaagauuagcugcauccauuccacugacacauccuucccagcugguggcagcacaagccaagcgugguuuucaucuucaccugugcaucucauuguugcugucauuaacuguggggauggaugcaugagagacugcuguggggugcuugcuccagucccucccugucaauuccaacuuccuguugucuuuaucacagcuuuuuucccaugguauucucagauuagucacgcgcaagcaguagagugggacgguuuccccgcugauaccugagcagcccccuuguccucccagcacacucacugucaguauuaaggcacagcagccuguuaauaagcuagcccugccucagagugcacauguggggaccugccaguggcucugcucugccgcacacagcggagcaccacccuugauggucagagcagagccaccgaauguuguaggcuggccugauuucugaggggccuaggaaaguguccagccuggcccacuuccuuuugaugugggagggggacagcauuuuguaccuggccacugaugcagcuuagaaccauacccagauaauccggcaaauccuucacaaccuggaaaauguugaaagcaaccauuccuauuuugguuuuuuauuaaaucuugcacaaaagccccggccccucucauuccuuccuccgcucgugccucccuugcugugcuaauccuggucuucugguggcccggaagagugacuugcagccugaagcuucagacuugucaagugugauggguccucaaaguccucuggaggggaacauugcugggguuuaaucugucugaaaagaagcugccaugcugcuuggcagggugaggagaagcccgugugcaaagacagacugucaggacuggugauagcagcagugugugcucaggacccucguuagucugggcucuggaagggucccuugaauugucugcuucucauggagccauugacagggagccugugcuaacucugcuuuucuagcugaacaggaccugaaacuacccaaagcagucugcagcauuuucuuuaaaaaacaaaccaacaaaaacauuuuucucuauucucauaagaaaacauucauacuguaagaugcagcacacaggaguccccaugucagaugggagaggcaauagccucauagcuagauaugcgaucuggcuucuuaguccuggcuuguuaguguuaagugggucagauggauggucucugagcguacaaauucaacucaugaguccccuaaagguucuacaugaguugacguacaaggucuagcuggccuaauagacaggcaggucgaaacuucaagauaacggauuuguuacauaccaaagugugccacugaccagcaggcaagcccugggcuccccuuuucacacguuuuuaaguuccacucuggcacaugcucaguggucauuuauguuuucagcauuaugggcaagucagaccuguuaaaacaagcuuugagcucagagugggcuagccuucaggagccugggguugugcguugaggacuccuguucucucauacgguuuccuugcagcuauccugcugcccuugggacccucuggccccauugcauuaucuuccugccuugugcuuccugggaugcuacaaagagccugcggaagaugccaagccuaccauucaaaaggacacuugaucuuuugcucuucaccucagaauccuaggauaugaacuuugcugaagguacaaguaccuacaugucagaggcaagggcugggagacaggcacgcugcacccaucuaaucugucacucagggcuccuacugcaggcucguuuuugcugugauagagcacacacugcucuagggcuuguuucacguguggguaucugguauguuggccaaaugcugaacuggcagacauuccuggaucaucccccacugucuacgccagucugagcaguaacaugugcaggaucagggugcaucuugauuuucuugauggugacuucuggcaaaaaugaaccaaacaagaaguuggucuuccugagucccugaacugccggcccacugcagcaguuuauuuuagacugccacaugucuucuguccauucccuucccucacucccugagccagguucacuuuugccugaccccucuacaggcuucccauucccuggaaagaaguugaaguugguguguucagagaagagguauggaaugugcaaauggaguugguucaggcauauguaaaagaggaugcuuggcugagaauggguaguguagaucaagaagucacaggcugcucccaguacagucagucaguggcaugcuuucuuuuacacauuuguggucuaccagcaucuacaagcaaacuaccauuacagggaacauaccauuugacagugaauguaaauauaugcuuaaauuacaucuugcaagccuggcaugguggugcacgccuuuaaucccagcacucgggaggcagaggcaggcagauuucugaguucgaggccagccuggucuacaaaguuaguuccaggacagccagggcuauacagagaaacccugucucaaaaaaaaaaaacaaaaacaaaaacaaaaaaaaacaaaaaaaaaaaacuucaucuuugcacgugugaugccgagcacaucugccacacagggcuacuggcugcaccuuuuccaguaugguuguggccacaaugccacaauaauaggaggccagagccccaugaaguagggaguccccagagggaagaacgcuaggaaugugugcauucacugaguguaaacaaaggucagaguuggcaaacuccauuggaucuagcagaacacugaacugggcgcacucacucaugucuguacuccuaccaccugacgcuccaaaguacaaggucagucugggcuacauagcaagacuaucucacauacaggugggcuaagggcauggauauaaaauauauaaaauuugggguucaacuacagcacuacagagagcacacuuguggucuuuggaacauuuguccaaagggagccugagagauuugacuaggaaacaaauggguaugaaagauauuugaaggaauguguacuacuguuaaccucucuacagggggagauggugcgcugacuucuuucuacccuggaacugcagagaaagcaccgccucacugcugccaccuagcuggcgccgagggaaguagcuggcuagcacacagccugcacuguugggugugaaccagggcaucagcuuaguuagauuccugcaggccugccccacacaccugaccuccaacuaagccuggcucucaaagacaggcuggauaagcacccagaggcccuaugcagccuucccacucaugccauacuccauguaaguaagccagugcaagcugcacaccaaagucugcuggcagcuacagggacaacaguaacacccaaaccccagacucugcuaguggagagucaguaguuaccucuuggccagcggaggguuagcuguucaugcuaugcuguaaagaugacaucaccuaguaagcuacuuagaggcuaucaguguagggacucauacagccuuucucauuagagcucccagcauacauacaggacagccuauggccugcacuucacuugcucagccuuuccuguauaucagagcaagcaauauuaaguauuucuaaggcauggugcaggaacuuuugugcaaaguuugugugaguuuuaaaauaccccuuuugaagguauguaaaggcaguguucagugcaaaccccucucaaaugucaagaccauuaguuggcgaggcaugguagcacacacauuuaauuagcacuugggaggcagagaagcaggcuaaguucaagaccaaccuggucuacauagagaguucuaaaagauuuacacaguaaaaacugccuaaaaauuaaacaacaaaaaagacuauguuaauaaguaaugccuuuuaaaguuuugguuacucaacagacucugaagauauccuugcccacacucacagcaagcucugauucuuguuuaaaguauucugugagacuugcauagagccacucaaggaaaaccaguacuaugagggacucuuggcaccuugcccucagguuucucgggguguuuuucuuaggggaacuggcuggagcauacgcugcuucagguccaggagccuagcucuaacagcggggcuggacuugagugcagagcagcccagcuacccauaucucuagcgaccucacuguauauagcaugagacuccagguagcuccaugacuguauuucuguacugguaaggagguagcccaucaguagaguuaaaagugggacaguccaaaacuaaaggacuucagggccucuccaguuucgcaugggucacaggucagccuggagcagcuuccauuguggggcaggaccucauugcuggcauuugccauaaagagauaccacuguuaagaauccuagccacacaagcccacuccagcuugccacagcugacaugccauuggcucaucucuccuuuacaagguagucagaccacacaucuaauuuuauuugagcaagcuauagauuguaaagaacacuaaauucacuauuauguuuuguuucuaucacaaacuuugauauaaaugaauuuuaaaucauuuuaagauuuaccuuugauauuaaugcuuuaauuccaggauccaaaaccaguucugugguuacuaacuaauguggcuucaugcagguuugcuguguagaauauuaagaaccgcagucacaguggcuccuugacaaucagaacucuaggugaccuuccauuacugcugcuugacuggggguggggugcguguuugugaacagggcgccuggcagggccucuuauaucucgacagaaacaggcuuguacuaacucaccugcuauuuagguauuuugucagaacaaaauagucaauccagcugccaacuaaaaauuacauguagaagguaauggagccucacugagccagagaggcuucaagcacagcuucucagagccaguucaggccucuguguguaugcacaggguguggcuuccugcagacaacaugucccccaacuccucauuccaagaucuuaugguucaguguaaggcauuuccuacaaaguuuguggucagguucgcuauaauugaaauguuaauuuguagaaauauuuauuccuuugugugacaagcuagaguccuuggcuguagcucaccauuuuuacuguguaaauacugcuugguuuuacaugaacuguaucauaauaaacuauuuuugcauugcccucugcaugcauauggcugcugacuuugccagucaaagagcagaaccuaaagcccugaguuguaaagguacuagagaccagaaugggauagauagaaccugcugcucucucuacaaugguccucugaguuguuuucaggauauuuacauuagauuucacauuaaaagggauauuuuacauuuucacauauaagccauaauauuuugugucuaaagucuuugguacuuuggacuugguauagaaacuucaaggguuaguuaaaacaacagcaaaaauucugaaggggauuccuucauuaaucaagauacuauaacucuucauuguagcugucuuguguuuuuauuucuguggugcuggaguuggagcccagggccucaggcaugcuaagcagugccucuaccacgugagcuuauggaguuacugcucagacuggccgccgccucucuaguucagugaguacuagugugcaccacuauagcuggccuguccuucauggauuuacuugugauauaauucugucucauuuuuuguuuuguuucaaagcaucauaaccuaaaaaaagacaacccaaaauaacaguguucccuaauuguggaauauccuugaugguucuauuucauuuuuuguucauuaagcuuagaauaauaaaauuggccagacaaauggcuaccaaccuggugauuccagcacacgaggggcucaggucagaggauucaguuugaggccagccuggguuacacagcaaaauccugucuguccucauagucucccaaaagguaagauaauaacuggguuuuucacuauugucacaaaccuuauaaugaaaguauguggaacugacuagaaauacaaaaauuguuucuacuaaugagaaaucaacguaaguuuuuuaugaaacagcaaa

SEQ ID NO: 6036 - RNA, 14240 nt, Mus musculus
ggccauugucaguguuuuaaucccaaggacugggaaagaguuccagcaguagagaagaagaggcauccuuugcaguuccuuucaucuggucacuacuggcugucggcacagcuucugucacucaguucucacaauccucauagcgauaguuuucugucucagaaauacgaugugucuuguccaugggugaaugaagaacacuuguuucuguauaggaaaggacaguuuacccaaagcagguuuaggagacugcuagagagggccuguaauuaagacucaaguggaauagaagggacuggcauuggaaagaagagguaaggaaaauuaggacccuguccugggcuuccugauccagaaagugagcaggauuuggaucuaggcaagauggggcauuagacuacugucucuguccacugcucccugaaaagaccugcugcucaguugcagaacugccuaugcuacaaggcuaugcuggacccucaugguacccuccccagggugugugcucuugagcucugaggcucaccagaaagucuugugauccagcuuucagccauggggaaggaagcaugggccuuguguggaugagagcucugcuauccuggggcugccucaucccacccccaacaaacucucugaaauuuucgucaucaagcaaguuagaacucuucgaccagccugaugacuuuaauuggaaagggacugcaaaagauuugucuaacaggcacuugacagaugaagcccaugggauaaugauucugagcucaggguggguaccaggccucauacccugcucucagacaaggguacucucagucugguuagcaagauggugauaaaaaugggucuguagaacuacagagggaggcaggccaaccacaaguguccaacugcugcucuaagcauuuagugcuaagaaaggaagcccaccaaguaguagaccuuggauaguuuggugagaaguugcugucugccccaaaguccacccaccuguggcuucuggagcaggcuaugcuaguguuucccagugugaagcaacuggcaugauaggauacauugcagccagucugccuucccagaguauauguguuaaaacauuccagugucuuaaaugguguguauauauuauauccaugugugcauguauguugaccuuugcccuccaagaagucucagcaggauuccuuaaagcccagacagguaugggugagccuuugggucugucucccaaucuuagagcuagugcucaaagauguggcucuauuuaccuaccuccuuacguguuuuuuuguuuguuuguuuguuuuuuuuuuuucuauuuugaaucuacuauucccgaagcuuuuccucacugaucugagacuaggaucuuggcugccugcucucccuagcauuccucacugagcacuguccugaccccuccugcggugcaagccaggacacuguucuccauguagaaaauaaaguccagaggguguguccucuacauaaguccagcuuggcuugccccaccguggauggguggguaggaaguggugcugugaaggcugaggacugaaggcaagggguggguccugcugguggcugugggaccugacacaccaccccuuuugagugacuuguuuuguccuugcagcccaccacccucccucagggcaccaucaacaugaaccagugcacagaugugguggauggggaggcccgcacagggcagaaguucucccucugcauccugacaccugacaaggaacauuuuaucagggcagaaaccaaggagaucaucaguggguaaguuggccagagccacaggaggcacugucuguuugcucacccauuucuggggacuccagggcuucuaggucuuccuuggaacucuucacugauuggucguccucccaccccacaccucauccucacccugugccuccuuggcacucagcacacagugcugcuccugccuuccccucaaguaaaauaagcccucuuuucuaggcuguguaucaggcagccugcguggcggccccuuugagaaacgucccguguagcaccaaagccuccaggugauucacaugcauguauuuucgguccucagugauuaaccccauucauucucuacggcuggaagagggcaggugugucaucaaggcucugucugagguugagggguauaggcuguguauagcacaggguagagggaaguaaggacaugaagccaucugguuuaagcaaguacaaggccauugggagcauugucuuuuucuagcauccuuuaguugcaucucuaguguugcuuuucaggaaaccagacuauacuggccaagagauaacauuugguaggugacugagaauucuccuuucuagguuccuagaacaaccugaaggaguacuuugugugucuuccugaccuuaacccagaacccaagauuuaagaguuuccagggcuucuaaugaacccauccucuauaccaagcaaucugacggucaagaguaagggagcagucaggugugagugaucaucuguacuucugacugcagcuggugcuaccuggucuaauauagcacacauuucccaaguggaucuuccuagagagccucauccuccuagacuuggaucuaggagagggccugaauggcagaugggacugaaaagguagucagaggucucuaggacaagcagggaguaucugaaacuggguugaugaugccauguggcucagagagaugauguuuagcaucugacugauugguccuuugacaacuaccuugggguccuggcucugcucuugagccucucuccuagguuacuucucugucaucuguucugucagcauaccauggaggccugcuagauagacaugguuauuaauuaacugaccaaguuaccagaggcauauaacuucaaaauccuguaugcaggcucauacuccuugggguccacagcuuauacggcagcuugaauuauagcaagucuacugaaacucuuucucuccccucauucuugaaaccccuuuucugacccaagcaguagcuucuuuuuuguuuuguuguguuuuugguuuuugguuuuuugagacaggguuucucugugcagcccuggcuguccuggaacuuacucuguagaccaggcuguccucgaacucagaaauccggccagcucaagcaguagcuucuuuagccuugcccacaugcugggaucuuugaugcccagagacaucagacauggcacagauguuccaaaaccaggugcuuauaauacccucacuuucugucuccucuaaccucggugcccucuccagugcuguuaugguucuucaucuucaucuguggacuccaggcccauuggccuacaugcucuguccacauccaaaaccaguuccuaaggagaaggcacuuucaccaagcagguagggcaucuaccaccuacccagccucccucccucaugccaugagugucuuucauacugcugggacuauauuugacacaacuuuucuaaaggauugguugggacucauuguugcugucuggcucagccagaagauagcauucucuucucucugcccugccaucagcucugcccguuuucucauucucacugauagcucugccuucuggaguuggagaaaauaaguccccaccaaccucauguguacuaacuggcccucuucucuucacuagauuguuauucuuaacauuucugacacaacuaaauauguugggcuuccaugacaaacucacauguagcugaguguagaagcacacgccugcaauuccaacuuuugagagacuggggcaagaggagaguuccaggacagcccaguagccugggcuacauagcaagacccugguuuguuuuaaauggggggaggaaggaagagauagcaauguagaccuguuccaucauggcucagcccugacaacucugaugcuagucauggcaagcuugguagugaccaagagucccaggcuucccuuccucaaacucuucccaagcuucuagcuaacuuagcaaccaaguuccucuugauggaugacuccacccucccaaggcuccuugguguugauaauggcuagagcauaugaaauuuuaagcacuugagagauucuacaaucccugccauguaccccacauaccugagguccuugugggaagauaaucuugauuuaggauucuagugaaguuguaggaaucacucccuucacacacacagccucaaguaucugaccgaaauaucagcugacauggaacaguucuaagauccaggcuuccuggagaaaggauggaguaagaagauaggagcucaaugccccaggaagucugcccaucugcugucuuccagauauaacuccuuccucucauuggggccacggagaggugaccuacaagcaccccuaagacucggagggaacuuguaggucccugggcauggguugagcugaggugagcagcccuuuguucagcagcuaugguuccuacacuuaaacuuggcuucccuagcucccagcucccaagacugcuccaaaaagcaaugcaauguuucucuccccauccugcagcaaacccaaauuauagaggcaccuuaaggagcccuucucuugccccagggguacugauagguauguggauguggccagcaccaucacuacucuaggccuggacccagccuggggccugguguucugugaaguuuagagcccugucucucuugugguuccagaaguuauugcuugucuggaaggaaggcuggcuguuguaccccacuuggcauuagcugaggccagguuucaaaagcaagccuucuucuguguuacagucccucuguccuucugaaauucuggaccugcucucauuuagccacuggucucccuaggauaugguuacauagaguggcagugccagaucuggggucuuaaccuuuugucuauagaucuuucccuagcuaccagcuccaugcuuucuguugcuggcccagaauggcuuucuagaaugcugggucuagugaaggauccuuugcaacuguguagcuuuguuuaaaccugguguguguggcauuuuuccucuguaagugguggucugauuuauuagccucuuacuccugaggugagccaccaugagaacuuugcugauagaacuccaaauuuuuuaccuuucagccagugucugccccaguagcccuaauuggccgccagucauugccugguugugcaaucacuaaauccaaaucugggugggcaguuuuuaaguugagacuagaccaguaauggcacagugcucucccugugucccaggaugccuuuguuagaacagagaagucaucuugcucugaguccauaguggccagggaagcgucauugucucuccuuguccugauacagccagugcuuuuccugacuugugaaaugacacagucucaacagcuacugcacucugaucuggaguaacacccaccuugcucagugucugaccacuggauagguaucuccaaaaagaguaccuaagagccugaggucuuugccaacccagcaaggcguggagucauagguccugaaaggcagggauuuaccugguacuauuucucauccugucuucccaggugguuagagaugcucaugguguauccucgaaccaacaagcagaaccagaagaagaaacggaaaguagagccaccuaccccacagguaggcugggcgacguguccccuaguggaacugggccugggaagaagugagggcaagaggguggagaagaucuggccagggcugagguggucacacuuugcaugccucuuccucccuccugccuguacccuaggagccauauuuaggucacugagcagacuagccugcuagagugcccugggcugucuucaggaggguuugaaccagcaggcaaauagugagcaauagcagcuuagccugugucccuuccccuggcauccaucccaucuacuucugggaacggaagaauggugcacucuucugccacuuccagaggaaagaaguaacccugagcaacagggaaagggaaaccugguaggucccugcccugacuagucccugugugaccagagcuagguagguggcuggggcagacgaaccagguccaguccuucccucccuuccuccuucucugccucccuguaucccucucauccucauucccucccuccuccuagccaguauccugggcucauggcaggaagugcgcugccccuauucuugcuguguucaccacacccuuaggcucuggaagggugaagucaccauucugaauuuccagcaagggccuuuugcuagggugguuguagguacuuaagguucaucuuuuccccucuguaccaaauguugcuuucaucaggauuuuuaccuacguuggacaaaucaagucaguccuaagaaugaacaaaauucauucuugaauguggucuuaugagccucacaaacccagagucuuguggaagcagagaggcagcccaagauaggagccugcgucccugagccaagcagucuuucuagcuucucuagcuucuugggcugcaaaagaaagacagccagaggcugcugaccuggaucuccacaacucuagacuacuguggacaguuaauccuacuaguaggauguagcccaggucugugucuggugaccagcauccauccugcaucucauccuuacccaagaagccccagagggcacccaagccagccuuccccagauaacagugcccccaacuggagucauuuaaaacaugcaaucaaagaaauuuaaaaauguagucaguuucccagaaacugaaaguagagccuuuugcuugggagcagcaguuaaugcucaaaaucucccaagcugccugguuugagagaaaaguccuggcugaguaacagugguuaggguuacgccuuguuuccauggugaugccuuggaagcauugcagcauagagcuucugccuccaaauaugguaacucucuauguaccagagacagccugggucaggcuagaaauuuggguguauccccucccccacaacuuugucucuuccaaaugaagcugcccuguggccaggcuccaacuuucugggccaguagaaagagcccuaugaucccagaacaggaaucaccccuucccugaggauaugccucagaacuagggcacagaguuccuagccuccucugccaguguuauggcaugccucuccccuuccccacagcuaaccucuggugagucucaggaaagagauuuagauugaagucucuggguacacccacacacacuuaagcaaccugcuaucagagccauuuauguggcaggugagcccgaagcucaguuuccaucucucucccauaucucugcacaaagccuagaagaguuucagguuaaaccacucaggaccagaagcuugguuucugcugggcccaagcuaaauucuucagguugaaccuaaagaaacuuagaugauagaggugauguucaccagacauauagguccuugaaaagaaggcuuagaguagaaggaaacaagagucccccaaggcagagugagagcaaguuuccuagcucucccaagagucuguuacucauaugggacuuaggaggguggcuuuuuucucugccagucccacaggcucgaggcccuuggcagagacgugggugagguucccuguucauuucuaggauucaugauuuuuuaaaaguuuuuuuuaaagauuuauuuauuuuauguauaugaguacacuguagcuguacagaugguugcgagccuucuuguuguuguugggaauugaauuuuucaggacuucugcucacucugaucaacucagcucucucuggcccaaagauuuauuuauuauuacaaauaaguacacuguagcugccuucagacucaccagaagagggcgucagaucucauuacagaugguugugagccaccaugugguugcugggguuugaagucaggaccuucggaagagcagucagugcucuuaaccucugagccaucucgccagccggauucaugauggugcccucuacuucaagacuucuuucucacuauggccccuucuccauuuucaugccagagaaauagagaauggcacgcugaagagagggugcggacucccuuuuccuugguucuggaagcccuucucagugccaggguccaucacagucugacagcaugaacauagcuggcuccucaggaauagggcgcaaugaaccugggcuuccauacccuuugcugacccaggcuggcucugugcagucugcaccucuuuguggccacauccaccaaacuagaucuuucauccaccugcucagaagaaaaagaaucuagcccaagaauggggauuuguuuaccuguccuccagaagacagaagagagaacaagcuccuuuggggucagcggugugggucagccccgauuauuugguuugagaccacaugggagugggauguggauauuuaucauccucucugucuuuguggcaagauaguaaucagcuaaaaccacccucuuggcagcccucucuggagauugguugggcacagaaugugaguggguacuacugggcagcugggauugccauccugucuuuaucuggguucaacaucuaaagaguccaauucucuguuuacucagaaacuggauuuguaugucugcugaguucuguucagggccgugccacuuuugugcccugggaaaacugggaagugacuugggcuaccaauaaagaacaacuugugcuugagaacaagguguucaugugacaggugugggugugcagguuucagugagaugcugugugucucagagugaggugcucaaacaauagacauugggauuuucucagaucugggaacugggaaguucaagguuaaagaagcagcagaugugggcccacuuccacaaaguagaucuccuggccucuuucacaggucacuaauuucauuugugagggcuccaccaccuccaccaccuccuccuccuccuccuuccuccuccuccuucuccuuccuccucccuccucuuccuccuucuccucccccccccuccuccuccuccuccucuucuucuucugcuuuccuccuccuccuccuucauuauuauuauuauuuauuaucacuaucauuauuauuacuauuuuuaaagauuuauuuauuuauuauaugugaguacacuguagcugucuucagacacuccagaagucagaucucauuucagaugguugugagccaccaugugguugcugagauuugaauucaagaccuucagaagagcagucugugcucuuaaccacugagccaucucuccagcccuugagggguccauuuucaagacuuaacaaaauccuaagggccccaccuccacaaaucaucaucaaggggauaggauuucuaauguaaaugagcaacaacugucaggccuuagugucugucuuauuucaguaguucuuucacaucaucccuuguguuccauuuaagcuaagagugggaaaaaccacagggugcugugcaauucacuuucuacauuuuccccaaugaucuugauagcagugggccuggcucagaggaguguguuccucuuuugucuuguccugucccccuuuguuuaugucucaaguaccuaugaguauaggaauggcagacuccuaugagcuuaccccuaguaauugggcugauauucuaggcacugucuggcaguauacagagagagcuuuuagauacuuggugacauggcucugguagaaaucaagaaccuuuccucugcaaggccucuuggacaaggcacuggugggugcaugacuucucaucccccaacacuguuuugauguuuuuauaucccuuguaauuuagcagccagaaccugugugcuagcuugggcuaugugcucauaugcuaccacccucacugcucucucucuaggagccugggccugcuaagauggcugucacuagcaguaguggcggcagcagugguagcagcagcagcauucccagugcugagaaaguucccaccaccaaauccacacucuggcaggaagaaaugagagccaaagaccaaccugaugggaccagccugaguccagcucaaagucccagccaaagccagccuccugcugcuugcaccccacgggaaccaggacuagaaagcaaagaaggugaguagcagcugaucagccugcggaccuccuuguuguggugaucugucuugcucugcuggagugggccucuguccaggaaauaggacgggacacugggcaugugauacagggcccuagcuagaggccugucauggguccugaacucuuccucccucugugcaucgugcagcaucaguucugggcagcacuggccuggcaugacuaguuccuggccuaugagauucagcuuggcuucucuaccucaccugugaaggagaaagguguagcaccuacuccauuggccucaggugaucuauaaacacgauucuuucugccucugugagaucucuguuccuguaccacagguuccuaccucauuagcucuuagaaccugcuggguugggugcuuccugucuuuagagggauagcaguuaggacaucagugccccucucuccucauuguuaccaucuuggucagcuccuggcuaagaagacgggccagagaggacaccauugacaucaccaugcccucuccacuuagaaugcugugcugcccuagcagaguuaguccccuucuuugccucucucaauuggaguucuuuagcauacacaccugucuacauuuacaguccaggugcucuacagcaugccuauaaaaggccuccucccugcuucaaaaaaaaaaaaaaaccuaagccugaaaaauguccuuuugguugguuucuuccuguggucugguaagaaaccauugguuaggauggaauccugcuucccuaccagaacuguacgaaagucccugccugcaaagugaccagacuggaggaaaggguagggaguaaaggcaauggagaugggugguccauuucugcccacaauuuucuccuuuuaccucuagcccauucauagcuguggggugugaguauggaggguguugaggcagcuucugggugaucaugugugggcuuuuggaaaguucugaugacagaacugacagcagucugagcaagcuuucucuugccuucuagaugaaagcaccauaaguggggaccguguggaugguggucggaaaguacggguagagagcggcuacuucucccuggagaaggccaagcaggaccugagggcugaggagcagcugcccccacuacucuccccacccagccccagcaccccacacagcagguaugguuguccuggaucgcccucacaggaacucagccacccccuucacuccccaggucuuccagccccaagccgaauggucuacagcaucugcccugccagccugggugaggccagcaggucaccuaaccacauggacuccagcagugcugggggguggggaacagagauacuggggagcaccuuugccuuuaaagccagcaggcaguaugccgcccuggccgacgucccuaaggccauccggaucagccaucgagaagccuuccagguggagagaaggcgguuggagcauaggacucgggcccggagcccuggcagggaagagguggcccgucuauuuggcaacgagcggagguaaggagggcacuagagggcuaaaaucauguauguacucacacaaguguacuucaggaacaugauuucuauucaguguguggagcauuuccucucugggucccagucugugguacuaguucucagcuccuggcagccagauacaggacuaagugcuggcuuauguagguugugcuucccagauuaggcccaguguggcugagucuuaggcuucuuggccuucucucuuauuagagagaacuucuauucucugagaagacucagagcugcagauagggacuaggcccuccucaugcugacaguucugcaguugucagagggcacugaagagauuccaagauacaggaaagugagggggcagcauagauccuucccaccaagaugcaagaggcagccagaaaagcugcugugugucucagcugccacuuuuauaaaaccucuggguuuugcugaaaggcuucccaccaguggcagagauagaguacuuacugcuggaaagauaaggcccuaccugcuuuucuuuugccccaaaguaccaagcuugaggacuagggaauguucuacccgugagucccccucugauucucuaccauaucucugagcuguguuuuguguccaggccagguuucuugcuuaacaccagacagguuucuaaagauccauggcugcccccaggagaguuuaaaagcacaucugugugcuuugcugugggugggagcacugcuuucauuagcuuuacaaagaaguccucuauucagaaaggcaacuccagaaauaucugcagugucuucccugcccugagugcaggcugaaguucagucagguguugagggcaggaugagauuagggaggacuuucucuuguccccuuuucucaacucaguuaguugacacccaacccagcuuguuucaaauggccuauggacccucaggaagacaguggacacuaagugcucccugguauuccauauaaucgucaaucuucacaguccaacaguggcucaggaaagcaccuguuacucuuacccuugcuucaaggaugugaaaacuugggugacccccaucccucauggugaauaacagcuagugggugggccuucagcaggaagucucugauucuaugauaggaaccagcaucagagcuccugauguccuucuaaagcauguggguagcagaaaugaaaggucuuguuaaccauuaaggaggccuucagggugggcaggggcagguuugcgcuggcugcugagcaggcuaauucugaugguuccaaaauggggucaacuaugcuuuacguuuaguggcaggccagaguuaacauuuugcccaccugcuuggcuaggcuccuugucagagauguuaauuuugaaugcauucuugucuaccugccugagauagaugcagucucuaggcuuuguucuugcauguucuucaccacuauggggaugauucucagcugguguuggugccuggacuacuucugcacauuaacccuguaacuaucccuuccugaaugaucuugcugguugguguugcucuuugaggacugcuaucugaggcccaaguaguccaccuggugcuggacuggauccuggucucugauaaguuagagugacaagaugccaguuacuuugcauugaguuacuguagccaagacagaccugccacacaguaaggaaguugaaaaccucaggguuacuuuuggaaaacuucaguaagccaguaagcaacccuaccugaguaccagcagcccugagcuuggaauuugcucuugagacuucugagccuuugaaggaguucuuauaggagguucuuagaccugugucugcuaaguguggagauccuuauaacacuuuuagugacuaacagaaagcuaauggaacucugaccucuccaccuugucagaguagcuugagugaagcuacucugucaccucuauuguuucagaaacaccaacuuagccacagagaacuagcuauaugcagagguugcccaagcuccuggucucaucaugucuuggcagcaucucugucaagcagcuauagcaaguccccccaagcaaguaguuucucaugcuaacuacucugcuuggaacccuauaaaccuauauuccauggugccagucuggccuggcacagcccuccuacuauccuggggccuugaaguacucuagccagauacagugcucucagcccgagaagaaacagcggcccugggauggugguguccagcucuucugcagcagucuagcuauacaggacaccuuggcugcacuuaaaagauuuuccucuaccuggcagccagcagcugcuuagcucacugcuuucccagccagucuccucaccucagccucuauaggcacagcaagcuaacccagcaccagucuucuaacgaccccgaguauggaggcagaacacacacaagcccuccugagcccuggcugccuuugcccucuuaccucccuugaggaaaggaacuguuaaggaagauuuguagugaccucugaaaagagagguuccuggguucuaggccaugacuuccucuugccuauuagagauuuuaacuuucugaaaggg

SEQ ID NO: 6037 - RNA, 5350 nt, Mus musculus
gagaaaugugguaaauauucuguuccccaguuaguaaaauguuuuuugccuuaaaaaacaauaccaagaucacaggaguuaagucaugcguguguguguguguguguauauguguauguguguguaauguguugauagcucuaucugguggucuguuggggauuccccuugucuuaaagcaguaaguucauaaagacaaaggaaugagacaugcacauuccauauauaggaagaaugauaggugcccagguuuccaguccuccacccaaguguuucgugguuuugucugaagaaccaacccuaagcuagaacugagcuaugacacauggucuuguuucucuuuauuauuuuccccuuucucacccaaguacauuuuuacaggaaaaagcaaaucccagucacacuacuucuccagggauucucucagggcuucugcccucgcaugcccacuaaucucaggaucccucgccugcaccugcuacugaagcccacuacgccugcugcaccaacaccuaacugcuccuuccucucugucuccaccagagucugaaggaaggccugacggugcaggagcgcuugaagcucuuugaauccagggacuugaagaaagauuagcugcauccauuccacugacacauccuucccagcugguggcagcacaagccaagcgugguuuucaucuucaccugugcaucucauuguugcugucauuaacuguggggauggaugcaugagagacugcuguggggugcuugcuccagucccucccugucaauuccaacuuccuguugucuuuaucacagcuuuuuucccaugguauucucagauuagucacgcgcaagcaguagagugggacgguuuccccgcugauaccugagcagcccccuuguccucccagcacacucacugucaguauuaaggcacagcagccuguuaauaagcuagcccugccucagagugcacauguggggaccugccaguggcucugcucugccgcacacagcggagcaccacccuugauggucagagcagagccaccgaauguuguaggcuggccugauuucugaggggccuaggaaaguguccagccuggcccacuuccuuuugaugugggagggggacagcauuuuguaccuggccacugaugcagcuuagaaccauacccagauaauccggcaaauccuucacaaccuggaaaauguugaaagcaaccauuccuauuuugguuuuuuauuaaaucuugcacaaaagccccggccccucucauuccuuccuccgcucgugccucccuugcugugcuaauccuggucuucugguggcccggaagagugacuugcagccugaagcuucagacuugucaagugugauggguccucaaaguccucuggaggggaacauugcugggguuuaaucugucugaaaagaagcugccaugcugcuuggcagggugaggagaagcccgugugcaaagacagacugucaggacuggugauagcagcagugugugcucaggacccucguuagucugggcucuggaagggucccuugaauugucugcuucucauggagccauugacagggagccugugcuaacucugcuuuucuagcugaacaggaccugaaacuacccaaagcagucugcagcauuuucuuuaaaaaacaaaccaacaaaaacauuuuucucuauucucauaagaaaacauucauacuguaagaugcagcacacaggaguccccaugucagaugggagaggcaauagccucauagcuagauaugcgaucuggcuucuuaguccuggcuuguuaguguuaagugggucagauggauggucucugagcguacaaauucaacucaugaguccccuaaagguucuacaugaguugacguacaaggucuagcuggccuaauagacaggcaggucgaaacuucaagauaacggauuuguuacauaccaaagugugccacugaccagcaggcaagcccugggcuccccuuuucacacguuuuuaaguuccacucuggcacaugcucaguggucauuuauguuuucagcauuaugggcaagucagaccuguuaaaacaagcuuugagcucagagugggcuagccuucaggagccugggguugugcguugaggacuccuguucucucauacgguuuccuugcagcuauccugcugcccuugggacccucuggccccauugcauuaucuuccugccuugugcuuccugggaugcuacaaagagccugcggaagaugccaagccuaccauucaaaaggacacuugaucuuuugcucuucaccucagaauccuaggauaugaacuuugcugaagguacaaguaccuacaugucagaggcaagggcugggagacaggcacgcugcacccaucuaaucugucacucagggcuccuacugcaggcucguuuuugcugugauagagcacacacugcucuagggcuuguuucacguguggguaucugguauguuggccaaaugcugaacuggcagacauuccuggaucaucccccacugucuacgccagucugagcaguaacaugugcaggaucagggugcaucuugauuuucuugauggugacuucuggcaaaaaugaaccaaacaagaaguuggucuuccugagucccugaacugccggcccacugcagcaguuuauuuuagacugccacaugucuucuguccauucccuucccucacucccugagccagguucacuuuugccugaccccucuacaggcuucccauucccuggaaagaaguugaaguugguguguucagagaagagguauggaaugugcaaauggaguugguucaggcauauguaaaagaggaugcuuggcugagaauggguaguguagaucaagaagucacaggcugcucccaguacagucagucaguggcaugcuuucuuuuacacauuuguggucuaccagcaucuacaagcaaacuaccauuacagggaacauaccauuugacagugaauguaaauauaugcuuaaauuacaucuugcaagccuggcaugguggugcacgccuuuaaucccagcacucgggaggcagaggcaggcagauuucugaguucgaggccagccuggucuacaaaguuaguuccaggacagccagggcuauacagagaaacccugucucaaaaaaaaaaaacaaaaacaaaaacaaaaaaaaacaaaaaaaaaaaacuucaucuuugcacgugugaugccgagcacaucugccacacagggcuacuggcugcaccuuuuccaguaugguuguggccacaaugccacaauaauaggaggccagagccccaugaaguagggaguccccagagggaagaacgcuaggaaugugugcauucacugaguguaaacaaaggucagaguuggcaaacuccauuggaucuagcagaacacugaacugggcgcacucacucaugucuguacuccuaccaccugacgcuccaaaguacaaggucagucugggcuacauagcaagacuaucucacauacaggugggcuaagggcauggauauaaaauauauaaaauuugggguucaacuacagcacuacagagagcacacuuguggucuuuggaacauuuguccaaagggagccugagagauuugacuaggaaacaaauggguaugaaagauauuugaaggaauguguacuacuguuaaccucucuacagggggagauggugcgcugacuucuuucuacccuggaacugcagagaaagcaccgccucacugcugccaccuagcuggcgccgagggaaguagcuggcuagcacacagccugcacuguugggugugaaccagggcaucagcuuaguuagauuccugcaggccugccccacacaccugaccuccaacuaagccuggcucucaaagacaggcuggauaagcacccagaggcccuaugcagccuucccacucaugccauacuccauguaaguaagccagugcaagcugcacaccaaagucugcuggcagcuacagggacaacaguaacacccaaaccccagacucugcuaguggagagucaguaguuaccucuuggccagcggaggguuagcuguucaugcuaugcuguaaagaugacaucaccuaguaagcuacuuagaggcuaucaguguagggacucauacagccuuucucauuagagcucccagcauacauacaggacagccuauggccugcacuucacuugcucagccuuuccuguauaucagagcaagcaauauuaaguauuucuaaggcauggugcaggaacuuuugugcaaaguuugugugaguuuuaaaauaccccuuuugaagguauguaaaggcaguguucagugcaaaccccucucaaaugucaagaccauuaguuggcgaggcaugguagcacacacauuuaauuagcacuugggaggcagagaagcaggcuaaguucaagaccaaccuggucuacauagagaguucuaaaagauuuacacaguaaaaacugccuaaaaauuaaacaacaaaaaagacuauguuaauaaguaaugccuuuuaaaguuuugguuacucaacagacucugaagauauccuugcccacacucacagcaagcucugauucuuguuuaaaguauucugugagacuugcauagagccacucaaggaaaaccaguacuaugagggacucuuggcaccuugcccucagguuucucgggguguuuuucuuaggggaacuggcuggagcauacgcugcuucagguccaggagccuagcucuaacagcggggcuggacuugagugcagagcagcccagcuacccauaucucuagcgaccucacuguauauagcaugagacuccagguagcuccaugacuguauuucuguacugguaaggagguagcccaucaguagaguuaaaagugggacaguccaaaacuaaaggacuucagggccucuccaguuucgcaugggucacaggucagccuggagcagcuuccauuguggggcaggaccucauugcuggcauuugccauaaagagauaccacuguuaagaauccuagccacacaagcccacuccagcuugccacagcugacaugccauuggcucaucucuccuuuacaagguagucagaccacacaucuaauuuuauuugagcaagcuauagauuguaaagaacacuaaauucacuauuauguuuuguuucuaucacaaacuuugauauaaaugaauuuuaaaucauuuuaagauuuaccuuugauauuaaugcuuuaauuccaggauccaaaaccaguucugugguuacuaacuaauguggcuucaugcagguuugcuguguagaauauuaagaaccg

SEQ ID NO: 6038 - RNA, 5350 nt, Mus musculus
cgguucuuaauauucuacacagcaaaccugcaugaagccacauuaguuaguaaccacagaacugguuuuggauccuggaauuaaagcauuaauaucaaagguaaaucuuaaaaugauuuaaaauucauuuauaucaaaguuugugauagaaacaaaacauaauagugaauuuaguguucuuuacaaucuauagcuugcucaaauaaaauuagauguguggucugacuaccuuguaaaggagagaugagccaauggcaugucagcuguggcaagcuggagugggcuuguguggcuaggauucuuaacagugguaucucuuuauggcaaaugccagcaaugagguccugccccacaauggaagcugcuccaggcugaccugugacccaugcgaaacuggagaggcccugaaguccuuuaguuuuggacugucccacuuuuaacucuacugaugggcuaccuccuuaccaguacagaaauacagucauggagcuaccuggagucucaugcuauauacagugaggucgcuagagauauggguagcugggcugcucugcacucaaguccagccccgcuguuagagcuaggcuccuggaccugaagcagcguaugcuccagccaguuccccuaagaaaaacaccccgagaaaccugagggcaaggugccaagagucccucauaguacugguuuuccuugaguggcucuaugcaagucucacagaauacuuuaaacaagaaucagagcuugcugugagugugggcaaggauaucuucagagucuguugaguaaccaaaacuuuaaaaggcauuacuuauuaacauagucuuuuuuguuguuuaauuuuuaggcaguuuuuacuguguaaaucuuuuagaacucucuauguagaccagguuggucuugaacuuagccugcuucucugccucccaagugcuaauuaaaugugugugcuaccaugccucgccaacuaauggucuugacauuugagagggguuugcacugaacacugccuuuacauaccuucaaaagggguauuuuaaaacucacacaaacuuugcacaaaaguuccugcaccaugccuuagaaauacuuaauauugcuugcucugauauacaggaaaggcugagcaagugaagugcaggccauaggcuguccuguauguaugcugggagcucuaaugagaaaggcuguaugagucccuacacugauagccucuaaguagcuuacuaggugaugucaucuuuacagcauagcaugaacagcuaacccuccgcuggccaagagguaacuacugacucuccacuagcagagucugggguuuggguguuacuguugucccuguagcugccagcagacuuuggugugcagcuugcacuggcuuacuuacauggaguauggcaugagugggaaggcugcauagggccucugggugcuuauccagccugucuuugagagccaggcuuaguuggaggucagguguguggggcaggccugcaggaaucuaacuaagcugaugcccugguucacacccaacagugcaggcugugugcuagccagcuacuucccucggcgccagcuagguggcagcagugaggcggugcuuucucugcaguuccaggguagaaagaagucagcgcaccaucucccccuguagagagguuaacaguaguacacauuccuucaaauaucuuucauacccauuuguuuccuagucaaaucucucaggcucccuuuggacaaauguuccaaagaccacaagugugcucucuguagugcuguaguugaaccccaaauuuuauauauuuuauauccaugcccuuagcccaccuguaugugagauagucuugcuauguagcccagacugaccuuguacuuuggagcgucaggugguaggaguacagacaugagugagugcgcccaguucaguguucugcuagauccaauggaguuugccaacucugaccuuuguuuacacucagugaaugcacacauuccuagcguucuucccucuggggacucccuacuucauggggcucuggccuccuauuauuguggcauuguggccacaaccauacuggaaaaggugcagccaguagcccuguguggcagaugugcucggcaucacacgugcaaagaugaaguuuuuuuuuuuuguuuuuuuuuguuuuuguuuuuguuuuuuuuuuuugagacaggguuucucuguauagcccuggcuguccuggaacuaacuuuguagaccaggcuggccucgaacucagaaaucugccugccucugccucccgagugcugggauuaaaggcgugcaccaccaugccaggcuugcaagauguaauuuaagcauauauuuacauucacugucaaaugguauguucccuguaaugguaguuugcuuguagaugcugguagaccacaaauguguaaaagaaagcaugccacugacugacuguacugggagcagccugugacuucuugaucuacacuacccauucucagccaagcauccucuuuuacauaugccugaaccaacuccauuugcacauuccauaccucuucucugaacacaccaacuucaacuucuuuccagggaaugggaagccuguagaggggucaggcaaaagugaaccuggcucagggagugagggaagggaauggacagaagacauguggcagucuaaaauaaacugcugcagugggccggcaguucagggacucaggaagaccaacuucuuguuugguucauuuuugccagaagucaccaucaagaaaaucaagaugcacccugauccugcacauguuacugcucagacuggcguagacagugggggaugauccaggaaugucugccaguucagcauuuggccaacauaccagauacccacacgugaaacaagcccuagagcagugugugcucuaucacagcaaaaacgagccugcaguaggagcccugagugacagauuagaugggugcagcgugccugucucccagcccuugccucugacauguagguacuuguaccuucagcaaaguucauauccuaggauucugaggugaagagcaaaagaucaaguguccuuuugaaugguaggcuuggcaucuuccgcaggcucuuuguagcaucccaggaagcacaaggcaggaagauaaugcaauggggccagagggucccaagggcagcaggauagcugcaaggaaaccguaugagagaacaggaguccucaacgcacaaccccaggcuccugaaggcuagcccacucugagcucaaagcuuguuuuaacaggucugacuugcccauaaugcugaaaacauaaaugaccacugagcaugugccagaguggaacuuaaaaacgugugaaaaggggagcccagggcuugccugcuggucaguggcacacuuugguauguaacaaauccguuaucuugaaguuucgaccugccugucuauuaggccagcuagaccuuguacgucaacucauguagaaccuuuaggggacucaugaguugaauuuguacgcucagagaccauccaucugacccacuuaacacuaacaagccaggacuaagaagccagaucgcauaucuagcuaugaggcuauugccucucccaucugacauggggacuccugugugcugcaucuuacaguaugaauguuuucuuaugagaauagagaaaaauguuuuuguugguuuguuuuuuaaagaaaaugcugcagacugcuuuggguaguuucagguccuguucagcuagaaaagcagaguuagcacaggcucccugucaauggcuccaugagaagcagacaauucaagggacccuuccagagcccagacuaacgaggguccugagcacacacugcugcuaucaccaguccugacagucugucuuugcacacgggcuucuccucacccugccaagcagcauggcagcuucuuuucagacagauuaaaccccagcaauguuccccuccagaggacuuugaggacccaucacacuugacaagucugaagcuucaggcugcaagucacucuuccgggccaccagaagaccaggauuagcacagcaagggaggcacgagcggaggaaggaaugagaggggccggggcuuuugugcaagauuuaauaaaaaaccaaaauaggaaugguugcuuucaacauuuuccagguugugaaggauuugccggauuaucuggguaugguucuaagcugcaucaguggccagguacaaaaugcugucccccucccacaucaaaaggaagugggccaggcuggacacuuuccuaggccccucagaaaucaggccagccuacaacauucgguggcucugcucugaccaucaaggguggugcuccgcugugugcggcagagcagagccacuggcagguccccacaugugcacucugaggcagggcuagcuuauuaacaggcugcugugccuuaauacugacagugagugugcugggaggacaagggggcugcucagguaucagcggggaaaccgucccacucuacugcuugcgcgugacuaaucugagaauaccaugggaaaaaagcugugauaaagacaacaggaaguuggaauugacagggagggacuggagcaagcaccccacagcagucucucaugcauccauccccacaguuaaugacagcaacaaugagaugcacaggugaagaugaaaaccacgcuuggcuugugcugccaccagcugggaaggaugugucaguggaauggaugcagcuaaucuuucuucaagucccuggauucaaagagcuucaagcgcuccugcaccgucaggccuuccuucagacucugguggagacagagaggaaggagcaguuagguguuggugcagcaggcguagugggcuucaguagcaggugcaggcgagggauccugagauuagugggcaugcgagggcagaagcccugagagaaucccuggagaaguagugugacugggauuugcuuuuuccuguaaaaauguacuugggugagaaaggggaaaauaauaaagagaaacaagaccaugugucauagcucaguucuagcuuaggguugguucuucagacaaaaccacgaaacacuuggguggaggacuggaaaccugggcaccuaucauucuuccuauauauggaaugugcaugucucauuccuuugucuuuaugaacuuacugcuuuaagacaaggggaauccccaacagaccaccagauagagcuaucaacacauuacacacacauacacauauacacacacacacacacacgcaugacuuaacuccugugaucuugguauuguuuuuuaaggcaaaaaacauuuuacuaacuggggaacagaauauuuaccacauuucuc

SEQ ID NO: 6039 - RNA, 8414 nt, Mus musculus
aaugcauagagcuggaugagcgacugaaggcuauggaccaggagaucacggugaacccccaguuuguucaaaagguaaacagggugcuccucauuugaaguggguggaggaggaaagacauuacagcagguacaagaacuugguucauuuauuaaaugugaaguugcucauuguccuugaaaaccaguucccauaaauucacagaaauaacuuuuaagauauguucaggaacuccucuaagugugcuuagggaaggcccagguugccuguuguuguucugugguaguuccugcagagacaggcuggggagcuggcaugcugcuuucacaagaguccucuugauagaguuggucacaaacacacuauuugcuuucuccuucacagagcaugggcucacaagaagaugacucaggaaacaagcccuccagcuacucuugaaacuaacccccaucuugagguaacagaaccuuggccuggcaagugugaagagcgcagcaggaaguaccaugcggguuccaugccgguuccuccuggacagucagaaauucaguuuaacaucugcaguccuauugcuuucagaaaaccauucucugcaaagaaaggaaaaaaaaaauccuacuuuagagucuguuguggauuuauuuauccucagauuguuauuacugcauuaaaguuaccuuuuuguuuaaccccuugaauguuaauguguguucucucacuuuuuccucucgcaaagguuccaaugauacauuucauugugaauagaauaauuggcugggagcgcgaggucugcacugaagcguuagcauccccuuguagguggauguaagcugugggacacugucggcuccuaccccugacguguguaguuuuugccaucuuccugcaccugacgugcgucguuucugccaccucaaggcuuucccucuuuucuacuuuucuuucuguauuugauucuuuaagaugggguuucucuguguagcccuggcuguccuagaacucccuguguagaccaggcuggccuugaacuuggagaucugccugccucuaccucccaagugcuggcauuaaagguaugcaccaccaccaccuggcucuaacauucuuuuuaaauuauguuuuauuuuguguauguauauacuuaggagaguuauucuccuucuaccuugugaacccuggagaaugaacugauagucaggcuuggcauucagugccuuuacccauugaacuauuuuauagccccuuuucuucuugaaaccaucuucagguacuuugcagaguuuuuuagauuuuguuccuagccccguuacacuuugggccagaagucacugagcuagcucucgacagugggagcauuggugaccuauggacagauuaaagugccuuaaguuugcugcuggggauggcucagugggucagagccaggaguaggaccugagcuaaaauccccauguacagagcugggcauugcuguguguucuguaaccacagcaaagacaagugguucccacugugauugucacuggccaaccagccuagccaaaggccucgggaguaagguagaaagugguggaugagauagauacucaacgucuucaugcguugugugguccccacugcauccacaugggcccacacgugcaacacacagauuuagucuuuaaaaaacguuucucagacuggugagguggcucagcagauagcgcuguguagucugaugauagacaguuccuuggcuuuaaucccuauagagaaagggaggagaagaccugccucuccagaguugcucucacuuccacacuagcgcuguggcagggacgugccugcacaugccuugugauaauacguuuuuaaagacuuagaccauguuagucucaggguuaacucuuggauuuguguacaauaauuucucuauggacuaugguacagcucaaugaaaaagcguucaccuaacuugcauacagcccugauucuaucacuagcauuaaacacaguuucuuuuccuuuaaaaugaguaucaggccauggcucugccuggguaaaaggaugcuucugggggagucuaaugaacugaguucaaauuauaggagccacguagcgaaagggaagaaaaggcugcugaagcuuguccugugaaguugcaugcuugccaugucaggugccccucccaccaaauguccuagguuuuguuuuucucacuagcauguguuuugagacagggucucguuauguugcccuggcuggcugggaaauaccauguaaaccauaauggccuugaacacauguugucuugccuuugccuccuacguugcaggauuaaaggcaugugccaccacaccuggcucacuaguauucuucccguuauguggcaaaugacaccuuuguuauguauuuacuuauuuuuagcccuggauauggaacccaaggucuccccagagcuagaccccaguucacauuucauuuuuuaaaaaccucagggcuagugaaaaggucaacagguaaaagcauuugcuaccaggucucauuaccagacaggucaguuccuccagcccacguggaaggaggagagggcugacauuuuaaguuaccuugaccugugcuugcaggcugugaugcuguggugucacacacacacacacacacacacacacacacacacacacacacacacacacacacagggcaaauaaacguggguuucaguuuugcuuuuugguguuuguuuuuaaggaaauccuugaacuggugggaugccugacugaguguguaagcuaccaaaccugauagcccgaguucaagcucaaaacccacaugguggaaggggagaacaugcucacugacacacucacacaguggcaugcuugcaugugcacagaaguguaaaaaaauuuuuuuaaagauuauuuuacauaugaguacacuguagcugucuucagacacaccagaagagggcaucggaucccguuacagacgguugugagccacaaugugguugcugggaauugaacucaggaccucuagaagagcagucagugcucuuaagcacugagccaucucuccagcccccaaaaauaauuuuuuuaaaaaaaugaaacucuuaaaacuuucuuuuuuuuuuuuuuuucuuugaugcaaaagcaagagguuuauuuucuggcuuguuggggucaaccuucaauuagugucucaaggcgaauuacuaagaaggcaaccccgaauggcuauuacaagaaguuuuuauucuuuuuacgggcacagguuacaucaguaagguuacaguucaaacuuauuggcuaacuuuuaaccuuucagauuucuguaauguggauccauacuggcaggucucuggaugugauaagccagcugugguucacgugaacucagauucucuccauuagcacugcuuguagcuggcaucucucuggguuguguguacccguguuuuggaaagaggacauauuuaaaggacaugugucuuuuguuuguguagugaauuauggacuuggggguuugucuuggguugguuuguuguugcugcugcgguuguuuguuuugguuugguuuuuuauugguuguugguuuuaaaugguguucugccugugugagggugucagauacccuggaacugggacaguugugagccaccaugugcguguugggaguugaucccaggccucuggaaaagcagcagugcuccuaacugcugagcccucuccagcccccagugcuccuaacugcugagcccucuccagccccgugaguuccccuggugcugcuugcuuucccuauacuuggcuauggguugugcaaucuuuguuccucuccuaacuccagcuccuuuggcugacuugagggucuacagguuucaugccuugcucauuguaagagcauuuaggacuucacacuucuugccagacagaugccuuccaaggcuuugccucuccgcuuuggagcacuaugggcccauuuaaaugcuugcauuguuaagauggccuuagcugucuguccuuggagguaacucccuggggcagauuccuuugugaacuugcugaccuaugaaugccuuuagcauuuguauggugccagagguuggcaaauuuguaccuagggaauuagggguguugcuaauauccaagaugaggucuuggguggguguucauugguggaacucccaguucucugaggaguuuuucaaauuuggcucuccacgguaaucucaaacgguaaaaguuuagauuaaaaccacucacuaauuggcuucggaauccagcauccacauuacauuuguguuucuguuuggauuuguaccaaacgaagcacaacuaaguagcccgacuuugauuaaaaguuacaggaacuacagggccugguauccaggccaccucgaguaauuuaaugugacccugucucaaaaaguaaaguguagguugagguguagcucacuggacaagcacuugcccaggaaauauucugcccugaccccuagcucuaaccauaaauacauaaauaaauagguaagacccguaaguaaaucugcuggguucaguuugaaaacuauuggcauuaaguauucuuugagaaaugguuggagugggggagcuagaacaacagcucagagguuaggcgaacuugcuguucuugcgaaagaccuggguuugauucccagcauggacacaacagcucacaaccauccaacucuaguuccaaaggagccaagacccucuucuggcuuccaugggcuccaggcaugcacauaguauauauauauacacauacauaugugcagacaagcauacacauaaaaaucuuuuuuuguuuguuuguuuuuuguuuaaucacccucauagaauuggugacugagcaagagguacugagaaggucagcaguggcccagcuggaacaaauuuuacugaaauagccaguaauagcgcuccucugucaucauggaaauaaggacaaugugaauaagcaguagaccuugggaagcaauagcagcaagguggcuacagaccuucagccaagguugcuccaguuaucugccuuuguucccguuucuugugaauuccaggccugccugaacuccugacuuuccugccuuccucagccucuaauugcugggauugugggcauguuuuaccaccccaggagugaugugguacuaauggauacaaccuaaggcguuuugcauccuaaccaagcauucucccagcuaagccacauauccagccccugguuggcguuuguuuuguuuacuuugugagacaauguuucccauccaaguacugaccaggccugacugcuuagcucccgagaugagaugagaccagggcguguucuggaugguauggccauagacuaagacagugucucguguuacccaggcuaggcucagauuucaccccugcuccuccugccuccaugugcccauccauacugauggcaaaaguagcauuaaggcagagcgugaagcuuuaaucucgguacccaggaggcagaaguaaggggauuucuaaggguuugaggccagccuggucuacagagugagacccuguuucaaaaacaaaacuguaaaacuagaauuccaaaucucuugaauuugcccacaaauuauuuguaacaaucucuuaaacaaguaagccuaguucagucauuagggguaggugcauucccucaacagaaagcuuuucaacacuuuuaugauaacuggcaaaggagcaguguagagguaguuggcucaccacucuggcuccuggcggguugcacuugagcaccugcccaggagcuaucuggauuugggcaucacacagguguaugcucgcgugugugugucgcucgaguuugugcgugcgcgagugcauacacacacacacaagucaguugauuuuugacaugcugugacuagcccaaagguuggccacuccuaaaucuuccccugcuagcacacacaccagggccguccacaauagacuguagaugcaaaaaccacaggucucaugauaaagggaaaagacaucguuuauucuggagccauuuuguguggccuggaaacacagauuuagauuaccccaaaugaaauguuccaauguguaggcauuuuuaugguuuuuguuuuauauuucuguuuguugagacaggguuucucuguguagcccuggcuguccugcaacuugcucuguagaccaggcuggccuugaacucagagaucugccucccaaggaaugguaaaggcauguaccacuccugccuagcucaaauuuuaguuuuauagaagaaagaaagucauaagacacagcaaguuuaaaauacauuggcagguaccucaggccgguacagcuagauaggugagcuauccuguaggcccaagauggugggugaacuuguuugguuuuucaagaugggguuucucuguauuguccaggcuguccuggaacucacucuguagaccaggcuggccuugaacucagaaaucugccugccucugccucccaagugcuaguugaccuuuugaauuggcaaguuaauacacugcacaagguuuuuaucuacuuguucugacauggagguaggcaaggaauggcuguugcagagggcuagcuagaacuagcucaagguaaggcaacuagcuuuugggucugcaacaucccaguccguccacugguacugacauucuaaucagccagccaucuccgaagacaggcuccuuuugagucgggaagugucuguccuauggcugaggcuccuguggggagcuugcuucagcgagccucugggacuggaucgguaggagcaggcaaagggacucauuacccccucagccugcgaggcuucucaaugacugcagaaaggaauccugguagccugccucagccuuagagaccugggggagccaguggggagcugcacacuccugcuguccccucacugaccuccagacucucucuguagugacugcuuuugguuggcugcccaaauccucuggucgcaauacaggauccugguucucagagccauagucagagcugaccugguucuuccuaacaucgcuguggggaguugcaacugguuucacuuauauccugaguggcagucugcuuaaagcuguuuuauccugcuuaaguuuguuaaccccuaguugucagguaucugcuuucuucuucugcugucugcuugcucuagucuuggagaaggguagggaagagccucguggaggacaggagaugacucacaguaucaggaauaaucggauugguaaaaauaaacacacacaagacaauaccuaacaccauaacuccacccugcacuccuuaaucuuuaccaggcaguaaacaaaguuauagaacacaaguuugcauauuuuuuuuccuccugcucccucuuccaacaaaacacgaaagcugaaauagagagaaaggaauccgauccccgugauuugaaaaacaaacagauaccaacucaucaacuucuacucaucugaagcuucccacuuccggauaaccacauucugggcguccucguguacacagcggaggcuggcagcgcuggccgcuguguacagcuggcagcguuaguuacaggcucaagcccagagcucuguucucaucugucuucaagggcccaugguaugcacuaauagcuuuaaaauucauuuaaaaaaagauguauuuuuuuuuauuauuuuuaaaaugugaguacacugucacucucuucaugcacaccagaagagagcauuggaucccauuauagaugguugugagccaccaugugguuguuuggaauugaacucaggaccucuggaagagcaguuaaugcucuuaaccgcugaaccaucucuccagcccuuaaaauccuuuuuuuuucuuuucuuucuuucuuuuugguuuuacaggguuucucuguguagcccuggcuguccuggaacucauucuuuagaccaggcuggccuggaauucagaaauccauccgccugccucugccucccaagugcugggauuaaaggcgugcgccaccacugaccggcuuaaaauuaauuuuuaaguagcuaaauaauauuccaucccucauccccaaacgggaaaucaaacccagggcuuagagaaaacaaccccacaauccacgaacuguuuugaaagcuaguuugcaaagauagggccggcucagggcaagacugagccgugcacaugcgugguccugcuucgcucuguacccuccucccucccaggaccuguccguaccuuccacuucucucgaaggggagacgguuucucugaucugcaacuuuacaggcagggaguggagucccaagaacucccagaauccagaggaaauuuuccgcaaaucuuuccucuucgguagggacagggcauggacugacuaauucucucugacuuuuuugaaaugucaguuuugacgucacc

SEQ ID NO: 6040 - RNA, 1260 nt, Mus musculus
uuucucgguggauuaaaugaggguuuuaaugguuucucgucacuuucauuccacaguaguagugauagcuacuguuugcuaacacugccguuuuaccaugcauucucccagaugucuccagaggugucuucaagucuuuucuggcacaccugguuccaucuuagaccauucucuucucccuucuuccucaggaaucauggcccuuccccuaagguggagagguccuggguuagaaggaaauccuacaguuuccugcagugagaaauguucuucuaaucagacacuuaguuccacaggggccuguauucccuaacuccacuccccccacccaccuuucccuuugggugauuagcccauugagucauauugagaaguuguguucccacuaaugggaugaaaugcaccuaagccugagauggaagaaaguggccauuuuguugaguguuucugcuaucuuaucuugaguucuggugcacucauuuucaagaaauaaauaaaucaccuuguuucacuuuguuucugucuucuuuugagcaacacugagauuauucuuuuccugacagugccucuguuuagagaacuaucugcagcucugaagaaaacaauucugagaccuguagcuaaaaaaccugaaaacaccauugugaaguuccacguuccugcuucuuuuuguuucugagaugugggcuccuggccucucuuuacugacaugguuccugucaucaaagacagauguccucucccaguugacagcuucccuaaucccugauuuuuguuagucagaaucagaauuacugcuacccuuguccagaaaauuuuuaauggagcccauuugcuugaaaugaauaaauacaagccuaucguaaaguucuccuauuugguccaagaucuuagucuuauauacguauguagucuggcaccugcuagaugcauaccaaaugcuugaagaacgauuaguuuuccccuuggcagccguguggaacuaguuuguauggccuguuuugcugucgccagucuggggcccuccuggaggcuagcaugacacaaagacguguaaguccuugucaucuggaugcucgcugccgcagagccucaguuucacacggugcucaccagcgucauccguucuuccugccagucccggggguccucguugguguuuugaccucucucugucaugugaacuagaaagaugacuggaguagauucccuaauccugacuacucaauuuagcuuucccgacacccgucgccuagcaac

SEQ ID NO: 6041 - RNA, 1766 nt, Mus musculus
ugagccugcugucuguacccaagagcccagaccagcucgcgcagucccgaagccaagcucuuccgucacuccggaguucucugcagcccucucucuaccuucucucggccacgcauccgccccuggggccccucuacccaaugaaacuggccgcgaugaucaagaagaugugcccaagcgacucugaacugaguaucccggccaagaacugcuacaggauggucauccucggcucauccaaagugggcaagacggccauugugucgcgcuuccucacgggccguuucgaggaugcuuacaccccuaccaucgaggacuuccaccgaaaguuuuacucgauccgcggcgaagucuaccaguuggacauacuggacacauccggcaaucauccguuucccgccaugcggcgccucucuauccucacaggugaguggggagucgacggggauagggggaccggagucuugaggggaguggauggggcugguguguugugcuuggggcuugccccuucaccuggggugucugcagcucugugccuggcagcuguccucaccuuucccacucguucccuuauaggagacguuuucauucugguguucagcuuagacaaccgcgacucauucgaagaggugcaaaggcucaaacagcagauccuagacaccaaguccugucucaagaacaaaaccaaagagaauguggacgugccgcuggucauuugcgguaacaaaggggaccgggacuucuaccgggaaguagagcagcgggagauugagcagcuggugggugacgacccucagcguugugccuacuucgagaucucagccaagaagaacagcagcuuggaccagauguuccgugcgcucuuugccauggccaagcugccuagcgagaugagccccgacuugcaccgcaagguaucugugcaguacugcgacguacugcacaagaaggcucugaggaacaagaagcuucugcgugcgggcagcggaggcgggggcgaccacggcgaugccuuuggcaucuuggcgcccuuugcucgcagacccagcgugcacagcgaccucauguacauucgugaaaaaaccagugucggcagccaggcuaaggacaaggagcgcugugucaucaguuaggagcccccagggucagccacacaaccugaggaccuuuuuuguucaaaagucaaaucggauuccuggacuagcgguccgugccacaggagcgccaauuggccuucuccuucccucccugagacccagcccggggagaccaagccaguaagggacagucaccugcugugaaaggaaagagaacuagcuaagacaggagcugucaccuccgauucugggaugccaggacccagcagaggggcgcuuggcauuuuucucaagagguuugagaaaaagcgugugaaguucaucagccugugagacuuaaaguaacuguccugcucgcuucagggcaggacuaauaauagggcauuaucuugucugugauugguguugccauggccgcugucagccaccucuguccucagcaaacuggaaacuuuggcuggaggugggggggggggguguucaaucauagccaagugacuuguuuacaugugugugugcaauuacccaaaagaaaaacaaaacacaaaacuugcacuuuaauaguuccagugucaaugugacaugaacaaaaucucuacauuucuauugugugaggucuuuauuauuauuuuuuauuuaaaauaaaauaauuuagaaacggaaaau

SEQ ID NO: 6042 - RNA, 1193 nt, Mus musculus
gccaagaucacaccugacgcaagcaccaugagauaggaaaagauuacaggucacagcacagcucugcacccacugggagggaacucauuugcacugcuuuucuucagggucaccuaugaggauccccaggcuguuggaggacucgcuucugcacuugacaaucggaaacagaacucagaaaugguaggucuucacaccugugugcugcccacagucuucuggagaugaggagauaaagacaggcaguuugggaaaguuggcuggauaguucagcagaagaugacagagacagcccagggaaggucccacagagcaccucugggugguggguagugcacagauaaaauauugauccucacaaggacaguaagugcugaucugagccaccucacuccuggccaaucaaagugguaccgauuccaggggaggacaguugagggucaguacuugucugugagguggcuuggguaguguccugucacaugcuaggccuggaaagagucaagccaagagucagaagguuuugaaauaaaggaugaaauugccccaaaccacagccaguuccugugagcagucagaucccaggggaaaaggcucccaggggagaagacccuaugcacuugauacacagauauucucuuuugaguuugcccaggaaauguaugggaaugcaugccugucagccuggcaaggaagaagacggcucccaggacccccugggcuggaaugacaggggacugugcccacccauucacuggacaaggaagggcccuuugcuuccugcaaccagaucuuagccuccugugguccuuguguaaagggacugguggggacaguacauuaucccuggcauaauggaaaggcuuggucuugaggguggggacucugagcugguguauguaacucuguaguggcuuccaggaggugcagaagagcccacccacugccuugcucucggcauaccaccguugcauagugguggccaacugugacauugaucauauuacacaguagucuccauucuuucuccaauuacuuagacuaucucugccauugaacacagcaagaaaauuaaagaacuaggccaggguccugccaguguacugccuagugaagaugagggugacccccuccucugacucaccucaguuuggagcagccuuguucuccagcaggcucugugcucaucaccc

SEQ ID NO: 6043 - RNA, 2181 nt, Mus musculus
cgucggccgccgccccuccccccacccgcggaaagcuucgagaacagcucccgaaaacaacaauuugccugcacgccaagccgccuccggggccgagggacuccacccgccggagugugcucgcgguguccacuggacagcgcugccgcgucacggcaucgugcggaugcccgcagacgccucagcuuccagcgcacaaauccucgggaaucgccacaacccaguccgccccgugaccgcccccuuuggagcuuccacuuucuuaauuggacugccggccacgcguugggcaaacacggacuggaguuuccagagucgguugguaaaucaugcuugucaaucaacuagucuccuuggcuacugcguccaucacuuaauuagcuucgggcagaagcucgaggaccccugaagagugaauggguggcuaaguaagugccugaauggaguucucggcgacgaaaagcccucaggacuccggugaagcuucggaaacaguggaaaguuaaaauuacgggcaggagagcaucaggcccaaacuguggagcaagccaggacaacaaaagcuggaggcgcgcgguccgggcacccacaccccauucccgccgccaucgcuucccgaagcggacguuccacaagucacgucccgggacugcccacgggucgcgcagccgcgggcacgcgcacgggcacgucacguuccuacugggguugggcguuguuauagggggcgacaaaaaggcuuuccugucugaagggcgcagauuuaccacggaucgguccaaauuggaaauauucuucagacagaaaauaaauaaauugcacagugggaugguaaaugcgucucagcacucuggagacugguuggaggauagcucacaaauuggaugccaaccuaggcuacacagcgagccucugucucaaaacaacuacaacaaacccaaacaauaaaaaauccugaagcggaggagaaagccugaacaaagguuuagccgugcuggaggucccugggcacuccagcaaauaggaauagcaaagagguucugcucugaaccuccccaagaugaauuccagcuuccuuuucugguucccagucccuuuuccagucuuugauacuccgucagauuuucauauaucgccgccccuccuggcuguccaugcugucugucaucuguaaugccuguccaucuacagugucugucacacagcucaccccuugucuuccaggcaucccagagucugguguguaaaaccaggaaccaguacuuaccucgaacggugguugugaggauggaaugacgcagcagaaggauugcugauacagcauccagaccucagucuucuaaucugaaaacugaggguggcagcagucucuguuggaaaguggggacugugugguaacuuggaaaaguuuguggaguggaaagccaagaaauuagggaauccaggccacccucucucccaaacagcaggcagacaaaagggaaaugggucuggggauucccggggcagccccuugggcccaggugacagagagaggguggaagggcagcugcagguagaagauggacugaagggcaaagccagcugaacuggacuugagcccggucuguacugugugaacaccuggugggucucuuaccugagcaguuugccugggcagauugaagcuuuucaggagcccagcucucuaagccucugaucugccuuucauggcgggagcucuuuaccacugcacccagaugcaccuaauagcuaagguccccagcucugcucacccaggcaaaaaugacccucuuuggguacggugcacaccuuuaaacccagcacuaaguuuuguguguguguguguauguaccucaggaguucagggccagccagggcuacauagacugccucagaaaaagauuuuuuuuuuuuuaagcgacuaucccauagguugaacucuccaaucccaggguguuuucuccuugacugugcuuuuuagucaagcccagauccuguggggaaaaagccaggcugccuggguugaacuucacaaggccacuugcacaaguccaauacuguccgcacuccagcagcaauuucauaauuauaccagccucacugggauauuuuagggauuaaaugaguuagcauuuauccagggcauggcacauaguaaaauuuguuuguuugguuggu

SEQ ID NO: 6044 - RNA, 22134 nt, Mus musculus
accugggcccaaggggcugccccgggaauccccagacccauuucccuuuugucugccugcuguuugggagagaggguggccuggauucccuaauuucuuggcuuuccacuccacaaacuuuuccaaguuaccacacaguccccacuuuccaacagagacugcugccacccucaguuuucagauuagaagacugaggucuggaugcuguaucagcaauccuucugcugcgucauuccauccucacaaccaccguucgagguaaguacugguuccugguuuuacacaccagacucugggaugccuggaagacaaggggugagcugugugacagacacuguagauggacaggcauuacagaugacagacagcauggacagccaggaggggcggcgauauaugaaaaucugacggaguaucaaagacuggaaaagggacugggaaccagaaaaggaagcuggaauucaucuuggggagguucagagcagaaccucuuugcuauuccuauuugcuggagugcccagggaccuccagcacggcuaaaccuuuguucaggcuuucuccuccgcuucaggauuuuuuauuguuuggguuuguuguaguuguuuugagacagaggcucgcuguguagccuagguuggcauccaauuugugagcuauccuccaaccagucuccagagugcugagacgcauuuaccaucccacugugcaauuuauuuauuuucugucugaagaauauuuccaauuuggaccgauccgugguaaaucugcgcccuucagacaggaaagccuuuuugucgcccccuauaacaacgcccaaccccaguaggaacgugacgugcccgugcgcgugcccgcggcugcgcgacccgugggcagucccgggacgugacuuguggaacguccgcuucgggaagcgauggcggcgggaauggggugugggugcccggaccgcgcgccuccagcuuuuguuguccuggcuugcuccacaguuugggccugaugcucuccugcccguaauuuuaacuuuccacuguuuccgaagcuucaccggaguccugagggcuuuucgucgccgagaacuccauucaggcacuuacuuagccacccauucacucuucagggguccucgagcuucugcccgaagcuaauuaagugauggacgcaguagccaaggagacuaguugauugacaagcaugauuuaccaaccgacucuggaaacuccaguccguguuugcccaacgcguggccggcaguccaauuaagaaaguggaagcuccaaagggggcggucacggggcggacuggguuguggcgauucccgaggauuugugcgcuggaagcugaggcgucugcgggcauccgcacgaugccgugacgcggcagcgcuguccaguggacaccgcgagcacacuccggcggguggagucccucggccccggaggcggcuuggcgugcaggcaaauuguuguuuucgggagcuguucucgaagcuuuccgcggguggggggaggggcggcggccgacgagcgggccucgucugcgcaugcgccggccucuccgccgacugggcggcacgcacgcgcaugcucaaaguacguggagucucguggccgccggcagugcgcacgcgcgucgagaagcccgcuaaggagcggcgcugucggaggucgggcgggcuggcggugacgucgugaggagagcuuuaaagugcgggccgggccgggcgucugaggguccgaccgggagucuggcggagucuuggccgaagcccuccgcggcaugaggcgcugccggcgccuuuuucccucaggacgcggagaagguggaggaggaggaagccccgcuguagcuggugcugcaugaccgaccgcggcugagguucgaccccuucccggccccucuacgccuaccccuuuggucccuugagccacgcaugggggccuggcacugaggacccucgcuucccuuucgggucccuuucggguccccugagagccaugccggaccgccgcggaggacccuagaguugaguuggcgggggccauggcggccgccagcggcuacaccgaccugcgggagaagcucaaguccaugacgucccgggacaacuacaaggcgggcagucgggaggccgccgccgcugcggccgccgccguggcugccgcugccgcugccgcggccgccgcugagccuuacccggcguccgggaccaccaagcggaaauaccaggaggacucggaccccgagcgcagcgacuacgaggagcaucaguugcagaaggaggaagaggcgcgcaaggugaagagcggcauccggcagauccggcucuucagucaggaugagugcuccaagaucgaggcccgcaucgaugagguggugucccgcgccgagaagggccuguacaacgagcacacgguggaccgggccccccugcgcaacaaguacuucuucggcgagggcuacacguacggggcccagcugcagaagcgcgggccgggccaggagcgccucuacccgccgggcgacgucgacgagaucccggacugggugcaucagcuggugauccagaagcugguggagcaccgcgucauccccgagggcuucgucaacagcgcggucaucaacgacuaccagcccggcggcugcaucgugucccacguugaccccauccacaucuucgagcgccccaucguguccgugucuuucuucagcgacucggcacuuugcuucggcugcaaguuccaguucaagcccauccgggugucggaaccugugcuuucucugccggugcgcagggggagcgugacugugcucagguaacacaccugggaggaggggcuggcccugcacccugccgccuaaaaguguccacccgguuccggggaagccacagcuggcgggagccgguucuuauuaugguucugacucgccuuuuuucuuuuugcgugcaaaccauaggaagcuugugucugaaacucauagcaggauaagacuaauguggaauuguguaccugcaggcagguuugaaguggccauaguagcuuaucugagaauucaucugaaagcaucuuucugaagacuagcauaggaguucgaguucuaugaauguggucuccuugucuugcauuuuguuuuaucguuuuggggguggggauggggugagggucucaggucgcccaggcuagccuucaaccuucuacacaaaggaggaugaucuugaaugucugauucuccugucuuggccucccaggugcugagauuacagaugugcacuggccaguuuuuuuuguuguuguuguuguuguuguuguuguuguuguuuuuuuuuuuuuuuuuuuuuuuuuuugguggugccuagagaaugaacacaaggcuucauguuuuccuuuugguuuaaagcaaaucacuuucgguuuuggaccucauuuccauaucuuaaaaaccugugcuuaacuaaaguuuucccuguuuuguuaaguuuaucuaaaaguuuucucuguucuguuuuuuuuuuuuuguuguuguuuaacaaaauguaauggauuccuuaacagaaaaugcagaguccuugacuuuugggggauuuuugauauagauuucuccauucucaggaagaaugauuuuuugguauugaacauuguaaugguuuggccagaaauaagugcagcaugcucuuaaaauucuugcuuaguuuuaggccucuguaggacacuuuguagaaaugccauagcaguuauggggauccaguaaaacaaaauacagcugguuugcugaccugguguuuggccuugugauuuggugaccacaucuuaggcucuuggccaguuggggccccagauccugcuaagaauuagcucagugcccugcccagcagaguaaaucaucuguuggaacacugcuaguguuuauaugaagugaaauuuuauuuggaggaugucuccauucagcccuaaaaaagguaagccugguuaagggacuuuuacuaauucucaucgugaggccuagauugcaacuguucugagugucucagaugugcguggugcuuccagaugguugucuugacaaaacguuuuuagaagggauuuccagcugguaguuagugcaugccuguguguaugcucaaacucgugaagcuggagcaggaagagugcuguaagucucaaaagaucuacccacucuaccaaaagaagguauuucuagggagcuugcuguuuaaggaagauuauggggacgggguuguugaaguuucuuggugcugaaaggauuuuauguggagaccauuuggucauuuauuggguuauuuuuccucguggucauagaccuuuuagguuaucuagagguuuggcagugauuggcugcuuagugggggauucuuaagacacugagacucccccaacauggucacaccagauuuaaaagcagaacuuucagauucuuauugugaaggucuguuagugauuaacaagauugcaucaucaggaaaauugucuucucuuugcaguaguaaaguccuaaagcuuucccaguccuuuccaacccuuccuggauucagacuuggcuccagaguuaguguaggaggcccagccacauucugaaaagugcugccccaggcuuugaguacagcucucacuugcuuuggguacuuauuuauuuaucuugagacagucuugcccuauagcguaggcuggccuccaacucaacacuaauacugucucuacuucuagugugcaaggauugcagggaugagccaucauggcuagccuuugcgauuuguagguauguuuucacagcugguuuucuuagcuguauaauaguagagauggugccaauuuuugaagucuauuaguuaaauguggugauuuggugucuaacagagcaugacacaggauagguauucaaauaucuauacaacuacuuauagugagccccugcucuggguggggaagguacuaaggaauugguugauuuuuuuuuuuuuuuuuuuuuuuuuuugaaacaugacucuaaucuucacauaguucauucucaguaggcuuuagaccagguggaucauuagaauucagaaagacaaagaagcaugcuaaaggggcauucacugugagauauugggagaggaaggaagcugcaacauaaagaaugacuggaaauuagcagagcuauugcagcaguagaaaguaguccuugguaaagaugauugcugugaagcagaugguauucuguaucagagaguuuugguaggggauauucuggugauaacaguaguuucucaacuacuguugauauuuggagcugcuguaaauucuuuucugggugggcuguccuuguacuguuauaaaaaaaaaaucccuggccaucaucuacuagacacuuaacuuuuuuuuuuuuuuuuuuuuuuuuuuauuuugagacaggauuucucuguguagcccuggcuguccuggaacuaacuuuguagaccaggcuggucucgaacucagaaaucugcuugccucugccuccggagugcugggauuaaagacgugcaccaccaugcccggcucaacacuuaacauuuuuuaugacaaucagaaauuggcuuccaacauuaacacguguccuaguaggggaggguugcagggcaucuucaucccaaauugagaacuauuguucuaggguucagacacuaauuuaaaucuucuugcaccugcucaguuaagcucugcuuucuugguaugcaguuaagaugagcaccugcacaugaguagugcgccucaucaaguccugcauggaaacccauuaagagguuugcuuuuuccuuguuuccacauagguucacuuaaccagaggugggaguggaaaaccugugguguuuuacagaugcagauggauucuagcaauugcugccuucaguuguuagugguaaugguguauuuauuugacaaauggcaaaauuguuuuacauuuauuaguagccagccugcauuuugauuuguggcagacguuugacuccaguguguccggugucuuagagcaaggccucacaggccauucuaguaguguuuuacauuucuuuccaaaccuaguugacacguuuuugacuguguugguaacguucccauuuugggucucauaggggguccuguucccuuuuuaugauguuuucuagaggcaucuuguuguuuaccuuuucuugaugucaguucaucucauauuccuugucccgaucuguaaggugaguaggacagauggaaacaaguugauaacacacuuagaagcauaaggaccuaaguuugauucccuaggaaucuuaucuuuucuaagauuuauuuauuuuauauaugaguacacuguagcugucccauuacagauaguugugagccgccaugugcuugcugggaauugaacucagaaccucuggaagagcagucagugcucuuaacugccaagccaucucuccagcccccuuuuuccuucuucaaaaccagauauaauggcccauacguacaaucccagggccugagagaugaauacaauacucacuagucaccuacccagccuugccuuuuucuagugagagagaccguuucucaaaaaaaguaaagugaaugguacuugaggaaugacaacugaaaucgaccucuggccucucauacaugcaugugccuaugcacaagugaaaaagcaauguaagcauuacuuuaugaaguaauucuuuuuuuuuuucuuaagauuuuauuaauuugaguacacaguagcuguuuccagacacaccagaagagggcaucagaucccuuuacagaucucuccagccccuuaugaaguaauuuuuuauuagauauuuucuucauuugcauuucaaaugcuaucccaaaaguccccuauaccccccccccccccccgcccugcuccccaacccacccacuuccgaucucuggcccuggcauuccccuguacuagggcauauaaucuucgcaagaccaagggccucuucucucaaugauggccgacuaggccauccucgccuacauaugcagcuagagacacagcucugguggguacugguuaguucauauuguugauccuccuauaggguugcagaccucuucagcuccuuggguacuuucucuagcucuuccauugggggcccuguguuccauccaauagaugacuguucuuguggguccuuaguacuaaauuaagguguagucagucuuggcagaaagaaccuuuaucuucugagcuuucucacuugccucuuguuucuguggaaugaagucagagauguaaacccccaggaaaggcugauaguuauugaaauugccuucccuuuguauugccaggccuggcaggcagaaaguaguacaggagaagcaacuagcugggagccauggucuucagcaggaagcucagagcaagcaaagaauaaacaggcaauaaaaauggaaaaacuggcuggcuggccauuuuagccugaggugcagcucugugauauaacccuuccugacucauuuggcguaccuaauucccauauucuuugaggccagcaagauccuaugacaaauuaaaccuuguuaccaagaaacacagaugaaauuuuuugcuuuugcuuguuccuuagcacaauuagcuaccaaaaauuaaaagauuauagcaaacuugguggaaguuucagcuuuauucuuuuagcauuuguacagaugaugaugaugaugaugauuuugaagacaggguuuuagaacauagcucuggauagccuagaauucacuauuaacuauguauaccagggaacucacagauucacuugucucugccuuccuauugugggugcugggaggcaugugcacacuggccaugaauaaauuaugguccuauuuuucucuuuuucuaaaaaggaagccagugaugccuuccaguugucagaaaagauugagucuuuguuaaacuguuuacuacugaguucuugaaguuuuguuaaagaugucugaagagaugaacugcugucaguacuuuggaauguguggaauugggauauaucagugccacaaagucccaagacuuauuuuccuggaggcuugaguucacaguucugucuguaccaguggcuccugcucccacccccagcccuuagcugcuucuuccugcaagccugucagugguaagguagucucaagggaaaugagaaaauggcccaucaaagggcgaguggcauuaggcuauuacuuuuucuaguucauccuuuuuauuauuauuuuuuuuuuuauuuuauuauuauuauuuuuaaugucuuggccuaggcaggauauggaacaguuggagaauaguugccgucuuggaaaugagucuuagcaacuacaucuccaagacuguuccuagaagaaacaugcauaguucuucacauuuccuuauuaauggguuuccagaguuauuuaacuuguguacaauccucagaggaaagcuuguugcaaucuccauuggucuuaaaauagagguuucaaagugauagacuuuugguauagaacauuagcacauuagcacacauuguuuuuuuuuuuuuuuuuuuuuguccacagugcugaguugaguaagaucuuuuaagaguguugucuuacaaggaaaacacaauuuccguagucugaauauaguaaaguaagggauggugugauuggguagcguggaggaaauuggggcagaaggcuuagggaaauuuuaccaggagaaagaagauagguaugacaguucccuugaguuauucuaagguuuauacaagugacagagcuaggcccugguacuuaaugguuauugcuggacacaggggcucagccaaggcagagagccagccaguuggacagcauaagguauuucccuuuguucuccaugugaaaacagcaauaggaggccauagaaauuucuuuagcaucagggguagaacuggacccaaggcauauuacauuucaaacuggcagaaugagauuuucacugucucuuguagcaaguacaauuuguagcagaagaaagaaagaaagaaaaaaaaaaacucuuguaguuucagcuagguauuaguucuacuuaaguucaacugagagaacuucuguuuaaaccuucuggguucucucucccacagaggaaaauaccaguagguucuagaauauuaguguacuaguguuaauagucuuauuaaacacaggguugguaugucaaggucacuucugugguucugugcagcgcuucauucuaguugugaguccugugcuuacggcaggaaccuagaauggcuuguuuguuuuauagcccuuuggaggauggaucagggaacacggaagcggucaagcuuugacaaacaauuuggauuugcuccagagcuacauuaagagaaaugguuucuuguuggagaugagaagucaggguccuugauuaugcuuacaauagccaagucaaacauaauacuuguuaacaacagaaaacauuguuuguagcuggcauuacugauucaagccuugagaugugcuguuauauuuagcucuuuugggaagaucuguguauauauaauauggaagauuuaucuugcagcccagccucuaauuacuaccauaaaaugauaacaugguucacaccuguaaucccaacauucaagaggcuaagguaggaauauugcauggguuuggggccagucuggauuacauaguuacaggcccacuuagguuacagaguagagagaccuuaucucaaaaguuaaaaugaaaaaaaaaauugucuugagucuuuaauaaugucaaacaaugagugccuaaauuacaaagcguaacagacugaauacuagaaagucuccuguuuuccuuacaagcauugaaguauugaagaaacuuaagauuuucuguucagcaugugacuuuacuaaugucacaaaacuuguagcuaggugaagcauggugguacacacauuuaauccuagcccuugggaggcaaaggcaggugaaucucugacuuuaaagacaaucuggucuucacagugaguuacauuuaggacagccagagcuauauagaaagacccuaucucuaacaggcaaacagaccaaaagcugugcuucucacuguagacucacaguuauuaaguggguuucuuuggucagugcuugguuacagucagugauucuuuugcuguaguaauuauauauaguaauauuuauuauacaaauuaguaguauacauccuuucacauaccaauccuuuuuaaaacucuaaucaguauuuuccuacuugauuuggcuuauggauauuuguccacagugucuuguguggaacacacacacacacacacaaaccacuaaagaacgcugauguagaaacagcuggaagugggaauaggagcagguaaggcauuuauaaagaugcuuguucuaucaccuaagaccauuggaaaagacagauauuuacaugacaauucauaacaguagcaaaauuauaguuaugaaguaacaaauauuaugguuagagaucaacacaacauaacgguauaggaucugagccuuuauauuucuuacuggcuuuugaauccaacauuucucuuggaacagccuggcacuuagggagucagucccagaucuuuuguguuucagguaguuaagaauguguuaucuguacagcugcacuugagaaggagaugaucagcagccaugagaaaaggguuuuggcccagggcagcuaggaauccuaaaugggaaaacuagaaggcaaucacuuaugucaggccugguaucuggcuguguugaucucugcacuuaaguggaguagcuuguagugggaguaguuuaucuuuugugggugcucauugagaacauggggggggggagcucaguaaucagaauuauucccagaacuucaaaucagaaggagucuaguugaggagaagauaguuaucuaaccacauuugcgucggggcaggcuucuguccuuuuaccaaggacuuccaccuucacuucacuugcuuccagaguuuuuuauauuuguuuuugugcuggggauugaacccagggccucacacaugccaggcaaagugcuuuaccucuugaauuacacccuauccuuaagaacugcaaacaaaagcgauucagacuguuaacaguuaacagugaauccucugugccagguuuuuccaugaaagguuucuaggcagacacgcuuaagaguuuaaaugcaguauuucccucccguguagauucuugaacuucucaaauaguaguggcagaagguaaccauaagacuugaucuaucacccaugaacuuggguugucugucugcucucuuacuggugacuuguucugucucauucuaguggguaugcugcugaugaaaucacucacugcauacggccucaggacauuaaggaacgccgggcggucaucauucucaggaaguaaguaccuucuugucuggcauccucugccuuaccuauagaccuaucuggauccuuuuagaacuuaccucucuguacuucuggcauuguacuauguaauuauuuuacauccuuggacuguuuaggaaguucaguguucaacaaagaaguacuucugauauuuauugacauacuuuuuuuccuuuuaaggauuuuacauacacacacacacacacacacacacacacacacacguguacguguguuugugugaaaacaugugugaaaaugucuguggagucccgaagagggagucagaugcccaguuguaaaccaccagacauggaugcuaagaaccaaacucagguccucugcaagaacagugcauguucuucugaguuauccccagucucuuuggucacagucuugaaacaagauuugagaaggacuuuucuaaacugaccccacccccacccccacccccaccccacuccccgguucugacuuguuacaugugcuuucacugauuauuuuuagacuguaccguagcagccuacuuuaaaaaugccuaggcuuucacuucuggaaggagcggggaaugaggagaguggggguuaggaugcaguguuuagcugacuuacagcugugccuguucuuccuuuggugagggggcuuugguuggggacauucugauuaacauuaauaaccuucccugaccuagcuggacauggugacucaauaauaccuguaaucuagcauuuaggaggcuaaggcgaaaggauugagucaggccugucauagaacaagaaagaaagaaagggaaaagagaaggaagaagaaagaaaaguuaaucaagcagagugaggcacuaguuaauaccuaggaaguagagguaggauucuuacaauguugccuuggcuggcuuggaauuaauuauguagaccacauuggucuuggagauucaccagccuuuauuccugagguucugagaugaaagccaccaugacaaagaagcucuaucauuuaaaaaaaaaaguugagcaaagcaaguccagguguacagggucagaugugcuugguggauguguauuguuugcuucccccccuuaaagcuuaagcagauucuuuuaaaucuuaaauacauuucuuaauuuuguuguagaaaauguugcagguaagucaagcauaguagugcagaggcguguggaucugaguucaaggcaaaccugguuuacauagugagcuccaggacagccaaaacuaccuaaagugaccuugucauaaaagggcugucgaguuggcucauugauggauuaggcggacuuuuuccaaaaggccaggguuggauuaccagcaccuacauggcagcucacaaccaucuguaauucuaguccugggguaucugguacucuuucuggccuucaacaagacccaagacuguacaauuucuuuauagugaaguucaacaaacuucuauauaguuagaauaggcauuuggaacagaaacugaagcuucacaguguauuuuauacuuucaauauuguuacauuuuuaugcacuuacccaaccacuagggaugaaaagucaauuccuaguaaacuagaacuagaaaaacaauuagcuuuauacacugguuuuguggguuuuuuuuuuguuuguuuguuuguuuuuuuuaguuuuucaagacaggguuucucuguguagccuuggcuguccugggacucacuauguagaccaggcuggccucgaacucagagaucugccugccucugccuuccgagugcugggauuaaaggcgugcgccaccaccuccuggcuauacgcuguuuuuugauaguuuguuuuguaaaacauugugagaccauuagaguucuguacaguacccuauauuucauuucccuauuuugauaucuucaauuuaauacaguauuuuguuacaguuaauguugaaguugaagcaggaagauuauaaguguaggaugucuaggcuacagagaacauucagagagagacacuggggguaggggugggggugaauauuggggggagaauguuacuugaguggaguaaaauaguaacauguccuuaaaaagugccuguauccaacaaugucccuggauauuguagucauugguguuccuuggagaagaacuagacccagccucuuugcggguguaguugaagaguuaaaauguugguuagguggccaaggugcuaaccgacuuuaagaacaaggugguucuuggacgugguacuagugaauggggcuucuguucuuugcaugacuuccugaugugcacuccaguguucuucccacuggaggaccuguuuuguugccaacaugcucacauauuaaccccaagaguaggagaugugaacucugaaaaggagcucaggcaggaagugaguuacuuaggaugaguuuugaacagggauuuccaacuugucaccagguuuuuauuguauauaggcauccaagaaaagcaccauaagacacucauaguucuuucuaucucugcauuaauuacagcacaaagcaaaggacacacugauaggaaagcacaaaauacauccccugaggacccauuagaaagaaaauuaaaauuaauuacaucccuuuuaguggaaaaaucaaggaaggcuuggcacuucuggcuuucagaacuagaaacuaaacuggcuagauagaaaugguauauuuagugguuggaaggccagaaaguaugggggacuuacuaguagggggcuggggcuaagaaggaguuuacaucaacauuugcaacucuggagagcuuucggggcuuuuuaggucuugaacucaagugccucuccgggcuuguuagguccgucuacaacacuuggagauggcacuguccguuaaacugagugaaauggaugaagugagacaaagcaauauaaauaggaugcuuuugguaaaguagguuuuagaauguucugaagcacuagggaagaaacagcuagagauccauuuaccaaaagugagcaaacauuaguauguucuaguuuucuguguagugcuagggauauuuguuagugugauuugauuuguuucuuuaugguuauguuuuaugagugguccagugcuuuacaacugagcuauacucagcccacgugaucucuuaucuguauguccuuugaaaaaaugcucaccacggaggggcaagucaagaaagucuuuccauagacguacaggcaguacugagauaguuuagccaaagaggcacucuuucggcuagggauguagcucaggcuaaagguuugcuuagcuugucugaggccccgguucuguucaugguaccacaaaaagagagggaaggcuggcucugaggcaucuauuaugcugcaacagaugagaugagguagaaauugauacaaaccugaauggcaauagaagccaucaaaaacaguggaaugugggguucacacaugacuguaggcgccagaagucugcuggagacccuacccuaguuaaguguguggaugaacagaggguggguguggugggugcacgcugcucuguucaucaggagaaugagugccuagaccucaguuucccuagcugugaccaugccuaagcuguugccccaucuccuagaauuguggugcugcccccacacaguucugcuuuagacaccuugaugagguaguagcuauguggcggaaguaagggaucugaccacugauuuaguauuguuuccuaccuucagcagcuucucuauuagaugaaugguaaaggagcauaagaagugugucugagacaaaaauucaccccuuccuuacccacagucuacauguggauguguuggagguuauuuuuuuguuguucuguucuuuuuccuguguagugguacaugugcgugugugugugugugugugugugugugugugugugcaguucuggguggguacacauuggaaaccagucuugaugcugggaaucuuccaucaucucuacugucuuagucaggguuuucauugcugugaagagacaccaugaccaaggcaacucuuguuaaggacaacauuuaauugggacugguuuacagguucagagguucaguccauuaucaucaagguaggagcauggccacgucugggcaggcauggugcaggaggagcugaugaggguucuaugucuugaucugaaggccaccaagagaagacuguuuaccaggcgcuagaaggagggccuuuuuuauuuuuauauuuuuuuaaagauugauuuauuuuauguagcuauacaaaugguugugaaccuucuugugauuguugggaguugaauuugggaccucugcuagcucuggucaaccaggcucacuccagcccaaagauuuauuauuauaaauaaguagacuguggcugucuucagaugcaccagaagagggcgucagaucucauuaugggugguugugagccaccauguuguugcugggauuugaacucaguaucuucagaagggcagucagugcucuuacaagcugagccaucuugccugcccaggaggagggucuuaaggucccuccccaaagugacacacuuccuccaacagguaaggguuuucguugcuaugaagagacaccaugccuacuaacagugcuacucccuggaccaagcauauucaaaccaucacacuuacucauuuauaaauuuguuuuuuucuuuuuuuuucuuuacacauauggauguuuugccugcaccugauggccacaggucagggagggcaucagaugccccaagacuagaguagugguugguucucaacccuucuacugcugaaacauuguggugaccccagccauacauuauauucguugcuacuucauaacuguaauuuugcuacuguuaugaaucauaauguagauauuuuuugaagauagaaguuuguuaaagggguugcacaacccacagguugagaaccacugguagaguuaauagauaguucugggcugccaaaugggugcuaggagccaaaccaggguccucuagaagccaguucuguuaaucuugggccuucucuugggccccugcuguuuucguuguuugaucuucucaaguaaacccagagcuuuucaguaugcuaucuugcuaaccaucuugcuucagagaucacuuccaaggcuguaguuacacuauaccuaccuggcguuuauauggguucauaucuauguuccuccugcuugucuggcaagcauuuuaauuacuugagccaacuccccaguccauguugacuguagccuuggccauccucucuuuguuccagucucauuuguaucuuggccugguuuguauucaugauagaguugcaacucuggaaauggcagucuucaugcuagcccucuccucucauaaggacucaaaucugcuuaccuuccccccacccccuuacuccuguguugauuacugaacccagacuucauacaugguaaacaagcacacugccucagaguuaaaguauaguguguaccccuagcucagaccucuuuggcagacauucaugucugcuuuccucugucugucucuucuguaguccuggggcaaagcccucccuguuuguauugcugucaggggugagggcaucuauuggaguaugcccacaaugcacuggcaaguuagauagagcuccuagagaaacucucaagugugacugguuugagaaaugcugccuucuguggcugagaaugucuuggggucuguuuacauagcaugcauagcaaucauaaucguuggagguguucagacagaaguuacuccuaaucuucacuucuaggccugagaguggaaaagucauuucucuggaagucacuaggcguaucucuaguugaaccaggaagaaaccaaaacacagaauacagacugcuggucuucacuggagacagaucuguccugauaggguuuaugccuuuacaagaugcccuuuugagacuccauguguguuuccuuugcaggacaagauuagaugcaccgcgauuggaaacaaaaucccugagcagcuccacauugccacccagcuaugcuucagaucgccugucaggaaacaccagagacccugcgcugaaacccaaaaggucccaccgcaaggcagacccugaugcugcccacagguacuuaaacccacacagaagccagcagugcagcugaguaggagaguggggaaguagggguguauggcaaaagccugcaagacuuugaaucugagguaagggaagcccagcacaccugacacaggccugggcaccaaacucagaauuaagcagacuccauaaggugucuuuaagagacagcccaagacagggacuggccccugucacuuagugggcaggccccacuguuaucagugcaucuugauugagaucuacugagucaagcagcccaauucaaggauggggcuucugaaguccccuuuagugacuguaagacuagaacccuccuucuggcuucucaaguaacagcuugucccucuuguuugcaggccccggauccuggaaauggacaaagaagaaaaccggcggucugugcuccugcccacacaccggcggagggggaguuuuagcucugagaacuauuggcgcaaauccuaugaguccucggaagauugcccagaggcagccagcagccccacccgcaaggugaagaugaggagacacugaggcucugugcccucuugggacucuggcuaauccugauguagcuaccccaucuucuguuccguuugaguguuuuuuuucuuuguuauuuugguccuauauacguuuuccuugcuuuguugaccauuaaggcuaaagagcgaauugguaaaagaccuggguucuuuuguucuuggcuuuccuccuugauggaaaaagcuguuggcuucuguagagaauuguucacaccagaguagccaguagagacaauggggacagcugucuucaaguggaaguuuauugaaacacacaaaauguuuugguuaugaaauucuaguuugggcuuuaaaauguaaaucuuuguaguguuuuaaacaaaaacuauucuuuugccagccuuuucuuccacugaugcucaugcuuggaugaggucucuuggagccauacagguccugcauugggucugcugugcccauacaucucaccugcuguccaggcucuggaaucucaugcaaauacccuguuccccacuguucaaguuugcugcguauggggcuuaaacagugccauccccccgccaucccauuucugaguccccagguuuucugcaugcccucuggcuugcucugcccaccaauccuggauggucaaggaacuagcacaaugguucugaccucuuuugcuaagagcaugccuguuugcuggguugcuccuguuaggcauaugugugugauuguauggaacuguuagacuugcugcagugggucauuuguaggaauuguuucuagcuagaggaacugauuggcuuccaaucuagcauuuggguuaugggaacuuggggugugugguagggcuucauuucuuuuguucugagguguuucuccucccuuuagucucuuucuccucauuugaccaucuugggccucuuuucccauaucaucucccuaagaagaugugccugcucuguccacauauagcauauauccaaggccagaagucagaccugcauauuggauuaauacuuucucagucuuggggccgggccugggggcugggaaaggaacuucuaaaaauaauagaaaaaaaaauacaaagguaaagucuuugagaguuucugccuauuuagauccuggaaggugggguucauuaggauugacuuuggcagccaggccaggacugagccugcugaaaacagaggccuucuaagcagccaugccaccaccacucuaaguacacaaaggucuggcucucgggccucaguggcugcagaggugugggagcacccagucaucaggaagucucuuuggggucagauccuuugccaguguggagcccucaaguugagacugcauaacuaaagcagucacagaucuucugugguuugggguuuuuguuuuguuuuguuuucuuguuuuuuacugcucuuuuccaaaaaaugauuuguaguugugugugcagcacuuugcccuaauaugugugugcucuacaauaaaaaccaaaucuaauauauuuugaaacaguugucugaugcuguggugagagaaagccugacuuugguuuuucccuuaauuuauuuucuugaccuuccaacuggauuuggagaaagcuaauuuauugcccaccaguccucugaagauuggucacugacaccccuugauugauggcuaaagguggacuuguguuugcccacugcccucuccccuucaaggaggguggccagggauacaccucauggaauucuagaagauacagucucucccuggcuugguagagaagcugcaggccaguacaaacacagguggagcuggagcagggacagaggagcucagguagaggacguggccauucuuguacucagcagcuaggcucuuggccucccuggguguagaacauugguagauaaagcagguaggauaggaugagauugggacucagugggcuccuccaguccacuggggucccuaauguggaucccaggguauugccaacugucagcagcucuccagcucugcuccagugaucugagccaauuugcucaaauugccacugugaaucuuggucaagccauuucauugcccauagaaugacuggccaacaguuugaaaagcagugguaggucuagaagggucagggccucuguaugaacugugcaguggacugggaugacacuagaacugagaggaagcaccaaaugucaucccagcugugauguugcagaagggcagaucccaauccaugcuuggguggcucuuccuagggacaagggauggaagagauuuugauaccagugaucuaggcuucagucuguccugggauagugcccccaguccuuaugaaguaauagccuuaagcaagucucucagagucccacaccugacucugaaucuuucuuguucuagccauggcacugggccuagagcuuuguuuggccccugacucagucuucauguuuauaaaguaguuuucuaacagcaacuggauguaccagcccuacccaccuaagaucucauuccauuccuuuaaccuuguugugugaagaguguucuguaggccaggcucaggaugggaaacagaccuguauaugacaugcuuacaugcauguaaagguguucuauaauguauaggaaggcaguagagcccauuaacuguaaguguaaauaacauguacagugugcuuguaaaucucuguaguuaguuguugcccacagaacauuuuaauuggcuuucuguuuaaguguggaauucauuaucuaccugugguuauaauucacacaccaugugagggagaugcauuuuaccaguuucucuuaguuuucuauggcugccaaaacauuaccacaaacuugagagcuuaaagcaaaagaaauuugcuagguaugguggugcgugccucuaauuccagcacaggcugaggcagaaggaucaaaaguuuaaggccugccugggccuugucucaaaaagcaaagcagccaggcauggugcuugucuguaaugccagcaggagugucgcagguuugaggccaguuuagucuacauagggagcuugaggacagccuaggcuacauugugagacccugucucaacaacaaagauauagacuguuuugugcucuccuuaagacuuugguaggaagccuauuccugccucuugcggcuugguauggcucuaaccacucuaguugcaaguacucuagauucauagucacauggccucuuuuuguaugcuacauuucagugccucucugcaccccaccguguguguguguguguguguguguguguguguguguguguguguguguguguguguguauagaaaggauagaaagggucucacucuagcucaggccauccuugaaauagcaaucuugccacugcauccagccuuuucugucugucuuaguugggcauuugucuuuggauauagggacucccauauacuccacagcugcauagcuccacuuccuuuuuuuuuuuuuuuuuuuuuuuuuuuuuuuuuuuuuuuuugacagugcuagggauggaacccagcgccucuccaguguuaagcaaggacucuaccacugauccacacccuaacucccaccuacuccuuauaaaaauaaaguauaugccuuccagaaacuagaaccugagaaccuugggggccgacaugcagcuuacgaugcugcucuuucuucagaaauuguuacuaaaucuguggccuauugauuccucaaagaaauuguauuaauuucgauugaaauuucuuagccucagcacuauuuuaaaauuuaaucuggaugaugauaauuacuccauugcuugcuuguauuuuuuucuguagugcuggggauuaggugagggccuugugcauucuaggccuuguaaauguuaccuaugccccagcagcucauugcuuucuuaaguuuaaaccuaugcuguccaaucuggaaccacuggacuccggcuuuugagcacuugaaauauggcuaguuucaauugagauaugcuuuauacaccagaauuugaaguuaguauuaaaaagaauguaaaauauauaauugauaacuuuauauugauuacauguugaaauacuauuuuggacauacugaguuaaauaaaauacauuauuuaaauuaau

SEQ ID NO: 6045 - RNA, 14966 nt, Mus musculus
cguccucgcccauugucuggcgagcaaggggcggcacggcacggcgggcacgcucacgucgugggucgggcgggcguccguggcgucccgcgccuccgugcaggccccgccccgcgccucaggaccggcggggccgggcgcaucccgcggcgguggcggaggcgggcgcaagaugaugaaguuucgguuccggcggcagggcgccgacccgcagcgcgagaagcuuaagcaggagcucuucgccuuccacaaggugcggcggcgggggcgccggcggcucaggcgggccacaucgggccgccucugcccugcgagcgccgcgcugcucgggugugccugguuggggugucgggcugcgccccgcgccgugccgugcgcuuucgggcuccuggucucugaaccccugauaucucucccggugucccuugggcucagugggguccuccgaccuaucugccuuucgcucuuggccucuuuucuuucauuuuugguguguagcccggcucggcugagggacauucagggccagguuuuguuuucuuuaacucuuaggcgggcgagagagggaaaaguggggggugggggggcugggaaaucccugcgccuccacuuuucucaccaggcucugcccuaccuuggggucccuaguucaagggaugugcuggucuguaugcucaacugcauuucaaaccuuagugccucaguuucccccgccaugaaaugaggccaguuucccccuuguggauucuggauguccuugcgacccggccaguuccugaccuuacuaaaguuggagagacgagauacagaagagacccgggaaaggccucagcucccaccuagucugcacugaccaguauagagccccacaagccuaacucuuaucuguacugguggggcucugauuagauguuacuuuuaucccagagccugugugcaucuugcuguugaggauucgauuucucauuuccauuacacacguuaaaaaacaaacaaacaaacaaaaaaaaaaaaacugagguucaguagggagagggccgcuuaucuuuccuugccuugcugugugauagcaguggaguaggaguuuugaagcagcugcuacuguccugaguagaacuuagggacccuggacuucucuuaggaggcacuuucagggggagacccugccauggcucaguuuuuucuuguugcgaucucagcaaugaucagggggugccaggcuuuacagacaccauaacuaaagagcugccaggagaggcuucucagaugggagccucuuuuuggcucaccgugagggugugccccaugaaacaagaagagaguggguuuuagccagugaaugggguguguaguggggaccuccacaguugugaugagucucugaagcauggcuuccccugacugaugaugcuacaguggguaggaguugaggagggugaggcccgauuugagugggaagcaaugauaggagauaggucaucuuggggaacgaguuugauugccacaggggguguuaggagaucucuagagaauagugagccccagauucuugaguuuggacuuguaguccagggugaccaguggguauuggguuuaaauccagcucagaccacaaauuacaaauugccuguaggaugugcaucuccuacuaguuuaauuuggaucccuaccuccuugguaccagggcauggcggacaauucuucauugaaggggugguuuauucccugggaaaggaugcggacaaaaaagccaaaacagaagggcagaauauauaguaguucacaggguuggcuagagcuguggauaaaauauggugugaugagggugugggaauauggacugggaugcugacguaggcgggaccaguuagggaggccuuucagagcuggucauuugggagugccagguaaccugcacaguguggucgggggggggggggugcgggggggggaacagaaggaaugcagaggaugccaaagcuuuagucagcugccuagccaaagagccaagugcuuuggggugggagucaggugaacugggaugcccagagaaggaccacauggugaggccuaggcuuuggcuguggaucagaaggcaucuccuggagggccccaaguagaggagguaggacuggcuggcugguuuccaccggugacugagcacugguccaggcaggcauugggugggccuggagcagggugugggaaggguuacuuuugugagucuuagaaguaagacaguagagcucagggauugauuggaguuggggugcaaaggguaggcacuagauagggaucuagccucuuccauaaaacgagucugguggugcccacuaaggacuguggggacuuaccgugcugucguguucuggugucucuuggacacggaacgcuaagccuggggcuaacuagaggaagucaggucuagacagggcauggcaguucugugggaaagggaauucccgagccaacugccgugguuggucgguugguugguggcccugaucucuuggauggcuugcugucacugcuaaguguaagcaggcuggauggaguacugugaucagcccaagacugcuuguguagacccugccaccccaccucucccuccccgauggcuagcuccauguagauggccucuuuuauuuauguauuuauuucugagacgucaucacaucaugugguccaugcuguccucuaucuugggauccuccugucuuagcguuccaaaugcuaugauuauagccaugugcuaccaguccauauuugacaccucaugaagguauucaugucccaaccacacuugugcaugggugggccagugggaagaggcacagucacaccaaaggaaggaguacguauuggaacuuaguguauagggaaggaccuggccucacaaagagcggagaagcagguagguagcaccagcaucgacauggacaauacucaggucccaggugcuauccccaccucugauggugcugggauuccuguuuuccggcucuccguguggggagguggacagcaccuucugggccaauuagaagcagaagccccaggguauuuugcccauagaacccuuucuucccucauagacuguggagcauggcuuccccaaucagcccagcgccuuggccuucgauccugagcuccgcaucauggccaucggcaccagaucuggggccgucaagauguauccuuugcuucugaggugcugcucacuucaugcuggagucuuagcauggcaggugcuucauggagacagcugugcuuguuggggcuucugaagaggucgcugugccugugugccugugaugacuccuuucggaaaugagagggucuuuugguugggagaugggugauuggaggggaggucgguuugcaguaacaauggcugucccuugcugccuuucagccuaccaauucuuagguaauccuaccaucaucuuggcagcugugacuggggcaguuagggguggccugugagcccugaugagagaaagaguacauguguacacacacacacacacacacacacacacacaaauacgaagaccccauguguucaacccagggcgggagggcagugccaggcucagcauggugagcgcaacacugcccccaucuggacaccgaugccauacaaugggcugagugagcuguacaaugcaggcauuuuccuguaguccaggguggggguggggcaacaggcugcugaaugucuccuuacucuggaaauagcacccuaaccugccuucaggaaaacuugaggugcagagucuggcuagaagcagcuugguaaaggugccccuccaccugcucaccaagagcuggagcacuagguuggggugggaauguggcucgugguuuaugagguaaugucccuugucagggaguguggcuggaggggauguccuucccucuguugugggccacuggguguuuggugggacaguuaccaagaugagugcugcuugccauucgaagacccguggaugcuaugcugcuacuccacuugcugugaccuuguacuggguuagagguauccacaucaaagguguccauaucagaguugcccauggucuacacugccaggugcuuagagcuguccuuguggguauugcccucgugcuuaguauacaugaggaagccaaagcuagauccuccuucucuucccuuuuuccucucaauuccuguagccaugaacuccugagguugggaaacugaggcuggaaagugccacaguuggucucuagagccucccuucccccugcagggcagucucaucucccaggagacugugcuuccugccagcugccccuguccucucuuugucauccuugccagccucuucagggagucccagcucaauauccaggcaacugcuccuuccuugucacugggacaacaucacugacccaucucuuagcucucuugggcccuuucagcuuugcuggccuccaucaguccuggaguuucugggucucggggcacuuguucaaacaggucucccgucuucuagucugugcucaucuggaagcugaguaguggaagcuguuggcuaccugcucugaagggagcuugggguucuugaccauggucaagaguuguuugaucuggcacugcucuguucugcuuaggcccguuaaccucuacugcaaggcgcuugguccgugcaggugaauccgcggccucguguguaccaugccggagccacagugcugagcaggugauuagucuuauuccauuggcaccagcuuucugguuugagucauuggccugcuguacagaugagggcuugaaaaccuauaucaguacccuacugggggcgcuguguggguucugugggcaccucagauacaggagcagaguugcuuuaggaagugggggucaucaggagacugccggacuccuggaugggcagagccugucugacuguccuagcuugucugcacguuuguucuugacaaguuaccuuagcuauggugcacccggaguggaauuuacaggccuacaucgggacgcagccaccgucacccagaugcauuuccucccuggucaggugaauagcuccccuccuuuacuagcaccagguggucccacccccgugcucuccuccccuucaggcuacccccauuuuggucucugcuccgucccaucagggccgccuccugacccugcuagaugacagcagcuugcaucucugggagaucauccaucauaauggcugcgcccaccuggaggaaggccucagcuuccacccacccagcagacccaguuuugacaaugccagguacuggaggaucaggcugggacuagccacugggcagaggaauuagagagggccuaugagccugcucugcugaagcagugcagacacaguugggcucugcuucaggagcccugccuggauagaacccuucuugaagugguauccuuugaagauaggguuagagguguggccagcugagacugaggccagugggcagagacuguguuucccaccgugggagccuuuaguuuugggggucccagugaauagaauguuauauacccaacuccuuagaccuuuaggcuggcacaguacccucuagggauuugggacaguucuaugccaagguaauaucagcaaagucucaggcuggccuugaauuuuuagugauccuccagccucagucuuccaaguguaggguuacugguguguacccccauauuugaccuuccugcugguuucuugaguugggaucggcugggccaugguugauagucgggaggguucuccaggguaggcuuggugaggugcuggcuggaugccuggcugugcauagcaggccgggcuccccagguggagagccuugcccucaggugugcuggaaauagcugcaaugggauagacuuugcccacagguuaguuuuuccuggccuggccuggucacuguuugggccccugaugucugagguaucuggaaagcugguauuggggacccuggcuggggcagugcucugauucugccugagagaagcaggguaguaagugaucugugagucuuuugggaccuggagaacuuauuuuuaucccuuucuuugcuggcaugcugggggauaauugaguaggcuaauuacacugcacauagccuucccagggugucagccugugcugugaacaggcccugugaaugcagagaggcauaagagagcccauagaaaggguucaaccuguucugccuuccccagcagguagaugggcucaccuuacucucucuuccucuuuccugcaguuucccugccagucuaacacgugucacugugguccugcucguagcuggcaauacagcagcccugggaacugagagugguagcauauucuuccuggauguagccacccuggcacugcuggaggggcagacucucagcccagaugugguucugcgcaggugagcagcaggcaggaggacccucccauuucugggaaguucuccugacucucuggggcacucucugcagugugccagaugauuaccgguguggaaaggccuugggcccuguggagucacuccagggacaucugcaagaccccagcaagauccucauaggcuacagucgggguuuacuggucaucuggagccaggccacacagucuguggacaacguuuuccuagguaaccagguaagcaaacgaggcccgaaugcuccucuuccaggcccuuguccacaccugcuggcucaugccauccuauccucauccauagcagcuggagagccuguguuggggccgugauggcagcagcauuaucagcucacacagugauggcagcuaugccaucugguccacagacacuggcagccccccaacgcugcagcccacuguagugaccacacccuacggugagcacuggggaggcuugagcugaggguggggacuagggggccagcuggccuugaggguacuacauagccaaaucuacagaaggagccuccggggggcaucgcuggguaugggccguaccuuggggagaggcacaagggugaggaaugggaggucugacacucuccccacccccaggccccuuccccugcaaggccaucaacaagauucuguggcggagcugugagucaggguagguagaggggcagugugggaggggcuugucuggcuggggacuagaggauuaggcuccggguauauaggggugcagcccuuacuggguuauccagcaugugcccugcacucccggagcuccugguucacacagccucccuccccuugcagagaccacuuuaucaucuucagugguggcaugccucgagccagcuauggugaccgccacugugugaguguacugcgagcagagacacuggugacccuggacuucaccucucgugucauugacuucuucacggugcacagcacacagccagaggauggugaguaucccaccucucucacccccagcuagcccaguguggcuguaagcugagcucacucgcccaacuccacagagugugacaacccccaggccuuagccgugcuucuggaggaggagcugguggugcuggaccugcagacaccaggcuggccagcugugcccgccccuuaccuggccccacugcauucgucagcuaucaccugcucugcccauguugccaauguccccagcaagcugugggcccgcauuguaagugcuggugagcagcagagcccacagccugccuccagugccuuggugagugugggugucuugugucccgggagggguggugaggugggagcuguucugguggaggguguagucuagcccagacgggagauggguaugcgggaggcauguggccaggaugagagagagaccuucagccuaacuuuaagcuccugucuuuguugucuuucuuagaguuggcccauuaccgggggccggaacuuggcccaggaacccucgcagcgugggcugcugcucacuggguagguauggguggcagacagggcccagcaccuaggaggccuuauuuguuuucugagcaucccagauucuuugggugcugaagugcucagugacucagucucaguccuagugaauccgaucugaguuguuccuguuaggaagccucccuugauucuggcucaaagcccuccucuccacuuccucuuggccugggacugaguuccagcccagcccagcccaggcuccacccaccuggcuugccugccauggacuggaaaaucuggguuggccucugcugacucuaccagucaggugcuggaaacgccaggcuaggucagggcacuggugacucaggccucacuaacugcccugcccucccuccugccugucugggacccucaggccucucaaggcagcucgcccuuuccuguugggagcuggcucuagccucagggaugcuggggagccugaaccaccucguucucuaguuccuuucugacugacuugggagcccaguggggcucugcagcuugucccagugcuucaccuuacuuuugucuccuccucuuccucucccuacuuucuccucguuugacacccagccuuuccauugcuuaccugcaaggcacccuuaggcuucuugccugaccugggguuuguggcaugugcuaugauuucuggguacccauugcuccucucugccaauuccugguugucaaaguggucauuccuuuaccuuccaaccuguucagaaggcucucggggcaugagauuguguguagccugaguaccuauucuuccugcauugugggugcuuacugcugugugcaguagguaccuguaguggccacuggaagaauaauugagagggcguggaucucccggggcaggcucugacacucaccuucucuacagccaugaggauggcacugugcgguucugggacgccucugguguggcgcuaaggccacucuacaaacugagcacagcuggccucuuccagacggacugugaacaugcugacagccuggcccaggcuguggaggaugacuggccgcccuuccgcaaggugccucuccucccucccccugccccucagggccggccuuugagcuggucauagcucugcacugcaucaccaucccgucuuaucccuucaggugggcugcuuugaucccuacagugaugacccccggcuaggaauccagaagguugcgcuuugcaaguacacagcccagauggugguagcuggcacugcaggccaggugcgguuggccugcagucuccagaugugguuggccugcggucuccagauguggcuauuggggaggcuuucugcaggagguggcccuguaggguguggugaaguagagggcaaccaaugugggcgguaggucagagugggaacggaacaccagggaagguuggcaggggugaggacagaugcaaaguguggggugccaucacaguguggggugccaugacuugaguaaggguaggggaagcacagaggcuugaggcugggagcagaaauauagcugugcagauguguucugcaacugcagggccuagcgggucuguaacagaguaccugugcacugacugcacucggggccuagugucuagucauugcucaguagaaggcagacucaggaaggaguuacagacuccaggagggcagaggccagcauguuaggaggucaccacagcucagugaaggcuuugguacauuguagguauucaggggccauuugcuggguaggugaguucuggggccacucagccucucuccugcuguguguccaggugcuggugcuggagcucagugaggucccagcagagcaugccgucaguguggccaacguggaucuucuucaggaucgcgagggcuucacguggaagggucacgagcggcugaacccacacacggggcugcugccguggccugccggauuccagccccgcaugcugauacagugccucccacccgccgcugucacugcugucacacuccaugcugaguggagccucguggccuuugguaccagucauggcuuuggccuuuuugacuaccagcgcaagagcccugugcuggcuagguauguggcacgagguggccaggugggugggcagccagagcccugagaagguggucugggauuccguuuccuuucagagguugugcagaagcaggcugguugggaaagcccuuguaaacgcucuccuccugcgggagaacgggucagcucuuggagcugcugugggcacaagcccuagcuccgguugcucuggcccccaggagagcaggagugcaguguagcuccauagcacaguuggcccugucauccccaggugcacccuucaccccaaugauucuuuggccauggaggggccacugucacgggugaagucccucaagaagucacugagacagucauuccggcgaauccgcaagagccgugucucaggcaaaaaacggacuccugcugccaguagcaaggugaguuggggcuggcagccauguccgugcccugacccagagugcuccggucuggucaggugccgugggcccuguagggugaagggauccugcuggacacggggcagagggcucuuggaagagcacgucugagcgccucuggccucuggcccucccaguugcaggaggccaaugcccagcuggccgagcagaccugcccacacgaccuggagaugacacccgugcagcgccgcauugagccucggucugcugacgacucgcucuccgguguuguacgcugccucuacuuugcugacacguuccuucgagauggugaggccaggguagggacgagggucggagaggcuggaugaccucuguacuggggggaggcggugugagaagcagcuucuguaugcugagcuacacuuugggacgccauggcagccagccgccuguauagcacaucuaggagacauguuugcggguuuauagaguugaacagaagcaagggagccguggugaggcggacggugagggccaggauggcugaggcccugugguaggcaggaggcagaggucggggacagaucaggcagagcuggugcugccaucacucagggacucugugggagcacguccucucugugcuucauguuggcgguucuuugguuuuuacguuguaucauacuaaguauaaacaaaauaguguguagucccucauauacuugagcuaccaccccagugugucagcacacuucacucuuuuacuuuuguuuguguuuauugcuuguuuuuuagacagggacucaccacaugggccuucugccugauacuugcuauguaaaucauguuggccucaacucacagagaucugucucuaccuccugaggguuggcauugaaggagugugcuagcgugcccagccuugcaggaggcacugcguuugcuggaaugaguugaggguguagcguguugaguuggugguaucagguacuagguuguggcccugauacccccuugaagaugcccucaaggugacucgugccucuggaucugggcugguguuucugaccaguggguugaggccacacagcaaguguagacugggagggcgcacuggucccugcagccaguuaggaaaugaugguuacagugagggugagggagaagggucuguggggaauggacucucagaaggccuuccuacuuuacguguucuucacagcgacccaccacgggcccaccaugugggcgggcaccaacucgggcucuguguucgccuaugcgcuggagguuccagcagccacagcaggcggagagaagcggccugagcaggcaguggaggcggugcugggcaaggaggugcagcuaaugcaccgagcaccugugguggccauugcugugcuggauggucguggccggccacugccugagcccuaugaggcuucccgggaccuggcccaggcgccagacaugcaaggcggccaugcugugcucauugcaucugaggaacaauucaaggugagcugccuugggugaugaggauccauucaggcccucaagcacugggugcagucuagcccugccuuaguucccccuaaggccuucuaccucacagccuucuccuagagccgguggaaagcgcuugaaucuugguccgugagaguacuaggcauaggacaaaugcauauguccagugaucuggccaaggguggaaaugaggcucauggugaagccugggcuguucuguaggccaucugcuggauggcugguuaagugaguggccuuugauaugcacaguuggauugaggccugcagagccaggugggugucugcagcugaggaauuuugugguuaggacuaagcugggccugucugucugucaacagguguucacacuacccaaggugagugcuaagacuaaauucaagcuuacagcccaugaaggcugucgugugcggaagguagcccuggcuacauuugccagcgugaugucugaggacuaugccgagaccugccuugccugccucaccaaccugggugauguccacgucuucucggugccuggccugaggccucaggugcacuacuccuguauccggaaggaggacaucaguggcaucgcuuccugugucuucacacgucacggccagggugaggcgggcaggucggggaugagugguggguuacacagaaaacccgggccaccaaggguuggcgguggcagugucccuuaaauauuccuuggcccuuuucucccgcccacaggcuuuuacuugauuucuccaucggaauuugagcgcuucucacugagugcucgcaacaucacagaaccacuauguucucuggauauaagcuggccccaaaaugccacccagcccagguuugugaggaaugggucccuuagccgccuugggcccugcacuccccugguguuagugcccauuucuaguuugggggucagaugcagcaccuguaauagucuccaucacacucccaucuuuuucacaggcuucaagagucacccaagcugagccaggcuaaugggaccagagacaucauucuggccccagagagcugcgaaggaagcccuagcucugcccacagcaagcgagcuggugagagggcacagggguggggcaggcaggcauugaggguaccugagggagagggguuaagacguaagcucagguuccacugagccagggcuggagggcgccugugugugcacaugcguguccugugugcucugucguuaguaccuggucucuaggugcacaguagauacugagcagcacuucuuccaacagauaccauggaaccacccgaggccgcucucucgccuguguccauugauucagcugcuaguggggauaccaugcuggacacaacaggggaugucaccguggaauaugugaaggauuuucuggggugaggccagcugcucucccaagccgccauccccagggcaacuaggggucuucuuaccccagcccuucugauuacugcccuccccagcucuccugaggacucugagaagaaccugcggaaccuggaggcagaugaugcuugucgggccuacacccuucugauuaaaugaggugcuguggggcagccuggccuuaccacacagcagcugccaucccucacuccagcuggaacccugcaggcuucucuaauggugucauuccucgaagccuagcugccuuccucuggcugucaggcauaggggauccacagucaugaaagggccuggccuggcagcacugaaauccugugcauuuagaaggccaccucugacccuguggguguaggaguugaugcuuauccaguccacagagcccauuucacaggagagucacugaggcugauagguccugccuauugagccagcacauggaccuuaugugccccuaccguaucuugcuauggacccagccuagcuggagacuggagcucucuggaccuuaguagcuagugccucugcagccuacauugggcauagauaacuaaccauacccucuucuacuugguacccuccuagcuccccagcaagcccaucuugggccaucacugaaaggggcugccuaccccgcaggcaggcaugaccuggguuugcuccccuuagucgucaccaucugucggucuugccuugccccuuaacacggacccgcugacugaugcugggcccugaacacaucccagccucaagcucagccggaggggugcgagcauccuuuugcacuccauacuguacuuccuuucuccucaagcagaguauuuuucuaacgccuggacugagcuggccagucauuucuaaagcaguuuugguacuugcuccuggccuguguguauugugugcuccugugacuagagacugcugggcgucaugacugaagucagucagaggugugugugugcgugugugugcacgugugugugcggcagugaggaugggcuucccuguagaugccaccuucggcuuuucugucuuuuuuuaaaaacuaguuguuuuaauauuaaaaguacugauuuuuuaauauugaaaauaaaagcauuuaauaucuuuuaaacuacaucugcacacauguggacacacugguggggcuuggggcugugugcugcuugcaggcuguggcuagcugaagcagguacgaggaguccuccucuuccucacuggagucugaggucauagguacugcuuaggcuggggcuuggcggaacgugcuccaggcguggaagcagcgggugaaggcgcgcugcucauuaccuuugcggaccaggcgcaggcgacguggccgcucauguucuuuagagcgugugugcuggauguauaccugguaagaaaaacaaugggccuggguaguccucuaaggccugcuggacugaccacugugccccuuccucaacgucuauccaggaugagggagggacaaguggcuccugaaaccgucaggcuggcuucaguaaucucuuaccuggcaagccuucagacucaguuugaucuccacuuggcuugucugggucccaacccacauguagac

SEQ ID NO: 6046 - RNA, 13145 nt, Mus musculus
aggggcggggccggcgcugacccagcccgcggcucucggccgccccgcguccucccugcccguaagagagcugcgccaccauggaggccaccggggugcugccguucgugcgcggcguggaccucagcggcaacgacuucaagguuagcugggggagaaggggaaaggcgaccccuaggccgucuccccgggccgcuuccucugcgcuuccgggaccggcgggcggggcgggcgggccuccgcgagucuucccgggccugccccgcccggggcggaagaccugggcgggggcuccgggggucuggggccgcgcgggauuugagcccucaggccgcgaaccggaccccaugccaccgagggaauacgcccuagccagccaccgccccacacuguggucucgggacgucacuucucccuccgcgaacucgggguucucuccaguccuaggggcucaggaacagcccguuugguggcguguaauggaaagagaucuguuaguaaggagugugacaggugcgccagguccuaggcggcaagucuguucaacugcuagacuagggggacaagcagccagcagcccugguucuugacuauaaagagccaggcuaugggcgugguggugcacgccucuaauuccagcucuugggaggcggaggcagguggaucuuugacuucguggucagccugcucuuaaaagcaaguucccggacagccauagcuauaucgagaaacccugucuugacuugaagaaaaaaaaaaugugccggcuagacccaggcccaaagagagaaaagcuggccccgaaggacagcucagaagccuggaccuucuccaccgccuggucgaguccuuuagauaucagauugggggaugcaggaggaggugggcuccucccguguucaccugcacacggacacauguuggaucccguacacugugggcaucacuucauccugucuacauacccaccauccucacuuguggucucuauucucucuccacugggaacgucugaguuaccuuagggaacgugacuggaagaagagguguuacaguagcaaaaggcaauugagcuucaugcugcucagaugucaaaacugccaggaguagccuggagggaguggcaaaugccuuuaauuccaacacuggggaggcagaggcaggcagaucucugaguuagaggccagccuggacacaaaaugaguuccaggacagcagggacuacacagagaaacccuguaauugggaguuacagggggacaaaaccuuaggcuggugugguggcacagaccuuuaauuccagcauucaggaggcagaggcagguggaucucugugagucugaggccagccuggucuacagagugaguuccaggacagccaaggcuacacacagagaaacccugucuuuaauuuaaaaaaauaauuauuuauuauuuauauguaaguacacuguaucugucuucagacacaccaguagagggugucagaugucauuacagaugauuguaagccaccaugugguugcuagaauuugaacucaggaccuucauaaaaacagucagugcucuuaaccacugagcuaucucuccagccccaagaaacccugucuugaaaaacaacaaacaaaaaggccagggaugcugaagugggcauugcaugugaggaaugaaugaaugaaugaaugacacuguucaaggaacauuggggagcugggcucuuagugcaaucccagacagccaaacugccuuggaaccccaggcaaagcaaugugaguuccacuaagcacaguggaaugcugaggaacccuugaaacacaccagggacagacuccagcuggagagacacguuugggccaggauguuuguccuuugggagcuuucguuuagugccauucugugaguaagaaagagaaauguucucuagggaccacagaaggugaugagaggaggcacucaucuccuagacuguccucacccuccuguuuccuccccaccccccaggguggcuacuucccugagaauguuaaggcuaugaccagccugcgauggcuaaagcugaaucgcacaggccucugcuaccugccugaagaacuugcggcucugcagaagcugguaagggauguaggcggcggggcgcggggaggguccuauccuaggggcuaggccagguuggcauacucugcaaaaaaggggaguggaaucaagagaaaacagaaauagcugugggugaagcugauggugugugugugggggcacauccaccugggagguaugcaaggcaggugaugguguguaaaggagaggggacuguugggauggccuucccagauggugcaguuacagggcugcaggcaggggcuggauaccuuagguccccaccugaaccuuugacucuuguccuguccaggagcaccugucugugagccacaaccaucugaccacgcuucacggcgaacugucuagccugccuucgcuucgggugaguguucgccugggcugcgguagggucaggcgcgggccagugucuccacccuccuccccucugugcccguguugcugcaagagagcucauaugaaugggagaacuuucugagagaaaagagaggacauuucaaaacccaccaccucucuggauggcugugaacacagcaguguaggcagaacacaguacuaggccacauuagugugucuagugugcuucuaaccuaccacauagguaaagacucuagccacacaaaagucacccccagacagcaguguagcuggugugacugggccuagaagguagcuugaaaaucaggcccuugccagccuuacaggcuucaguuaggauuauccuucacagggccagaaccccaagauguucagaguccaggaucuggacuugggcucccugacucuaaaccagggcuuugccacuuaacuggcuuaguuacuuuucuguugugacaaagcacaggacuaaggcaacuuaaagaauauauuucauuuggagauucacaguuccaagggcuagaguccacgaccaucucagugaggggaacaugacagcaggcaggcaggcauggcacuggagcaguagcugagagcucauguguugagacaaccaugaagcagaaagaacuagcugggaguggugugggcuuuugaaaccucaaagcuugccuucggugauauaccuccuccaauaaggccacaccuccuagcccuucccaaacagcucuaccaguuagggaccaagcauucaaauauaugugucuaugggggccauucacaucuacaccaucacauuggcuaaguagcuuuggcaaguuccuccauuuccuccagcagguagguugcacuuaaaaaaauagauugcagggccgggcaugguggcgcaugccuuugaucccagcacucaguaggcagaggcaggcagaucucuugaguuugaggccaaccuggucuacacauugaguuuuaggaucuacauaaugagacccugucuugguuaaaaaaaaaaaaaaaaaggugaguggggauacaguccagugacaacaugcaugcuuuucacacguaaagccuugggcuuccauccuaguaccauaacucugagggccccauauuggccuuggaggcacgcugacauuggguuuuaaaguuugaagaggcacucacugggaggcugggagaagcccaccagaugucgugugugagcaaaggucagaggagggagaauucucagaccuggccuccaguuuccgaaggagcuccccaccuggccugagcuucucucucagagcagaaaaugaggaucccaaguucuuuccuuauacuccuaggccauuguagcucgggccaacagccugaagaauuccggagucccugaugacaucuucaagcuggaugaucucucuguucuggucagugguuaccugcccaucuggccccugugaugcucauucaguccucacucauagcugccucaagggccgccaucaucccuuagaguggucaaugcugagcccacaucacuuguacacucaguucccuagcccaguccccuuuucacucaaucuauaucccugaacguucuugucacuccauguccaauguccugccagaucccuggguauggcagaggcauggggacgguguguguguggggggcacccuggccugaccuugucccugcucccuaggacuugagccauaaccaguugacagaaugcccacgggagcuggagaaugccaagaacaugcuggugcucaaccucagccacaacggguacuggggagaucaagggcauggcaggugggccgugcagagccaggugggcagugcagagccaggugcagagccaggugggcagugcagagccaggugcagagccaggugggcagugcagagccaggugaggagccaggugggcagugcagagccaggugcagagccaggugggcagugcagagccaggugggcagugcagagccaggugggauggaagacugauuuucaggcuuuccccucuguacuacagcaucgacuccauccccaaccagcuguucaucaaccuuacggacuugcuguaccuggaccucagugaaaaccgccuagagagccuucccccucaaaugcgccgccucgugcaccuucagacacuggugcugaauggaaacccgcugcuacaugcacagcuccgguaggugccuugcuuuuccuugcuuccuaggaguccugacccuucccacccuaggccucaggccucagcacuggccugugcuugcuauacaucuugucccccucuuuggucaugcccuccugcccacuccaucccuagagucccuugaguggacuuacccuaggguggcaaauccuuuccucacaggcagcucccagccaugauggcccuacagacccugcaucugaggaacacucaacgcacccagagcaaccuccccaccagccuggagggccugagcaaccuuucaggucuggacugucuggggagccccuaagguucucaccccuuugagcuuaccagcuuccuugggaauaaaggggccgaguccugcuucuugucaugucucgcagauauguuagguaggggcuugcugugugacucuggcugccuggccuggcuugauacuuacuguguaggcagauuggccuugaacucauagcgguccccugucugagcaucucaagugcugacauuacaguucugcacacaguggucaauuuccauuggguuucugucacuaggccaccugcuaugaggagucucucaaguguagaaacugcaggucauacaaauuacuugccuaagaccacacaaccugguuguagaauaguuggaauucacacugaggcuuguuccuggugacugcuguauggguccuaacugaugugcccuuccaaugucccagauguggaccugucgugcaaugacuugacaagggugccggagugccuguacacccuccccagccugcgccgccucaaccucaguagcaaccagauugcagagcugucccugugcaucgaccagugggugcaccuggagaccuugaaucugucccggaaccagcucaccucccugccugugagccugugccugggacauugggugggccaggcaggagugcugguucuguucuaacugacuuccugcuucucuagucagccaucugcaagcucaccaagcugaagaagcuguaccucaacuccaacaagcuggacuuugaugggcugccuucuggcaucggcaagcucaccagccuggaggaauucauggcugccaacaacaaccuagaacugauuccugaaagucucugcaggugcugggcaggcuggcguggggugggagcucacacuuggcgaucugucugcauccugcuaaugacugauuugccuuuagggaugagacccaucccaccccacacccaacuugagguucucagaguaccuguuaggaagcuaguguggucccauccucuucugaaaaucacuggcccucauauggaucccuugcucuaagacaaagaauugggaagucaccuuucgccuggcccuaacuggaacgccagauccccuaaggcucugucgggcucugucuuuacaggugcccaaaacugaagaaacucguccugaauaagaaccgccuggugacccuuccugaggccauccacuuccugacagagauccaggucaggcagcugggccaguguuggaguagaggcaggguaucaggaaagauggauggagcagagggugugccuguaucucagacugagagacccagcaguagccuuccagggucagugcuacuggggugagcaccuucuucacagcacaccuuugugucugucacugaagccccacaggcagcugcagaguagccagggucagaacuuaguuccuggucccaggcagagacugaaauuagaggcugcuuggagguaaguguccagaccagcagcaccucugcucacguaacagguccuggauguucgagaaaaccccagcuuggucaugccgcccaagccugcugaccgcaccgccgagugguacaacauugacuucucgcuacagaaccagcugaggcuggcgggcgccuccccggccacaguggcugcugcugcagcuggugaguggaaugcgcucucgcccaggagcaagggcacuucucugcuucccccucugcacacuggguaccagggugggguugcccucgggcuguauguccaguagccaacccaguggcucagaugauugcauucccugaaguagggagcggguccaaggaccccuuggcucgcaagaugcggcuacggaggcgcaaggacucagcacaggauguccaggccaagcaagugcuaaagggcaugucagauguugcccaggagaaaaacaaaaaccaagagguaagucaggucagggcugggcuggacucucagaaggaagaggggcccugagcagagaauggcuaaugcaaaggcccuguggugagggcaggaagaggccagucuuagugucucaguagagucacugcuccucuguccccaggaaagcauagaugcccgggcaccagggggaaagguacgacgcugggaccagggccuggagaagccacgccuugacuacucggaguucuuuacggaggaugugggccagcugccugguuugaccaucuggcaaauugagaacuuugugccuguucugguggaagaagccuuccauggcaaguucuacgaggcugacugcuacauugugcucaagguggggcuggcuccuaguguucugcauggugugacgcagugaggcugggggaugggaguugaugcagcuguggcugugcauguagccuggaaggccagcaaagcccucauggcugauuacuuggucuccucagaccuuccuggaugacagcggcucccugaacugggagaucuacuacuggauugguggggaggccacacuugacaagaaagccuguuccgccauucaugcagucaaucugcgcaacuaccugggugcugagugccguacuguucgagaggagaugggugacgagagugaggaguuccugcaggugcagccagagauacacacagaagggaacucgggccacauguacagagguggggcagggggcuaaggccaaagguaguauaacaagagaccucagacagcaaggugaggucuggagagccuaagguggucagagcugagcgggagggaguggcagguugcuuuaaaggagauagacagguuaaggaauguagcugugagauagggcugggaccaauagcuguuagaguaauuacuggcucgggguuauaggcagagccaaaccuaaaaauaaaccacaaaaccagucggcaaacugacuuaccucugcuaccagcugggcucccuuuagagagauagcaggcagcuggagcguuuacuuuaggccucccccccaccccccagguuugcaagcuuccauaaacacuguccagacuguccuucauuugggacaguuuugugcagcccugugcuccaguauauaccucauccuguuuagaauaacuguagguuugcacacacgcuucagcuguauaaacuaccaagucuggcagguacuugguggaggagggaacaacucaaugaugaaccauccucacacacauagguguuugacaaugacaucuccuacauugaaggcggaacagccaguggcuucuauacuguggaagauacacacuauguuaccagguaagcaugcagcaaugggugggccggggcuggguggaagcaaggcuguugaagucagguggacccgggugcucacaguaaauuauucuugcucuguuccccaggauguaccguguauaugggaaaaagaacaucaaauuggagccugugccccucaaaggguccucacuagauccaaggugagcucccugguacuacaggaagcaggggugcuuguccucaguugccucccaucuaugaagaagcaaccuugauaacuucucagagccuggcagaaaagccugaggucugcccaaaaagggaaccagagccccaucuuuugagucagucuacauuacagcucuuccugucuuauccagguuuguguuucuccuggaccaagggcuggacauuuauguguggcggggggcccaggccacacugaguaacacgacuaaggccagguagguggaucuuacggaauauucugggcaaaagaaggcaucccccugggcuggugagauggcucagcagguaagagcacccgacugcucuucugaagguccggaguucaaauccuagcaaccacaugguggcucacaaccauuuguaacgagaucugacucccucuucugaagugucugaagacagcuacaguguacuuacauauaauaaauaaaucuuuaaaaaaaaaaaaagaaggcauccccuaagaacaacauggccuuacugagggguuugcauauauccuuaggcucuuugcagagaaaauaaacaagaaugagcggaaagggaaggcggaaaucacacuccuggugcagggccaagagcccccaggguucugggaugugcuggguggagagccuucugagaucaagaaucaugugccugaugacuuuuggccaccccagcccaagcuauacaaggugagucauggugucgcugucggcagguaccgaaucagcuugguacauugguauugcuuugagagaaggaggcgucuaucaccuggaugagaagcucaggucuggaaggcagcuuugaggguggaguccgaaugcucuuccagaagguagaccagaagucucaguugaacauuugcuuuaguuuuuuugaguggcaaaagacuaagauucuuaugagcaggaaagagauaagucagaaacagggccgggcacugguggcacacgccuuuaauaucagcacuugggaggcagaggcaggcggauuucugaguucaaggacagccuggucuacagagugaguuccaggacagccagggcuacacagagaaacccugccucaaaaaaaaaaaaggauauuuaaaaacugcccuuccaggggcuuggacaggggcucuguaacagaguacuugccugguguggacaaaacccugguacugcugccuacucuaagaaaaaaacaauaaacacuaaacccuuccauugguaagagcucuuuaaaaugccauucauuuugaagggaacacagcaaggugggggucugccauucccaucauuucuuccugccaggugggccugggucugggcuacuuggagcuuccgcagaucaacuacaagcucucaguggaacacaaaaaacggcccaagguggagcugaugccaggaaugaggcugguaagauggaggaggcuggacauggguccuguguaguucugugcguucccagugcugaccuccaaccguuugucccacagcugcagagccuacuggacacacgaugcguguacauccuggacugcuggucugauguauucaucuggcugggccgcaaguccccacgccuagugcgugcagcagcacucaaacuuggccaggagcuaugugggaugcuacaccggccacgacauacaguggucagccgcagccuggagggcaccgaggcccagguaugcccccacacccagaagccugcucaucaugcccuaugcccucugcugcuggccaacuacuacagagguggccaaauccacuuuucuuugcugaaccacccccucuguagccugucccaacuucuguuugcuaagcuacaccuccccaagcccuagcuccagcuccugguagacgcuaccccgagugcuaaccagcuuuuccaggccuacacaaucccucuagccucuccagccucugaccuuaguugugcuaugccccuccagcuauggcauuacacuguucaacacagguguucaaggccaaguucaagaacugggacgauguguugacaguggacuacacacggaaugcagaggcugugcuucagggccagggccucucugggaaggugaagcgugacacugagaagacagaccagaugaaggcugaccucacugcacucuuccuaccucggcagccccccaugccccuggcugaggugggugaggccucugugugugugcggagggggaggggaggcgggggggacaugagagggaggggcucugcacagcauggugcucacaucuccuugaugacggcuaacaggcagagcagcugauggaggaguggaaugaggaccuggauggcauggagggcuucgugcuggagggccgcaaguucacucgacugccagaggaggaguuuggccacuucuacacacaggacugcuaugucuuccucugcaggugccagagcaaaaccucagccucuuguucuuuucccugugcaacccuugcucaccacuguuugaaucgcagguacuggguaccuguggaguacgaggaggaagagaagacagaagacaaggaggggaaggccucggcagaggccagagaaggggaggaagcagcagcggaggcagaggagaagcagccagaggaggacuuucagugcaucguuuacuucuggcagggccgggaggccuccaacaugggcuggcugaccuucacauucagucuucagaagaaguuugagagccucuucccuggcaagcuggagguguguauucacacaagcccugaacugugccccauggccugugcuugggaugguaguaugaucaaaccaggccugagggagcuuggcccuuggaggcagggucuagggaacuacccagcacuucugaucuccagguaguacguaugacacagcagcaggagaaccccaaguuccuaucccauuucaaaagaaaguucaucauucaccgaggcaagaggaaggugacccaggguacucuucagccgacccucuaucagauccgcaccaacggcagugcccucugcacccgguggguaccuggcuuggggaggggacaggauuccaugguggagguaacacugcugacaccaccacccccuccccaggugcauccagauuaacacugacuccagccuucucaacucugaguucugcuucauccucaaggugaggcugugggcaggacagcagagcaggguggugggcaagaaucaagcugacccaagcacuugugcauacccagguccccuuugaaagcgaggacaaccaaggcauuguguaugccuggguaggucgggcaucagaccccgacgaagccaagcuggcagaggacauccugaacacuauguuugaugcauccuacagcaaacaggugacagaggugggggcaggcaggaagggaagagcagaugagggcccuggcugaccagcccuucucacaggucaucaaugaaggcgaggagccagagaacuucuucuggguaggcauuggugcacagaaacccuaugaugacgaugcggaguacaugaagcacacgaggcucuucaggugaguaccccucaucccuccccuagcuucugugcacacacggggacacacaaggccuaugacaaugacacaaaguacaugaagcacacagggcucuucagguggauccuucuaaccuugcccuucaccuuggcuguugcccgacaggugcuccaaugagaaggguuacuucgcagugacugagaaaugcucugacuuuugccaagaugaccuggcagacgaugacaucaugcugcuagacaauggccaagaagugagacauucucccaccucagagccugccuucuggauuaagaugagacgcuauagcugggaauacuggggccaggggcagccuucccaccagccacauguggagcacugagcaucauauacaaaggcccugggcucaguuguuuuuuuuuuuucagagacaagguuucucuguauaguauuggcuguccuggaauucacuuuguagaccaggcuggccucgaacucagaaauccgccugucucugccucccaagugcugggauuaaaggcgugcgccaccacugcccagccugggcucaguuuuuuuuuaaaagcacuauaaacaucaaaagggccaagaaacccaugugaccauuucauccucuguauccucaggucuacauguggguugggacccagacaagccaaguggagaucaaacugagucugaaggcuugccagguaagagauuacugaagccagccugacgguuucaggagccacuugucccucccucauccuggauagacguugaggaaggggcacaguggucaguccagcaggccuuagaggacuacccaggcccauuguuuuucuuaccagguauacauccagcacacacgcucuaaagaacaugagcggccacgucgccugcgccugguccgcaaagguaaugagcagcgcgccuucacccgcugcuuccacgccuggagcacguuccgccaagccccagccuaagcaguaccuaugaccucagacuccagugaggaagaggaggacuccucguaccugcuucagcuagccacagccugcaagcagcacacagccccaagccccaccaguguguccacaugugugcagauguaguuuaaaagauauuaaaugcuuuuauuuucaauauuaaaaaaucaguacuuuuaauauua

SEQ ID NO: 6047 - RNA, 4557 nt, Mus musculus
cucggauuggagcgaaggccugcuuauccagcgugccuuucgggucacuugccgccucgggccucggcguucgguucccgggguuugaacguuccauuccuaggcgaguccugggccuccaggguccuacucgcccuguccuuggguccaugcgcugacgcucggacgcagguacggcuacagcgcaccggguggcccggugucucccagcacugggcguggcgcgcaucccggggcaggugggggcguggccugcggucacugcggugggagggaggacuugggaacugaagagcagaguucgaaucccagcggugccucuucccgacuuggguauugcacacgauuuccagggccacagugacuucgcucuugaauagagucuaagagccuauuugguuacacguuucugcucagucaugaucagaagcaaucagcuuuggccagaauguaagaacaggugaaguucaggcugucaagagucggguuauuuuguuauuuuuguuuuguuuugaauagaggcucuauuauguaacucuggcuauccuccaacucaguguguagaccaggcuugccuugacugccucugccucuucagugcugaaauuaaaggccugcaccaccacauagggccuaaguggguuauauuuagucaccuauuuuauuccuuucuuacuggaguuugaauacaagaccccucuagguguagggcugagucccacuuuagacaggugauggaaugcaagccccuuccauuugcagaguggcuuacugcucugagggcaguggugggcaguaacagagcagagcuguuucugagcuuggaguaggcucccuggcugcccuuugaccuuaccaggcucgaggacagggucuuauuuuuagucuggggagcauggacaggugucucagcugagucacacagugccuaaggcuucagcuacucuaggcaucuugucacuuggcaacugagucccaaggcaaccauggcccugaaagaagggcugaaguccuuggugccccggcaggcaaugaccuuucuggcuuaguggccugggccuguggauuucugugacuuuuucccaaguuccugacugggccagucacacacuucccaguccuuacuggugcggucguacaaauaaacagaagcccuuggcuccgggccuuucucucaccuucuuacccucuccaacuuuguuccgaguccaugggcccuggccagcuuguccugauucaguguuuauuuaagccuacuucacucaccacugcacccuggggccuucagccuggcucugaugggguugcccuagcccagguaguuuucuugucaaggucugggggggccacuaucuagauuccugaauuugcuaagggucuaucaaaggucugacaggccccacccaggcaaacuuucuggaaacccauauuacaaguauuucugggccuuuggguuccuccugacugguuuucacacaguauggcuguucuggguagguucugauuaggagugagggaacucgaccaggaggcauggggaaaauacucaggcuuugggaguggaagagucugggggcugugcugugaaucccagaccuuagcacucaguuuguggcuuggcaacuuuugucuuuguagacucaggguggugauguugaacccagauucccaaggucuugggguggagucaggagaaaggccuggauccuuccuauaugaacccuuuuccagggcuuggaggcuugcaggauucagggagggggcuggcagguccccugauucccuccaagaaacucuuugagcagccccuuucucacggguccccagaaaccacccucuuggucauugcuaagcaucuaugccuuacgaacuacaucucuuugcaggugaccauggcagaguucucccagaagcagaggaaacagagcggcagcgagggccugggcagugugguggacuuccucuuggcuaaugcucgauuggugcuaggugugggcggggcugcagugcugggcauugcuacccuggcuguaaagcggguaaggccaagggggcaaggccugccugaaaccuccacaggagaaggccagacuggggagcugggggacggugggacuuuugagguuggacuggaacacggggccccuacuuuuucacccuagcuuccugguuugcuuuccccccagcuuugccauggcccccgaugcucugaucugugucacuuugccuauagcucaucgacagggccaccagcccuccagaugaggaugacaccaagggggacagcuggaaggaacugagccugcugagagccacaucgccccaaaagccccaacccccuccugcugccuucagccagccccuagcuacugggucccccucccccucugugccaggugagcuacacugcuucucucuaguguggugagccccuugcacaugcccagcuagugagcaggucgaguuuucuuaacuuguggggccuucuaauauguucuccuggaugcuucccuccgcaguggagcccacgcccauucauucucccacgacaccuaaguucagcacuauagcaccccugugccugacguuccaggagaggcugcuggccuucgagcgcaagcaugugauuaccccagaagcccacgugacguuggcgaaacagcuggcuggagacauugccuuggagcugcaggccuacuugaggagcaaguucccagaacugcccuuuggugcacucgugccgggugggccucucuacgacgggcuccaggcagggacugcugagcacgugcgccugcuggcgccucuggaguuggagccggggcuauggagccugguaccuggcguggacacuguggccagggagccucgaugcugggcuguacgcaggacucagcuugaguuucauccccgugggugcagcccaugggaccgcuuccugguggggggcuaccucuccucccgagucuugcuggagcugcuacggaaggcccugucagccucugucaacuggccagccauuggcagccugcucgggugucugaucuggcccgauguggcuucggaggagcugcugcucaaagugcaacacgagugccuggaguucacuuuagcugugcucaugguagucccuggggccagcacugaugaccgccugcugcuggcuuggccccuagaggggcuggccagcaaucucuggcugcaggaucuauauccaguagagaccgcccguuugcgggcccuggaugaccaggaugcugguacucggcggagguuguugcugcugcugugugguaucugucguggccauccggcucuagugcggcugggcuggagccaccugacucaggugguucugcaucugggugaagaggaaguggccuggacugaggaggccuugggggaacgguuucugcaagcccuggaguuucuggugggcagcuuggagcaggcuagccugcccugucacuucaaccccagugugaaccucuuggguaacuuccgggaagaggagauugaugacauuggcuacgugcuguacagcggccuccagguuccugaaagccuauucuagguaaaugaggacuguaacugacauguuuucugaugcuggagagcagcagccaccucccuccuaggacacugcagugugguuugcuuuauuuuagccagaguggagggggagugacaucaccuaagcccacacgugggcaugugccugggugauggugaucaagagucucaaacccagagacucuggguugcugacaucugaguguggcuggccuccccuggcugaccgcuuucagugccagccacauuaauggcccuuagccgucugggguucauuuagggacuugggcucaggccaccaucaccagcaaugaacucacaaagaauaagauguggcuuuugauuuccuaggcuucaccuaggccaagacuguuuuuuuuguuuuuuuguuuuuuuuuuuuuuucaaaaaaaagaaaauguucuuggguggguaacagccccaggucuccuggaggcacuccgagggggucagcuggaggacagcugcuuagcugcugaaggacaguggcuuccugaugguggugcauuuguuuuucugauuggguccucaggccuugaagcugaaguugacucccucgagggcucccugccuuauaccccagggaaggaaggucucguucucuucugcuugguuuucucuaugggccacgaauuaccucugggagaacaacuuccucacuggggggcugaacucugugcugucuaugcaaggcaaucccauagaggcugcuccuagaccucacugcaggguagaggauacgcuccucucagaggccugugugcagaccuguccucugcagcgugccaaaauauucaugauagauguguguccucaccuugcacccugguccagguggcauggcuggaggagggagacugucuccccuacaaggggggcuuucuauuuuagguaccacccccuuaaacacacugaaacaaagccaugccuugaagaugugaauaaaaggagaaagaacugugua

SEQ ID NO: 6048 - RNA, 4557 nt, Mus musculus
uacacaguucuuucuccuuuuauucacaucuucaaggcauggcuuuguuucaguguguuuaagggggugguaccuaaaauagaaagccccccuuguaggggagacagucucccuccuccagccaugccaccuggaccagggugcaaggugaggacacacaucuaucaugaauauuuuggcacgcugcagaggacaggucugcacacaggccucugagaggagcguauccucuacccugcagugaggucuaggagcagccucuaugggauugccuugcauagacagcacagaguucagccccccagugaggaaguuguucucccagagguaauucguggcccauagagaaaaccaagcagaagagaacgagaccuuccuucccugggguauaaggcagggagcccucgagggagucaacuucagcuucaaggccugaggacccaaucagaaaaacaaaugcaccaccaucaggaagccacuguccuucagcagcuaagcagcuguccuccagcugacccccucggagugccuccaggagaccuggggcuguuacccacccaagaacauuuucuuuuuuuugaaaaaaaaaaaaaaacaaaaaaacaaaaaaaacagucuuggccuaggugaagccuaggaaaucaaaagccacaucuuauucuuugugaguucauugcuggugaugguggccugagcccaagucccuaaaugaaccccagacggcuaagggccauuaauguggcuggcacugaaagcggucagccaggggaggccagccacacucagaugucagcaacccagagucucuggguuugagacucuugaucaccaucacccaggcacaugcccacgugugggcuuaggugaugucacucccccuccacucuggcuaaaauaaagcaaaccacacugcaguguccuaggagggagguggcugcugcucuccagcaucagaaaacaugucaguuacaguccucauuuaccuagaauaggcuuucaggaaccuggaggccgcuguacagcacguagccaaugucaucaaucuccucuucccggaaguuacccaagagguucacacugggguugaagugacagggcaggcuagccugcuccaagcugcccaccagaaacuccagggcuugcagaaaccguucccccaaggccuccucaguccaggccacuuccucuucacccagaugcagaaccaccugagucagguggcuccagcccagccgcacuagagccggauggccacgacagauaccacacagcagcagcaacaaccuccgccgaguaccagcauccuggucauccagggcccgcaaacgggcggucucuacuggauauagauccugcagccagagauugcuggccagccccucuaggggccaagccagcagcaggcggucaucagugcuggccccagggacuaccaugagcacagcuaaagugaacuccaggcacucguguugcacuuugagcagcagcuccuccgaagccacaucgggccagaucagacacccgagcaggcugccaauggcuggccaguugacagaggcugacagggccuuccguagcagcuccagcaagacucgggaggagagguagccccccaccaggaagcggucccaugggcugcacccacggggaugaaacucaagcugaguccugcguacagcccagcaucgaggcucccuggccacaguguccacgccagguaccaggcuccauagccccggcuccaacuccagaggcgccagcaggcgcacgugcucagcagucccugccuggagcccgucguagagaggcccacccggcacgagugcaccaaagggcaguucugggaacuugcuccucaaguaggccugcagcuccaaggcaaugucuccagccagcuguuucgccaacgucacgugggcuucugggguaaucacaugcuugcgcucgaaggccagcagccucuccuggaacgucaggcacaggggugcuauagugcugaacuuaggugucgugggagaaugaaugggcgugggcuccacugcggagggaagcauccaggagaacauauuagaaggccccacaaguuaagaaaacucgaccugcucacuagcugggcaugugcaaggggcucaccacacuagagagaagcaguguagcucaccuggcacagagggggagggggacccaguagcuaggggcuggcugaaggcagcaggaggggguuggggcuuuuggggcgauguggcucucagcaggcucaguuccuuccagcugucccccuuggugucauccucaucuggagggcugguggcccugucgaugagcuauaggcaaagugacacagaucagagcaucgggggccauggcaaagcuggggggaaagcaaaccaggaagcuagggugaaaaaguaggggccccguguuccaguccaaccucaaaagucccaccgucccccagcuccccagucuggccuucuccuguggagguuucaggcaggccuugcccccuuggccuuacccgcuuuacagccaggguagcaaugcccagcacugcagccccgcccacaccuagcaccaaucgagcauuagccaagaggaaguccaccacacugcccaggcccucgcugccgcucuguuuccucugcuucugggagaacucugccauggucaccugcaaagagauguaguucguaaggcauagaugcuuagcaaugaccaagagggugguuucuggggacccgugagaaaggggcugcucaaagaguuucuuggagggaaucaggggaccugccagcccccucccugaauccugcaagccuccaagcccuggaaaaggguucauauaggaaggauccaggccuuucuccugacuccaccccaagaccuugggaaucuggguucaacaucaccacccugagucuacaaagacaaaaguugccaagccacaaacugagugcuaaggucugggauucacagcacagcccccagacucuuccacucccaaagccugaguauuuuccccaugccuccuggucgaguucccucacuccuaaucagaaccuacccagaacagccauacugugugaaaaccagucaggaggaacccaaaggcccagaaauacuuguaauauggguuuccagaaaguuugccuggguggggccugucagaccuuugauagacccuuagcaaauucaggaaucuagauaguggcccccccagaccuugacaagaaaacuaccugggcuagggcaaccccaucagagccaggcugaaggccccagggugcaguggugagugaaguaggcuuaaauaaacacugaaucaggacaagcuggccagggcccauggacucggaacaaaguuggagaggguaagaaggugagagaaaggcccggagccaagggcuucuguuuauuuguacgaccgcaccaguaaggacugggaagugugugacuggcccagucaggaacuugggaaaaagucacagaaauccacaggcccaggccacuaagccagaaaggucauugccugccggggcaccaaggacuucagcccuucuuucagggccaugguugccuugggacucaguugccaagugacaagaugccuagaguagcugaagccuuaggcacugugugacucagcugagacaccuguccaugcuccccagacuaaaaauaagacccuguccucgagccugguaaggucaaagggcagccagggagccuacuccaagcucagaaacagcucugcucuguuacugcccaccacugcccucagagcaguaagccacucugcaaauggaaggggcuugcauuccaucaccugucuaaagugggacucagcccuacaccuagaggggucuuguauucaaacuccaguaagaaaggaauaaaauaggugacuaaauauaacccacuuaggcccuaugugguggugcaggccuuuaauuucagcacugaagaggcagaggcagucaaggcaagccuggucuacacacugaguuggaggauagccagaguuacauaauagagccucuauucaaaacaaaacaaaaauaacaaaauaacccgacucuugacagccugaacuucaccuguucuuacauucuggccaaagcugauugcuucugaucaugacugagcagaaacguguaaccaaauaggcucuuagacucuauucaagagcgaagucacuguggcccuggaaaucgugugcaauacccaagucgggaagaggcaccgcugggauucgaacucugcucuucaguucccaaguccucccucccaccgcagugaccgcaggccacgcccccaccugccccgggaugcgcgccacgcccagugcugggagacaccgggccacccggugcgcuguagccguaccugcguccgagcgucagcgcauggacccaaggacagggcgaguaggacccuggaggcccaggacucgccuaggaauggaacguucaaaccccgggaaccgaacgccgaggcccgaggcggcaagugacccgaaaggcacgcuggauaagcaggccuucgcuccaauccgag

SEQ ID NO: 6049 - RNA, 1306 nt, Mus musculus
agaccuaggaagaguaagaccacaggcaggucccaguggucggaagaacaaacccaaacccucgccaaaggagacgcagauugcagguaacuuccuuuguuucauuuugacagaaaagacacagcacauuccgcuuccuuucccuccagguucccugucucaagacagugagguagccagggauagaggcgagcacuucuacaugcaugugcuugcuggcuuuauuuugcuguaaguuaaguuuucuuuuacauuuauuugugugcagucacaccacagugugugcaaguggagguuagaagacaauuuauuggaguugguucucuugccucaaauacagaagucugaaggauucaggcacggugacaagaaccaugguccauggagccucucacagaccucuuguuuuguuuuuaaacagaaaagucuuaucaaaaauaaaauguuaaggucaacuguuagaccaucauuggaagaaaguggcuguugaucuuuugguguacagagccuuagauacauguuccauauagcucucuuagguguuuaaaaauuacauuaaauauguuaagcuaacuuaauauaugauaccucuuacaagcauagugcuaagugagagaagccuguugcaaaccccaccccaugugugguucugcuucucuggagucucggaacuggcaaauccagagucaagaagcaguuugguagcuacuaacaacugagaaggacuaagggagaagacagggccccuaagggaugcagaguuucuggggugaugaaaguggcauaaaauuacgggauugaugcugagcuaccuaaaacacagauccuuccaccucccucgcccaugugcauggggagugggagugcaucaccauauuucacaugauaaaauguguuuaaaaauacaaaucaaggguuccguuaucagucuaucaaaaacuacugucagcuacauauaguggcgcacgccugcagcccugcacgugggaagugggggcaggagaaucaggaguucagucauccucuguuacagauugaauuccaagccaaccugggcuacuuaagaccuugucccaaauaaauuagaaauaaaggccacuuuacuucacaguugccacaaugacuauuaaaagaaaccaggcccaguaaggcuugcuagguaaggaugagucccugggacucacuuagugggaagagaaagccaaccccuggaaugcugaccuccacgugcacucuggcauguauguguccuuugaaaugaaauaugaaguuaagauaagugggacuggagagccggcuuggugag

SEQ ID NO: 6050 - RNA, 1162 nt, Mus musculus
cuggaguagccuaagcagcaguggggagauggucagaagccaggaguacaaaagaugugaaauggaucuugugugccaccaucucauccaucuugaaggugacccacaagaaaggcccugacaaguccagcugaaggucagcgagggcuaaggguacugggcugcucagcagaccacacuaagccucugggcuggcuccuguaggugaaugcaugagaagggagucccucugacagggaaccacaugagaagccaaacaguguggaguguggguaccugacccgccucuugugcucauguguuggugugcaugcucagaugggccugggccagagcugaauccucggcucucucacaugccaggauuggcugcccucugccgccgucccacugccugugccagggcacgcaagucugagacagagaaaggguuagcacugguuguggcuaaggcuuggcaccuccaccuugggaagcuggcacacaggguuccuguuguucuucuuggcuccaggaacacccuccucauuugcagaaaggacauugaugccaggaggugguggcagggacucuacgucacccucuugcugaucagagcagggacccaguagccaggccagaggagaugugcagcugguaggaggaccaccucagcagagcuggaggaccucugugggaagcgggucuugaccacuuggccugcccuucgucccacucuggcuuuucacauauccacaaccagcagcugguccccagaauccuggaugaaggcugcagacggguguccuugcaaaaauaacucugagccuguccccaugggaacagguuccugagagcacaugagcuggcugaggcccacacagaaggcccacagggugcacuccugcacacaguggccagggucauggcuguaggcgcuccagguacuguggcagaggguucuccuugacauacuucuggauguaccagcaggugaggugggccuucaggucuuccuccaccacgaaguccagggcagccugggccagcagagggagaacagcuguuagagcagcagcuugccuggggacugcagcccacuguagcccaacgagauugguagucaccagcucucucuguuacugcuccagguucuccacguggauaaccuucccacuuugcc

SEQ ID NO: 6051 - RNA, 20781 nt, Mus musculus
cggcaggcguccggcgcugcccaguguggcuuuggcgccgcccgccucggacgcuuggaaccgucgcgucugugucgccugucgcccaucgccugccgccgcugccagccaccagcagccaugagcgcgcccggccccgguguagucugcuguccucuagauuagugcucuccgccgcgacgguccgcagcauggagucgcccgccgcgagcccgccggccagcuugccucagaccaaagguaggcucucccgcccuguugcgcggcccgugccacauucaauuugaguccgcccgugauccugggcucccuuccgggcugggcacagacgucugcacuccaacccaggacuggguccagcccaagcccgggaccucacgggaccuuauuggaauccggaucuuaggccgugggacuucacccaggcaggaccuaguucucgcuccacucccaagucuguagccucaccgugagcuccucauuuaggcuuccgggcuucauccuggacucagggauuucagugaucccugcuagagggucuuugggcugcucuagcccucucaggccaggcucuuggauuuuguccaggcuggaauuuacucugggccccagggcuguguucccaaugccggaaaccugucuacucagagcuccuccacucuuccaacuccuuccauccuugugaauccuccuuugccccaugucuugcuggccugcucacuggcugccugcacuccucccuaaggcugucccuguagaacuuccuggcgucuccacuucgcagcucugcccaugcuaccugcuacucaguugcagucuucucacugaguuucccgagcugaccgauucuugcaccuaguguuucuuagucugcucuuagacgugcuguuugguccuugggcuagcagcaggccaggggcuggcugugcaaagcuuguccuucuccaauuaacugucuuuccuggaaauuucugugagguggcaguggugcugcgugggcugcagcagcagcauuugucaugggaagugagggggacaagauuuggaggucagaaugcuuuuuuuuuuucuccaggaagagagaaggauguuuuuuuuugacaugucagagacucaguaggguugaucugcagaaaagauuuccaagcuggaccuggagauaugaauggguugacccucugaauucugaacugcuucaccuggcuagucucugggcaugucuaggacuuauuaaugaaauggauauuaggggcgugaugugagauugaauguagagugguuugaagcaagcacgucugagaugaucgagaacccagcauagcgcccagcacauaguagguacccaggggcaaauaguuguugcacuuccuugacuaucuccagcuuuccugcugcaacgcugggcccaguuuuggauugcagcugcagagcacagaggacagggauggcgggcaccuaagaggguacuugugcagugguggccuucucuccuucugaccuaggaaaccucaaccucaggaguccugguccuggucagguuguccugagcaggcgggggccuuuuggguccccuacagcuggcuuccauggcccugcaggagccuaguggacgggguaauugcaucuuacauaagugggaggccagaucccugaccauugcccaacuucugugaguaacuagggaggcacuuauugggggagguggcuggggaggaccuugcagugcagaccucguggaacuugagaaccaggaaauuagaugcugcuccacucaggaaggguuuggaagcaguguuuguuuuggaggcauuucagcucuuccaggcaagagaugccucaccaaaauaaaaguugcaguugcagaucacagccggagagauugugagugauagggagagaccaugggcuuucaugugcuuggugacuugaggccuggcacuggacguuccgggccucucuucugagugugaguuugcagauuguagguuagguaacaugguauuggaugguuuggguggaggcuuuuuccugggccagaaucccuguagccuuuuaggggucuggagauagcuguagugggaaacugacaauauccauucaccaaaacucuaagagguuuuuuuuuuucuuuuuuccacguguuauacauugcuuuauuacucaucaccccauuugcccauaaacagaggcuggggaacacuuaccauucacagaggcugcacagcuauguuggcagagcacagcuacagcagguucuaugaugaucuccuuccaucccguucccaugugaggugcuuaggggagccaugggacccugggacccuggcuaucacccccauguucacuggagcgugaggucugcugaagcagaggaccaccuaucaugcacgcagucuuuacaguggaugcuucccucagugugacccugcaacuggugcaaaguggagaccuuggcgaggccauaccaauguggacccugacaggaacucuuuuucaccuuugcaggagacuuaaaaauuacacacacaaccaggcagugguggugcacgccuuuaaucccagcacuugggaggcagcagagucaggcggauuucugaguuugaggucagccuggucuacagagugaguucuaggacagccagagcuacacggagaaacccugucuugaaaagccaaaaccaaaaaaaaaaauauacacaugauauauauauauauauauauauauauauauauauauauauauauaugcaugccacauguaguauacuaguauacuuuguggguaucaguucuuucaguucagucuuguggaucaaccuuccaccauguggguuucaggcauggaccuuagauuauuagacuugauaguaaguacucuuaccugcugggcuaucuugcuagccuguuugcagaggacuuugaacacagcggggagugguagcaccugaccuuugguggggacugcaacuuuaucuaugaacuucccacuggacgguuggcagccuaguucuuugugcccaagcuuaggaaguucucuccacauguguaaggcauguaggucccacaacuuuguugacaucuccugucuccuugcucauuagugggucacugccugccaucugaggccaagggcagcugguacaggggcacaugucaggguggucuggguuugcaugucuuguuuguccuugugcauauugucagggauggccuuugacacucuguuggagguguugucauuggaguucaucaguggcugguggcucuggcagcccagugagacuaaggagcacugaaugucuuguccugguccugucugcuaugguuauaagcuuuccuccugucccaggaguuggaaagacuagaggguggcaccuuggggacuuccccccguccuggugugacgcacaggaaacucucuaucagccagccuguggcucagggccugaaggcaguaaaguucccagucagccuguguggggagaggcagccaggcuuccggugggugagucagcagacacugggugcugacucaccacaggcaugccagucacugccuauagcuuaaaggggcaaugccaggcagggguuacauaccuguaggcugccccugguccugggcuggacaucacaggugacggucugcuuuggacuuuucaguugagcugggauucugggcagauccuccuguccuguccaggaacuuccucuguuagguaaaugacucuugcuuccucuugcucaccacagacgaguagauggcagcuguuguugacggucccuggcccagggagcaaggucuaguaagagccaggagcaguggccuugcagggacagccagcuugaacugccucggucagaucccuacucugcccauuuugcaauguaacauugaacacauuguauccaguacauucuugauacuuugauuagguuuuaguccagugaguaggggacaucuuucagagaagaagccggagugcuccucucccccccuucccaggaaguacaggagccuugccuguauggaugcagauggcauuauccagcagcauugcagcuauguuauaaugggccuaggaucccaaccugacucuuacuuccucaucagggcaaauggcauauccucuuugacucucaguccgcuucugggcagugggaggaaguaccucuccccugcagggugguaguaaagaugggagauagaguuucccaaacaaacggcaucugucauuauuuaauuguugggacucuggcugcuucucauugggaggugaauacauggcuucugaugauguauucauaggguuugugacacgaggcuucuuuggucaggaagccagaguuugccaagcucuagggcaaccuuccuaaugcuacgacccuuuacuauaguuccuuauguuguggugaccccugccauacaaucauuugcauuguuauuucauaacugcaguuuugcuacuauuaugaguuguaguguaaauauuugugguuuccaauggucuuagccgacccuugugaaaagguuguuugauccccaaagggaucuugacccacagguugagaaccccgagcucucggcucuuuuucuccucugcuuccuaagccguaagcuaccauugcuccugaacugccugagacaaucaggaaggggaguagagaacugaguuagucuguccuuucuguagaucugucccugucacucagccuuguugaccaguggccgccuugaaagcauaggugagggaagcucaggaggugcaaggccggccucaggguacaaccuccugggcuaguuucucaggugggagaauuucauccaugucagaccuggugcuagccuggggagugagggagggagugagugggcagcaggacucaggugugcauucucucacaccuccccuugguuguuuguccauguugcccauaucugucaggccugugugcccagcagccccuauagauuuuucuucccccauugcagguaaagagcagagacaauggcagcuugcccuaucucacuggggcacguacuacaggccuagugauaccuggccuuggcagggucaguggcuuucuagcccucccuacuucuuagcccugccugcaggguuaugguaguagugccuccgcugagcuggaguccagggcugccuuggcugcuucucuggaugcucucugugaucagcucaacggggcccuccuugcauguaugggcccauagugaagccugcuccugcuuucccuucccuccaacuuccucccucccccuuugcucccuauugucuuuccuccuccuccuccuccuccuccuccuccucucucuccuuuucuuuuugagaccuaauuacaaaugugccccaccccaugguuuuaugugcuguugaggaucaagcucaggaucucugaggauucaagucagggccucaugcacacuagguaagcauucuaccaguugaguuauagcgccaguuuuucaaguugagcuuauuagcaaucaguugguggaggcaagaggagcagaaguucaaugucgugguucaauagcugugguggcgcauaccuuuaaucucugcacuuagcaggaagaggccaucgugagacucugucucaaaaugaaaaauucaaugucauccucagcuguauacuauacaaugaggucuaacgugacacugccuuaaaauauacagauaaauaaaauugaacuuuggugugcccaaaguguguuuaucccccuguccuacagaggcccaggcuguuccacacugucaacuacaggauaucccugggaugagaagaggaaggagcuggagucugaugucuaggaccaccgugccucuucucucuugguuuugguuucauuuguggugggacuuuguggaguggaaggaaaguucuguguguggcuugaugaggugcugguuuaggacaguucagagucuauguggguggguguuucucuugcugcuccaaccuguguggcugugugaacagccuugguuuuggucaccuacaucacugcaggugccaccaaguucagguguuugucuugagucagcaagugugcaaugacaggccaggcuccuuggacacagggcugaaaaggcuccuggauauuagcagcaggguuugggcauaguaaaaauguagauggguggugucggggcugggggcgggguguccaagggucaguacuuuggccuggcacaugauaacguucugaauugccaugggagugggcuaccagaggaacgauuuuuagcagaagggaaaugagcguuuugaaagcccucaagaugaagguuuagugaggucuggcccaaggagaagaacucuugcuuauguugaccugugaggccaguacuggguccuggaauugguuggggcucugccccuggaagaagacucggcccuuuuccaucugugcuuggccccuugccauggccagggggcucaguccuccaugcuuacccuauccccuaucaagugcucaccugacuuccaggcacucgaagcuggcacaguuuaucuaccuagggguagcugcucaccagaaaagcuugcccuucuuuuuggugcucaguuuaucccgcucagauguggauggccuagcauguucucugaaagacugcugcaugcagacagccagcugagugggcagaugggacauuuugcuucugacacuuaaguggcaguauuagcuucuuccaauucgguugcccaggcccaggggccagggguggggaucauaaacaagguaugggugccauuuuagucauuggauaccaugggauggaacuuacugucuuauggcaacuguuccccguggccugcucucagacuauccuugcugaugguuggauguuagaacaagugggucuguucagggucauauccuuaccccaccagaugcccacaaugcccuuuguuaagccaucucuccucucugaccgacuuguacagugaaaaacuuugcugcauggagcuguaacauggagguggccucagauagcaaccccaucccccacccccaccccgauccucuguugggaggucugccauuccucuacacauacacugaggcccuguugcccagagagguauaaucaugugucugagagcgcagaacaaagaaggggcugagugaggguugagcccagccacuuggcuccagaguggccugucagggaaaguaacugcaagaauugacaguagaggcugggaagacucaggaacagcagaggacuaagaugcagcaucaaggguagagagaaugguaugugcaaagcagauacagugggaaacaagguggcucacccagggaagugugaggggacgauggugcaagggcagcagagggggccagaauuucacccuaucuguggguacuucauuaucauggcuggaaccucagguuagugguugaaccccucucagcuucaguguccccacuuucugccuggggagcugcugugaggagugagcuauuuugacaccuagcucuaggcuggccugcacaaaggacccugcgauccuggcgggcuugugguuugcucaugguggccaagagccucuguuuguuguggugacagucaccaccuugggccacaccuggguagccccaggcugccugaccaucugggccaagcccugacauuggcauugaauagugccagcaguggcugguggcucgaggccucucucuggguuguccccaauguggccuugcccauccccucugacaguuggcauagcuguucugguagcucaggucacuccuaacauaggcugguggcccuguuaggguaguuggcugugugcugcccaggcugggacaauaagaagaccucaccaccauauccagcaggcagguaugggcauggccuugacagauggggcaauugaggccuggcaaaaggcagagcuuauaacaucucccaacccacugccagagacacaggagagcagaaaguggaggugauguggguggguagcaguauaagcucucuuagacuggcuugucagggcugggggucaggcugugacucuagauauucuaagcagagcuguguauuuuauuacagaauauuuuauauuuugguuacagagaaccucaugucaggaaugcaaacuagauaucacaggccaaagugcagagaaauagcuugcacgcuaugccauucuggguccaugcagaguuucuguagcugucuaccucuacuccuagcacguguagccagacgugguaccuggcaaagacuuggacccacaggugcaugagacucaggaccugucccuccagcacagggacaaacccccugcucccgaaggggucugcagugagcccagcugccucccucgaucuucuggucaguacuuuugaaagccacucugggcuggcccgaauacacaggccuuacugccuuagucacaccccaagcucuauauugugcguagcuauggcuggaucugccagaaacugguuuagauguggcuucaggagcuagguggccagagugagcugguggcaguuugcaggaugcaguguaagccucugggaagggcaggcacuuggucacugcuuuccugcucugugugauaccgaggagacuugucacaucuaccucucucauccugcuucucucucacauuuucuccccuggugggggucagagccccugcuuccuggagaagccgagacugaaagagucagugccugcugccaguggugggcgcugagccacauggcccuacaaauaggagguggaaguccguucaugccgguugugcaccaggccaugucuucauugccccagugggugucuaugcucugguuugaccagugggcaaacugaggcucugaguguggaaauacagugagcagggauuagaacucagucucaggcacucccccacgaacguugacccucguggaaggacacagugcggcuaggguuauugucauaaagucccacggccacagaguggacggcuuccgcagcagguaucggagaggaggguaggcagcucucauaggccacccaggaaggcucugccugugcuugcuuucaagccucucuuuggcuaagggguggcaucucccauggcuccacuuaucuuccuuuucuguacccguuuccucuauuauaaggauaccagugggguugggagaacacuuaccugggauucuuccccuauaugugcacaugcacaaaugcaaacacacccaccagccuugucacaggauuagggccaacccuaaugauaucauuuugauuuaauuggccacaaaaaaacccuaccauuuuccaaauaaggucacauucuuggguacuggggggucaagacuucaguauauaaguuuugaaagacacagcucagcccaaaacaagagacguaggacacaagcuuuugugugguugggaacacugguacugggcagacgacauuccauuccuggcaguaagaggccuggaaacucaugcauagcugagcauuugagugugugugugugcgcgcgcgcgugcuauaggcacagcugucugaugccucccagcugcagggcagcucccaggaggguggggcuugucucugcuauugugggaggaggacugaaccugcuccccagacugagugggaccaugcucugccuaccccaaagcccugaggcucucuggguacugaucauacugacucucggacguguguguguguguguguguguguguguguguguguguguguguguguguguguaccagagaucugagugaccucugucccuagcuuugcacagcccagggcugaauguugaucagauccccgucuuuucuccacuucaggaaaauccaaaaggaaaaaggacuuacggauauccugcguguccaagccaccuguguccaaccccacgugagucugccuuaaguuucucacuuuguugagacuuggagaggccucuuaguggaggccagggguaugaguaagaagcaggaauacgggggucagaggugggugagagagcauucucuucucaucccgcccuggguggcuccagagggucucaggagcauuggcuguuugucccaugccuucccaguccuugucuuggggucucugucagggcugcaccguuacacuuuaccuuguggaugccuaacagucacuggacugaggugacuguaagcugcccccauggccaguguguuucacccucaccccccuauagcuccuucucucagagaagcuuguggaucugcuuucuccacagacccccccggaaccuggacucccggaccuucaucacuaucggagacagaguaggugguaacuagacacugagaggccuccauagggccacugagagguagcuggagcugggccucagggaggagcuuaccguagcuuaucaugcugguggcuguggcccugggcuaucugcccuuagaccuccucucuggaagaaguacauuccaccugccuuauagggaggggugugaggagcgcagagcugccacacugccuaccucagagugugggcuaugaaucccacaugaaaucuguaccaccuggaagcaccaugugggacauguagacuccugggcuccccagaccccaggucagacccuagacuccauacuguccauaccccugagugccuuggaaggccaccuacuauugagaagccugauuuggggauguguaccaggcagaguaggccgagagccucuucuuggaagauccucccuccccaagccuuugucacugccugguguucuguuaguccaguuguguaaucccaugucucucacucaggggagggaacucccacaaagggucaguagaugauugacuaauagcucccuuugcugagauguguguggaagacgucucccauagucuccgaguuuuugguuuugcacccauuuuauagagaucagcgguagggucagauuggcucaguucuuuccacugggucacaaagcguauaguacauggcguauaguagcugcgagcucaaaucugacaagcuggcccucugcuuuucucugggugagggacaagagccaguuuccagcuuggugccuaccaaucaccucucccuuugccucuuaagaacuucgaaguggaggcugaugacuuggugaccaucucagagcugggucguggagccuauggggugguagagaaagugcggcaugcucagagugguaccaucauggcugucaagguaagcagggcuucacccuaccuggaguagcacuggaggaggcacuggcugagcuucagagugacugucuacuuguggcucugucccucacugucaucaccagcguugaggcagaacuucucagacaagucagggccauggauuccccaagguuccuggcccucauggacuggguuaggggaacagccuaauccguggcccugacauguggcucuccuauagcgcauccgggccacagugaacacacaggagcagaaacgucugcuuauggaccuagacaucaacaugcgcacggucgacugcuucuacacugucaccuucuauggugcccucuucagagagguaggcucugucucugcccaccucuugccaaucacgacugccauuucaguccuauuguguggaguucccgggaccuuuggguauaggggaguuauacucaagguauagggagcacccuucaccugaugcagcuuggcugggcucuucuugagaggcaggcuuuccuguuccugacccgcucugccucagguucccugucugaagauuaaacaggugucugagcaguucucuucagguugugcucaggggccuggagcuccggggcagcugagauuucuguuuguggucguuugcuuucuguuagccccguaguggccauucagggcaagcccccaggggagaagcacugugaaggggugaggaucugggcuagagucuagguguauguuaggguagaggaauggaggguaaagcagggugcagggucuaggagcaagagcacagagcugccguuggaagcauauaguacgcaccagagucaggauggaacugggacuucccaugaugaccugccaucuuggaguucuugagugguccgugauguuucucugcccuggcuuuccuuugggucccucucaagucccagugguggcucagaccccacuuuaugcaucucaugugguggacugagcaacuuguguaagugucagccagcucaucccaaggcuaugcggguuugcuggggagaagaaaggucauuuuccagugaagaaauucgguucuugucccuuuauguccugacuuaaaagucucaggacacacuagguucccgauugcuugggaacacuguuauacuagggcacagagcggggagacuagggcgggggagcaugaacugcauggugaggugccagagaggccgaucugaaaggcagacggcgauggcgaggggugagaaguguggugagaagggucaucgugucccuucccagguggaggcuggaccuggugcucacagcgaggcuguuaagaugaaggcuggagaagccugggagucuguagacugcccagggcugggcagcacugggggaccagcuaagcacuggauguucucacagggggauguauggaucugcauggagcucauggacacuucccuggauaaguucuaccggaaggugcuggagaagaacaugaaaauuccggaagacauccugggggagaucgcugugucugugaguggccucgcucuacccagcaugcacaggaccugcuguguggcugaauuuuggcagaguagcuguccccucuaagacucaguacuucugaagccugagagcaguaccuugcugaagaggccccagggauggggcucuucagacuggacugcucccugcuuccaaggucgugagugcggcucucacguucccacccacuuugaagaaagugccgugugucccacugccuuguacucagaugccgccugacagcuauuggagguccaggcugcuuuggggagauguuugcuuucugagccugcuguuucuagaggagggcagcaacucugguuugaguauugaaacagggcgggcagucguaucaaggaugcccuuuaauccuauuugcaucuggaagcguuuaaaccacccugugccucaggcucuuuuuuuuuuuuuuuuuuuuuuuuuuuugucuaaucucuuagagguggcucaugggggagugagagaaacuugggggccugguaggucuugguaaaagcccuuaggaggcacugcuugggauuuguggagcaggaggaaggcaggaagcugacauguuuguccuaggacagccaggaugagggacagauuuggggcguaggcaggagcugggguguguuuagaggagaugggguucuacugcuguguuaugauuucuguuaccuggaauaauagcagcccugccucuccugccccauucagaucgugcgggcccuggagcaccugcauagcaagcugucugugauccacagaggucaguguccuccaucagccacagaggcucagggaggggcagacugugauauaccugcuggggaauaggccgcuuucugcauuugugccuuuggcucugccugcugcacucugaauaggaggaacuaaguggaucccagcuuuuucugagcuccauggcccgcuucucucucucucucucucucuucauaaagauguauuuauuuauuauauguaagugcaucagaucucauuauggaugguugugagccaccaugugguugcuggaacuugaacucaggaccuucugaagagcagucagugcuuuaaccacugagccaucucuccagccccauggcccgcuucucauucauauuuacauuuccugugccguggagcaccuagguuguggcaugucacacuaggacucugauacaagcccccuuaccccacacaugacuauccuggacucuucugggauuccuuugcccccauggccacuagucugggcuucccccuccaggguuauacuuaauuaaguaucagccucccauuaacuugguugcacuguaccuagaaaacgaaggaggcuaaguggacuucgaugaccagcacccaucccauucuguccacgggucaucauuguugacucuuuggcauggaaccuucccgucuuuucuggggcaucuuugucuuuuucacauccauguggcccuuugcuuggaggcuccugccuccugugagacagggauggguggggcuccucauuugcaugcacagacccauccgcauaccuucacuccaccucauuguucacccacuaccuucugcuugcuggauuuguguccauagcaggugacgugcuuagguagccucaagguagagucuccagagcucagauguuucucuuugguugggauaggcugaaguucauuuugauuugucauccagccgagcgauggggccuggugcugcagaucucacugccgcuguuuccuuggcuaauccuuggggcauuggguagcaugcugcuggcccacagggcacuggagaagguagcaucccauuuggcauggacugagaaaggucugcucuucuuguagaugugaagccauccaauguccucaucaacaaggaagggcaugugaagaugugcgacuuuggcaucaguggcuaccugguggacucuguggcaaagacaauggaugcuggcugcaagccuuacauggccgugagucagggcauccccgcaagguggagaccaggacaagauuuugccucugugcagugggcuggcuauuuccagccguaccuccagucuuagagacccugccaccauuuaccuauacuccaugaucccuguuuggaugaacuuguguucucuguuguuaggaacauggggauccuuaagacugguggccuggggggaaggcagggguuggcucucgcucuugcuggccuauaucaugcaggcaggagaaccuaaugguauucuguuuugguguagaagagaaaaggucuaauugagggagccuuguuggguguucaagccuucuggucuuucuugcagccugagaggaucaacccugaacugaaucagaagggcuacaaugucaagucugaugucuggagccucggcaucaccaugguacgucuggggcugggcucagcacuugcuggccuguugggauggaugucugucuguauagggucuguggguuccaucaaacauuucuauaugaguacaaggauaucugggaguuguaggacccuuuccugaccaucaugauuguucucuguauccugugauuucagccuuuucucuagagccacugguguagaucaggaaaucccaggcaaugcuaagcuuaguuguugccgugcaaguaaaucaagaaggcaaacucuuagcugggcaugauggcaccuuccugugauaugauuccuaugguagcauccuuuuuaaaugguuauccucagcuucauaauaaauuagaggguagcuuggccuucaugagaccuugucucaauauccuucccaacacucaaaaacaaaacaaaaaaaaccaaaacagugccuggucccccccuaaauaggaaccuauugcuguagguuccuuuuguguuucucuagguucaguagcaugaggcuguagauccuggcuuguggaggcugaaaggacccuugguuuggagggaggagcagggcccagaccauuaggauugaguuggaucagacaaagcuaaguccagguguggggauggacuuuuuugccuucuagaacugccuggccgagagcuccgaugcaccuauuaaugugauaaaacaauaaccaaugaccaaaagggacuuggggaggaaaggguuuauuuuggcuuacagcuuuccaguugcaccccuuuacuaaggggaauccgggcaagaacugaagcagaagccacgaggagugcuacuuccuggcuugcucagccugcuuuguuacauuacccaagaucaccagcccaaagguuggguugagugucuauggugagcugggguauccuacaucaauugagagaaugcacaggcuugcccacaggccagucuguggggggggggggggaacgacacacgggacacaccuguuuucaguugaggcucccuuuucccaaaugacuuuagcuuguguagcguugacacaaaacuagccagcaaaauguuacagucaaguuaaacucuuugaagauggggacacuucuguacugaacacaugugagaaaaugauauagcaagaauagucuaucuuccguugcaaagauauuuaacagaaagggacauucugaccgucaggagucacaguuaccaagauaugcuguccacuuucuucguuccuccugccuaaauguuuugagacuguccaaguucccaugauugaucucaugacuauuggggaagacauuuuguuauuuuuaaagaggcuuuaucuugaaggcaggguuuuacaguaggguuuucaggccccaggaacaggagcaaggcuuggacugucuucuaggaccucuuccuccagguucaccacuuauguuuauccuuggcccaacauuuccacuuaaaaugcugcaacgguacgguucagugcaucccucuugcccugggagcucugggcacacaaauuuccugugucucagaauacaagggaguuaccuugcacagacacaggucacacucugaaccaagaaggcccugaguggugucaccaucuccacugcugucucugacgcucagucauuauagggggcuggcucccgggggguccugugauagguaaacugucuuauaugucuuuguguugaguuaguuuuuauuuaucuuuuucuaaacucuuuaaaaaaaaucaucaggcugagcaggguaauguauaccuuuaauaccaagaggcagagacagaggcagguagaucucugaguucaaggccagccuggucuacagagucaguuccaggacagccagagcuacacagagaaacccugucuggaaaagccaaaaacagacaagauguuugagguccauacucuggugcuuuuugguuagguauaugggugcuacugagcuuucucuugcagucugcagaaagguccugcaguagauucuggaaaugcugcaugcaguucuguccugugggcgggcacacaugugacacacacugucuucccauucaugcuguucccacguugguuggaaaggcauggaaccugacaggaaagucccucaucagaauaguuucuagugcucuauguagggccaguugcaguugcuauagaggucuccuccauuccuuaugguggucacagccugucacugaggccuuccacugcacccgucaggagguauccaugcaggaguccgccacucccuguuggccuaacuaguaaaaacaacagcuggauagguggcccuggauauugaagucuguguuggggagguacugaagaggaaguagcugggccaacaggggcuuaggacuggacccagugagguacuuugauuacugccaccuuaugggaaagguguauguggcugccacuccucauguuugacacgcugucuggaacccaaguuguuaaauacaaaucauccaauuuuagaguguuugaaaaaaaaauuuaaaaaaccaguaaggguuaaacccagcccagggugagccuuagucugagcuaggucugccaguccagucagaggagcuucaguaguuaguuggccugcugcuugguaugagggcagucagugucagcccucauaccaaggccuggccuggggugcuggggaauuauggguaaaaucccuuccucaucaugcuucuggguaccaaaugaaccugcugacugcugucccuacuucagaucgagauggccauucugcgauucccuuaugagucuuggggcacaccguuccagcagcugaagcaggugguggaggagccauccccacagcucccagcggaccaguucuccccugaguuuguggacuucacuagccaguggugaguaucugggcuguguccccuccuucugcagcaagauaacccuugagccaccugguaucagaaggcaggagguaaagcuaguuccagcacgaguaaaagguuuuagucccagugguagcuuuuaguucuagucuuugcagaaaaggaugaaucagguagccccaaagaguagagggauuuuguguguguauguguguguguguguguguguguguguguguguguguguguguuuguguguaguaacauauauuauggaacauuaaaaugcauaaugaaguugcuuuuuuguuguuuagaaguuuuuacugaauuacagaaaguucauagagguuuuagaaaagucauguuuuugauccaggcagugguggugcacaucuuuaaucccagcgcuugagaggcagagaaaggaucucuguaaguuagaggacagccagggcuauacagagaaacccugucucaaaaaaaaaaaaaaaaaaaaaaagauguuugaaguuacaaaagaguaagaaaagcaguuauacagacgagcucucuaaccauaauuaaauaacugcauggaaaguaaaaguauucuuauaacucuuggguuauaagagagauuuagaaaauacauuuuuaagaggaaacuagugagagcaaaccaauguuuugcauguuuggcccagagaugcucagaggacaagucaaagccucucagcagaaaacaagaaaagcugcaggcccaggagaccaguaacaaagucauugauuaguuugccucuuguugguuggacuuuauguuccggaaccaaugacuggaguccucccuucugauaaaggauaaucuagucugugguuuuggcagagcauguugggguuggugccacagaccuagccugggucacuauagagaccacuggucuccaagaggcagggaaaguugcugcaagacuauagaguuaguacccacggaccccaagccacuuggcgagacucccagacaguuugcuccaucucugagccccaggagugugcugcucaaugggggcaagcccagccugucuggauucgcuuccuccgugugagccugucuucacugcccucuuuccuagccuaaggaagaacccugcagagcgcaugagcuaccuggagcugauggugagugugcacgagaaguaccugcccuguccccugugcuguguaguggcuggguggggcugggugggacugucuggaagaggguugcacuccaggguagagagguagcucuucugccuggcccuugcaugugcuuguguaguuucaccuucacccaugccuguaccccaggccuuguggaaaggugcacggggcugugacaguggggcacaggagucacuguggcaucagggaaggcuuccuagaggagaugccauuugagcugagccuggaaggauggguaugggcucuuugcuaaugaaggaaggguagagggucugguagggcagaggucugguacccuugaggaaagagauguuuguguggcaggagggacucuuguaggagggugaggcagagucacaagcuuugaugguuuuggagggcuucgaggggcagcgguccuggauggaccagcaggaguuggccagguaggaggggcaugaaaagagggaaccucuccuuuauacuuucuccugugccccuucaccccuagaaauuguaccucucuuuccuaccaggaacacccauucuucaccuugcacaaaacuaagaagacagacauugcugccuuugugaaggagauccugggagaggauucauagggacuggcccaggaccccacuggucugccagcauccauacauccgugcuggggcagcacuuaccuacagccauaagcuacugccauucuguuccugggcauuugagaaauuaagggguuguuccugucggucucugcaacuagcugucccaagugccaaagaaccagaccucaggggcucccagccaggccauaugugccccacagugccucugcuguugcugcucccagggucucaggccucuacccaagggaugaaucugacagggccuguguaccccggcaaacgcugucgcuucugaagagcaggcagcuggugucucucuggacaggccauagccuugguacuguccuggaugccaugcagguuguauauauauuuuaaaucacaacugaaugaauggacuucguacacuguggccuggaucagggacaucucuauccugucucaggugcugaggacacacuauggggaugaaucuccuaagacuuuccugagagacguacugagcuucccaaggccuuccccccagcacuggccaauggucucugagggacacacuguccucagacagccucugguuaccaccuuuagugguaucugccuuucccuuugaacuauuauuccuguugccuuuugcuuuguggguauugcuggguuuucuugcaugguuuggagcugaccacuuaacccugggugccagcaggcucacagccgcccagugcucggacuggagucugcaaggauggcucaagcucuuggcucaaagccacgagggagcuguaacaacucuccaggugugaccagcucuuggaagcuaauagguuuacuuuggugguguuuuuaaaaaaaaagaagaaaaucuauuuuugugaagaaaggccugccucuuccagccuuuuccugggcaggaaccuauugcuguuuuaauuaaaaaaaaaaaaaaaaaucgugugagacugacu

SEQ ID NO: 6052 - RNA, 23281 nt, Mus musculus
ucagguuucagaauaaaaugcagcuuuauuaugauauaggaaagacuaaaagccauuagggaggagucaaauagccccucaaaaugacaagggaaagaaaagugacauaaaugucuugguaauaaaacuccuaaccacaguacaaucauuggauuuuuuuucccucacgauuuuuuauuucaaagcuauaauaaaugaaacaaaccacuugucaaaaagaacaaugauuuuacacaaggaaaagcauacacacugagccgaauacaacagcacucagguucacaugguguaggacacucagguagugcccagcuugaggggacuucugggguaaagagaggaacugcagaauccaucccaaugcccuacucucucacugaggccauuugaagaggacuuuagucuccugucaagcuggcgccagcaguguauggaagagagggguaggcaaugcagcccuguggugagaugcacuucugugaccaucugagcacauauacuaggugguucuaggaugaggaacccuuuuccugccuugcuauccagaggggcaacugaaagaaccaagcccauugcucaaauaaacuguuccuuagccauccacacaugccuguccaguggagacagcacgcugaggaccccaggacagagagggagggccagaugcaugugcggcagccauagaguuggcagaccuugcuacagguacagagugaaguguuuagaauguuaaaaccauggugaaggagaaugcuuucggauauaaaagguuaaagucacauugacagaaaacagcugcuguccuccuuagugccccaaauauaggaagaaaugggucguguucuguggggacagaggaggcaggccuggccagcacaccugcucaucuccccuguucuggaugccccauucacuggagugucaaggaggcagaccuucaggaagcuuggagcucugguucccguggcaacugcagugaaguuuuucauguggacuuguucacaaauacaacaugcugacccuggggcaucuccacaguagagucccacaaacaugguccaugucugagaaucuaggcucagcuguacucaaaagaggauuuuucuaaaacaugcuucaagucuguucuuuacuuaaaugcagaaauagaaacacacuagagaagaacagggcaacuguuaccacgugacaaaguuucugcugccccugaccucgagugauuuucacaccgauugagcagcggccgcuuaguuuugccacagcuaugucauuccaucgcaauucgcuagcuaaggagcugggcugggcccuguacugcucuuuuauagccuguaagugaaaaaacaaaaucuuauuuucaaauaguaaaaaaaaaaaaaaaaaaaguaucuguacacauaauuauauguaauuuaaaucacagccguacuuguuaugcaaacacgaugcacguguuaccugcuaugggucuacggcucagagccuggcucuuaggaaauaguugccuguucugaugggcaacuccugggugggugccaacaggcuccuggguaagcaccacuggaaaggcagugguaugaggagaaacaccaagacccuagauuccaguugcucagaaguggacagccuaggcuuguccagagauacaugcaaaauaucuuacaauaaacuucaugaaugacccugccaggagaacugguaauggagccuuccuauucuggcuguaacugaaacuauagugaacacagaauggaggcaagcgggugacacuaugcaaugcagucuccaacuggaccucagcuucaaaucucacacagucacuaaaccucccugggcaggcaaaaagaccaagaagaaacaugggaggauugggucaauggagccaccaaggaaucuacugcaaagaucaagauaccagggacucugauaucugccuggccaccagccguuugagaaggaaggcagggcacagggcaaggaaacaacacugaucaaaagagcaagacacgcucucagaggggagagaaucaucuagaauuccguauaacuugauaaucauucacuucacuacuaucacguuuaggaaacucaccaccguggaaaaagagcaaaugggguagagguaagacgacaccuauuucuagaaaacaaagggaacgucugagccgauguuuccacaugcaguugaugcuaaguuaucuguaggacagauguauuuguagccuguggguggccucaaccugggccuggggcuaucuuacaauuuuagaaagaagagacauacccucugcccuucaugccagagggcugcugcugcaagcacucugcccucuggcaucaucucugcccacucuacagcuuugacgggcucauuuucaaggaggcaggugggauggcagggugaagcagcaggcagagugguuggucugcucugaagacauccauccccugccuacaaggcucaaaggacaggugcuggggaggcagcuccuuuccaccaagggcgcacuccacucugcucaucccaccugacacaucuccuagugcaggccaugagggaggcuugccugcauaggaggaaugccaugguguucugauuuggggggagcagggaucaugucgggaaguuugccaacuugcucucucucucuuucucucucucucucuuucucuggccagcaaggcaggaggcuacucguauuccaggaacuguuugugauagaagaguagguaccuguggaagcaaagggaaaguggguuucguuaagaauggcucacauucugaaauacuguaguaccucaagaaagauacuacgugacucccaucacccaaccugaccaccaugcuuacuagggagugacugacuguggcccuggugacuuccuauagucauuaucacuacuguucacaguggcacuacccucauguaggguccacgucuccucaaccccaaccccugcccaguaguguacucuucucucugacuccucuccuggguaccccagagccucgcgugcaccguccacaucuguggcagguggucuacauggucccuggggcugggaauccuaaggaagccccgggcaaaaaauggagcacaaguaacaaaagcagcagaggcgcugauccagaagcacugcacagcaagcucaggacaaaugcugaccacggcagccucugauuuagaggcguaacuguucagcaacacucccacccuguaaucaugaccuacaggcaacuucugacccaaagaaccaccgucccuucagcaacaaaucaaacuacacgaaggugaauaugcacacuauggcagaugcagccaagccacuggcuuuggucagacaggagggacagacaaacuccagcacggggcuccuccagcccugcccccagacguacccuucacuguccaguacaucuuugaugcuggccuuggugauaauggcgucaucacacuugaaccacuggucuuugugcugccggaugaagcugguguaguggccacucuccaaggucccuugaugguuaacgacagcaaacagggaguaucugguaugcaaggagaggacagcugaauuauggucuguugaacuggcagaacaccuccaaauuaaagcagaauacguaggcugcagagcugggagagccaagucugcacuauucagcucugggccaguaaagacaucuccuagaaccacaccaagugcaaaugguggcagcaguggcaaccaccguggaaguaacuacuuuagucagugccaucugccuguucuaccaacagcaagaggaacggggccagaaggagcagguuuguuaggcuaagcuccuauguagacccucaucaggccucuacagugggguugccaccaggagggagacuauucagagcggaaggacugagugugccuuucccuacaagcuaugggcagagaccugcaugaccacaaugccagcucacccugccccaggcccugcaaccccacguacuuguugucauuguugagacuguccaggggcugcugguauugcccauucauccugcucucuuugcugcaagaacagaaacaaacuguaauuaccaccuccccacagacacaggcucugaugacagcauuaacugauaugaaccaguuuccuuuggcagacugcccccauguggugaugagauucuagcuugggcuggagcuuccuggccuccuaguguuggugcugguacaccuccccacacccccauccccauggaccccgaagucacuggcuugugaagaguuuugcuuguaacacaccaaaugcaaggcaguguaggguuagccccacacuauacccuuaaaagagcauaagggacaucaugaaguaacucacgagcaguacuuacuaacagaacuuacuagcaguagguuggguggaaugggaggagggacugaacaggaaauaccaaguuuuaaacuaguuugguguguuuaccuacagccaaaauaagcagaagacaacaagucccaugagaccuugcuaucagcaacaaugucacuccaucucuagauaugugacuaccccaucuuucaaagagauuaacucugaugaucuauaugauauauuucagccagugaccuaugaacccaguaccacagcuacaaggaagggcaucaauggcuaauaauaugaagccugcucaggucaguauggugggcugagguguggcuucugaaguggacugccugcaucuugacccccaaaacagcaaaugugacccauuuagaaaaucugugcagacaggauagaggggguugguugacacgaggccgucuagacggcccuauccuuaaccacuaauaccuaggaaacagaucaaugacugagacacagaugcaggaagggucuuggcccagagccucaaggagcuagaugagucucagagggagcccugucaggauccuucucaccaaguuccuuauuucuggcuucuauuauugugagaaaauaaauuucuauuguuuuaagccacuacacuucuagcugccagccacagacagcaaaccaaagacauuagcaagcacuguaguuuuuagaggguuaaauuugauguagucuaugagauauaggauuugaucucaaggaagauaaucaacccuguuuaucuguauuucaaaaucggucaccaucaaccaaaaaugucacaugugguaugccuugaguggccaagucugaaaguugauaaaugaugagggauguuaagaguacaaauggguagcccacaguaagcuuagguaaguucugggguggcggugaggccuggauagcugucauuaccaugucuaaaggcuggcacuggguaagcacccacuagacaacuugccuucccacucagacacaggagcaccaacccuuucuaccuggaggccaugaagggcgucauguccaguuccaggggaaaagacacauauguggugaucuuccgccgaaguuuggcugaguguucaaaucgcugcagagauaagggagugggggacagugagcagacugagcaauagccaggcgaccaagccuggaggcccagcaaacagcuucuacuuuccugacugguuuuccugacucacaagccuacucaggcuggcgcacacugcaggacccuccugggccccccaaugcugugauuacagcuacauaccacccagcagaaacuaaucuuucacaguuuuaaagaacaggaaacagaccauauguaccuuuaaagacucaaacacuagcccuggcuacucuaccagaggaccuugcuuugauucccagcacacauccugguucaugauaugccaguccucaaggaucugacacccucuuuuggcuucugugggccccagguacacauauggugcacagacacacaugcaggcaaagcuacaugcaacacuaccagacccaaauuccuacugccuacuaucuagccuuucccacaaaggacccccugacucuagacuagacucagucuagaguuuguuuucuggaucuuuguuucugcaguucugggguggaacucagagccuugugcauguuaggcaagagcucuaccacugacucacaccuccuagccugggcccagguauguuuuuaagugaaauggaaaguuaaagaggaguuggaaagacggcuuagcaguuacgagugcuggcugcgcaggcuugacugagcaccuuaguucaccuaagagcaccucccuaacaaccacauaaaaugccagagguggaccuggaacccugcaccgugggaggcacagacaggaggaucacugggcuugccaacucaauuccaaguucagugggaaaccaucuccaugcagcagggugucguaucacagugcaggacaucagauguccccucuggccuaugcuggcagggauggaaagugcaggaggcagcccuccuuccugcuuccugggacuggugcacuggugaguuugaggcugugcugcaggcuaauacaaggcugcccccguggcugguuuucugggaaacucacuuugagauggaaacaggccacaaugggcagcuucuucauggugagcugcuuuguggacucuugguagcuauggcaaccgcuacacuugaucuuggcacugcuuccuaagugcucuggucugguaaaucuacaaggcauuuaaaaaacguguuuuuauuaaaaaaauaaacauggaaaggggaaaaguaaaagacaugaggacauggaagaaaggggaacagauuauuuuaucacucaaaguucaccaguaguuaaaggugucaucuuuucaugauucucuuaaacuugucuuagugucuguguguauacacauauguaauaguacuaaugaaagaucuggggaaauggugauuuucuuuaacuuccagcaacacaaccugacucagaacggagcacauagccacacaaagcuacacacaaauggcucaauaaacaaaugguucaucaccuacaggccacccauaagcaauggaaugguaugaucuauguccauacacaauucucugggcugccagagauuaagagguggaaagagacuagcccacagugagacgccgugagguacacucacaaaccucccugaggaccuaaaggaagcuagacuuggacugcuuggguaaggagcacacagggguuguggaugcagaugaaggcauggcugggaaggauugcgaagccucugcaagugcugugacauauacaccuguccauucucugugcugugggugucaugguggaggacugggugaaggcaccagaaucgcuaugucaccuuauaacugcaggaaacucacaaugaccugcuaccuuugucauuuuuuucuucuuguuuuccgaucauuuuaaagaucaaaucauguaguaaauggaagggagaggugguauucuacuaacccugcagggugugucucaccuucgcaggcagucugugagagugguggucccggaugcauggcucuccccauuaaccacacugcccucgcucccugggcucaagggccagaaugggguagaagaaccgggaaggucuaaacugaugucccagaaggggucuauggugguggagaccccgcugcaaggagagaggaaaacacaugagaacauuugagaaccgaagccuauugugaucucugaggcagcccaucuguccacaagguaccucaggauaaaauaggcccacagucaugacuuuguuugaggagacacacaaaguauaaaguccugagcuacaaccagaacucuguucugggauccacuucacaacaggaacugcagaaacacugcccagaaacuaggugcccugaaugagcaaggacagagagcuccaugcacagaacauacaggccaaacauggcagccccacaaacaagucugcugcauuuaacaaagcugacuucugccaggaggugcaaguuacaauacuuaaaagaggaaauucagaguaagaaauugacuaaauaaggacgggaacugaagaccaccuguugcuaacauacaaggccagagacugaggaaagacaaagccucaaaggggcccugcuccuggaaagccacaggagcacccugagauuccugugcccugguccugaacccuguucagacagcagguggguauugagggacugcagccaguuuuaaagccaggaguggauaaaaacacuagagugcagaggugagccagaggagcaaggauaaggcacgggguggggaggcugcucuagccacugccaaaggauccuuucuguucugaagaugaacgcacuaaggaaugggcacgccugcccauuguuacugucacuguaugucagcaaauggaaaaggagccaagucacgcuuuggaccacaggggccagugaccugccaccugcaggugcaaucugccuugggucuuggccuugacuauaaggaaagcagagaaauguauaugaagcugccaaggacauccugcugagugccacaggaaauccggcaggccuccaaggggaagaggaaccgucagacucaggcaaucucucucucuccauuucuugucuuuucuacuagagguauuuuaucucaaaugaccagagcacagcuguuuaaauaaaacugucccucaccugaaacuaguguaggugcuccaccaugagcaccacaggacccaggagccuuccuuaagguggugcugagcuuuaggcucgaagcccacacagcagucaaccuugcugacuaggaagugggacaggaagugcccuggcaaacugacgcucacagugacuggcuggcugguggagcacuuacuggcagacuuggcauguaacaucagacuggagcccacccguaaagaucuggucaaugaugcaauugcagugguuaggauuguuggcuuucuucccauugucaucaccugaggaacgagauguguaguuaccauuagugaugucacuaagacgguacaaaauagccagcaaguccccacccacccagcagaggugggaggacagcaggaggacuaacacucuaugaagagugaaggcauucauuucaggagagaucuccugguggugagggugugaggaggugguaaugccauucuuccuugucuuuuuuuccugacagguuaagguauuuuucuggcuggucuugaacuggcagaagaucugccugcuucugccucuugggugcugggauuauagguguguaugccagcacacugacucugggaucucuacucuuguacagagauucccaccugaaaucccagcacucaggaggcugagacaggaggaccacugcuuuaggccagucugagccacacagugagaccuugcuucccaaaauaccccaaaccaaucaacacaaacaaacaaacaaacuacggaggacuccuuggaagcaaccaugcgguuuuccuuccuggacacagaaccugacuauacggacuaugcaagacagucugggugcacagcagccuugcucuacuccauuuuuaaggaaacuugccgccugccccagccuagcagggagaugguggcaggcccaccuuugcagugccgguggaggacguccagggcugcaaugaggaacucaugugcguccugcugcucauaacccgccaggugccgggcgugcguccacaccaggugcagcagcuuguauggaauguguggggagcggugcccugaguaaaacuguucagagagaaggaaagggacaauaggacacccgccagucuucaucacacaaaacaucacagccgcacugacuuguugcaguggacuguuuaauacugcauauugaaaaccaaggacagcaacuuaaccaaguuaacuuaaaaacuggaaaucaccccacagugucugacccaggcccucacuaacugcacuaugaccacuacacagguucuuuggcaagagagagagcccacauggacccucauguaccacaacgaggagacacaaacaaaccuagcaaggaugguggaauguugcacauacacaacacuugggaaacgugcuacacaaccauccauaucacaugcaugggaaugggaauucuggggacaaaaaccugugucacacauuugucaacucacagaacuauauacuaggaucuuuuacuggaugcaaauuauacuucacuaagccugaguuuaaaaaaaauaaucugagagagaugcauuagucacaugguaacuagcugcuugccccggugaagcccgggacucauuucccagcauaccuucucuuacccuguagccucugacaguuuuaccugucugcucacuaccacggcuccagucaccagcaaugcaggggucaggaauagccuggacuagggcaaacauuggcaacuuacagcuaagucaucucaguugcaaagccacuguguaacucuguccacugcucaacccugggcuguggcaugaagcagcccagacaacacuugaucaaugaugccuggaugcagagucaguaaaagaccacugaaagaaaugaggccuggcugcugguuucugugcagggcaggggccaugcuauuucugggaugggaaaagaacuuauuucaguucuaauaccuggccugagucuggagaucaagccugaacaggucccaccccugagcaaggggacaggcaucgacaggcacaacacgaguguagcuaugauuagaucaaggacacagccucagcacugucucugugcuucuggucugcagggcagaagccuuugacaaacacacuugggaagguacucauccgcagauuuccugaaugcacauggcagacagcaggacucuugagacaaacgccauccacaaguugacucugccacaccugccacuucgagggcuccucuccuaggugaacagugugccuccaaacaccaaacuaacaacccaucucuaacaaucccuuuguaaaagcuugucuuccacaggauagucacggaguggaagauaauuaggcaagguuuucaucaauuccauuuccucucuuuuuaaagaggggagaggcagcuguguagccaucucaccccagcagccgcugcacucaccuccuggaagagagaggacaucucacagaccaagcaggagcuggggcucugcaucucacagcggugccuauccgacagaaagaagucucucaggagcggagugugggucagcgccugcacgaugcaguucaugaaacacguguuccccagguugaucaguccacgcagaccuggauggaaagucaagagcagggucaccugugcacugagcucagaccacgccacaaccagucagucaagcagccugagaagaggaggaaggugccgugcucgcucaucuccaacggacugcagaacgcucacccacugccccaccacuugguccucaugcuuucacaaaugcguuugcuaugaaaacaggcaggucuaacaaagcauaguguuuuccaaacaagcccuaaaauauacuaauauauuuccuucuuuuuagaagacauggucagcaugagggaugaguuagguagggugugugugugcgcgcgcgugcgcguguuguacacacacaacucuuaauccuaauccuaacacuuaggaggcagagacagguggaucucaggguucaaguccauccuggccuacagaguucguggagguggagguggagguggagguggagguggagguggggagagaggugaugcccucacucacuggcaggucaccucuucaugauggacagcuuugacuugauacacuugagucccuucaaauaggcaggcgccaguugcuggaaggggccaucuccacucaccccucugcauccacaucuacagcagccccugaagaccgagugcuuaagaguuggaugcuuaacaaauccaggagggccuccaugaggcaagaccuacugccacucugggaaagaagucuaagcaggagucugcacaccccucaccuaccuaugguacaauuggaggugaucuuccgccucuuuggguuaugcuucagcaguuccagcucccguuuaguugguucccaaguugaaaacuucucuccaacaccuaaggagaugaagaacagucucagcaaucauuagcuaagaucucuuauaaauaaaagcuucgaugacuugacacacaucuggagaccucaacugaaaaacugcuuccaucaaauuggccugggaaggugguccugguguguauaagaaagauaguggaguaagccgugagcuuuccuccauggcuucaguuccuguccugacuucccuacgugauggacugugaccuggaaguguaagauguguuugucaguguuuucauucccagcaauggaaggcaaacuuaaggggguuuccaauaaagagcagccaagcauggugguggucugcucucccugcacacugacacaggcucacugaucaagggggacacaccagacccagcauuguuaaugcggacaacugugaaccucucuggaaacugaaaggggaaaacccagggaaacccagaagaaagaaagaauaaagcuucauaacacuucuguaccugugacuaaauaugugacagaaagcacacauaaggacagagacagaaacacaaaccuauggugccaccagagccaccaagcaccugccaggagugcaggagucuaagccaccagggaagcuuagcugcuccauucuccaccuacuaucaggacaacagugccucuccuacaggaacugauaugcuguuuccgguacuguuuuccagaacacuguggagcugaggguaaaccccugaucagggauucucgcagucagucuggaugaggugggcagagacacugauguggaagcgcugcacuaagcccgguucuccaacgugcccucaaagugagcugugcuucccuccugacccuggcagagccccaacagaacccacagccacaggggcauugccuggccaggcuggcgcccugggaaugaaggaaugagcugauagagggggcucauugaguauaucagaugcuugucugcacaaacgcaguacuggcggcuuucccucgcuccucguaucucuaucucacuaccucaucaaguucuaccacaccugauggaaugcaggcucucugugacagaccuauaaugucuauaacguccguguuaaggacauuauagagauucauauguacuaaaaguuguuccacugggaagacggcuuauuggcuaaugugucugcuauguaagcaugacaacccaaauaaggaucccggcaccagguagaagccacgcacaauaguaugugcucacgaucccaaaaccagggccagagucagcccaauccucagggcucacugauaaggcagucuuguugaaaugguguguucaguaagagguuuugacuauacagucaaacuaugcaagguggggagugacagaacgucggauguugacgggagggugugcacacugacaaccccaaaauauucaaaacuccguucauaugauuccuucaccaugggcuuauacaguuguuaaauaugagauuuuauuaacgaaggcuacacugcauauaaagucauaaagguauuucuuaaagaccuuuguguaacauugauuaugaugugagcuuucuuuuuaugauggauucacagaagaccaccaccucugcaaacaaacacucaaugaacuggguggcucccacauacguagggaacugaaggauuauuuuacgauucuaaucuucaccaaggagagauacaguaguuuguacuuaaggaguaauuaaauugcuaccauaugcuuuuaucuagcauucaguguuuuuaagugggcuuuuuacuauauaaaauguaaauuuaggaaacagaaauuguaagacuuuguagugggaaacuguuaauccccucugagcacacacuucuaguacacacuccccucagguauuucucagucuguauuuuauccuugcugcccugcuuccuucugggcagcccucccauggggccacuaucccuuuguacccacauuucagccaucucgccuccucuccuuuacagcgugaucaguccuaugccccucucauggccaaauuccuuguuccucaccccugcggguuguccccccaggaauccuaaaaauccugccucuuucacccuguccagccauuggccgauggcaacuuuauuucccaaucagagccaacugggugcaggcuuccuuuagccuaagaaguuuuguggguaacacaauuagcaugagaacacaagccccuaagacugacaccgggcaaggagguucuucugcaugguuucuggacugugcuuuaccuggaacacaaacuuaccuugugaaugcugagacaggcuguuuuugcuauguaugaaagacauaaagagaacaaaaguccuaaugguauugucaccaugauguaucuaacgccacugccaagaagagcuugaauaauuuaggcaugggcacauuucaacagauuuuguuucuuccuuuuuaguagcacuaggguucaagcccuaggccuugcauaugcuaggcaacagcucuaucacugagcuagacaccuggcccaauauuuuagaauuuucacaccagcccagcaagaggcaauacaguaucccaaucugccaagguugagaacugaauaaggaaagggagggacugcaguguguagcaggccuuucauggggaggauggacaaccugggcuacugugguggacgugcuauccauucucccgaggacccacuucagcuaaaucuccaugcuuccugcaguagcuaucacuccuacaagcuggauggcugccgcaggagaguuggggcuuguuuuucucuaccuggcccaaaccaguuuccccaaccacuuuugggucacccaaccuucucucuaagcauggcgaacguaccuugcaucuuccaagccuugcgcugcuccucuuuggcaaugauuucuaugucuuugucauagauguaguccugacacaagaagcaguaaauaccuccguacaucaggucgauggcugcagagagaggagggagaggaacauaauucaguccgcacggcuccuucagacagcuagcucagagccauguguucuaggcaccgccugcccagagcacuuuccuccuucaguuacaggugcuccaacuucgaggguucauccagggugggugaaauauccgcugucuccagaaguuucccuaagggcuguucaagaaugagacacacaccugagcccugcaaauucuaauuuaugggucaggacacucugcuucagcugggcaagcucagaacgcaaaaccagggcuaaacuucaugagcauuuacuucagguucacaggcauucccagcaaccugacuggagaacaaggcuuugcuacacccugaauggcuggcaaucuaagagaggcacagcuaugugcuguuuccucucaucuugacuacauuguugcucccccagggaugggugaaguaguaccaacugcuacuuuaaaauucacgagcgccggaacugcugagccacagggacaauuccaggugucacuuucugaggugcugcuagacucugaaacacguauuccacugaaacaacagcuuucugauuacaaugaaauaacucuacaauaacagaaaaacaaaagaaacaaaaaaaauuccaaaacccuggaaaggguguagauggaacagacauccccaucgagucaaaggagaaaucucaggaaaauuugaaaauauuucaagagaaaugaaaauuaaaaccugccagguguggcaguguacaccuuuaaucccaacacuugggaggcagaggcagagggaucucugaauucaaggcuaguauggucuacacagagaguucuaggacagagcuguuacacagagaaacccucucuugggggguggggggagaugaaggaaggaaggagggaggaaucgagccuaccacacuaaaacuucuagacuuggggagaggguagacacagugcuaagcugcggugcuguaaauguuuauguuaaccaagagcaagccaagugugauggcacaugccuagaaccccagcacacugaacgcuggcagaggaggaucccacaagguacggggcaguccugaguaaugugacaaaacuguuucaaagaacaaagcaaccgcuggacauaguggacacaccuacaaugccagaacugggguguggaagcaggagaaucagaagcuuaagguuaucuuuggccacacaaacaacucuaacugaccccccaccacugcauguaacagacagcagacaaugaaugcucagccagccuuucacgaccccacuuuacugcaaaccaggaaaaccccuugcugaaauguaaaaaucuucaagcaaacgauaccagccccuugaguucaguuucacaaggaccauuccaucacagugggucuuuuggagagauagcaugcucacucagagccuaucuaugcccgucccuguccccugcaggagggcgccuuacccagguugugucgcuuugacuuggcauggucauggaugugcuucuucgugaaacagccaaagaagacacaguagaggcaagagugcagccgguucagguggaugccgcagacauggcagacacaggacuuugccugaaauuuacagagugaguuacaagcagugucaacacaacagggguccccaaggggaaacauggagcucaugacaaaugacggaggaaggcaggggcugccuuuuuagucuuagcacccugucacauucuccucagucuccccaaaacaugaucaagaagaucucagcuaugaugacaucaucacauucccacgcccaguccugacuggcgccucaggccagcaccaccacagccguccuuaaccccgguaucaguuugagguuugagaaucaagguucuuaaaaaaaaacaaaaacaaaaaaauaaaacaacccaagaagagagacaugaaucaaagcaauauacaggaacaaaagagaaaaguccacugucaagaaagagaccacagaaacccagcaagacaaucacagcaacuaugaauauagugguaggcaagucuaauaaauauucacacuacccacacauaugccaauuuguagcauggugggucagguacagaaagaugaagagguagggaaugcucacugggcaaccagggcacaaugugacagagauaucagcaguaagaaugaauugcuuacaucugauauaaacaaaaggcacccaaguuccaucugaaauuacuaccauacaagcacacauacgagcuuucccaaagucuucauagaauuccaugugauaacuacagugggggagacaaaacaaaacccauuuucugucaccauucacagcaagaagggacuuaaaacagaaucagccauggauacuacaucaccaggcaaaauaacaaugguacuagaaaacugccaaauacaccaaguaccucccaaaucaacgaacagauaaacaaugacaccacucuguaaccaagauaagcugaugugggcaaggacaugggccacaggcuacugaacacgcagaacaagcaaaucccugcagauuguggcuggggacggcagggaacagauguagugugccaaaaucuggcagaggugggcacaaaaccucauagcacugaauacuccagcucauacucuccuguuccuucacccaugaagggcagcacccugcucugucuaaugcaccuggacuacuagguuuccgguuugauuuuguuuguuuugcuguuguuguuuucuguuuuguuuuguuuuuuugcuaaaucuguaauuagguuuggauccagagugcccaguaggccuaccuacugaacaucuagucccagccgccgccaucaccaucaucaucuggucccagccaucaucaucauuauuauuauauuauuucuucuucugaugaugaugaagaaacuauuauuauagguuagcucagggaguuuaguaucuggaaacaauacaugucuguauuugaguauggacuacguaugagauagccacauucccucauuauuccuggacaguguucauuauuaucgucacagacuaugcccucauucuuauggcagcaauggcaauaacuaccgagaugucaccaaccaauucuuauacaacgagggugagggcggauguaaaacuggaccuggagauggcacaacaguuaaaaagguccugucugcucuugcagaggacccgaguucaauccccaacaacaacacagcaacucacaacuuccuguaacuccagcuccagggacucugacacccucuucuugccucuguagaggcccacagugguacacagacauacaucaggcaaauacacacauaaaauaaagaaugguaaaaaugaaccaauggaaauuaugacaauuguuuucugacauuacuuauuguagguuucuuuuuuuuuuuaauaaaagauacacauuaaacugaacuuauaagcuguaaaacuccuagacagaaaaaaggcuauaaccugucucgugaaugaaucucaauagacacaacacugagaaaggaacuacauaguaaaguacaccccacaugcuccaucacauuaaaauacagaggcaggcagcacgccaaacuccacggaagccuuagcagacacccacgaagaugagaguaaggacuggcagaagaaauggacugcucuguuuuuaaauguauuguauuugugugugaaaguguacaaugucgcagggggugugcaggucagagaaccaccuguggaagcuggcucuuaucacaagugggucccaucaggccacccaguucaguggcaagcaccucuauccacugagccacacuggcccuuucugucuguuccauuaaaucaccaagauguacauauccucuaacauauggcuuaaaaagcggagugcaaaacaaggacaaagagcaaacuuagguaaauucauaggugaaauccugcaggaauuuaaagggucaccacaucugauggaugagcaguuuaaaacugugaaauaaccugugucuucucagggccaugacuccaacacacaaaauaagcagucucuaugcuagucugagaacaagaaaguccucauggaccaccugccugacucucgccaguuggugacgagagccuacuguacaauccacagagacuaaggcagaacugcaaguuugcuacuuguauggaagacacaucuuucugagcuaauagauuaaaaaaaaaagccaggacagcuucccuucccaaugaccauacagaacagaaguggucuuugacagagauaaaacucugacuuuagcaaaacacaguggcacacaccuguagucucaguacucugaaaggugaggcaggaggauugcugaguuugaggccagcguggacuacauagggaaacacugccuuuaaaaaaauucaauuauuaauaacccuccccuuaccucuuuuauacaacuuguuagcuacauugaggcuacugggcuacugaaguaugucuagcacaaccguaaguuuaaccuuuacuuaauggcaaagucaguggccacgaugcuacagcaguucaagauccugaagugggugcuaccuaccuauagagcuuauguguaguguacauucuggguucacucaagugcagguugcaauuuagacaaugguuuacuucauagcacugaguuaaaacaaaacaaaacaaaaaaaccaucaaagcccugggguagcucauaaaacaccuucaaaauuaauguucaugauauuuaagcaaaggcaugguuaacccagacagucugggguuagcccuaaaugcucguccagguaaccuccccuccuaagagauggugaugggaccagaggcuaaacccaugugaaugacuggagguugggccagggucuuggaagagggaggccaggauggauucuuucuagaguccugccagggaagucguccugacauuucagugccuggggccugggaguuuuacaacagccgggggacaguggcagaggucacugccacuauuaaccuguuuccaucuaccaauacugcuaaguuugaauaugaauucccagucauccucaaggcucagauuuuaaaccccauuuaggggucaucaugaagcagccauugagaggcacaauggagugccugaccagggguccuauggagcagcacagccagucauagagccagaggcagcgaagcugcuucccacccacaaacagugacuguugugggcucccggaggaacguggcuccugagccagcagcagccugccugggaccagccugccaucagccaguacugagagcuagcucugugagcugguggaaugaaguggaaguuaaaccucgaacaggccaugcagggagccuuugccaccacguccacaugaaggugcuggcucuccuaagucacacuccacaggcuacaacccugacagacaccuacggugcuucuccacuuuuuuaaguugucauauagcaguuucauuaugacaucuuuuuuuguuguuguuuguuuuuugagacaggguuucucuguguagccccuggcuguccuggaacucacucuguagaccaggcuggccuugaacucagaaauccgccugccucugccucccaagugcugggauuaaaggcgugcaccaccaugccuggcccauuaugacauuuuauuacauuaucacuguaccuuguucaacucaccuccaauacuacccucuccuuccccucccucuccccagaugucccccuuucugcaucgcugugcuuguuuagagaccucugggucuauaccucagagugugguggcucagugaccaggucuuugagaacucuccacugguucacagaaggcugcagcagucugcauccccacugcaauugugcauaaggcuucuccaugcauuugcucuccuuucucuucaggguaccuaguuugccugggguaagauggaauuucagcacaguuuuaaccagccuugcucuggugguugaagaggaauaccuuuccagauauuuacuggucauuuguauucuuuguuuuuuucuuuuucuucuucuucuucuuucaccaccaugcaaggccaaacuuuuuuuuucuuuuuuuuuuaugacucacugacuuguaaaaugaaaacauucuaagucggagagaacuucaggagugaaguucuguucacaaccuuaaguuugggcaccuucagagcauagcuaucugccuucauuuccuaauuuaguccaccaaaacaacacaauuucugaguguuguccuggugucccaacucuuggcugugaagaucacuuaacaaagaacuuguagcacgguggagauuuaaacauugagcugagcagcccuaauuaaaaaggaaacuuuucauuuccuuguguagugcuauacaaaacuaagagucuggggagaugaagaaagcaaaacaaggaaagagaaaggggaagauuccuccauuuaaucccaauguaaaaaugacuuuauagcacaucucaauccaagaagcaacagaauggaucagugaccguuuacugcugugauccuaguucucacgaggcugagacaggaagacugggugguuaagucuggaccacagagaaaggcuccugucucaaaauacaaaguaagacaacucuaguaauuuuuuuaucauaugcuucuauuaccaaaacucuugcuccaauccuaaaagacucuuacagaacauaagccuuuaacgcccucaaagacuuauauuauggccacgauugauuuaaaaagggggaauuuaggccggggugggagugggggggggugugguuugcauucaccuuuaaucccaucguucuggaagcagaggccuguggaucugugugaguuagaggccagcuaucuacaaaucgaguuuaagaacugccaaaggcagccgggcgugguggcgcacgccuuuaaucccagcacucgggaggcagagguaggcggauuucugaguucgaagccagccagggcuacacagagaaacccugucucgaaaaaccaaaaagaaaagaaaaaagaaaaaagaaaagaacgccaagggcuauagagagaaguccugccucgagaaacuaaagagggagaguuugaugcuuaacaugaaacacccagcagauuugucaguucucccguuauaaaaugcuacucaagauagaaacaaucaaaauuuucuauuccacuuuucaccuucaaaaucaaauuguaauuaugaaguuuuuuuuaaauuagaaaauaauguuuucccaucuccaaaucacuaauaaaaucaucauaguugcugagauuuacaggacccaaaacaacaaaauagccacucucgaaggcugcgguugucaaucaccuccuacguccuaaaaaucucgcuucucaacucgagugcgcggaggcccugccagccucagguguccgcgaagggucucagccccgggaacgagcuguuauccacggaacuacccugcagaccccaggcccccaccacuaccuuuacagacaaauacuccucaauggaauguccagacagaucuuccuccuccuacucagauaccccucccccucccaucguggguuccaccgccacacucccaacagcguccacuagguggucccuggaccccucccagcaccgugaugcuuccucuagcccccucccugcaccacgacgcuuccucuagcccccuccccacguugcgagguucuccuuagucccccuuccugcaccgggaugcuuccucuagccccuucccugcaccgcgaggcuucgccuugcccauuccucggccccacccccucacggcaaggcuuccccucacgcccuccccgcaaggccaggcucccuccccacgacuaccaggcuuccccucucccucucccaccuacacuccccgcuucccagcccgcagagcggcgcaagccuugggcucaccuugcgcuugcgagccucggcaguuccgcuccacacgaagcacugguagauggcccgcagguuuugcuuccaguuguccaccuugaagcugcccaggugcgagcagccaggcggcgguaccgccagcucagcguccauggccucgaccucaggcuccggccuggccaccauggcgggcaaggcccgggcgcgcggggcaggcggcgacgggggcgaggacgacgccagggcggcgagaacaaagcugggggacaaagaccgcguugagaacucaggcaggcuacagcagcacccaccgcacgcgcagcacccucugacuucgaggagggcggggcgaggcugggcg

SEQ ID NO: 6053 - RNA, 561 nt, Mus musculus
ucagggacuuuucuuuucuuuuuuuuuuuuuuuuacucaaagugauuuuauugcuugugcacacaacagcauuuaugccacuagagcagaugcuguggaugacucauauuuccaauugggugggagcacccgcuuagucuuaaaguaucaagccaaucggugaauucuggucucuaucggaaucaggcagaauuuagcauccuuauccuuucuguuccucucaaggugcuuucggacagcaacagcuuucuuaaucaaaugguagagauccucggggaggucaggggcaaggccuuuggacuugaggauucucaagauuuuauuuccagucacaaaacggaccugggccaccccgugugagucccucaggauuacaccuaucugggagggagucaggccuuucuuggccaauuuguaaaucuguuccuucacaucaucagacgucaacuucagccacguggggacgcuauggcgguagggcagcgcugacugggacaggcccuucccgggagcgugcaugugacccaugauggcggaggucuggcagcaaagagucaggga

SEQ ID NO: 6054 - RNA, 3470 nt, Mus musculus
cugcagucuggggccccagacagccagccucucucaacugagcugacaccaugaagguacuggccuggaggaucaagaccauuuguggagacaagccacuugccagauagggaacagcgaagcucaguggaguucucuugaaacuuaaguucuggggauauugggccuuccucugaaaguugagaggggguaaaaaagacagagggcagaguucaggcagggagagcccugggaggugggaggcgucuggcccauguugggggcuacacucaccccauuucccauccccaggcccucccagcccugccacugaugcugaugcugcucuccaugccuccccccugcgccccgcaagccucugggauccggggagaugguaagcagcccccauucacagacacggccuggucagcaggcuggaugaggccauucuaagugaggcucugcaggacugcuuccuccucuacaaaguggcagguaucccccuagagaaaucuccagauuucuccugauagagucccuuaggccuggagcaaaacugggauauggagggggguguccuuaugccuuagucuuucuccucacgguccccacacugccacucgcagcucuggagaaguccugucuucagcaaccccuggacugugaugauaucuacgcccagggcuaucaggaagacggcguguaucucaucuaccccuauggccccagugugccggugcccgucuucugcgacaugacaacugagggcggcaaguggacggugaguaggcaaaggggccucaggccagaugggguucaggcagcugcgcgaucccggcugucaucucugugaaguggauuuuucaucuucauggggacuggauccagggcugcuagcacuuacuugccugaggaagcuaaugcaugcuguccucacagcgguagguuggugccuugucuaaaugaggaacugcgagcccagguaaguagcauuaauagccuuggcgggcacaguaaugaacucacagccaaguauucuagauccuccugauggguuuuggguuuuuuuguuguuguuguuguuuucuagacaggguuucuccuggaacucacuuuauagaccaggcuggccuugaauucagaaaucugccugccucugccucccgauugcugggauuaaaggcgugggccaccacgcccggcccuccugcugguuuuaucaugcagugcugggauggaacccagggccucuaagcuaagugggugcuuugccacuaagcuaugucuacaggucccagcucccucuuaaucuuuuccccuuccugucucucagcagacaaggggccugguagauacccccuucucagcagcagauguucaaugagaggccuggagccagagaguguguucuguuuuagcaguucccuaacaaaauggcuaagagucacccuaggguacuggaccuccaucauccagccccuuguccacuuguuuccagguuuuccagaaaagauucaacggcucagugaguuucuuccggggcuggagcgacuacaagcugggcuuuggccgugcugacggggaguacuggcuggguaagguggggccauggggugggggcugccccucagccaagucucugcugaccggcugccacccgucccuagggcugcagaaccugcaccuccugacacugaagcagaaguaugagcugcgcguggacuuggaagacuuugagaacaacacagccuaugccaaguacauugacuucuccaucucccccaacgccaucagugcugaggaggauggcuauacccucuacguggcuggcuucgaggauggcggggcagguaccccucucagcuucuucaggggcaguggcgggggggggggggguagggggagucaguaagggguaggaucaguaggggguggggcggguaccucucucaacuucuucaggggcaguggugggggaggggguggggucaguagggaguggggucaguagggauuggggucaguaacguaggauuggcccugcuccauugguuccuaaggccccucccucaacccuucuggguguagaagagucauagcucuccacagaccaacuucagcuacaggaaccucagccccagggaacagccacccuggcccugcuccaaguggcccugcuccaggcagcucugcagaagaacagcuguucucuuuguggcucagggagggugccccccauccgauaggaugccacaucaugucaucccaagagucauucaucaagugcugucauccucucagcuccuggccucaguuuuucuagucuuccucccucuugccaggugacucacuguccuaccacaguggccagaaguucuccaccuuugaucgggaccaggaccucuucgugcagaacugugcagcccucuccucaggagccuucugguuccgaagcugccauuucgccaaucucaacgguuucuaccugggugguucccaucucuccuaugccaauggcaucaauugggcccaauggaaaggcuucuauuacucccucaagcgcacggagaugaaaauucgucgggccugaggggcuggcccaagcaggccccaucuuuccccugaagucccaaggguccauguucucccuccacgcuuuacccacaauuccugagcaccagccaugcccuggcaaaucccugucccacauacagccacgcccugaugcauuccaccugaggcuaggcugucagcagcccuccaggccuuucuguggcugagccauccuagccuggaucuggcugaaauccauuaaaaacuccaaguugcuucuaccccuucacgacagcugaaagccagaagcuaccuucuagcugccagcuuuugcaccccaccucagcaguuuccuuacugcagagccuucuguuuggggcuacccucgacagagucaugcagcaccuguggcauugccaaucagcucuugcacacugccacaccccagcacucacauagcucuccucagaauacuuccuaccuuggccucaucacuuuacucccuacgugagcaucauggagcccaaucccaucugccuucacucaucccucaaaauucaccaccaaaacaauacucaccacggcuacugcucaacucugaagucgucauggcaaagauaggcuuguugacuugguccccuacuugcccuagcgaucgucaugagaggcagcagggaucaauauguggggcuggaaguggguggguagcagaggucucaauaaacuucaggaucugauggacuggcuuuguggacagacauuuacuuggcuccaaauaugagcaccuggcucuuccucacuguaccauuguugguguguuuaccccaaccccaaaaaugacgcagagucagguuaaagaaaaccuuguauuucacaggccucauuuugauggcaaaacaaaugcauauuacaacaauaauaaaaaauacaauacu

SEQ ID NO: 6055 - RNA, 6651 nt, Mus musculus
acucacuguccuaccacaguggccagaaguucuccaccuuugaucgggaccaggaccucuucgugcagaacugugcagcccucuccucaggagccuucugguuccgaagcugccauuucgccaaucucaacgguuucuaccugggugguucccaucucuccuaugccaauggcaucaauugggcccaauggaaaggcuucuauuacucccucaagcgcacggagaugaaaauucgucgggccugaggggcuggcccaagcaggccccaucuuuccccugaagucccaaggguccauguucucccuccacgcuuuacccacaauuccugagcaccagccaugcccuggcaaaucccugucccacauacagccacgcccugaugcauuccaccugaggcuaggcugucagcagcccuccaggccuuucuguggcugagccauccuagccuggaucuggcugaaauccauuaaaaacuccaaguugcuucuaccccuucacgacagcugaaagccagaagcuaccuucuagcugccagcuuuugcaccccaccucagcaguuuccuuacugcagagccuucuguuuggggcuacccucgacagagucaugcagcaccuguggcauugccaaucagcucuugcacacugccacaccccagcacucacauagcucuccucagaauacuuccuaccuuggccucaucacuuuacucccuacgugagcaucauggagcccaaucccaucugccuucacucaucccucaaaauucaccaccaaaacaauacucaccacggcuacugcucaacucugaagucgucauggcaaagauaggcuuguugacuugguccccuacuugcccuagcgaucgucaugagaggcagcagggaucaauauguggggcuggaaguggguggguagcagaggucucaauaaacuucaggaucugauggacuggcuuuguggacagacauuuacuuggcuccaaauaugagcaccuggcucuuccucacuguaccauuguugguguguuuaccccaaccccaaaaaugacgcagagucagguuaaagaaaaccuuguauuucacaggccucauuuugauggcaaaacaaaugcauauuacaacaauaauaaaaaauacaauacuggagaagacugcucagggaggaguagagucuccugguccuguuauggcucggugguggcucagguggcugcuuaaggcugaaaggugggucugagaugaaccugcagaguaacucaagccaagccucaccugccaggcccagggugcagcccuuuggaucgcaccccuggaccuugaugcugggucuauccuggcagcaaggcacaagcuguggguuucagggcucuuggaggucaggcaggucagacagcagcauuggggaguccaucuggaucucacgcugcagagacucaaugucagcaggguucaugccauggcccucaagccagucagcaaggagagaggcugagagugaggcugagucugccuggcuguaaggaaaagaaagagggauggguuuucucagccugggcuggcagagcagccauucagacccccacuaaagcucaggccagccaucuuacccauccuguggcccaucagccacacccauaucaaaagauugauuuaagaauuccuccagaucaaagccaacuccguagccagccccacugcccuuuggagugccagagaacacaggaggcaggggguccuccaccugcaggggacaaucacagguuauaacacaggugccaggaaggacaaaaugaggucaguagagcauacccugcuauuccugacgacucuacccagauaucccagagcaugaacacugccuugacaucaccaagcacuggugcagauaaggcugacucuaaggcagacauuuuccaagcagcgccuaccuuccaacaggcucuccacuggccuucuauguucccucuaugagcaaaggggcaggcucaaggagggaagccucccucugcugcuuccucucauccaacguggacaacuaaccaacccaccuuccaagaccagaugaagauaucccaggcuuuccucuucucaccugagacuuggacagcugcugagucaccagguugacaucaggugacucugauguagaaggcugaggggugagcccaggaucuggagguggugggccagaugggaaguaaggcagaacuucuggggcaccagaaccaggcaacccacuagguggcacaagugacugggaggccaaaaggcuaguggaaggggcagucuggagcggagcagggauagggccagcaggcuggggaacagggccagggggugggcaaacaggcugggaggcaggacccggaauagagccugcaggcuguagaggaccaguagacugagauacggggccaguaggaguacuagugggcugggcagaggacggugcuggcgcuggugcuggcgcuggggcaggggcaggggcaggaggccuagccaugcgaguccaccgcucuagcaggcuucggucauugucacugagcaccaguccagccagagggucaguagaggggccccccaagguaccagccccccucuccuugcguucucucucuugucgucgcuucucccgcuccuuggcucucucuugucgccuccugcgcuucucuucucguucucgcuggcguuccugagcugucacgggcuuucgaggcucaggcgccuccaagggugcacugggcccaucugcagaaaaguuggacaagggaaagguaauggcuuacagaucugucccagaaucccugucuaccacuccacuacccacucagcugcugggcccacacaccaccucugagccugcuccuuagggacuugagcagggcagcuuugagggcugcuuugguauugucggagauggcacccucucuuuuugguggagcaagcucacuggccggcggggcaggcugcagagucagaucaacggugucaggugcaggaucagagcaugguggcagugcuggaggaggcgacuccauggcacagucuccacuuggagcccagggacugggcaucucaacaucuggacacacaggcucacuagccacaggcugcagagaaggcuggaagcggauuuguuggcggaugcccucccgucgugcauggaaguccucaaucucagccacaauggccuccuuaaugcgcucccugguaagggcuucacggucaaaagcaaagucaaaagguggggcgcaaucaggcucaucaucagggucaugguacuuagccaggaagggguggcgaagggcagcagcagcugagauucgggcacuggguucaaaucgcaacaugcgucccagcagggagagggccuggcggucagcaccuggguauacugucucccaaggcacagguugccuugguggcaggcucuggauauaggcucgcacccuuucagcccccacagccugaaucacagcuggugacggaguucccaacaccaucaugaucagcuguaacuggugcacguaguuuuugccugggaagagcuggcgccgagccagcaucucaccaaagaugcagcccacagaccagaggucgauugccugcguauacucgugcagggaaagcaugagcuccggggcacgguaccagcgaguagccacauacucagucaugaaguacuggugcucggcaggggaaguacagaggccacgggccauuccaaagucaccgaucuugagcucacaguucucauugaccagaagguuagaggguuuaagaucacgguggaugaccugagcagagugcauguauuugaggccccgaagcagcugguacaggaaguaucucacauguuccagggugagcggcugugaagagugaaugaucugguguaggucgcucuccaugagguccaguaccacauagcugaaaaugggaagaaacgggugagcuagccuccucacaucacagggagaagcccccccuggcacuccguccccuggcacucccaauuccugagguuauggccuuacagugaaaccccaaaggacuaacagcauggaaagagagaauagcaacagguucuagguuuucuacaacuuucauucuuucuuucuuuuuuucaagacaagaugucuguguagccuuaucuggccuggaacuugcuugcucuuguagaccagguuggccucaaacccaaaacucaagagaucugccugccucugccuccccagugcugggauuaaaggcaugcgccaccaccgccuggccacaacuuuuaugaaaguuuucuuaaacguauguguauguuuuccugaacguauguguacuacuugugugccuugugucuacagaggcagaaagagggagucugaucccaacaccggagucacagaugucaguuagccaccgugaagacacuaugcacugaagccaaguccucugaaagaucgagugaucuuaaucaccgaaucgguuuuuucuagccccaacuuuuuuacagcuuucugacaaaucacuuucuccauggaccuaauuucugucaaaaaaaauuuuuuuuauagaaauauucaaaucuaccaagauuggccaguaugguuaauuuuagagcaaacucuacaguuugccaacagcuacugaaaaagcuauguugaagacucuauuuuuaaggagguauucugugaauaauuaguugucugccaugaggacacugcugugugacacuacaauguauuguguccguugucuuacaauuuggaucuguccugucugucuguccucucucccucuccucuauugcuguuuugguuuuuuguuuugucuuuuggaacagggucuagacuagccuugaacuuaugauauaaccaaagguggcaugaccauaaagagguaaauccucuugauucuuuuccccuuuuguacaggagagucaaccuaaaaccucaaagaugcucaucagccuaccagugaucgacauccccagcccuugcccucuugagagauaagaacugucccuaccaauguccuggacucacagcccgcaucacucuggguucaaccgcccugccagaacuucaguauuacugaaccugggcuucuaagcugaucccgacugugucuccuccuccuggcccacuccuuacacagaucugaauucuccauagggcacaguaggcuucaggauguccuugauggcgaugauauugucguguuugaaguguuugaggaucuucagcucccugaggguccguuuggcauuggucaccacaucaaaagcauuagguaucuucuugauggccaccugcuggccuggggagcaggaaaagggcauauaccagagaguaccuucaaguuagcugcaggucccuuccagcacugcucuucuggagcccagauagcaguaaguaccuacugugugcagggcccuguguguaacauauaucaaauuuuaauuucgcaacugccucgugaaacggcugcuaauagcucacauagagaggaggcgcggcuaguuagcagugguugugacuguacuaacugauccucccucccucccuccucacauagucaguccaucccagauccuccccauucuuccaccacuccaucgugccaaucucuggcucuagaacauaucucuuuuggacaccaaagagcaucucucuauucuggcuuacagggaauauccuuuuccuaaggagaaaguaggcugacugggagaagcagggguuccugagaaggguaccuaacggggagcuggcaccuaguccguaagcgugaguggaaccagaauccccggcgcagcugauccuccugggaccgugcggguuccucaccgccucuggaaagcaguccacacaugcugagccucaggaagccagcucacccgugaggcggcggcgcgccgaagacaccaccccguaggccccauugccuauggucucgaugaucucguacucgucccccacgucaaaggucacgucgaaggagcgggcuuugagcagggccagguucuuggccaccacagaggcagcggugugaacggguucugccuucacccucccagggggcuccccagagccaucuucgccguccuccuccuucagcgguucggccauggucuguacgaagcgcugaugagaagaucguccugagggccucucaguuccgccucuguggguuuggaggcaggaccugugcagcaggcgagaggggaccgcuggcacagagaaccccacggcccaggauccaggggggcgcggcgcggccccggaagaaagggaggggcggggcgcugggacucccgggaucgcacucaccgaccggccggcaccccgccgccacgccuccucgggaauuugggauuccugagucuugccaacccagugaugaguguucccccgggcucgcucacuuaacaagaaccgcggccaccaccaaagccucgcgugcgccgaagcagaccaccccaccggccgccccgggaccacgcuccuccagcucccagccaaucguugagcggccuccguggagguucccaccccuuuauuuuacucuguccaaucaaaacuuaccggacgggaaaaccgcgcccuugucaaucacgcgcgcgcgcgcgcgcgcccagcugucccacuccgggcggga

SEQ ID NO: 6056 - RNA, 1312 nt, Mus musculus
uggcugugugguagggacucauacuuuauauuucuguacauguucaaaaauugcuaauuaaauaaaauuuagucuuguccaccuguaaccccauuauccagauggcgguggcagaaagauugaugcaaguucuaggucaggcagaaucucucuauccaguacauuaauuucaguacggggacagagucuguaggagacaaugcaguguuugagaaagaauuaaaguuguccucacaccaugauguaaugaacagaccgacagagcgagcauuaggaagaaauugccagaucagcgugugcugcaugguagagcaugcgcuuuguacacacgggaccuuuggcuucauccccaguuccccaaugaccccucaaauaagaacugcuuucuccuucugcuccagacacucucaagauggggccaccgucaguauccccucccuccucagggcgggcacacacacacacacacacacacacacacacacacacacacgaacaccaucccugaauuaguaaguguguuagcuuuuggucacugugacaaaacaaccugagaaaaugaacuuaaaaagaggaaagguuaauuuugacucacaguuucaaaggaccuguuguaacuagcauaguacaucacagccagaggugugguggauaaaacuucaucuccuggaagccgggaaacaccccaagagaggacugaggcuccaauauucucuucaaggguguggccccaaugaccuaacuuucuucuaaugggcccacuuccuaaaaguuccaaaccaaauagcacuguagucuggggacuuuucacacauggccuuugggagacauuccagguccagauuccacaggaagugaagcuaguuauucugcuccuagaaucucugcuggccgugcuuguggcugcguagaggacuaagaaccuaugagugccccaggagauccgggcacgauccgggcacaucggcagacacagucgcagcaauuggucaguagaggcagggugggccaggauuucauccugggccacauagguggagcgagaucagccugggauacaggaaaaccuaucuaaaaaauaaacaauaacaaaacaaccacaaacaaagaaacaaacaaaaccccaagagaaucagcagcugcuggaaagagaugccaacucacgaggcagaaacacccauguggggacucaggcucccagaucaaggucccagacgaucuuccaggcagcagcuaacaaaugugucuuauccauucccacuucaaaagcauaggaacccagcuaaaccuauucucacacuagcaaugaaua

SEQ ID NO: 6057 - RNA, 32441 nt, Mus musculus
cgccccuggccucgcagucucgaaagacuuucucgcgcuuagagucgccauuuugcuguaagacgccgugcggagcucugugcucucuuccuucggcagccgaggcugcggcgggccgggcuggggucgggaccagguaggcgggcgggagccucggcgggcggacggcgggccccgcgagcucgcgcggugccgggcgggagccauggcccuuguugcuccggggcgagcccggggccccguguucggcuccaccagccuuaguggaugauugggcuccaaucagacguaggaggagcggcauaagauacucugcagaaaaaucucuuccucaaucuguuacauuauugauaaggauuuauuuuucuuauaucgauauuggcagaguuuggguguuuagcuuuugugagggauacgaaaauacugaaccgagcuuugaggccugaggaagugugaguucuaauguuuuauguuuuuuuuuuuucuuuuuuuuuuuuuuucuugcgguucuggagucgaaugcaaggugaagcaaugcaagcggccugccauugacccaucucaugcccuagugcuuaacaauuuaaaugcacaaauaaaaauaaaauaggugcgugccccuaagccccacuauaggaaaccuuucuugucuuuuaacugcuguaguuuguaucauuauuauccaauuuuugcagagauaugcacauuauauucauuagcuacucugugguuuaacauagaaccaguguuucuguucuuaaauaaucuugcaguuuguggggcuugauggcacaccccuuaaucucagagacuggugaaaggaucuugagggcucaugguccacagagcgaguuccuggcaaacagggcuacaaaguuguuggggguuuuuuguuuguuuguuuguuuguuuguuuuguuuuguuuuuaaauuguacuuucuaucauugacaauauagcucuauacuugggauaagcuccaagaauugacaacaccaaaacauaguucugugcucuuucuuuggcauuuaguauguaucuuuuuuucugauaagguauguuugcaauagacauuucaaaaucuggguauuugauucuauugccuguaguucaucagguugccaagucaugcucuguaugacugagagucgcaaccuauuguuguaugcagggaacuguauugcauaucagacugcuaccccacucuguccuucaggggccacuguuaugaggaagagguuaccucguaugacuucguuaaagucugggaaguaaugucaaaccuguuuuccuauuaaaacugcuuccccaggugugggggcuggagaacuggcugguuaagaauacuaguuguucaagacugagucaguuccagcacccacccacgugacagccuacaaccaccucuaaugcuagacccacccaaucugacacccucugcuggucuccaagaguaccaggcacacgcggugugcagagaaaacacccauacacauuaaaugaauaaaaguuacuucuccaaauuuaaaauaguuuuagauuuauuuccugcuucucccaaguugucacaaaaacaaaacaaaaaaucaaaacucucagaacagcauuagccauaagaaagcaaaaugccaguaaccacagaauauggaagaguaaugugguuuuaucucugcccugcaguuucucaauuauuuuacuuuauuuuauuuuggagacggagguuucucuguguaacagcccuggcuaucuuggaacucuuuguagaccaggcuggccucaaauucagagauuugccuaccucugccucccaaccucugggauuaaagguguaugccaccauggccaggccucaacuuuuauuuucuccuuuuuaucuauuuauucuuaauuaauuaacuaauuauuuguauauuuauugguuucucaagacaggguuucucuacguaaaccuggcuguccuggaauuugcucuguagaacuggcuggccuccaacuuagaaaucuaccugccucugccucccaagugguaggauuaaaggugccgacaccaccugccugugcuuuuuauuguguuggugauuaaacccaggccugcagcacaaagcaccuaauuuuccacuaaaguacacuucuaauccauuucugcaaguccggcuuuuuuucccaugcugggguuggaacccaggcccugugcaugaugggcaaaugcucuaccuaccauugaagcagauuuuccaggagugaguuaaugaaaguaacuccuggauccucuuugcuaaggaaugauuuucuuuuuuucuuuucuuuuuuuuuuuuuuuuuaagauuuauuauuauauauaaguacacuguagcugucuucagacacaccagaagagggagucagaucucauuacggaugguugugagccaccaugugguugcugggauuugaacucaggaccuucagaagagcagucagugcucuuaaccgcugagccaucucuccagccccaacaaaugauuuucaauucuguuuucgaacuguugugccugaagugaggcuauguucagcacacacugguugagccucugcugccuggaccuuccauuuugguggagaagcuuuuccaagccucuaucuucauugucugggagguaugcaggucuaggcuguggcucaggccugcugugguguaagcccacagcugucuuccuuuagccaucuuagaaggauugguuagacaguggcugcuuuagggaggaaacagcacaaauggugcggcuucaucaucucuaguaugaauguugaaauacaguggugguaaauccaucuaaaacaagugaucuucagugugaggaccucuucacucaugaagucugacagguugucucauucagagagaugaauaugauuuguucuuucagucuugaaagucucuggaaaagauuuguuuuuaucccugcauaaauuucauauucucgaguaaguuuaggguaacacaaaagcaauuacaacacaugaugggagaguggaaacagucucuguacucuccaugucacagggaaacuuugugcuaaugaacacugccgacuagugauucuuagccugauaaauagcacauugaaguaggaggcuggucuugguagcacaugcaugccuuuaaucucaguauuugggaggcagguggauaucuuugaaucugaagccagccuugacuccauaaugaguuccaggcuagccagggcuacauagagagucccugucccaaaaaaaccaaaacacuguuggaauuucuaagugggagggaaaguggaacuggaggcagcucuuagaggugaacagcuugugaguugggcagucauagugauuguucugaugcccuuucuagguucaugcccugccugccccugcuguucaagggugggcauacauuaggauuuggcauggaacccaaggcaugccucgugcuaggcaagccuuccacuguuaagcuacacuucaacccuuaugucagaguuuacaagcuguugcucuggguucaguuuuggagaccaggcagacugcucuguucauuugagccacaaaaggaaagucuucaagagauguccuggaggaguacaggguaaagagaggcugggcuguugugugugugagaguagaauguuuccuuuaaauccucaaggaaagaaccacaggcugcaaggagaggaagacugguucuaagguagaaauuggggugaugggccucagaugagggcuccaauccuagggacuggaauccuguagaccuagaagagagaggccgaaguauauauaagagcccuuccuaccccuuaauacuuuaugcugccucggauccucucagggucucuuguauuguuauuuaggaacuucuuauuugaaguuuaggggcguaauggccaccccaggcauuuuacugauuauuaauuuaguagauaaccaagacuguuaugaacuacugugugguugcugcaagccuaagcuggguccucugcgagaacugcaggugcucauagcccucacccccucacuccagcccugcugauacagugguucuuuuccacuaccccauuuuuuaagcuaagccccauucucugaaagccaggauugaaauauguguuacagaaggagcagaguaaguuuucaggcuuuguggcugugcucaguacaucuagaaaugauauugaaaugguucaggcuuuugaaggacugggcuugacugaguaguaucuguggacuccugguccacagccacuuuucacagugugcaccaguggacuccuuaccaacauuaguugguuggcugugcagacauuugugacauaauaacuucagagaaauugaacuguagcuuguguuggaacccuggacuuuccauuuagaauaucccuuaaaggcugcucugcuacacaugugcucuccuagccuggugaucccacuguaugugugcaugaagccugucuuagaugaugauccacugaccacaacauagccacacuguggaaguugaggcagcacuuaggaagaauagaauagcuuguccuauaacucaaguuguuugaacaagccacuuacggauagucacagugauacacucuuuugagcuagaaacauugaauguauagaguucagugucugaaugugugggaaaggccugaagcaguauguuuguaaagugaaagaacccuaauugccagaggaggagcucuggaagagucaggguggggcuggcaaauucagccuuaucagucauguuucagguuuuaacuggaagauguauuuggggcauaacaaauauuuuaguuuucauaauaaaauaaaaacacuaaagcaaaacaaaacacagccaaaugagucucccgagagcuagccaagcugaguaaacacagagaagaccaaagaauguguguucuuggagagucacaucuucuacccaaucuagcacucucccugugagagaggccaggcccuacucuugucugucccuugaggaccacuuccuccaagguuauuaucuagucagccgugucccauuugagggggagaaauaugacaacuugaaauuuuuauuuauguuuuuguuuuguuuuguuuuugagacagggucucuacuauaguucuggcuguccuggaacucacuguguacaucaggcuggccuugaacucauagagauccuccugccucugccuccugaguacuaggauuaaaggugugccuugaccaggugcucuaaagcacagagccacuuccagcacugacaagaugcauuuuagauguggcccagagcagcugcaggguggggugugggagcaggugucauagaaggaucugggucauuuauucuuuguuuaaggaucaguuaguccauguccuugcuaauggcucugccauuuuucuguguuaauccaggaggaauuuuguugucagagaauaacaggagguuguccauaauugacuuuaagcagcaaacaguaaaacacugagcucuucagcuccgccuuucuuguaaguuuauuauuuauucccagugaguaugaaaaguaauggaguuguguggugccauuugcaaucuuaaaauccaaggguuguacuugcccauacuauaucucccuuaagaucagagccaccauuaugguggcaacuauuuuucuuaugcugaugccauucucuguuuaaaaacaaaaucugcuuggguauauuuuauauauguugguccuuuauguauacuuuuuuucuucuaggcucugagaauuggaaagccaagaagguuuugauguuuuguguggcgccuccugaauuagaaaccaagaugaacauaaccaaaggaggccucguguuguuuucagcaaauuccaauucaucauguauggagcuuucaaagaaaauugcugagugaguuccaguuuuaccauucaaauucauagccaauuaugugugauaauuuuaaguaugauaaucagacuagcagugauuaucaaguauagcuaaccugcaugucaucugauauacucagcgcuacaaugugucugugaccacaccucucaggagugugguaggcacaacuguagauaaauuauuggaguuuaacaaacagggauguguaguauaugaggauaguuuaguguaauuuuaagaaacugauuaaacacauaccaaaucccugcagugcauaaaaccuugauaugauuauugugaguuaauggugagcaggccagucaaaagcuuuucuucucaugcaagcuaagauaagcagcuaagugguuuucggugguaacagacgcacgaaggaggcaugaguacauaaggauggguagaguggucuguucuggcuuaggagcucaggcaccuuuaaaccaaggccuguuacaugcaguagggaaugugggcaguagagcacggaguacuagaaagaugcccgugaagcaggagagacagauugcauaggccuuggguggucgugggguggagguccaggguaggcaacaaacagguaugauguaauauuuacuuuauuucauaauuagaaugacuuuuaucuuugucaacuuauaagucaucuuuaauaguaaagauguugggucuauucuguugccuucucagcuuuucccccuuucucuucucuaggcggcuggggguggagaugggcaaagugcagguuuaccaggaaccuaacagaggugagcuuccuuggaaauauguauuguggaucuucuugcagaaugugguguaaugggucaucaaguuguccuugacugucagacggauucagucaucuacucaguucagaaagcaggaagucaggcaggcaagguggaggagugugguuuucaguccuuacuaauaccaaauagaaguaucccuggugcaagucacauguauggagguuuggugaugguucuugagucucauucaggaagcacugcguaaguuuagcuagcuccucagcuuacuguugguugagaucacuuugcugucgguaacaugaguccugcgugccuacacuuuuagucuguagguaugugggcaugcccaguacuacauacacacccaagcucgcaugugcugcguuauugugcccaggacuucaugcaugccucccuacugagcuguaccucuaacccuagcuuguuauucuuuauuuccucuaaggccacagguuaauuccuuaaaauauugcuaggaaauaguuguaagaaaauguuauuuaaucuugguauuucuuuagaguggugaguauucuuagugaaauuuuucuagcagggguaguugcagcuuauauggacaugagaaucuuacucuuuauucuugggcaguaauaaaugggauaaucucuguacuugacaucuuuugacacauaguaggugcucaguaaacacucauucauucugaccucucacuacaggaauuugucuagugguucaaccuuaaaaaacuguuucuccuaguuuuccuaaaaugguugcuacugggcaacgugugauugagaucuggggagguucuuuucagggagacuggaugagggagagcugugggaagaguggggcuaugggcaagcuccuucacucccaggcucaaaaguauggauggaaaaucauugguuuauugcagaggaacuaaacuucuauauuccuuacuguuuguagauacugaaauccugggucagggauagauacaaggccccaugaguaucaguaccaggauuuaaauccagaccucuugucucuaaaacucauuuguaacaucacaucccauuccuuuguaagcacacuauuuuuuuucuaaugacuuuguuuguuuagaaucaaugccuuacuacauagcgcaagcuggccuugaacucagcuuuaauggcuguaagccaugaagugguugcugggguuugaacucuggaccuuuagaagugcaguagguguucuuaaccacugagcaauugcucuagcacuggccuugaacucagaaugcagcccauguucgccucaaacuugaaauccucuugccuuagccaucaccacagagcacagagcccacuaaagcauucugccacugaguacaucucuggcuugcaaacguuuuuaaugaaaacuuucaaacauaugaacuaauugaaagaauagugccaugacggcuguauugguaucuacuauauagguuugguggguuuuuuuugucuaaauguugcauuugaaagugagguguaagccgggcagugguggcacacgccuuuaaucccagcacucgggaggcagaggcagguggauuucugaguucgaguccagccuggucuacaaagugaguuccaggacagccagggcuacacagagaaacccugucucgaaaaaccaaaaaaaaaaaaaaaaaaagaaagugagguguagacauccauacacaaucccuagauaccuggucacaucucugaccaguucuugcacauaaauaagaauacuuuacucacauuucaagaaauuagcuguauuuaugacuuuugaaggcuuuuugcuguuuugcuaguuuuauaugauuccuaaccucaagugauugguuuuuugguuuuuuuaaaauuuuuuuuaaaaauuuuuuuugauuugcuuuuguuugcuguuuuaugaaucagaguauuacuuuguagcccaggcuagcuucuacuauucuauccuccugucucagcuucuuauuauaauucuagacaagcaucacaauggccagaaggugacaugguuucucuuuugauguagaaccauacccaacccugccauuuuccucuccguugauguugcagaccuaccccguggaguguucaauccuggauuugucccuuguugcuaguuacaaauguuuaagagcagggauagucaccagucuucuuuuauccaacaacauacuacauuuaugccucuguucuuaguuggugcugguugcaugacugaauacaucauuucuaggcuguacucugugucauagcagacacuacuuaaaugugaggggagaagccuaaauuugauucuaaaguaugauuaauggugacacgcuucaugucagugcauucugcuguuugguaggaguccugguuucuguauucuauaaguuuggaaauuaaugcagacuuggugcauguuuuaacauuuugaacuauaucuucccuccuuuucccuuuagaaacaagaguucaaauccaggagucugugagaggaaaagauguauuuaucauccaaaccaucucaaaguaagugcuuucucgcugccucuugaguaugccuauuagagucugaagacuaggucacacaggagaagauaguuuuaagauuggugugcuuuuuauuugagaaaugaggacaacugaaucccaccauucucaugggugggugagaugguggccucuagauacaguggaaucugagccagagagcagcacugugaauucauggacacuaggagaaccacugcucuucaccacugagcugucucugcagcccccugugcuagcuuuucuagugaaaaugcugacucuuuguuccucucucccuuuagccauacuuuguuuuguuuuuaaagagauaaacucugcugugcuucuaguccaucccuagauuccuagugucaagagacaucucugccucagccuuccuaggcagauaucacugugccugcccuuuucuagauuaguuuggguguuuauuguugguuguuuuggcaggaccuuguguaucucuggcuucaaacuugcuguggugccaauaauaacaaauugcuguucuccugucuccacuugaguucugagacuacaggcgugcgucccuaugcucagugcugaggauuuaacccagggcuuugugcgugcuagcgaagcacucuaccagcugaacugcaucuccuuuucuguauuguuuuguuuuguuuucuuagauguauuuguuuuuauucuauguguaugagcauuuugcauacauguauauaaauguacugcaugcauuucugguaccuauggagaccaaaugaggguauuaaguccuuuggaacuggaauuagggacuguucuuggccaucucucucucucuuuuuuuaagguuuauuaauuuaguuuuaccuuuaugaauauuuugccuguauguauguacauguaccacgugugugcauacuuacagaggccagacaagaauguuagguccccuagaaccagaguaacagauagcugugcagugucacaugggugcuaggaacugaacccagaucuucugcaagaguaacaaguccuccuaaccucugagccaacucuccagcucccucuccugucuugauagggaaguggcaggcagugcacgcucuuagugauagagucuauuaaguuuuccuagccaucaagaaucguguuggcgauuaguuucuguggcagaacuguugucagcugagccugucuuuuggcuccacacagaacacugagcucugucuuagccagguugcagaaagugugcgugcaugucaggaucuucuuucugagaugcgaagaaauagacugaggaugugaugcugucacauucagcugcugccucauuguauugguugauugacuuggugaugaauuaauagcaguaguaaguaucagacccagguccuauuggugggcaagcauuguaccacugaguaguacugcuacuccuuacuuuauuuuagucaugaccaguuuaagcuagugaaaccuaagacagauuuuaaaugaagacaaucucugcccauuaacuggcauuuucuugucauccauuugcucaugaguuagugguaguaagcugguuuguuagccucaggaugacuuucuacgcauugcagguuccccugcuuauccuuccucacagaaugcuuuucugaaguuacuuuaauuaaucugggaucaggcuaguucaauagugauagaaccuucucauccaaacguuggcauucaauuauuaacaauauuuguugaauauuuucaauaauuggggucuuguuucagugugagaugcuuucaugcuuggaacaguugaugaucugguaagggauuauacgcagagaacaugauaaaccagaaaaagugauacaugccuccaaucucagcacucagaggcuaaggcaagaggauuauuaguuccaaauuaguaucauuuauaagguauauuagcucuguagccuucugguugugugcaucuguggcccaacacauuuauagacaucaguaucaugucacagugccaaaagguuggcacucccagcauagugagaccuucuucagagaaaacaaaacaaaaacccagagaguuugauagauaccagguacaccaaaaaguaaucagugcugugugacauauaacacaaaaugaggagugcuauggcuguaaaucacugguagaaggguugguugucuuacauucaagagccucuaaacucaauccucaacauugucaaaaguuuucggguagugguggcgcacaccuuuaaccccagcacuugggaggcagaggcagucggauuucugaguuugaggccagccuggucuacagagugaguuccaggacagccagggcuauacagagaaacccugucucgcaaaacaaaacaaaacaaaacaccaaacaaacaaacaaaaaugaugggagagaguugggguuaugguaguaagagggcagacaagguaggccucagugaagagggcaaugagugucuaggaaggcuuguggagcagaugucgaggucaggagugugaaagcagaucauagaggggccugggcggcccugagugguacagccugagugcugguuccugcuaugggugagaauaggaaccaguucaggcccuugggccuuugcacugacuuccacuuuaaagaacaagcugcucuguuuggaguauaaacugagggcacuggugggaggcccaguggcgggguggggggguggggggggguaauagagauucagaggcauaugaagagaggagucgagccaccucucagcucgugcagaguagccugaggaacaguguggccagcaaaguaguggucacaaguuuucugaugauguaggcauuugcaaggaagaacaguuccuuuaguuagauuuuaacauucaaauggaagcgccuagcaacagcuaguuauauuacuuucugaaggggaucuugggcuagugauaggacuguaagaguggccagcauuuacagagccugagaggugaagggugacaagaggagacgacaauugaauguuucuuuggcagguagugaaccaagaaaggaaucaaaggaagcagaaggaggcagaaggacauugugcaccuaauguaagcacagcugagaagcugccuuagaagcagaaaggcaaaggaaagacuauuuuuaaccaauccauuguuggaggcuguugaugaaaguuggggaguuguuuuggagaccaaagcuucuuugaaguguacauaggagaaaaaggagagugggacuauagauuucucuccugagguguccuucaaagacacgcaaagaacugggaugaugagggucacaaguuguuaaggaugagaggcaggagacugaggaaugauggcaacacugguccuccacagagcauggugaggggauggcgacuagaguguaacuuuagaggauugcgaaaaguuccccucugcugcccaguggcugagugcauguggugccgaaagcugucuucugauccucucuuuagugagaaagcagaagucaucuggucaggggcugcaggcgguuuggaagaagacgaauuagucuuugguuuuuugagacaggguuucucuguauagcccuggcuguccuggaacucacuuuguagaccaggcucgccucgaauucagaaaucccccugccucugccucugccucccaagugcugggguuaaaggcgugcgccaccacgcccggcugauauuugucuuuuuuaugucuaaugcuuuaaguguaucauagucauaaguaacauacuaagugucugacauuguccacggguuucagggacgugaacaccaccaucauggagcugcugaucaugguauaugcauguaagaccucaugugccaagagcaucaucggagugauccccuacuuuccuuauagcaagcaaugcaaaaugagaaaaaggggcuccauugucucaaaauugcuggcuucuaugaugugcaaagcugguaagaaugacagauuguuuguuuguuuguuuguuuguuugugacagggucugucuauguaguccuggcugucuugaaacucacuacauaaaccaggcuggccucaaauauauagagauuugccucuuucugccucccaaggaggaggcuaaaguuuugcgccaccauggcagauuuguuuuuggccuuagaaauuucaaagcauuaucuugacuagaguucuaaagaaaguacaaguagugaaacagacaguuuauacaguggaaagaugugcuggucacucagcagcuagcugccugaaacccuggugugccagccccacaguaucacagugguauguuucacacaccacuaaguggcagauacagcaccaguacacuguccuaggggaagagaaggacaucacaagauuuggugacauuauuccuggugacaugagguuuaaauuugccaauuauuucuuucuggaacuugucauuaagugguuuuggaucauggauaucugaaauuaugagaaguauaccacagguaagcuggagucuaguuuaauuagaaaacuguaauuugcuaauuauuggaauucuaauuauucgaauuggaauucugcuuccaauucacuaagauacaaauaauaacaacuuuuguuauguuuuuuccugaauuacuuguaacauucauguugauaugucauauuuuuucaguaauauucaaguuucaagaggagaaaaauaauuuucagucuuuuagacuuuaauacaggaaccauuuugauuuuacaaauaguuauauuuuuauaaaccacauguucuuuucuguuaaacauuuuuagguaacagccuaaguauuguaaaaaccauuuuuauguuuuuuaauucguguacagguuauuaugugugugggucaaggggcaaauuugggcauuguucucaggugacauccaccuuuuuuuugagacaggaucucucauuggccuggagcucuccgugugggcaaggcagcuuuacuucugcuuccuguuucucaguaccucuuuccuuuucccugguaccguuucuagucucacagcccauaccuccauauuaauacaugcaaguauuaaaggguaggauccacauaugaaagaagacgugcauauuugucuuucugagccuaaauuauuguucaauauaauuuuaagauuaauuuuuuuacaaacguaauuuuucuuuauagcuggauaaaauuccauuguguacaugugcuacaauaucauuaucuguucaucuguugauggacaucagguugauuccguuuucuuguguuugugaguacagcagcaguauauguggauaugcaaguguuuguguggcagagcguagagaccucuucaugucugccaagcagugguucaacugggauaggugguaguucuuuuuuuauuguauaucucuauuuuggcugaauuauuucuguguaccacauguuuguaguacccucaggccagaagagggcauuagauccucuggaacuagaguuccagcugucaguugcccgaugggugcuggaacugagcccaaguccuguggaggagcaacuauugccuuuaaccccuaagucccuucagccccugguagcucucucucucuuuaauuuugugagaagccugcacauugauuuucauggugacuacauaaguuuauaccucacuagcaacaguguuucucuuuagccgugucuuugacagcaauucuuguuauuuguuuucuuggugguugcuguucuagcuagggggaggugaaaucucaaaggcuggcagucuucuguuuguuuacuuuuucuaagacagggucucacuaagugaccaugucagccuuaaacagcaguugaaaagcuuaaaggaaugcaucucaccacauucggcucaaaguaguuuuaauguuucccugauggcucaagaugucaaacacacggguauaguuguugcucauuuguaugacuucuuuugagaacugucuguucagucugcucaccuguggaaugcuuggcaauuugagggucuuguuuucuggggggguugguuuuuuuguuuuuuuguuuuuuucauuuuucugcuguuuaauuugugcauuucuuuauauucuaaauaacaccuucccuaucuaacauguagcuagcaaagguuuucuccuguucuguaggcuggauguucauuccacagccuaagaauuuuauauguguuuguacauacuuuaacagaugucuguguugugugugcuuguaugugaguguacaugauuaagggaggcauacaucacagaaguuugugcagacaaaggacugaaacuuccccaggucaccacuucuuacagauacucacuauagaaaauacauuuccaaaguagcuuuaaaaagaaggcagaaacaaaacacggcuuuaaaaaauauaaacccuagcaacuucaguccuggggaaccauaguaguuauuuauguuauugaugugacagaacaccugacaaacacaccuggagggagagaacguuuauucugacucccaguuugagguacaauccaucacguagaagguaagguagcugggccuuccauacugcacuuucagucaggaagggaggaaggacagauacugggcucagcuaguuuccuccuuauucacacagacaucagcccaggugugaugucacccaaugaaucaucuuuuuuuuuuuuuuuuuuuuuugguuuuucgagacaaggauuucucuguauagcucugacguccuggaacucacuuuguagaccaggcuggccucgaacucagaaguccgccugccucugccuccgccucccgagugcugggguuaaaggcgugcaccaccacgcccggcccaaugaaucuucuugcuucaguguaaucaaaauaacccucauagucaugccagacacugaucacucacaugugucucccagacucaccucuaggugacuguaaauccuaucuaguugacuuauuaaccacugaaccccuuugaaacacuaacaagcuuugacagaggaaacaggcuagcucacugagucuucuggacgcuuucuccuuucucuuauaggcuuggauggaccacacagguucagcuccuuacucuuuuggacaacacuacuucuaaaauguucucguaccuuuuucuguuaaucauuucagaugucacagugugggugaagaggucuugguaucuuauguuggguuuugucaucccugcuaaggaaaauuguaggagagacaaucagcuguaaaaacacuuguagaaauauuucuuuguuaagauuuucugcuguuucuguacuuuaagggcuuguuguugauuugcuuauucguuuguuuguuuuuuucaagacaggguuucucuguguagcccuggcucuccuggaauucacucuguagaucaggcuggccucuaacucagagauucaccugccucugucuuccugaguacugggauuaaaggcgugugccaccacuaccuggccaaaggucuuauuuuuauuuauguguaugugugugugcauggguaugugcacauguauguugguuucuagaggacaaaagagggucuuggccuuuggaacuggaauuacaggugguuguaagccuccuaacauguaaccagacuuaauccucugcaaguuauuugcugagcuaucuuucugccccuacuucugaucuucaaauggaagugaaaaucauacgucuaauauuaccaaaauuauaagcagaggugccagguuuucaugauaggacaguaugugcuuggucauuguuaucuaggugucuuagaguccugugguaccgugacauguuuaacuugcuuauguuugaaggucugacucaucucaucacuauggauuuacaccagaaggaaauccagggcuucuucaauauuccaguggauaauuuaagagccuccccauuccuguuacaauauauucaagaagagguaagcuagcucuaacuuuuuauguuaauauucugggaugauauaguuucuguuucuuuuaguuuuuccuaaaaggccaaaacuuuauguauucuguuauacuucauaaguacaagucucuaaaauuucguaucuguagguuuuuuuucacucagcucuuuuuuccccaaauuuugcuuauguguguaguuguuuuguuugcauguagguaugugcaccaugugugugccuggugcccuuagaggccagacguguacaucaguuccccuagaaauggaguugugagccccuccagguggugcugggaauugcauccaugucccuggaaggaugcuaguugcugagcccuugccucuucaccucucuccuuauauuuauugccuuauaugaguuccucaucgcugacuuuuucauccauuuugcuggccuuucccccuggugucucauuucaucagcccucuuuuguuaauuucugaaggaagacugucucuguaaaauaagaucuguuuuuacuuaagcugacccuuuguuggaccaugcagaggcagauucuauuccaugaucuuacucaaaaguuuccagaauuuguuaguuuuaugaguauuuguggucugcugauuuagaagucuuuugcauguuugguuugugccacacuuugguguuuugcuuuuaggagcuguuguuagcacauggaguguuucucuguaguaacuuuuccagagagcgucauuucuuggugguguauuuaagggcagcacuuucuacauuucuaaagcguguuuccugguugacaguccaggccuuccucauaggccuggucuuugguucuuugucugcggugguucugucugguuggcugucaucuuucuuuggcaggguuuggcaggcaugacauuagcugcuuuucuuguugagcacuaguacagaagggucugacaaaagcagcugacaggaagggucucugcugaccagcagggucagagcgcugucagaguggggaaggcaggcuugacugcagcaugaggcagcugcuuacacagcacccagucaggaagcccagaugugagugcugcugcccagccgucuucuccucuucccuccuuaggcaaaccuuucugaaaacacucuuggagauaagacacaaaggucugaugguucuaaauccacuuagucuaaauccacuuagguuuacagucaagauagccaggacaaccauccauagugaagugauuuagaaguauauuugaaaagaaagauguauagaagcugagcagugauggcgcacaccuuuaauucuagcacuugggaagcagaggcagguggguuuuugaguucgaggccagccuggucuacagagugaguucuaggacagccagggcuacacagagaaacccugacuuggaaaaaacaaaaggggguggggggggggaggaagaaaagaaaaaaaagguguauagaauaucugcauguuuuauaagacacauuaaaaccaguaauuaaaaauaauaugcugggcugugaugaugcauaucuuuuaucccagcacuugggagacagaagcagguugacaucugugauuuugaggacagccugguauacagagcaaguucuaggacagccaaggcuacacagagaaaccuuguugcaaaacaaacaaacaaacaagaaaacaaaacuauagaagauagauagauugauagauauucauucaauuuuuauuuacugauuuauuuugagaugaccuucuguuuguuacccaggcugaacucugggaaucaaguaauccuccugccucaaccuccugaguguucacauuguaccuggcuguaacuucuuauuuuugugagauuggcacuuacugugcaggccaguuuggaguuacugcacuuggcucuugucuuggucuaagcacuuggcuccuugcauaaugguguccugggcaaauuggcucucuccucccagacuucucaggagcucauuucuccuguugaccagcgacugagcugcuuguuuggacugauagcuuccuccuaguuaugugguucuuucacaucaaaccuugaucuguuuauaagauuuccuguuuuauccucugaagacacaaugagccuguuuuuacuagaguccuuugguuuuauuaagggcuuuguuggcugcuaugcugucucuuggcagggugugauguuauuugaugaggcaaagaaagaagugcaugaaauaguucagaaaaacuucuggcuaaaacaaggugccuaaaugauuucguguuuucucucucuccucucucucuucucucucuucucucucuuuugccugagaacacugggcaggugugucuuuucucuaccugaaaguccaaucagcauaucuguguguguaauuuuuauuuguuuguuugguuuuccgagacaggguuucucuguauagcccuggcuguccuggaacucacucuguagaccaggcuggccuugaacucaggaauucaccugcuucugccucccaagugcugggauuaauggugugugccaccacgcccagcuguguguaauuuuuuaaaauucaccuuacaucccaaucagcccgcccugcucucuucccagucuucccauuacaaaucccaccugacauuacucccuccccuucuacuuagagagagaagggauggugaucauuuuguuccuuuacugagcacuuguuacccagcgggccuuuggaugcuuacaaccacuguguuaagauucaguguugggacuagagagaguucacagguaagagcacugcaucgucuucccagcauccacaggguggcucacaacagucuguaacuccaguucuggggaccuggugccuucugaccucugcaguaccaggcauaagcugguacauagacauacauguaggaaaaacacagcugucacuuuguuuguuuaaagggcucuuaagcccuuuuauuaagagcaguaagcuaacuuuccuuucacaaauggcuuuccucagcauggaguaacugcaguguauuugucacauguuugaaccacagaauuuuagaauaugacauuaacuuggauucagacucaauggauaucuuucuauugugaaauuacauuugaugugggauucaugaaaagucuuuauuuauugaaacaaagucacacuagccuccuagacaauugggauuacaaggcauacacaucacaccugguuugcuucuguuaauuuuuuuguuccuugcuuuuugaggucucucacugaacauggaguucauugauucgcuagauugccuggccagugugcuuuagggaucugccugacucuaccuuuuauaaucaccccccacccccacccccacccccaccccccagcgccacucccaguguugggguuacaaacacaggcugccauacucagcuuuuaugugggugaggggugagcaugcucagcucaucacacuucuccagccaucagcuuagugacugagccacaucuccauucucucugcuaacuuuuuagaagagcacuuguucuacauuacuggguuuuucuauauagguaaaaauauucauguugagaacauuuucaucuuuauuuuccaaaggaagauuuugcuuugaacuuuuuuuacaagauugauugauugauugauugauugauugauuuauauaaguacacugucacugucuucagacauaccagaagagggcaucagaucccauuacagaugguugugagccaccaugugguugcugggaauugaucgcaggaccucuggaagagcagucagugcucuuaacugcugagccgucucuccagaccuuaacuuuuuuuuugcugaaacuuuaagucaaaugauaauuuuuaauguguuagaacauucauguguguugguugaugaaauagucucuuagagauaaaguaguaaucccaggccuuuuguuugucacagaucccagauuauaggaaugcagucaucguggccaagucuccagccucagccaagagguaggugggacugugucccgaauguauagauugggcugcaaugguuccccugaugccccucacuuuucuuccguggacuaacuuaguauuauccugucaccucuaauguuagaaagauauuuuaguuuguucauuuuucuccaaucucaguuucuccaaugccagucauauuucuuucuucuuuucuuuauguuaugcauaagugcucagucugcauauacaccugcaugccagaagagggcaucagaucccugguuguaagccaccaagugguugcugggaauuaaacucagggccucuggaagugcuuuuaaccacugagccaucucuccagcccccagucaguguacucuuaacugcugugcuguccagccccagucauguuucuuaaccaaccagagucaucccauccaaggaagacugaccuaguguauccacuguuaguccagaccugucaguaaaguccuacuuaaagaaagguaucucugagaguaaaggcauuugcugccaagcuugaccugaguuuaaucccugagacccauaugauagaaagagaaccaacucccauuaguuguucccugaccuccauacuccuccacccuauguuaaauaaauaaguaguuuuggguuuuguuguuguuuucuaagacgggguuucuuuguguguggcccuggcuguucuggaacucaauuuguagacuugccuggccucaaacucacagagccccaccugccucugccucuggaguguuaagaguaagggugugugcuaccaugccggacaguaaagguaagccaggcagugguggugcacgccuuuaaucccagcacuugggaggcagagacaggcagauuucugaguucgaggccagccuggucuacagagugaguuccaggacagccagggcuacacagagaaacccugucucuaaaaaccaauaaauauauauaaauaaauacacacacacauacauauguauauaucagcaugagcaggguauggggagcagaccaguaagcaguaaauaaguaaauaaauaaauaaauacacacacacacacacacacacacacacacguauguaucagcaugagaaagguauggggagcagacccauaagcagcauuccucugaugucucugcuugaguuccugucuuggcuucuccuacugcuggucuguugucaggaaauguaagcuacauaaagcuuuuccuccccaacuugguuuuggucuuggucuuuaucguaacaacagaaagcaaauuaggacaguaacauagcaugagaaacugauucuuuaaaagaaaacugaaggggcuggguuuauaucugacaaacugguucagugaacauuccaaagaauaaagaagguuuuuuucaugaugagaaaagaucacuucuucagagugugcagugacuauaaucauuaugaacuaguagcuguaaggagaaaggcuagccucagggauggucaguagucucauuccuccucugucagcaaaacagacagcaucaggaaggccacuaagcaccaggucagccggccuccaggcuguacaauggacauucugugcuguaaagcaagucuugaguuuaaaaugauguaaguuggaccuggaaagguggcucagcaauuaagagcaauuaagcagccacuggcugcuuuucuagaagaccuggguuuuauucccagcacccacaugucagcucauaaaaauccucugcuggccucugugagcagcaagcacauacauacuguagacaaaacacucguccugcacauaaaauuaaauaaguaaauauuaaauaaaauaaaguacagaagagguguguaagaaucaucccuaacugcaauuccagggaaucugaugucugacugcacuggaggugcauagacauacaugcaggcaaaaggaaaacuguguuaaugguuuaagucauauaaacuguauccauucuuuauugggggugaggggcagggcccuucucuguauccuacacuguccuugaacuuaaaacauuccucuugcuucagccucccaguacugcgaugguguacaugagcuaccacauccagcuaggucuagauuguaauggugaauccugucacaccaugagagagcaaaugcuagccuuauaaagcaucagcagauacauuccccuuuccugaggccuucuuuacccgauagcugauaucccagugaacaauuguaaaguucuaaaggaacuuguuagcaaacugaaugaacggugcauaaaagaugaccacagugcccuucgggcuuaucacuggaaccugagguuggugcagcagcuuuaaaggucuaugaaugucaaucaccauguugaggaacaagaaagagaagccacaugauuaugugacucagagauuuaacaaucuagcuuaaguaaaaccaggaauagaagggaacuuuuuaaucagacgaagaucuguaaacaacagaucugacuucccaguggugaaaacugaugcugucccccagcucuagaacaagauggcagcaucugaccuuuuccucggauccagacagcacugagguucuagauggcucagcuaagaacugcuaagagugggugugaugcaaggacggcuugaucacuuauauaggguguauucacuucaguaaccuuguaaauaaaagauccauacaugcuggauggacaccucuaaucucagcacuugggaagcagaaggauuucuaugaguuucaggacagccuagucuacauagcgagucccugucucacauccagcaccaauguuaguugucacaaccagauacucacagaggacaguuccaggaucugacucccucuugggcaacugcacaaauguucauauacccacaacagauacaucugaacauauaauuaaaaauaaaauucuuaguaauuaaaaaggaagaaauggaaauaauuugguuucucaucaauaaguaaagagauaaacagcaauauauucauauacugguagacuauaacuuggcugaaucgccacaacacauugagugaaaaaaaaaaaaaggggacacuaaaggcauacuguaaucagcaugcauggaggacauuaaucuugccagaaaggugaugggcagcugccagagccaaaaggagaaguuguaaagggccaaagauuuuacuugaugcuaguagaacaguuuauugucaucagugauuugaugccaguauggacauguauuugccacauuagaagaaauuauuuggagagcaugaaucugaugaauguauaaagaucucucagguugugaaguugugugcuuggagucccauuaugccuucauaaagcuuuaaaaaguuaauauauaauacuuuaaugagucuuuaauggucguuguuucacaugguugauucccagagaagucucaaagauaguauuagcaacugcaaaaaagggaacuugaggcugcaagaagauuccuuaaucagaacuuggguucugauuggcugaagagagguagaugcucaucugugggcuccauacucagucuuccugaaucugaagugggcauucucuuuuguucuugguuuuguugguuuuuugcuuuguuugggguuuuaguuuguuaguuugguuauuugguaguuuaagguuuuuuuguugguuuguuuuucuguguaacccuggcuauccuagaacucaaucuguagaccaggcuggccucaagauccaccugccucugaagugcugugauuaaaggugcguaccaccaccacuagguggucauugucuuuuguaauuacuccuuugggagaaacaucuugcuuuuguucuuucguaucuugcccaaacauuggcaggcugccucccgguuuugauuuguuucuaauguucuuuucagggcacaaucuuuugcagagcgucuacgucugggaaucgcagugauccauggagaagcacaggaugcugagucugacuugguggauggccggcacuccccaccaauggucaggaguguagcugccauccaucccagccuggagaucccgaguaaguagccacaaguaccucuuugccacuguucucugagcugcuugaauuaauuauauuuuguuuuuauguguaugccacaugugugcaaauacucacagaugacagaagaugaugucagauccccuagagcuggaaucccgggauauugugagccaucugauauugguacuaggaaccaaacucagguccuuuggaagaguagcaagugcucuuaaccacagagccaccucugcagcccauggauucucuuugguguguguguguucacauacacaccaugcauguuuucagacgcacaugcaugucagagguccaagguccguguuagguauuuuucucagucuuuuugucuuuuccuuuguuuugagacauggucucucacuggccugcagcucaucuguuauccagacuggaugugcagcaaguacugggaaucucucuagccugggguuauaaacacacagaacuacacccagguuguuuuguuuuguuuuguuuuguuuuuuuuuaaccuagguacugagaacccaaacuugguccucauuugcuauuuuacccauguguaaccaucuuccuaucuauccuuucuuaacuuuuugaguuggcaaacacugauaauucccuuccugguugaauuaaaauagcuguuagccuuugagucauagggcccaaagacuaggaaaauggucaucuauuuggauucaguugcaauaccucuggaagcugcaugcaucuguucagugcauguaucccagagcuugcuggcauaagcaggaaguuuauuuaugcacaaagcuggucagcguuauguuauauggaaugcaaagugcuggacagguuuuauguauuuagcauaggguaaggccuaaccaauguuaaauguauuucuaaguauuuuauucuuuuaggugcauuucugcauggcuaacuguugcucucuaaauacucaaaacugcuuacaacaaaagaaaacguggccgggcagugguggcgcacgccuuuaaucccagcacuugggagggaggcagaggcaggcggauuucugaguucgaggccagccuugucuacagagugaguuccaggauagccagggcuacacagagaaacccugucuugaaaaacaaaacaaaauaaaauaaaaaaaacaaaacaaaacagagugaguuccaggacacccagggcuauacagagaaacccugucuugaaaacaaaacaaaauaaaacaaaaaagaaaacguagaaugccaauaaauaaagucagaauacacaccugucugucuuucuguccugcaaaguggucugcuuggcuccccuucugauccugaugccuucuguucuuuucuugacucauauuacccagugccauuggggcagagugguccaugggauguccuugacugguuccucuuucuaggcaacacuguggggcaucaugucaccugauaauuuuauaguuauccaucauaauuaaggaaguuccuuccucuuuuaaguacugggagguuuuguuuuauuuuguuuuguuuuuaauaaaacauuaaauucuuguuguuguuuuggguucuuuuuagguuuuguuuguuuguuuguuuuggggguguuuuguuuguauuuguuuugaaacaggguuucucuguguagcccuggcuguccuggaacucacuaccuagaccagucugaccucaaacccagagauaacauuugugucugccuccugagcgcuggaauuaaaggcacgugccaccaugacuggacacauuaauuacuuaagccuuguaagucuuuguuccaccugugagcauaggcacugagguguguguuucauucugaccagugcugauuccuaaagagaagcccccaaucacaguuguuggugauguuggaggaagaaucgccaucauugugguauguaguucuuuauuguuaccacuguugcucuguugacuuuccuguaacugugugcaugaagacuacgggggucguguggccgggcuaaguaucauggcaguugguuggugccuuaugcuagauguuaacuuuggcccuaaacagaaaaauuaaugguuuaagaaaaaaagucauuucuauauaauuacaagaauaugguacaacuguugguuuucauauucugggaaguuguuuuuuaugguuaaagugaaggacaaaguugauuauaguuuuaaacaaauugacaguuaagguuguaguucaauaaggccuuggauuuggucccuaacaccacaaaacccaaaacucacaucauuucauacauguauacuaaaugaaacacugaagaauggaucaggcagcugcagcucacugcuccccuggggagagagccagggccaagcccaccagagacugucuuagccuaagagucuuccauucaugacauuacugaacuuuacugucuaccaagagugcugcuuuuaaauguaaaagacauuuggccuuugggguuggagagguugcucagugauuaaaagcauuugcuauuccugcagaggacccaaauuugguucccaacacccacauaguuuuaaaacugccuguaacaacaacaacaacaacaacaaccccuucuccuccuccuccuccucuucuuccucuucuucuucuucuucuucuucuuuuuauauguaaguacacuguagcugucuucagacacuccagaagagggagguugugagccaccaugugguugcugggauuugaacuccugaccuucggaagagcagucgggugcucuuauccgcugagccaucucaccagccccuucuucuuuuuaaagauuuauuuauuuaucauauguaaaugcacuguagcugucuucagacacuccagaaaagggcaugugaucucauuacagaugcuugugagccaucaugugguugcugggauuugaacucaggaccuuuggaagagcagucagugcucuuacccgcugagccaucucuccagcccuguaacucuacuucuaaggaauccauuuuacacaggcaaaacacucauacacaucuauaaaaaauaaagacuugaauguuuguaugaagagugugucugugcacacagugacuuuugguccauguuguggcugauccgccuaguggugccauguguucuuggagugcaguggaggcugugcuuuggucuucacuacgagguaguauguuaggauaccguacagcugaugcaucuguucuucauauuggaccauuucugauuuuucuuaauucccaauaacacugcuuugaccauccuuauaacuguuuucuggugugucacaugcaccagaguuucuaaaggauagcuggagucacuggguuugaaaguguuguaacaggcucccacaccccaucauagguaccuuguguuuuuaacuugucuggugauuuuguuuguauccuuuucagggaucucccgugucaucccacagcguuaagcugcaugcuaguuuauuccauggacacaggguaguggcaggaggugcagauucagcacagugacugcaggcuuucuucuccauguggagcugugcuuucuuuuccucuaauacuaaggguugaacccaugaacucugugugugcuaggcaaguaucuaucauugagccacaucuccagcccucuuuauuuugagacaguuucugaggcuggucuuaaacuauuucuucacgucagucagaacuucagcucacaaucuuccugcuccugccucuucaguagcugagauuacacaucuguaguguuagaaucugcuuagauauucuuaaaaaacaaagaucaccgagaugguucagcaaguaaaggugcuugucaccaagccugaucaccugcaucucuggaacaaucgaagaagagaccugaccuccacauacacuuagggcauaugugcccacgcuugcacacgugcacaugugcacacuagcaguaaauacgguuuuaaggggcuagagagauggcucaaagugcuuauuucacaacaugagcaccugaacuugaaucccucauaaaguuggguagugcagcuguaaucucaguuccccugugaugagauagccggcagagcagagucccagaagccaugagucagcacaugcagcaucagacauuuagagacccugacucauacaagguggaccaugaggaaugauacccgagcuugucacugcacagaggccaccuguacucagacacacgcacauauacacaaacccaaaguguaaaaaccaacauuuuauuuuggaguaguuuagguuuacaagaaguaugagauacugugcaggagguccugcaggcucuugaccaugguuccacugcaugcugccucguuuuuauguuagcuugacacaggcuggcagcauuuuggaagaggaaaccacauccuaugugcaagccuguggugcauuuucuuaauuagugacuucaugugagagggcccaguccauuguuaguggugccauccuggggcaggugguccuggguucuauaauaaagcaggcugagcaugccguaaggagcaagcugguaagcagcucuucucugugaccucugccucagcuccugcuugcagguuucugcccgagucccucagugauggacuuuguuguagaacuggaaacugaaguaaacccuuuccuuuccaaguugcuuuuggucaugguguuucaccagugucauagaaaccuucacuaagaacuuuugcuaaaacuuugguauaguaguaauacaugcaugcuauggcauacccacccacacacaaacaguacacacauaauaaaaaauaaacaaaaaaaaugcaauagaaaagaauugccaaacugacugauguccauuauacuuuuuuuuuuuuaaucuaaagacagggucucucuacauaguccuggcuagccugcaacacuguaaagcaggcugaccuugaacauagaguuuugaucugccugccucuuccucugaguucugggauuaaaggugugcaccaucaugcucagcuuucauuauauuuuuuaaauuuuauuuauuuaauguaugugaguacacugucacucucuucagacccagcagaagagggcauuagauccccauuacagaugguuaugagccaccaugugguugcugggaauugaacucaggaccuucggaagggcagucagugcucuuaaccacugagccaucucuccagccccuccaaagacauuucuuaagcagagugguauggggugguguguauucccagcuacucaggagacuaaggaggggggaaucacuugcucagguauucaggacacccugaacaacauaagacaaguguugauguccuuuuguauggucuuugauuugacaggaugacauuauugaugauguggauagcuuucuugcugcagcagagacccugaaggaaagaggugcauacaagaucuuugugauggccacucacggcuuguuauccucugaugcuccccggcugauugaagagucugccauugaugagguaguagggcuggcggucagggugggcuuucugaguccuuaacagcagagcaggaaugaguauaagccauuuuaguuaagaauaaagaugcaagccaauaggguagcccaugacuuuagucucagcacugaaaaggcugagacaggaaucuugucauuaguucaacauuagucugggcuauggaguaagaccaugucucaaaaaauuaaaacaaacaaacaaaaggaauggaugaaaaaugcuuguguuugauuuuaauucacuguagcuuucccauuugagugagguauggcuggauucaguucuggcuuguauaccguauuugucucccaccuccagugugugguacagugaugguuagaaugcuccaguuguaugcugggcacccagcugauuuaagaggacacauccucugugagcuguaacuacacacucccuucuagucccuccuugcuugcuuucucuuuggauuuguucaugugcucaugucacauauaauauguggucuguaaugaaaugugcuucaacauguugacucuuccuaaguugauggaaacuugagguguucacauauuuuaaaacuuauuuuuaucuauuauuuuguguguguuauguguauauaugaauauaaguucucguauagaggucagaggacaauuuucaggaguuagguuucucugaagcuaugaagaagagacccaacuccagccccaccagcaguaacggguugcaguuucuccagggcuuccccagcauuuguagugucuuuucagcuguaacugcucuaaugagugagguuaucagaucuuaaagcuagagcagcuuuuccuaauggaaacagaagcugugagagacagcaggccucccauagggugagccucagagacucaaggcugcaguacguuuuucaaacaaagccaugacacuggcuagcuuuuuuuuuuuuuuuuuuuucuuucuguuuuccagauuuggcuuugcucuguucuauucuauuugcuuuguuuguaguacuggcccuaaaccuagacauucacacaccagccguacacucugccaugaguccuaccccaguccugaggcugcucgggaccugacgcuuucauuucuugugcugcacaggugguggucacuaacacgaucccacacgagauccagaagcugcagugccccaagaucaagacuguggacaucagcaugauccucucagaagccauccgccgaauucacaacggggaguccauguccuaccuuuucagaaacauaggcuuagaugacugaacaguucuccuaugguagaacucccacaggucaagugggagcccagcguguacgcugggagggcccaugcccggccagacacacgugacccucccuuucccacaucuuccucauucauuccugugaagguacaaggaccagcuuuuuaauguugguuuagguuuuugugaguuuuagggguaauuuuuauaacagaaagaccuccucugaaaugaaagaaguuaaaaccugauuguuuuuaguguaaccauuuuaaauaauacacuugugagauuuuuaagcucagccuuuuuuuaaaguugcuugauccaacuguucaaaagaauuaaauaaaaugaucugcugucuacuaccuagaaucaaaaagcuacuguugguuccaacacaugaccuuuuuaggaacgcuuuuauaaaugggcauauagaguauguggcuguauuuauuuucugcaacuaaaaaaagaauaaaaccuuguguuuguuuuuuaaaccucu

SEQ ID NO: 6058 - RNA, 8004 nt, Mus musculus
uucaugaaugucuuggagucuguaggacucugaaggcaucauauccaagaaauggccauccuggagcaggaggcaagaggagccaaagacuagucuuguucuuucucuggcaguucugaguuuuaccgugcuuaacauuuacccuauucucuugcauaucuucuccuuauauaccuacuauugcaugaguuugcaugcaugaauacacacacgcagagucagcaaucagauuagcucgggccuuuguucagugaaaccccugcauuugauguaugauaaggacgaguggugaggucagcagaacugagcauguaccuucagggagaagagaggaaaucaugguuaaaauaucauaauaagugagccauugggggaugucucaucaugugaccugugaagcuuauauugguguuguauguucccuccaugaugacaaguugacaccagcucucugaaucugaagggguuguagcugaggauaguggcucacaccuauagucucagcauuccagaggcaaaggaccccccucauuuaucuaucuaucuaucuaucuaucuaucuaucuaucuaucuaucuaucuaucuaucuaucucuaucaaucaucugucuguccaucuaucguguauuuauucaucugucuaucuaaucuaauguauccauaucuaucuaucuaucuaucuauccauccauccauccauccauccauccauccacccagagacagucccacuguguagcccuggcuagcuugaaauucacugagauguccccugccucugucuccuuagugcuggaaauaaaggcaugggccaccacaccaugggaagauagugauuuugaguucagccugggcuacauaaugugacgcuaucucagauaacaccacaguuuuggguugaguggguuuggguggcaugugugugucuacaguauccugcuuccugaaagcaugaggacagucuuggugacuucugugaaguuucuuauggccuucguuugcaauauauccagcaugaggcagccauggguuuguagaacugguguugacaucucugaugauggcuuccuguggucagagaggcaguggggaaagacaaaagcaguggaugccugaugcuguggcccucugagaaguccaccagacuucugacucucaagcugcacuuccggagugcagcugcuggagcuuugcaggaggcaggugagccugucucauuggccuuuuugaggggaccaaacugaguucuagcugugcuuaaaauguaacaauuauuccagaacauaccagcuagcauguggcauacacaaacuuuagacucugaggaggaacauuucauucucaaaaauaaaauaaaauaaaauaaaauaaauccccuucuuccuguuuccaguaguccugaauguuagauaauuuuuuccuauggggucaaaguuaccgaagcauacaauugcaacuggaaaaauaagggacaggaaucagguguuggcaguuuuucuguuuucauuuguguguuaauuuuuaauauaaaugcagggugcaaagcauuaacguaagucaaaguguuucagugagcucauuucagcauacaacuuuguagcaauuauaaauaagccugucaaaaauuucuggacaaugccagcauuuuaaauuugaauuaaaaaaagguaaaugucuuauucucauucucucucucacccuccuucccuccuccuccuccuccuccuccuccuccucuuccuccuccuguucuuccuccuccucuuccucuuccuucuccuccuccugugcuuccuccucuucuuccucuucccccucuuccuccuccuccucuucuuccucuucccccucuuccuccuccuccucuuccuccuccuguucuuccucuccucuuccucuuccuucuucuccuccugugcuuccuccucuuccuccuccuccuguucuucuuccuccucuuccuccuccuguucuucuuccuccuccucuuucuccuccuccucuucuuccucuucccccucuuccuccuccuccucuuccuccuccuguucuuccucuccucuuccucuuccuucuccuccuccugugcuuccuccucuuccuccuccuccuguucuucuuccuccuccucuuccuccuccuguucuucuuccuccuccucuuucuccuccuccucuucuuccucuucccccucuuccuccuccuccucuucuuccuccuccuccucuuccuucuccucuuccuccuccucuucuuuuucuuugaggcaggucccccuauguaguucuaguuguccuggagcucacuauguaauucuggauauccuggacucacuuuguagaccaagcuggccuugaacucacagagauccacccgccuuugccuccugaguacaggcaugaaaggcaugcaccaccaugccgggcuauaaguacauuucuuacugaagcccaaagggagggggaaguagcagauguggucauggagguggccuugccucucacaggcuuuugucauauugucacagcgggucuaauucagcagugcaguaggcaaaguuugucccccgcccuugagugucaguaguugaugugaaggugcagggcacagaagucuuucugggcaggaggggcagugugcuuugccguccuggcauuguuuccagaggaaauaucccaaaggugacagaauuggcugcugccguagaaggcucgccucuagucccagcucacacaagggucucgggaacaaagaagcacauggguggaagauagaguacccagaccugaagcuuugaauuauugguuccauaaauuuuuguuuaccacuaguucccauauuuggagcaucagcuuacauaaauccauucguuauguuccuguuaagccaucugguucuuaucaccacaaacugggucagcaagguuucucagcagguaaacaccuuccaccaggcccgagaaccugaguuuagucccugggauccacaugauggaagaagagaauagacucccuauaagccuauaaguugcccucugaccuccauaugugcacugugguauguaccuauacacacaacacauaaaauguaauuuaaaaaagaacuuuuaagaccccauaaaccacuguugauaucauauggaacgguggcuaauuuuuagagagcuggcauggaauaacuucgggaacuauuuucuuuucuucuuuuuuuuuucuuguaaaaaaaagauuuaucuauuuuaaauauaugaguacacuguugcugucuucagauacaccagaaaagggcaucagauuccuuuacagaugguugugagccaccaugcaguugcugggaauugaacucaggaccuuuggaagaacagacagcacucuuaaaccacugagccgucucuccagccccuucaggaacuauuuucuugaaguauuuuuguuacuuuuguuuauuuguguguccugggagguggcacacagugugaggauuggaggauaacucugaggaguugcugucucuccuuccauccugagggauccagggaucaaauucagguugucagucuccguggaagguguccuuacacucugagccaucuugccacuaugaguuaaugaaauuaaguuguaugauguaaaggguugugugucaaaaugaguauuagcguuggugacagugcaggaacaccugauaccuugagcagcgguucuuguucugagagcagcuugggguccuuuucugggugacuguuauagauuuuccugagaaguuccuuuccucuuucagaagagacuugcuagugccuucuaguucagcuuugaauuacccauuacuucugcacugucauaauggcucuccuauugcagggcccuacgcugggaccugggugccuucuggagcuugguugggcagaaagcaggaaacacuuaccagcagguccucuuuuagucccugauggcguggcccuguuacuuuugggucuguggcagcccagcccagcaugcuaggagcacguggcagagggagccauccauuuauagugucuaggaagcaaagauagaggagggaggggcugaguuccaauuuccacagugguuugguuuuucagaaaggugucaccaugucccaguaggaauacaggcuagagaccaagccuucaacccacagaccuuucauguguaauucuauuuuuuuuaaaaaagauuuauuuauuauuuuauguauaugaguacauugcugucuucagacacaccagaagagggcaucaaaucccauuacagaugguugugagccaccaugugguugcuggggauugaacucaggaccucugaaagagcagucagugcucuuaaccacugagccaucucuccagcccuuauguguaauucauaaccagagaauuagcaccaugugauaugggggggggaaugugucacagugacacagugagaggugaucaaugacagguaaaugauggcaccacuaggcaugguuuguuuauaaagguuuugaagagauaagccgggcacugucagcugggugagagaacuauucuagagccucccagaggaagugcucuuauacagagauggaacccagaaugagcagcccugaaugugagcaucugggggaauucacacagagagaauagcaggcacagagggagcagcaggcacagagggagcagcaggcacagagggagcagcaggcacagggggaguagcaggcacagagggagcagcaggcacagagggagcagcaggcacagagggagcagcaggcacagggggaguagcaggcacagagggagcagcaggcacagagggagcagcaggcacagggggaguagcaggcacagagggagcagcaggcacagaguuugcuggaagaaagcagaugucugaagaagcugaagcaacuuguuuggcugaaguggagugggcaggcgcuagcacuagggcccagguggagagcuggacacagccugagaccuggggggucaugacacaggacuuggcuuuuuauuccaaaugcacugagaagugagaggccagcauguguucugugggaugugacacaauauaauuugugggguguguguguguguguguguguguguguguguguguguguguaucuuugcugaggcuugagcccagugucuuguguguacaugguaagcacacacacuacagcugaacagcacccccaggccccuggugagcuaugcuagauuuccauuauuguaacagaacaccuaagguaaaauuguagagaaugugcuggguacuuuuaugucaaguugacacaggcuagagucaccugagaggaggggaccucaacugagaaaaaugccuucauaagauugggcuguuggcaagccugcagagcauuuucugaauuagugauugaugugggagggcccaacccauugcagguggggccacccuugagcuggugguccuggguucuuuaagaaaagagguugagcaagccagggagaguacccuuccauggccucugcauccaucagcacuuuccuccagguucccucccucuuugaguucuuguucugacuuccuucagugauggacugcuaccuggaaguguuagcugaaauaaacccuuuccuccccaagucgcuuuggucaugggguuucaucacggccgcuguaaccuaaauaggacagagaggaaaggguuauuuuggaucacagugucagagguuucaggcaugguugauggccuccuggcgggugaaaggaagagaaugagauggugagaguauuguaguuggaggcuuccuccuuuauccauuucugaucccucaggcucuuggcauauuggagggugccacccuucggaaggcucuccccugcucacuuuccacaugucccaugucucugcaaauucccucacagauacaaaugcccauuaauuacccaguauaagguuucuuuucugcccuuugcaguguuggggcuugaacucggggucccguaaugccaggcaagcacuccacacuugagcuuuguccccagccccauaagguauuuacuguaguacccagaagggacuaagacauugaaugagauggaguaguagcccaggacugggugcacagggggcagguggcacugccuggccugccucugggcguuagcugccuucuuguuccuuagugcugaucuguaaacccuagaugucaguggcuacuuggcaagggagucaggaacaugagagauaaugaaaggauaugcuugccauugugcuggcucaugguugauaaauaguagcuucaaaauaaggagaaauggaugguuguuaggagaaagugaccaaucccagaggaaccugcagaagucuggugggaauacacagagggaugagggacguguugacgaagguuugugcugggcacaagggccuuucagaaacaggacaggggccugaucugcccauguguggacaguugugaguuugagaaaugagccuaggagagaguccaaaaugaugcuccggauggcugaaagcaagacgguacugaagacagaccaggaaguugggagcaagacugguuaugaagaucuauucaaaacugugcuaaagcuugugggagacaggcagacccucuggauaaguuugcagaucuggugggcagguggguaaagggucagacugccuaggagccccuagaagacccuuguggcuggagaaacagauucuagagggaguagacuuaaguucacuuuggaagguaguguuuaagugagccagccaaggaagcugggcggguguccuuaguuuccuguguuugugccaggcagggccaccagaagcacuaggcucacacacuagccucucuagcaugcugugggguggggguggggguggggguagggggagaaauggcuucuuugaagguuuuuuuuucccccuagcugcauccucugcaucuaggugguggauucgcuuuucuccugaaguacacacacaucuucuggauacugguccagcuccgucugagccguacuuuacucuccuccuuuauucuccccugcaggcuagcggugcagacggugauagcccuaggguucuaccagcucugccaugcccucauuccugucagcuccacucuguuucccagcaggcauuccaggcagagguggaggccugcaccagaugccucaagccaggacagaauaaauaugacucaggaugcuucagucugaguaggcaugaaagccucugggcucccugucucccuacccucgcuuuguucuucugccaugugcucuuuaaaacugcucccaaagaaagggcuccggggggaucuuguuuccaucuccuuuuccugaagcuuugucucauucccuucaagucucugaugugaaaccacaugauaaguaaggaaauaacugcccauuaguggucacuccacucugcaggccgccaacuccucgguucagcuuuggagccagaaggacaccccagacgaguaguucugagcacuugaucucaauauagccacagauuauagccucugcuaccaccugcauucuguauucaugaccgccccugccugccuugguuucucauuccgggcugugcccugucucuguuucuugugguucccacccuuggcagagugccuugauuuccgagucccugacaucauuucuucccaaguuugugauaugccagggcucccgucacuccaguguaccuuuugucugaggaugggaccagugaguccggguuugcagcuucucuucugauuuaguguggaaaucuuuccuuuuccccccguugaccacggaggaauuugcacuauugggauggcuucuuucaucuccaagccacaggaaguaaucauuuggaagcauuuccugugaccaacacugaagugugagggcagcuaacaguucuguguuccaugggaagcccagcaggugccuggccaggaccucaugaccccgacaccgcuucccccacugcauugcuaacauu

SEQ ID NO: 6059 - RNA, 14174 nt, Mus musculus
cccccggccugcagggcgcgugaaguucgcagcgcccgggaggagagaagacgggcggcgugccauggcggucgcgcucccggaggugguggaagagcuccugagcgagauggccgccgcugugcgagacagcgcgagaaguacggccugcgggcuuuuauucuuaccccgcaugguuaugucccugaagccugggccccuuaaaucgcuuaacuaaauagagggauuugagugacuagacgucagaucccugagugcgagccggugugcgggaaccccgguacuuaaagagagccacuggguacauccaaggagugggcgagggcugggaugcggaauggcagaugcguagacaauuucgaguuacucagaaucuuuauccacaauccgugaugcaaaguuuaaaaauaauacccuuguuuacuacuuuguuuaguaaauagauuuuacuaaaaaacauucagggaggcaaaaccuuuaaaaaaaaaucgggaaguugaaaauuacuucuucccucuggccuguagaggucgcccuaugccugucuccaacaaaaugaccgaccaaggaugaucuuugcuuacucaccagaguaggaggaucuaccaaaaggggaaaacuaguaaugaggaucuacuaugcagcucggcugguaaagaggcuugccuggcauguagagagcugccguggauuccccaccaccgcacaagacugggcacauggcuguagucuccgcacuugggaaguggagacaaaaaaaaaaaaaaaaaaaaaaaaaagaaagaaagaaaaagggaaaguuuaaggucaaccucagcuacauaaugcuaggccagacugggcugcuggagacuuuaucucaaaaaacuggaggugggguggggggugcuuuugaaguguagacuaauuaaagcacucuccccaaaaauagccucucuaaaugauagccaaauuagagcacaaaacuccuauuguucauugauugugcucugugaacugguuugaguuacugcuucaaugggacuagaaaaguaaacgaauagucucauuuuggucuuuuacguaaaagauucagccaaccagguauucaaacaugcuuugacuucaaagaaguugugggguguuagucuguugugaggucuugcuuccaggauuugaccacagauguucugagaugcuggaacgagaugaguuuuacagaacagggcuguugguuaauccauaugccaguaacugaaggggcccccuuacacaggagcagacucucaauuccuguuuauuuuucaguagagcaguuuucaguauugggucuggguauuccuuucuaauccccaaucuuccuugguaaccgugcagaauauaaguccagguugcauguauaugauuuugaccauauagaagcuaugauuuccuuuccuggguaacuugguuccccugaauuauaaccaucucggcuuucuaagcuuguuuaguuuucuacauauguauuuuuacuugaacuugaaauuuuaugccacuaucacaggucuccacucaaaauguuaagguaaaaaagacauuuuaucaguuacauuuucauaaaggaaucugcgaagagccugccgacuucccuaguauggacuggcugcuguccgguugggcugcugcugucuuccuucaguguuaacugggaauucucuuuucccaguuugggucuuguguuagcacauccuacaguuuacuuuccucuuguugauccacuuguguauuguuaccugucuuauuguaugcaguacacaccucaguagguuucugaagaaggcaugaacuaugcuuuugcggcuuugaaugucugaaaaagguuuuucugcucucacgcuugguuaaaagguguugagggcggccagcggcccacaugucugaguucuagccugggaggcaucuuggaaucuggaagaaaagagggaacuaggcggcacgagaaaggauggaaccaagacauuagucugaucaagguucaauuuuacuauuuggagacacgggguuaugaagaagggggaggggcccauucccgccaaaucauccuuggaguccaguuucaggugaccauguguuggcucuggaacagcuagguggcagguaguagcagugggaguggcagaacgauaggguggcaggcuucauccccaugcucucuuagugcuaacagucaaaccugaucagccagauuucaggcugggggggggggguuacaaaaagguauuaaguuucauguuggaaauagcauaucuucagaccucugaaaacauugucccauaauugucuagcauuuuguaucuagcauugcuccugaauuuugucgguggcuuuuauuuucucugggucuuugaauugcaguugcuccuagguauccaugaugguuaagauugcugauguacagucccuuugguaggauggcaugugacccauauucaccuuccuuuguacuuuauuuuauguauaugaguacacuguagcuguacagaugguuguuagccuucaugugguuguugggaguugaauuauuuuaggaccucuacucacuccggcccaaaaauuuauuauuauauacauaaguacauuguagcugacuucagacacaccagaagaggguauuagaucucauuaugggugguucugagccaccaugugguugcugggauuugaacgcaggaccuucggaaggguagucaaugcucuuacccggcugagccgucucaccagcccccuuuguacuuuaauaugcuugaaaccaucccuacaucacucacagcuccuguucucugcagugucagugcugaguagguagauggcauccuggguugcuuagagaaaaugagagaaugacauguuuaguagaggcucagagguuucagggguugguaguacugguuucugugugauuuuguuuggccucuuuauagcccaggcuggccuugcucccugugcuugugccuuuggcuucugagcaucccaguuagaagugugugucugaccuuuccauuucuuuuuaaacauuccacguguauggguauuuugccugcauauguaucugugcaccaugugggugcagugcccugagaggccagaagauggcaucagauucccuuguaccggaaugugaaccagcuggggcaugaacccugcucuuaacugcugagucguggcccagccccucaguucuuaucucguguuaggugaguccacagauguugguccuacggguguggagagccagcuauaacuucuuuaugaccaugauucucaagcuucugauaagauuuuguucaaguuucauuuuuacuucuguaugaauguaugaauguccaugugugagggagcccccagaagccagaagagggaguuggaccuguggagcuggcaguacagagguuaagagccacucagcaugggugcuagaaacuccagcugucugagagcagccagccagugcucuuggcgggugcaccaccuccagccccugguuuuguuuuccacucaaagugaggcucuacuaacuuacuugauagacauuuguuuuuuuguuuuuuuuuguuuuuuccuaguauucccaucccuugguuauagcauguccuuuauugucccugaauaauuuaucuccuguauuuaaucuuuuuaucccugccucugcuucuugggaaauuccuucaacugugucuuccagauuuucuaugagguuuuuauuucugauauuauauuuaauuuauaauuuucccugccguuuuuaugauugcauuagccuguuuguucugauauuagugauaguuguuggaacuuucccucugacuucaguguuuccucuaaguagauucuuuugcugauuuuuguucucuuuuuacuuaguugugguaauuuguaguugccguguuuaaggauagaaaacucaagcaaggacuuacagaccuuacuuacuuacuuacuuagcaugcgucuuacuagguggcuuagcugaacacccaugacagugcuauucccuguccgauggcucagauucccaaugagucuccugccuggagggugaagacugggagagcagcucagccgcaggggggaaaggaggagggcugguucuugcaggagccacguugggaagagagcagcaacucccccuggcuuggguguuuucuccuaguccuuucggaaauccucuauuagagccuuccgugaacaccaucagucaucugccagagggagcgacagccacccacagcugagaaaggaacggagacauccuucugcuugguugucuguuucuuuuauuuauuuaucuuugaggcacugucuacauaguccuggcuguuuugaacucaauauguagaccucaaacucacagagaucuaucugccugccucugugcagaggguuggggaggaggauggaagguucuggaguaugugccagaccagugcucaguucucccuaccgauagcugaagauccgucuuguugaggucugucuggaaaguuauguuccacuuucauauuugcccccaguguauuuuagcuguuguuuccccugccuccccauccuugggaacuaaugauucuuuaaauaaguaaauagauccuauuauugcuucaauggguugggaaagacguagaauuggauagauagguucuguuuacaucgucugcagugauuugggaucguuguuauaagagcuucauguuugccgugacuagucuagcaugacuaacucuccuguucccaucuuacaguucccgacgagcuucucuuaucguaaguacagacucuuguuugaucuauaaaaagaguuacacaguuuuaagagccagauccuuucaauguauuucuugguuuuuagagauaguaagagggcuggagauaagacuugcuccuauuccaggggaccagaguuccauucagaaggcacauaaccaccuauaacucuagcucugggggaucgaucggauacaccucaggccuuugugggcccugccaacacacggugaacagcauguaggcaaaacacugacacacacuuguuugguuguuuuuuaacguguaaaaacaaagcagaccugguggcaggcacagguuuaauugcagcccuuggaagguggaagcaugagguccaggaguucaaggccauccugggcuacagcagaagugugaggucagccugaccuauguaagaccuuggcucaaaaaacaaaccuaagucagaucuggagaacagacucagugguucccagcacagaccuugggaguuucccagaagccuaauaucccucccugacauccaugggcaccugaacacagaaugcauuaaauauacucagacauaugcacuuacacauaagagaaaccuucuuaaaaauaaauuaauaaguagaaaauaggcaaauaauaaaagaauacaaauauccaaaaaacuauugggggaaaugauaaguauuacuaauaaucauaagauacaaauuaaaagauaauuucuccuauaaaacuagcaaccccgggaaagaagguugacaggucuauggaugaguaauaccuugcuagcgaugucaguuggaagguagccugguaccuugguuaaugcucugcugugaggaccaucaugaccaaggcaacuuauaaaagacaacauuuaacugcgggcuugcuuaugaguccuugacauccugguagggagcauggcagcaggcaggcagacguucaggauauuagagaaguagcugagagcuuacgucucagccacaagcacaagggggagggggggugacuggaaguagcauugagaaaccuugaagcucaccuccagugacacaccuccaagaaggccacacuuccuaaucuuugccaguuuuaccaacuguggaucaaaccuucaaauauaggaggagccuaagggggcauucucgauucaaaccaccacaccuggcaacuggcaguauggcuuuaaagcauacauauuccuugaccuggauaucccacuuacaagaaugucacccaaggagguaacugugauguucguaaagacuuuacaaugaacagauucgcccaguacugaauaggacaacacaagaaacuggaaauaaccuacucaaaaauauaccuucaaauauaggagccuuuauguuuauggagaguaaaaaugguucacuuuuacaguagaguaacuuuuauggccaucaaaaguaauaaaauauuucauguguuuugagagauguucauagaagccaugaaguagacaaagccauuuuuaaaauaauugaaguuaaccgugguuaucuuugaguuaagaggcucuucagcaaauuccauuuccuuauuuuuguugguuaaauaaaucuuuauguauuugguauaagaaauucaaaagcacuccuucucaacuuuuccuaguacuguugugugugagacuagauucugggaaaaugaagugauacacaguuauauuuuaaacuuuauaagcagugcugugugugcauagguacacauacacauguacauacacacagucauuccgugaauaauaggauacaaaacauuaacaggaaagaaaccagcaaguauaugaggucuugcugcagguguagcucagagacagaguggauucugaacguauaugagggccugggcucacucggcaaugugggauagagagagaaagagaagaggaagcccaggcugaggaagggaugaauaaaugcuugccaaagagacagaaaggaaugaaaugucuggaagcucuuuaaugaagcaugaagagagcuugguuuuuugccuguaauaguauaucgucuuuuauuuuaaaacacacaaaaaaaaaucugaaauaaaugaacaagauguuaacacuuauucuggggagcaaaugaaaccauggauuuuguuucauggauugguuggguuuuuuuuuuuuucuaauuuuuaauuuuauguguauggguggguucuuuugcauguuugucugcaccacaugcaugcagugcccacagaggcuagagacgggcaguggaucucuuggaacuggaguuacagaugguagggagcugccacaugagaccugagaaucaaacucagguccucaggaagagcaaccagugcucuuaacucugagccaccucuccaacccaagccaaggggguuguuaauaauauuuuucccacauuaaaacuugggguuuuuuuuguuuuaaguguggggguuggcuagaaagauagcucaguuguaagcuguuuguuaugcaagcacaggagucugaguuucaucccagcaccacuuacaaaagccaguuccagggugugcuccuaaucccagcuccggccucacggcagcuuucagaccaguuagcaacccucuguaaaagaaguggauggcacuugagggacagcacacacaauggaggugcagagaucgaggcucagugguagaggugcuugcccaccaugcaugaggucucggguucagucuccaucaucacacacacaaaaccauaggacaguaaaccuuugugucaaguucucgaggugacucagaaucggccuuucuaauccagugucuuuguauucccuaggcuggaguuuguguuugggucaucggccauccaggccuuggaccuagucgaucgagaguccgucacuuuaaucucaucacccaguggaaggcguguuuaccagguagaagucuagagguggggauaaucaaaacacaaaaccuuaggacauaaaucuauucacagucucuguggaagcuaacaaccaacgugaaguauguacuaagcuuugugauauaacuuaguaaaguuaacggaaucauaauuuaaauacuuguauuuauuuugaauugacaagaacuauauaugacaauacaaagugacaucuugacauaugauaccuuauagcuucaugcuguugacacauccgacuaucucagaaaaccuuauaugcuuccuuuucugugaugagagcacucccuuacaaauucucaggucugugaugcauuguuaguuacuguggucagaaaccucccugagcuucugucuccccugacuaucuccauaagcuccucccccucaccccgaaugcugaacgcugguagacacuugcuucuguaagcuggacuguuuuagauuucacauacaaggauauguaguauuugauauuauaacaggcuuguugugcuuucauaguaucuccaaggauucuagaaauuaaagauaaauacaacuuuuugauucugucaguagcacuacauagaacuaacagugguguggagaggcucuuuucucaagucuaauggauaccagccucugcucucuuguugauuauagggguccuucucucucucucucucucucucucucucucucucucucucucucucucucucucucucucuccaagacaggguuucucuguguagccuugacuguccuggaacucacucuguagaccaggcuggccucaaacucagaaaucccccugcuucugccucccaagugcugggauuaaaggcgugcgccaccacugcccaaccauaaucucuuguuuacaggaaaaagucaaaaugguucuugaggccauuccaugugucuagaauaaucuuguaaccaucuaucuuucaaaacuguugucgccgggaagaacauuuuaggaaggacauggaaaugcuguggcuuaucaaguaugugcuugacucucagugguuaagaaagaugccgucaguggguaggaaaucucauuguuuaaacucuagcuucuagugaacuugucagaacuggggccaagacaguaacucucauugaaagauggugccagcuaauucuuagagaaugacuugaacagagccugcuuugacaaauaugugucccuccuuaugaaucuacuugcccuuauauugcagcccaccuuaaucgacuucggagguagaucgcugcguguuuccauuaaggaaaauggaguguggcuauauuuacaauuuuuggauaguacguuuuuacucaaagggguuuuucucaugguggacuucuagaugaacaaucagcuggagccacuaaguuucuuucuuguguuaucuuuuuguauuuuauauacuuagauuauccacgacuuagaucccuccagucuucaccauguuucuucacugcagaauucugguuucagggcugaagagauggcucagcaguccuucugcaaaggauccagguucagucccaugugcacauggcagcucaccacugccugucacuugaauucuugggaucugguacccacuccuggccucuguggucaccaggcacaaacguuauacaugcacauaggcaagcaaaacacucuuacauauaaaauaaaaauaauaugaauguuuuaauaagugucaggguaaaaaaguuuuuuggucucagcuucauuaccaucauaauaccugaccagaacaggacuuccagcugucccucacuuaugugaccuggcuaccagcuaaaacuguaaagaucuuguuuaaaacuauuuaauuauuuuuaugaauaugacuuucuuaaugauugucugccauguccuuuauuauauuguguuacuuuaucauuaaaaaaauacucccuagauauauagcugucagcuuugacuuugacuggaggugaaggagcccagaaaccuccgccagccucacaucaguccuacagugcacuguuguguauacaggaggacucugccuugguuccugguuguauacgauggaaaaugcugagucaaacaccgccucgauacccagcugguaaccaucccaugagucaaucuuuauuccauaguucaacccaauauuuucacuguccuccagguguaauguauaauuacuuuaaagucauccuguguuacugugagcugcuuucuaaacacauccugcucacuuaggaaggggccgcuucgcaacagccuggaaguuugcaaggcuuacagaacaaggcugaauacccacccuccuguacauccauaggaggcaaaugugguuccagcccugacauccucagucagcaaucccagaacauuagaaaacaugcaugcaaaaaucuuuaacauuucugcucagcuaugcacacucuaugagcuccuucacccagucuauaucaggacaggaacuguaaacccuucuuccagaaagagacaaacauuauagauguagcuuucugacguccgcagccugggaggcugcgguaguuagaagguuguaccuguccaugaaugauggucagggacgucuuacaagcuuccuguggucacuacacacuucccacccuugagacuccugugaauccaguccuggucuugaguguguucuuuccuguuuguuaguuuuuuuaaaucucaguuaaggagggggacuaaagggggcacauuccagccgaugcuaugaugaguggaagaacucagcaguuccuguaagagaggguccuucuuccacagaauuaaauuaccccuaaggucaauuuccagcucuaaacauuucuagcucagauuuuugccugauuauuggguucauuaguagucaacugcuagauaaagaagaagcaaauuaaagcauuuccugucuuuagaguaucuacugccccaggcauuugaccaguuuacuuugaaucuuaagcagccuuugggaaggguaaggcuuggaaaccucuguagaauuuaucccugucccuaaaucacuaggcuuugaugcaaccuuauccaggaggaagcauugugauagauccugaaccugcagagucccggaggcucugccugcuuugucuaaaucuagagagaaaagacaggggagccaaguaaagaaagacccuuaaagguccucggugcuccgagaccgugcuuagcccacggcugcugcgcgcuggggaguuugcuuuaggauuaagugggaagcggucagcucuaaugcccaccucacuauuuagacucacagguaaaauuguacugauagucaguggugugugugugugugucauguuccuaacacagcaggccuugggauaggaaaguguaagagguggauuuuaauacgugauguaaacuaaguccagucuuuaaugguauagaaaaaggacauuccuaguaaucuaaaaaucccccagaguucugcugacuuagucaacaaauaaccagaguagcuguaucauauuagcacuaggcagacacauagaagcacaguacuugagcauauuauuuccucuaguuaaggccucgcuuguuauucucagguuggagcaaaggauccugggacugcugacacuguaauuuuggcaaauccugaccuuuuguuuagauugccaucuuaaagcccaaauuuaauuugaaagccuuguggcaaauucauaggacaguccauuguaaaauaauuaaaauguuguacuucccuuucuugauaauaaucuacuucauuuggaaguuaacucucagaaugcagcccugugcuaucgcauguccaccacuauggggaauauccggcagaagucacuguaaaggagaauagguucauauuggcugacaguuucagagggcuccauccauggugccuggguccuguuauaugggccuagggcagcaccauaauuacagcaggaacaggaggcuaagaagaucccuccaccccacacccaggaagcaaaggcaggacaggaaggagguuagaaucccagugucuccugcaaggcaugcccccagcauuagcucccucuaacuguauccuaccuccuaacgguucuccauucccugaaugugccaggaaguaacaaccacacguuaacacaugugccuuuggaggacauucagaacccagacuauaacaagcuggcaacagaagugucgggcugcuuggugguaggagugguuucucuagcgaucugguugguccagucucaucacagacaaaucuuuuuuuucccuugaauuccuuuugagcgucaccaacgguguuugucguacugagccucucaccagcagccacgucuguguccuuccaucccuggaugaguaggcaggucugaacuugccucgggccugagaccuccguccugagcagcugagucagccccuucgcaagacugcuuuauuuauccucccacgcggaugcuucccgagcaucuggcccacucacucacacaccgguccuacuuucuucaccugagggcugcccugcuucugccuccgagggcccauuucauucucugggaauguaacagcagcuuuagaaaugucccugcauagugucuaauaccacagcuaaggggcccaugguagaauguucacaggccuucccuggccuccauuccagcccugcaggcugagaccugugcaucacaugaagcaaagccgccguguggaaggcugaacuggacggaggcucuuccacccuccaacgcccugggaagcugaagagaugaguuugcacgcugcaggaagauaacuugugcuguuccuuccguauaaaccccacuugagaccuucagugaugucuaugagcaacucugacaggcugaauggauugucaggaagcuguaccaggagcaaacuaacacuguccuguucuucccaggugcuagggaguucuggcaaaacauauacaugucuggcuuccugucauuacugcucgugcccagcauucuccuucucaguguuacggaagagugacagccugcugguaaggguggccucucgccacugcacacaguugugagaggagaggccagccucgugucagacuugagagacauuuuugggaggcggggcguuuacacagaauggguguuucccucaguguuggaagaaauugugguuuauugucuuagucaccuccuggauucagcccccacaacacagugucacuuugguauauugcuuuccugcguuuuuaucuaagagguccuggaugagguugugucggucagugagguagucuuggcagugagugcugggccaggggauggcccaguagagagagaaugaaguaagagaugcucccacaucauccccugcucauaaagacagccuggccucacccucaccucacacgcagcagggacgccuccaccuguaccucgcagcuguucacacagcccaucggacuccagagcauggaggaaggacagcaccuaucuguacaucccuaguucuaaagggaaagaaacacaccauccuccugagagcagauguuagucuuagucuugccaaaguagagaacaauaaagucuaccucguuccuacuuuuuuauauucuaguaccagcuuaaaagucuugagaguuuggugccaaccugagcaucuccauucauucauauacgugcacacacacacacacgucacuaacuacuaaccacuaguaagguauauuucaccuguaaaaugauaggauuguaccaugguccucucaggaucaaugcuguguucugugacauaggucugacagugucaucuccccacgugugugugugagaauuuccccuacuccuccuucccccgagaagguagcaaugccuaaaaugaaguagugguucugcacauucauuauagugaaguuggaagcggcuggguagcuauuagauccgcaugagcucacuggggaggagcucugagccagugucgugccucaaggacugucagccauugcuguaaccacacacugaaggccaggaugaaaccauggcagagcucccucuccuugcaugugauggugaggucuugauuagacuggccaaacaugauccugcuugucccuaacagcuguguccuguguuucaguguaagcaucuucuggcaauuuaccuuagucagcuucugaggaacugccagcagcuccaugugucugacaagcaacugacagaccuauugauggaggacacaagaaggauaaaaggugcggcuggaacauggacuucaaagacagaagccuagcaggaaacgcauucacaucucacggugcccgagguggaggaaugggaugcacuuccagacuugugacugucacuucacccucacaggcuaggcugcagagggucugugugguuaagagcccucuauggucuuaauauuagccagccucugagcccugcagguagaaaugucccuugggagaauuaaguauuguugacucaaauaaagccugagccauguuguaucugcaau

SEQ ID NO: 6060 - RNA, 50446 nt, Mus musculus
ggggcgucccgggccagccguggcuuaguggaucucugagggaggacccgucggcauguuccgguugcuucgcuggcgucugggucgaacccugcugcgggccgcgggccggcgguguggggguuguacggcgcgccugcugccggagcggacgggcgacgcggggacgggcgcggagcggcugcggacccgaggcgcgccggcgcgggggcacggggugcugccgcuguuggcaggugagcggugcgcuccgggcggggccggcccggcgggggcggggacgcgggcacgggccggucccggugaccucugagccgcuucucgcagcucucgccugguucucgcgacccgcggcgacggccgagcagccgggagaggacgcgucagacgaggcggaggccgagaucauccagcugcugaagcaagccaaggugaggggcucgaccgggcgcgcgcgcucucugcuccgguuucccgaggccuggauggauuggcccuggguggaagguugggauccauccagacugguccagagcgaauccugcagcagaaucgcugcaguugugagugcagguggagacccucacauuuccuuuauuuauuuauuuauuuuguccaaacguauugauugaggauguuuugcgaggguggcuuuaaucagcuaaccuccaagccgaaugacauuuuguucauagacuaugaaugacgccccgaaaaugcaauuuaguaucguuuaugccuauugguuugcgucuaaaucuguuucuccacauccuuuuuuuccccccuccagguuuauuucaucucuuccuacggguucaauaucgacuuaaugccaacaacguccagauuuguguucagacugcagugugucauugacaugcugucucuauugcaaggccacagcuaucucucagauuuagcaugcccgggacuaagcacuuuuucuuaaauuccuuccccccaaauauggcuuuaacaguguucucucuaucaccuaaaaaauuaagccuaaaaaaucauagugguuccucaggcggaccccuguguuugaaaccagcuugcucuacaaagcaaguccaggacagccaggauucuguuacacagagaaacccugucucaaaaaagaggagaaaaaaaaaaaaaaaaacagaaaauaaucauaauuguucuuaaaguguguuguugauaauucccaguuacagcaguaaacacaguugccaucaaauccagaacacuucucaaaucgccugcccucuuuuuccauucccucuuuucccccaguuuuccucacacagguccuguucucuugccccaaccgcaguccuuucuccguguagcaaccugagugaugguuugaaaauguaaaucagauuguaguagugcuuucuuguuugacagcugagugacuucucccuguaccugugagaaaacacaaacccccugucagaggcugcagggcuggaagugaucuaagccagcgucucauccuccuguggcaagagaugugauucaggacccucuguccaccucuccguccucgaaugucuucugaagauccauucuuuucaccccugucuuuuggggucauucuucuguccauuucguuacaugguuaacuccuuagucacuuuaccucaguuuuacucucauucucuugaacacguuccagauuccucuugucauucuucugugcuguuuuucuuccucuuuucgugaguuuuaauuaugccuacuuguccuaccugauucccuguaaucuucaggaagagaagaagacgaaaggcgaacagcuucgguaggaacacagugccagguguggugguccacaccuuuaacugccacacucaggaggccgagccaaguggaucucugugggucaggaggcagccuggucucugucucuggaggaaaaacaaaguaaagauggcucacauuccuccugugugaucuguugguuaaaacuuuguuguaugagcacaccuagauacaagggaggcuagucucccugucagcugggugggcaugguaccuggacauagcugggauucaguacauuuugugaagugucugcucugcagcauagugcagcugccuccuuacagcucaguuaauguugccuuugucuuuucucucuaguugagcaucaugaaagacgagccagaagcggccgagcugauuuugcaugacgcucuucgccuugcguaugagagugacaacaggaaggccaucacguacacuuaugaccugguaacugcucuaaccagucuagcuauugaggaaggguacaugcugagaaaguguucuugcucauuuaucuuccugacugccaugaugcccugaagguguuuguuucuagguuuucucuugguuuaauuuuuguacccuccacagggucacuuauaauuucaaaccauaaagaaacaaauagcuuuguacuuuucauuggugaucuggguuuaguuugcuuuuaacagaauauauaaaauaaacugugugcgucuuucacuauugcuguacugagcuucuagcagauuaacgggggguguuuucuuuguucugaacuuuuuuuuuuaagauuguaaaaacagggaagagucuuccauuuuaaaguuguaaaucuguguaagcgcagcacucugaacugaacagccauuuauaauuugcuuucagauggccaacuuagcauuuauacgagggcagcuugaaaauguaagucaaucgcuuuguaacaucuggaauugguaaugccucaagggagcugacuaaggggaugcuacuuccucagaaagguccugaaaaugcaguggcagaaggugcagcuguguuucuuuuuuuuuuuuuuuuuuuuaaagauuuauuuauuauuauauguaaguacacuguagcugucuucagacaccagaagagggcaucagaucucauuacagaugguugugagccaccaugugguuacugggaauugaacucaggaccuucggaagagcagucagugcucuuaccgcugagccaucuggccagccccagcuguguuucuuuuuaauugauuagcccgcaugcaugccaaagacuguuaggcaucucuauucauguuaagauacgucuucaucugcgugagugagcugacucaccucuggccuacaagaaggggggagagauuaaagugcagagacauccuuauaaaaugucuuaaagggguuggugaucucucugccuguuaguguuagacaguacuuaaauccaugcuaugaucccucacuguaaggaagguugauucaaaaauugaggguacuuagacagcuuaauugaugggguguauauuaggagcagucuucagucugucccguugguugaggugacugaccugcugaaguuagcuuucacucaucacgcagaggaugugaggaccuugucuuuuggucccuuuauaaaaauaucucagugcugcacauggguacaugcaugcacgcacacacucacacuaaauuguuaccuaaauuaagagccauauguagauggucuaaagaaaaucuuuaugcuuuuaggcagaacagcuuuuuaaagcaacgaugaguuaucugcuuggaggaggcaugaagcagguaaggacaugaccuaguguuacccccucaucaaagcaguucaugaaaugaaaccucccucugagaguuucgguugcuguaauaaaacaccaaaaguaacucguggaagaaaggguuuauuucaucacugagggaagucagggcgaaaacuuuaggcaggugucuggaaggaggaauugaaacacaggacauggagaaaugcugcuuacuggcucacuccugugucuggcuucccguggcuaacucagccuguguucugauaccacccaaucucaccugcccaggcgagacacugcucacccaugagcugggcccucccacguuagucguuaaucaugaaagugccuccuacuugccuauaaccugaucugauggcaaccauuuuucauaauugagguuuaucuuccuagauaacuguagcuuguauuuaguugacccccccaaaaaaaaaaaaaaccaaccaggauacuccucaccccaggcccagcacauaauguacuuugaccaaaaagguggcuguuucacccccagaccuauauaaaaauagcuaguaucucacuaauucucaguaaugauugcuaaagaauucauagcuggcuaauuccguuaaaaggcaaaaggcuggcuuucaggcagaauucauuauagaaguugaaaauacucuauaagaaauuuuuacuuuucaugaauuuucuucuucuucuucuucuucuucuucuucuucuucuucuucuucuucuucuuuuuuuuaauuaucccaacaggaagacaaugcaauaauugaaaucucucugaaacuggccaacaucuaugcugcucagaauaaguaaguaugaucagaauauaggaauaguaguggucagguagaagaaugaugagcaggaaacucagaccuugggauaaucuuaauuuaccugucaggcaucugggucuccagaaaccaugugccacacucaaagcguugcacuucucagcuguuugcaguuuccuccucugguuuccauuugccuaagugaaacaaagcccucaucccugugacugaacugugguaguuaaucaaguauuugauucuugcuugaaaucagaagagaaauagagucagaacuguaguuaacucucccuagaagcaaaggguacagaauaaaaaguacuucaggauaauacacucaaagaagccacuccaccagcagaggaaaaagaaugaggggaauggugaucauuacuuuauucauucuggaaauaacugguaucuuaguuaggguuucuuuugcugugcuaaagcauuaagaccagaagcaacuuggggaggaaagggauuaugugguuuguauaucuaaggagggaagucaggacaggaacucaaaacagacaggagccugaaagcaggagcugaugcagaggccugcucacuuuuacucagccugcuuucuuuuguuuuugguuuuuugguuuuuuguuuuguuuuuucgagacaggguuucucuguguagcccuggcuguccuggaacucacucuguagaccaggcuggccucgaacucagaaauccgccugccucugccucccgaguucagccugcuuucuuacagcaccccagaccacagguccaggggcagcaccagccaugucagucacugauuaagaaaaugcccuacagcugucuacagucccacuuuauggaacauuuuuucagaugaggguccuuccucccagauaacgcuagcuuauaucuagcugacgugaaacuaacccagcacgaguggcucuaaaaggaaucagcuguuuuguuuaaaggcuuucagagcaccugggaauaaccaucuguaggguucuggaggggacauaguuagugguagaggggagucuggguguuaggaaauauaauguggacauaguuagugguagaggggagucuggguguuaggaaauauaauguggcaaggagauaacuggugggcucaucccagggugcaucugaauaauuauaccaugcaguagaucuaguauaaagauguuuauuggggacgagaugggagugagggccuagagaagggguagaggcagacacauaggcagacagaugggaacagaaaggaggacaggaaggaggaucagaccacaaacaugcacauacacacucaugcacucagacugaaaagagcagaaagggugagagagacuggcugggaacaugugggaacagagagggugugagcucacaguggcacaguccuucuguaugcagcccacaccugaagcgccugcuaggucccugggaggagccuaguggaaucuccuguaugcuaacacuggauauguaagcuaggaagugcuaguuuaaaaauaguagauaaauuugaauucuguuuguuuauuuauuuacuuacuuacuuauuuuugagacggggccucuccauguugcccuggcuauccuggaacuuacuauauagaccaggcuggcccugaacuuacacuugucucugacuccugagugcugggauuaaagguguauacacuaugaauuuuugacacaauuuuuuuaaacuuuauuuuuuuacuuauuauuauuacuuauuaaauaaguaaaaaaaaaguuuacuaucccucucccaguuacuccccugguagggaccuccuggguauuucuccaguccuggcacuugaagucucugugaggcuaggcuuuccucuuccacugaggccagacaagacaguccaguuaaaagaacauaucccacauucaggcaacagguuuugggauaggcccuauucuaguuguucaggacccacauaaccccaguccagauguuuagaaccaagcuuuacaucugccacauauguauggggaagccuaggcccagccccccauggguuggugguucagacccugagagccccaaguguccagguuaguugacuguuggucuuccuguggaguuccuauccucuuuggggccuguaauccuuccuucuguucuuucauaagaguccccaagcucuaaccacuguuuggcugugggugucucuauucugaugagucggcuacuguguggagcaucucaggggacaacaugcuccugucugcacacauaauagaguaccauuaauauaauggugucagggauugguuauugcccauggucucaguuugggcugcuuauugguuggccauucccucagucucugcuccauccccugugggaaaggggucugggagaggguuggggggggggguuauuucaagaucagauaaggggagggagaggagggauggccagauguccaagagaauaaauggaaaucuguaacugacggguggaaagguaggggacaucccuaggacaagacagagaccugggauaaggaaggcacccaagaaucaaugggggugaccuuagcugugacucacagcauuggggacauggagccugaagaggccagcucauguaaccaugcaggaaccccaguagagcaaaagggacaccaaccaacucaaaaaacuuuugacccuaaauucuuauaaagaagaaaucuauuagcugcaugaaaggcuuuggaaacaguuuggauguugccgaaagcuagaaaccccaugaggccuuacggaccauugucuuagauuucuuucgcugugauggauacggucuguugggaagccaagguagagaguaaggcaggaacugaagcagaagccacggaggaaugaugacugcuggcuugcucuucuuagcuugcucaguuuguuuucuuauacacccaggacuguuugcccagggucacaccauccacagaaggcuaggcccuuccacuucaucauacaccaaggaaauguccccauaggccugcuuacaggcugaucuggugaggcauuuccucagcugacagucccucuuugacucuagcuugugucauguugauaaaaacuagauagcuugauugaccccuuguuaccuugacacagaaacaugucacuaaccuuuccuuucacacuugucccuaagauguuaauacuaauaucacaaaauaaaacauguuuuuuguuuuugcauuuuuguuuuugguuuuuuuuuggguuuuuuucuuuguuuguuuuuuuuuuuuuuguuugagacaaggucucuacauaguccuagcuguccugguacucacugugaagagcaggcuagccuccaauucacagagauccaucugccugccuuuugagugaugggauuaaaggugugugccaccacacccauaaaacauaauguaacuucuaaaagucccaaagucuuuaaaaaaaaaaauucaaacacuuuaaaauucagucuauugaaaauauccagcugugggcuucuguaaauccaaaguuaguuacauccuuucuauucucagagggaagaaccagggcacaguuaggaucaaaguagaacccaguucuucucagaaguauaaauagcucuuaggucugagauucaagcuccuucaugugcucgggcagucugguucucgagcuuuccuucacugcaaacauggcuuacaggcucagggcagcucuacgccacaucugcuccuguccuuggcaguguccugugacaccagucuccaguaugcugaggucuccccugcaacugagcuguaauuucaccauugugcuuggacucucuucagggacaccacccugucaauagaguggccagccucagcugcaacucauggccccccuucauaugucuaaaaccaguacugccagggugacucuuucacaucaucaagcuuggcuauuagcaugagaugccaccuuggcucccucugcaccacagcucugugugaugacccucaggacauagcccuagaauauuuccucuuaaugaugcugguauuaaaucaccccuuauuucucagcuuuagcuaaggcacauugauugucucagcaaagcaaagguuucacuuccaaggugcugguuucuugcuaaucauagcugauguuucagcuccagcucaugagaaaccaagauuguuaauagaaaacacgcgaauggcccugauaaucuuuuuuuccccucaaacuucacaagccaguucuccuccaucugcaacucuacagcauuccugucuucucaucaacagcaucccauuaagcccugagcacugaauggcuuucccagccuagaguucacauauccuucugcgauugcccccaacacauggucaggucaggucuuaggguuucuuuugcaguaguaaaacaccauucccaaaaguaacuuggggaggaaagggcuuauuuuacaacuuguaagucauaugacagcacugacggaggucaugacaggaaccuggaggcaggaacuagagcagaagccaugaaggaacacugcuuacuggcuggcuccacacagccaccugaugcagguaccacauguuugccuacaaagcuagucugaaggcgcuguccugaguggcauggccguccauuccuuuuugucucuagguagaauugaaagggggaacacgugguguuuaagcugggaaugucucuggagaguucuguuuuggcaguggguuuagggagagaaguaagaauguuuuccuuuagauuuuuagcugcuguagaaguuaaugccagagauuggaugacacuaagcugggugcuauucagaaaaguugcacuuugaggcuaggagaucccagcccuggccccuguucuagucaacaacacucuuuucuucaccaccuacuuaguucccugcauuuugauuggcacuagauaggcuagggcucggucggugauggugcacaccuuugaucccagcacucggaaggcagaggcaggcggauuucugaguucgagaccagccuggucuacaaagugaguuccaggacagccagggcuauacagagaaacccugucuggaaaaaacaaaaacaaaaauaggcuggggcuucugugggucucugacuucgugucgucuccuuuuugagauagaacucgcucucuaaccuagguuaacuuguauuacagacacacaacacaacauagcucucaguuuagaucuugaacuucaaguuuggcugaugccagagaacauugcagcuggggacacuagugucauacaggacuaaauguuaacgaugucucaaggcuucugacaaguagaagcucaaagcaaauacgugcugagaagacauucccagacacaagcuuuuauagaacccauuaguaauuauuaccuaaguuacucuacucuuuucaugucuuauuaagggaaguaugagauaagagaacacauugccaggcuauagggcuuagagaugcugacugagagcucuuacuagcaugugugaggaccugguacuggaggaaaaauguuaacacagggagcuguuuguagguauuuuacucugacagaguuaucuuguuggcagcuuaccuugccaugcagcuagaggugucucuucuaccaagguuuggaacuggagaaggaagaagauaucccuucuggcaacgcaguagagaagagggcaugagcuuuauaaugucagcuguggcaagaauguagaaacuacaugaagagcaggaacuggaguuagagaaggaguuucuccuuguuccucugcaugucuuuugaagcuauccagcgucagucuggguguccauguaucuucucaguuugucucagggucuagcaugcaugucaggccuucuuaugcuauagcugguauuuuguuuucuguggggggaaaauaaaaauuaaaacagcuugggagaacuugugaagccccagaguuucccagaagagcaugaugauaacaguugggacccucagguccaggagccugagccucaaggucagggguugccacgugaagacacagaaagacuaauggcuauacagucaugagaauguuggcaccaucuauuaauuucccuuaaaucgaugacuuuaaaacaaacucuagagaagugcagauugacagcagaagaaacagacgucccccuguugauagugcucagagcagagcuguaaugggaaaaggagucacaggugagcagagcugauugacuaucgauacuuguuuccagacaggaauuugcccuugcuggcuaugaauucugcauuucaacucuagaggggaaaauugaaagagaaaaggaauuagcagaagauauuaugucagguaggaaacuugacuuuuuuagacauuggguuuucuccacaaauguuuccauugcuggauguuuauuaagggaaagagucuauauugggggagggcaaauuauccaucguggggagucaguggcuauccuaauaccguguguuugaaacagguuaucuuguuuaaauggcuugagcacuguuuugaauuauuuuuaagcuccauagguggcaggugcaaaauuucucugcuaacuucugcuacauuuauaaucuuugggaaauugacaacuaugaagggaagucuuuccuuuuuuguucagucacuuacuaaaguagagcugaaugggagagcacuugccagccaggcaacagucccuagauuagagaggaggagaugaagcuaggugugcugugggguaaggaagaggaggaagugcugcugcccaggcuggcuucaucaggcuuggagcacgguggggugagaguguuuaauuaagcucuguauuuggguuucauccucuccccuccccuacuugaggcagggugucauguaguccuggcuggccugaaacuugcuuuuuuaucuaucuaauucugagauaacauuguccccaccucgugaaagcccggcuuuuguuuggguuucuuacuugauuugaaguccuaacaauuuucagauuucauauucacugagggacuuguuacacacugacucuaugccacgagguagcaaggugcuagggagccaugggcaaguucucaucccuaaagccaggcaccguggaagacacaucuguguccugacguccucugauguccucucugugucagugucagcacguccagcccuugaccgccuuacucauuaguugugucggucaugugaucacugucucccacaggaaaccgugucucuugguuucuugggugucucauugaccuuuccccuucuauugccuacuucccgaugguggcucaccucagagguauccucaccugcuucacuuuucccucuggcucaccccuaggaaaugucguguagucccauaacauuucacuauuauauuuagacauccuagcuggccccaagacggcaggcauauggucuggucuuauacuugccuagacuguuuagugguuaucuaacguuagacauguccaguauuugucucuugauuucuuccacucagaaguuucuucacugcucagcccuagguuagugaugccagcauucaccccauggcuugggcagagaaccuaggaauucucucugauuuccuccuuacacuggucuaccaacauguucaauuggaucaacuaugaaaauacauucauguuagaugacaucuuuuuuuuugccuggauggugaucucaguucuuccugcuuccuuuccuuucccuccucagugaaucuguuaccaugcagcaggcaaacuaaccuuuuagaccucauugcuucuguauuaccuuugaaguucauacuccugacaaggaccuggcuuccuccuacaucuguggcaucacuauccucucucucacuucuuucccuggcuuuuccccuccugagcccacaccaucucaaggccuuuuugucccugugucuucucccuggaugguucucagcacggccucacuuccuucagguuuguugguguccuccugaggccucucccaacaggcaucccacccgucuuggagucacucagccucuuuauccugauucuucuuuaccauccuugaaguagaaguaagagugcugugugcuuguuucuguauuaccaagagagguacuuuuuuuuuuuuuucuccaagacaggguuucucuguauagcccuggcuguccugguacucacucuguagaccaggcuggccuggaacucagaaauccgccugccucugccucccgagugcugggauaguacuuuuuuguuaacuguuuuuaguauuugucuucccuacuaaagagcaaucaagacacuguauauuguauuaaauccuuagugccuggaagagagccuagcccccaacauggccucaguaauuacugaaagaacaaguuggcaaagagcagugaguaaauacaauuuggagcaguacagaggagcaugaagaaacccagagaaaauaugaacaagguccagccacagaguaugugagucauucaccauccauguucuugcuauugugcauugagacauuacuagaguuguuuccugcuucccuccaugcucugucuuucuguucucuccccgugcccccucucucugaugggauauuugcuguauaggccggacuagcaucaagcuuaaggcacuccugccuaagccucuugauuagugugagccguagugaguuuuucccuugauuuaucuaucuguguuggucucugucucucucacucacucugacuccaggcuggccucagacuuacuguggagcugacuuuguacuucucaccauccugccuguaccugcugagugcuaggauuauaccagaccuguucuguauugugcuguagguggaacuccgggauagaaaagcauuuuaccaaaugagcagcauuuuuaaccccuuguuacuauuuuauuaagaggauaacacuuuuuccagcuccaaaaauaguuacuaauuuucuaaagaaaauucuggaaagcauuuugaagaaagauaauccuauugcuaagaaagaacagcuguuuacuuucuguuauaaccugacuuuuaauaauauauuaugaagauauguuuggguuuuuuuuuuuuuuugguaagagaauucuugguguguauggaagcuuguguguguguguguguguguguguguguguguguguguguguacgcacgcugucagcacacgcuccuacggaaggacagacuuggguuuuguuccuuagacguuguccauucuguuuggggagacagguuaacucacuggccuagaacuugccaaguaggcuaggccggccagccaugaagccuuagugaucuaccugucacugcuucucuagugcuggcauuacaagcauaugccaccauaccugguuuuuuaaaaugggauuuaauucuggcaucagauucuagcacaucagguguaaugucucaugccuccauuuucagcauuugggaagcugaagcaagaguauuucuaugaguuugagaacagcuuggguacagagugagacucugucuuagcaaagaaagggaaagcugagauagcccauaaagugcucaccaugcacacauuaagucccagaacuugugaaaaaaaagacaggcauugugauggcugcuuaaaauucuaugcugagcacagacacaggcucccuggggauccuggccaugcagccuagccugccugacauccuagaccccagugacgaacaacacuaaggcugauaugaccuuuaugugcaggcauaccauucacagaacauauacuuggcacauaacgaaaacaaaacuuguauguuuucuguaugacuagcccuguaccaagaggacuuuagugaaaaugacacuaagaauggucuagggaacuuugucucccaugagauagauauauguaauuacugaggaggucaucauaacguaaugaggguuggggagacguaaaugagagaacucaaguucuauccccagcacccaugucaaaaagcuggguguggugccauucugguaacaacagcacuugggcgguaaggacucacuggccagucagccuagccuggucccaugagcuucaggccaauaagagaccuuguuucaaaacucaaggagaacaacauguaaggaccaacacccaguguugaccucuggccaggugcaaacacauaauucaauuacaaaguagcauauguaguuuagaagaacuuaauuuucuagaauacaaugaccaaaggcugaaugacuuaaaaauguagacauauuuucucugguuguuuaacauuuauaaguuuauaguucauuugugguuuucuacauguuuuauuuuuauuaugaauacauauuuuuuccaauuuaauuucuacagcucacauugcaacauuaaaagucaaauguauuauaagacuuacuuuaaaauagcauucccuugccauaccuuaccucaucuguguuucaacuaaacuaauuucuucuggcacuucugaaugugugcgcacacacacacacacacacacacacacacacgugugcuuacgugggugugaguaccugugaguggaaaccagaagucaaccuugguauccuccuuguugauauccuuuauaugacacuugccuguguggcucugcuggcuggccggcaucccuggggacucgccucuuucugucucucauuugcgugcuccacagcccuggcaguuucagacguggacucuggaauugagcucaagucuucugguauaugagaggugcuugucaacucuuacauuuuucuuggaaacauaaaauuaucauuuccuaauuuuaauuuuuggaaucuacugacuuauugaagaguuaagauuacaguuuuuuaauucugucuacauaugaacauauaaauaacauuacuugcugagccaaguaacacgauugcauaauuuuauuuccaauuuuuucagcauuuuauuuccuuuggaguuaauuugcuuucuuauugauuuuagaauuuauuuugaaauacuuuuauuauauucaucuauuuauguauguguguacgugcccaggcacucaugugugccacagugugccugaaaggucaguggaccacauaugggcuuguucucacucuucuguugcugugauaaggcaccauggcaaagacaacuuauagaaaaaaagaguuuugggggugcuuacgguuucaguggguuagaguccauggccaucauggcucggagcauggcggcaggcaggcauggaguuguagcuaauuuggucagauuaguucaucuguugaucucuaguaggagauuaagggcaguauucucuuuggcacuuuagaauucgaugagucaguguauacaaagcguuagaauagugaccaguacauaauagcagagaagauggugauuauuaguucuuauuauugucauaaggcugugugaucccucuccuugaagcauguugauugacuucuauaacccugccagcuucauugagaggcuauaugugucguaugaagugcaaauaucauuuguuugugcuuuucuuggggugguagugaguacugugguguguguuuggaggucagaggacagacaaccuugggugucaguuuagacaaauaaugucucuucuugcugccacacacacuaggccagcuggccucagagucccaagauuuuauuaagugugaauaaaugagucauauagucuguguucauuuuaagguauuuuuaugaugugcaugauaauguauauuucauuugcuuuuauuaaguuuuaauuuucuuuuuuacuugugucuaugcguguguguaaaacuccugagugcagguuccugaggaggcuggaggagagcuuuggaacccguuggauguugggaaucaaacacuauaccucuguaaaagaagcaagugcucuuaacuguugaaucaccuguccaccccaacuuucauuaauuuuuaauaaauauugaguaguuguccuaugcugggcauuguuuuuagauuugaauagcagaaagugaggcacaggcccugagaaauacuuucaacauucaagucaggcacucguuuuucugcauuucuuuucuucuuccuguuuuaacuaucuaaacauuuuuaguguuuagcuuuuuagcuuaucuagaauuuacuuggaaaguugaccacugguuucuuacagguaauuaccauuaagaaguuuucuucagaauuuucuauuuguuggaugagucuuaacagucaacauuguuaaauuauacugaguauaaaugugugguagcagugcacacugcuuuuauagaaauucccucaguuuucaugugaguugaauggaguuaccuugucagucuccagcuccucccccagcccagcccccccauguauuuggggaaauuaucaucugaauaaaucagcauauguuuaucauagaccuuguuagggaaugucaacugaguuaaaguuaggacaguuucagagcggcugaccugacuacugggugggaggcucacugaagucucaccuguguuaucaccucacuguuucagcugucuuguccucuuacggcuggaaagcaguuuccaggaaccucaucccaaaguggccauauccacaagaaaaguguuaggcagucuuuccuggaggucugcacguagaucuguccuucucauugacuggaacuggaucacaugucuaaucauuucucucucuuuuuuuaaggcaaaauuggagccuuuuagaaagauaaaauggguuugguuuaggaaugcuggggauggugugauggcucaacauagagacacaguugcuguaggggcuggaggauguccuggggucggcuuucucuuuauaucuuuacccaaguuccaggaauuucauucagguugccugguuauugugcaaguuccuuuacccuuucagcugucuuugcuggccccaaaagaguccugauguggagauuuggggcagcucauuuuuugagcaaacuguaaaguugugccuucagggccauagaugaggcagucuccaaguggggcuggguuuuccugagauaggguguaguucucuccuaucuccuuacaugggucuucugcauguguuuggucagauucuugaucccaucagcccuuggcaagagaaaugugauagcucugguuggcggccuugguuaguauccauucccacugagugacuuugcucugcucugucaugacagccaggagccugcuaguaaagaaaugcgaacuacugggccuuccacugagggguguggcaggccaccagcaugguaguuugagccagugaaccacuucauucagcuguuggcuuuucaguugauaaagauggcguuccgggguuacaguuacggagguggagaauaauaacauuugcuuucagacaaccgugugucugccucuuucuuuuuuucuuuuucuuuuuuuaauuuaguucauuggcugccaacauuaaauaaugauuuuagggaaaucuucuauaugauuugguaccaaacugaaaaauagauuuccucuguaucuagagagaaauaggcuugguuggaaguuaauguuuaguauguuaguguuuagccugcugcuggacaaugcuuaaugccacuguauguagcacuuguguggucacgauagaauuguacugacaugguuuccauaguuuaugcauuagaaugaucagguacuugaauauuuuggcaauuuuuuuuauuacucacauauuuaaauuucuuccauuuccuuuuuauccauuuuuauuuucuguguuggugcauauaugucauggggaccauguggaggucagaggauaacuugugggagugagugaccacuccauucugugcaucucugucaucaaagucuggucuucacgcuuagcagcaagugucuuacucacugggugaccuuguuagccagcccccuuuucuuuucuaaagguuauuuuaugucuuauuuaugugugugacugugaguguguaccagaugugugugauggguggauguagagucccagggcaucagggauccuggaacuagaguuacaaguuuugaacugcccauugugggugcugggaacugaccguucagaacaccugagcaacaccuguucuuaaccuaugagccauuucuccagccccuucuguuuucuuauuuaacucagaaauaccaagcacauggaacauuaguaagacaaugaaugaaaucugagugaaugaaccugaaaucuaaccuacccagaagaaaguuacguaagauuuuucauguugauuccuuccuucccuucccuucagaguuucauuuguuuucauauuuuaagccaaaauacuugugaaggguuaaucuauuuagggguauuguauuaguuuucaagaguguuuaaaacuuggagccugaguuuuaagcaucuuuuacuugggcagguaucuuaacaucuuuauucuugguuucccaccaguaaucuaagaauaacaacugaccccauagaucagacugcaugcgcuaacugaguugggagccuguacgcuauugauuuuuuucccccuauauuuuguuuuguguuucacuuuuuuuuuucuucguuuuucaagacaggguuucucuguguagccuugacuguccuggaacucacucuguagaccaggcuggccucaaacucagaaauccgccugccucugccucccaagugcuaggauuaaaggcguaugccaccacuuucggcucacuguuucuuuuuaaaucucuguuaucauaauuguccccaucugggacuuauuuugcucuuuaucuagcucacaugagaauuuagguuacugauuuaaaaguuuucuuuucuggacuggagagauggcucagcaguuaagagcacugacagcucacccagagguccugaguucaauucccagcaaccacaugguggcucacaaccaucuguaaugggaucagauguccucuucugaugugucugaagacagugacaguguaaauaaauaagaguuuucuaacuuaccuacaucucauaaauauugguauauuuucauuuuuguuuauuucaaaguauucucuaacauuucuuaugcuugguaacuuaaaacacuuaggagugugauuaauuuccagguuucuuucuguuguugaucucaaguuuauuguugugagacagagacaggaugcugugcacacucaggccuucccaugagguuuguccugccgaaugaaauauucaggauuucucucuaaguaucaggauugaaccuugggccucacgcauacuagguauuagguggaguguuuggaauguuucuuaagucuggcuguuuauaaugaguguugcccacguuucuucuucccugacucauuuugucuaguaauuuauuauaugugauuuaaaaaaaaauuuuuuuuugugagcuccuuaaccccuacgccaccaagccuagccacugccuauccauauuucugauaaccaccucagaguuccaggucucuuuguugcaaauaaucccuucaccagaaaacaggguuuuucuagcuacuucucauauauuuuaguuuaucuaucucucacucacucuuugcugaguauuaaaguauaagauuuccaaaaaaguaaaaugugacaucuuugacaaucauuuuuuuaccuuucucccaccuugucaagcuuuuaccuaggagcuuuagggacuuuuuguuuguguuguucuuguaaagccugcucgguucuaauuacuguccugaaauuagucauuuaccuauuugcuauguauauaucaauaaguaauacauagaaggacuauauguuuuagcuuuauacgagugacauauuguauaguuacuuccugggauuugcuuuuucuguggaacauuucauuguggagauuuaucucugcugaaaugggaagagagcugugcucuuagcuugggggcccuuuugcuugcugaacaguguaucugcugagucguaucugucuagaagggugacuucuuuggauugucacaugacuauggaugaagugagggaugaggccacuuuuuacuggggagugcaggcucgggcagcucugacuacuucuguagcaugguccuccaugguaccacaguucuauuacuggacauagaggauuuuguauguguuucacuauguaaaguacuucuuauugaacaucuuuagaacugccugcacauauguaggguccccccacagagauacucaccuuucuuuugggguguguauacuaaauauuacuaaauuguauacccaaggguuuaaucagugaugauucucugccccuguuccucuuaaacuuaagauuguuuuaauauuugggagcuaggagaggaauuucauuauggcuucaguauguguaucugcuuauuagugaacuauaauaauuuuguauauugguuguugggauuuccucuucagagaauugucugugguuuuuuucucaauuguguguuuauuaugcuuacaucuuuuauagcgcuuuccauuguauauacuauuuuuuagugcugcuggcaucguauuugccaagcacaugcuucacuccagcccuuuugcuuaguguuuaagucagugccucccagcccuccugaugcugugacccuuuaaugcaguuccugaugcuguggugaccccagccacacaaucauuuccauugcuacuucauaaguguaauuuugcuacuguuaugaguugaaucugauacacaagauaucugauauguggccugcaagggggcuggagugcacaggcugagaaccauugauuucagccauccauccauccugcuugaacagacucgagaacccuugccgggcaguuuuguuguuguucuuuuguuuucuucuccuuaggccgaugugacuuauggccccuagaaugcacuguggcaggagaugggcugccugcaaagcaggcacauaagccagcguugaguaugcaccacuacauucaggguuuguggguuccggggaaucacacucauaguaucagacuugugcacaagcacuuaaaccauugggucauccugcuggcuagaguuauuuuucuuaauggcuuaugagaguuacaaauuuaaguuuucuuauauuuugguggguuauugugaguauuaauagaaucauuggauauuuuccuuuguaguuuggagcuuugugucuucuuuaauaaaaccauuuacuguauuaaacucagagagauacuuuccucuaaauaauuuaccuaguuuaguuuauuuuagaacaguaaaauguuuuauuaaaaaguaagauuuacauaaguuucuagauaagccauacaaaaggaccacaugguuucucuuuuugaaaagggcagcaaagucacaguguuacuaaugaggguuauaaugcuuacuuaauguuucuuuucuuuuuuuaaauuuuuuuuauuauguauuuuccucaauuacauuuccaaugcuaucccaaaagucccccccuccccccccaccccccuacuuaauguuucuuaugguguaaauagucaagccugaccacuuaagaguggugguucucaaccuuccuaaugcugcagcccucuaauauaguucccaauauuguggugaccccuaauauacuucagcuguuaucuuggguauuugauagucuuuuuacucaaagagaucaucuugguggcucacagucaaaauaauguguuccucugaccugguucuguuauauaacaggcacugacuccagcugccauggggcugccuugaugguucugcauagcagccgggcagccuaaguuuggcuucuggccuucucuccugccucucuuucagugcauuuuuagagugauguuaauguuuuuaaauucuguaauuacaauugacaacuuuauuauaucuucuuucauauucauuucaguccccuuguuucuuuucauuuguuuacucauugaacuaaucacugaagaaaugagagccagccccuuugugaggcauugagcuguaguuaugugaccuccaguggaggaaagacaugguaaacguccaguaugucgugaugucuacaguugacagugcucuguacauccuugcauuguauaaauggaauauguggcauaugaugggaggacuuagaucuggcucuccauuuugcacaaguugaaggccuuaauuucuggauucacagacacucagaccauuuacagaggcagcagaagcugggcuuacacacauuccauuugggguuuuuagcuaauuuuuaccuuguggcccuugagagcucagcuaugcccagcagaaagauucccagguaucggucauauucuuggaaguaaaugcguuagauuagauucugcuucucuccucuauuacuguguucuggaaagugcugaauaugacaucaguugacuaaggaaaguuucaguauagcagaaaucccaggauguuccagguagccagagauacucuugguuuuguacacaaccuuguguuucuagggguggugcuggggagaggcugcugugcucagacuuuaauuucuuucuugcuuucuuccuuccucccucccuuccuuccuuccuuccuuccuuccuuccuuccuuccuuccuuccuuccuuuuucucuucucuucucuucucuucucuucucuuuucucuuuucucuuuucucuuuucucuuuucucuuuucucuuuucucuuuucucuuuucucucuuaaagaaucaguccugugucuuuauuaaagggguuggaaaggaccaugccuggcaaccaaggagugaaguaccagccaggaaggugggaugggcucaggcucuugggcuucaaaggaagacugauggccuggaagggcccaaggagacuuuguccuagcagcagcugagaaagugccuaagggaaagcuuuaggaacuacagccgcaagcugggucuacagggagggaggggcugaggcuguggaugcaaaauagguugggguggucuggaaucacucugagcccacuuuggcuuguucaccuagaucauccacucacuggucugauccuguugguugccuuccauauccaccucauuaaccucuccaucaucaagugaaucauuauaaucauucauuucauccauguccugcauguccuccucaucuacaucauccucucaggcaggcuugccaguagguaccagguuguugucuuucucugcaaugcuuugcaaccagguauugauacugcaacugucuccucuacacaggguugguccagauuaaaucacagugucucagucacacaagggaagagugaagggaacaagggggacauagcucuuaaguagcuguuugauuuuggccaguacacuuaaccucucugggccucaguuucuucaucgcaccaaaagccagcagccgguggcaaccuggaagugcuucugcucagauauuuuuagagauuggcuuuuauuaguggaacuucuauaccuacuuuauuagauauguacuguugcugcagcacuuccucagacuccguccugugaaucacucuucuacacuaauguaguaaaucuacugaggugcuguucuuguacccugcaaaauaaugccuggcuauccucugcagauuugagaauucccuuggcuuacauuuugacuauaggcgucaguaaugaauuucgguuucuucauauacugguuuuaaguaguguauguuuuuacugugauuagaaauaauauauggaagauauaauuaaaguuuggagaaauaaacaugcucuucuuggguuccgaugucccucggggcucuuacaaaugguauggacuucuuacucaguuuuuuauuaggcugucugauuugucuucuugucuaauguuagcaguaucuauauuucaaagaaccguuuccucggugcuggagaguugacucagugguuaagagcacuaacugcucuuccagaggaccuggguuccuuucccagcacccacaugguggcucagaauugucuauaacucagcuccaggggaccugauguucucuucugaccucuagaggcaccagguauacaugugaucacagacauauaugaacaggcaaaacaccccuauauauaaauaaaauaaaaauaaucuuuuuuuuuuuuccuuagaaaaagaagucccuuuggguuagugaaaugacucagcagguaaaggcagugccagcaagcuugaagacuuggcuuaacuccuggaacucagagugugaaaaggagaacagcaacucccaugaauucccuauaacccacacggcuacugccguuacacacacaugcccuguggguguacuuuucuggauuucuuauaaguucuuccaucuaccacccuuccaacccuuauuccaccccaauuccuucuaaccucccaacacuagguuggagagaaagaagguuagaggagaaaggaggcgaagaccucucuagacuacuuccggcugauuagggucaucagguuccuuggggcacauccaggcuccaucaucaggaucuccaacuagcaaucuagcaaacuagcaauagcaaacacaacagcagugggggcaguagccaccccaggccuucuccagaguucccagaauuaaauugcaaccggcaaaacucaagccucccuacagcauaggacagucauaguuaagggcuguggaaaaacugaagcagcccauaucucacaccugagauuaaaacaaaaauauauucacauaaauggguuuuuuuuaagaaaccaaaauuuucacuauaugccaccuuauaaauuaauguaauagaaaaaacuuuaaguccauuuuuguauccugugugaaguuaucuugacagcaggcagagaagccuuuucauacuucauucuggaaguucuuuuaugguuauuuuuuuuuucuuucuuuuuuugaggcaggauuucucuguguagcucagacuguucugggacucacuauguagaccaggcuggccucgaacucacagagacucuucugccucugccuccugagugcugggauuaaagggguaugugcccaugcccaggcacagugcuuuuucauuugucccucagucacaauugaaaaacuguuuauuauuuuuaaaaauguauucauuuaaaaauacuuauauaugaaugaaugacuacuuugccugcauuuaaguaagugugcaguuugugugcccgaugucuggagaggccagaggaauugggaguucuggcuuguuacaagcuaccauguuaugagcagcaggcauuuuuaaccauugagccauaucucuagcucugauuuauuuuuaguuauauguauguauauacguauauguaacacauacauaguuauguguauguuguguauauauguaugcauacacauacaaaauauucuguguguagauaugugcgugugagugcaggugccuucagauuccagaagaagguguuagaucaccuggaccuggaguaagugcccagcauggcugcugggaaccaaauguuuuuguggucagaaugugugaugaauuuaaguuauauuuuaaaguauuuuuuaggaaauauuauuagaguuguaccucauuaauugcauccucuccuuuacauguagcaguaguaacuguacccuagaauugcuugucauuuguccuuguugucugcuuguuugguuuuggacccagggacuuacauaugcuagucaaugccuagcccucugucuuuuuaaguuauauugaugaaugcauuuuauaguugaaugauuuuaaaagaccauuuagaaaauacagaaccauuuaaagacaauuaagugggccaugguaggacccaagagguugagugcuagaggauugcaagccauaggccuaucucaaggaaggaaggguagugaggguggacauaggagguguuuuucacauggguucugggaucugaaugcuagucuucaugccugucaaguguacacucuuagcugcugggccaucucucuaaaccacucccaacuuugauuucugaaaaggcuuuaugagucccguacugcacucacuguguagcugaggaggaacucuucuuauccucucaccucuauuuccaaaugcugggaucuugguguauucucugaaaccugggcagugcuaugcuguggucaaacccagggccucaugaaagauagguaagcauccuacaaaaugagccccagcccuaaacauuguaauuggcuuuugauuaagcaaaggcaaauuauuuuuagauuucucuguuuuaaacuucuuauuuuuccaacuuuccuaaucugauaauguugagacuccuaugcuuauccaccacgacuguguucuuuugcuugaacugucuccucagugacugcucauaguguuacuuaguaacaaauauuuucaaacauuuuuauaacauuugagaauuuccuggaaaccuuaaaggauggagaaggagugauagcucuggugaauuuaauuggucaucuucaaauggugugugauaguuacuuaacuaaaauuagcuaauaagcugaggcagggggacugauagaaguuugaagccagcuuaggcuauagaaaauaaaacaaaacaccccgaauccuguuucuaguucuuugugaacuuugacuuguucccacccaucacuuuuccuacauuauuugggccgugucuggaggucuagcaguagcugacacugggcgcugaugucuggaucugcagccuccgcucuucauguggcaucggcuguguggagucuguacucaguucugucugucccagcccuuagucuuugaaaacuggaccauguucuuuccauuacagaauucugaguuuucuugguuucuuacugcauuuuuuucuuaaacccuaaaauaacauccauuggcccucuacucuuuuugcgguuggcucauucuacuucggguuuaucuuaaucaucuuuucugaauacuaguucccaacuuuaagauauucaauauugacuuuuucaucuauucaaaaggagggggagguccaugauuucaggcagcuacuugucacuuuucucauuuaauugguugucugcccaccugaacaguuucuugugguuaagaguuuaaguaucugaagcauucagugaagccugguagccacaaagaugaaguacaguggcuugcuuuuugaccuuuguauauaacuucuauuacauccuugcaacgcuuuuauuuuucuuuuagaagaaacagccaauacuuaccuccuccuugguaugugcuuagacucuugugcacgcuaucugcuauucuccaagcagcuaucacaggcacaaaggauguaugaaaaagcccugcagauuugucaagaaauacaaggagaaagacacccacagguaagagaugaaacaguguauguaagccaggccugcccgguggcacagguacucuguagagggucauaaggucacagguucaagggugcugggcaaaguuggugagcucccaugccaaagggcugggggcguauuucagcuugcauggcacugguaaaguucuacauucagugacuagcaucaguuauggguguggcaagacaugguuagccaugugaaaugucauaaggaaugcagguugauauccagauguauggaauccugccacuccccggucuguucauuuuuuuuccaccagcuuucacuacucccaacuacuuguuucaggaaggguuugagauugcugacuaagucacuggcacugcauaggcccuuuucugagucaugguuuauacaguagucuuuguacaaggcagacuuuuaacccaggggcuucagaauauguagccucauguuuacagugguuuguagacucuuagaaucuuuuuuuucuuccuccuggagcuggggacuagacccaggggcuucuuccauaccaaucagaaccuugcaaguaacuauuuaguucauauagaaguaucuuuuucuccuggguaacugggaggugaggaaguagagauuuuugaauuugggauggggcagggagaggggggcaggacuagagauuaaaacuaggaccucauaaauucaaggcaagggcucuaccacugagcuguggccauaacuuauaaaaacacuauuaaaagcaauauauagcaaaccaguagccaacauuaaacuaaagggagagaaacuugaaguagucccacuaaaaucagggacuagacaaggcugcccauuuucucccuaccuauucaauauaguacuugaaguccuagccugagcaauuagacaacaaaaggagaucaaggggauacaaauuggaaaugaagaagucaaaauaucacuauuugcagaugauaugauaguauauauaagugacccuaaaaauuccaccagagaacuccuaaaucugauaaacagcuucagugcaguagcuguauauaaaauuaaaccaauggccuuucucuacacaaaggauuaacacacugagaaagaaauuagggaaacaacacccuucaccauagucacaaauaauauaaaauaccuuggcgugacucuaacuaaggaagugaaaguucuguaugauaagaauuuccaagucucugaagaaagaaauugaagauuucagaagauggaaagaucccaugcucauggauuggcagaacuaauauaguaaaaaugguuauuuugcugaaagcaaucuacagaucaaugcaauccccaucaaaauuccaacucaaucuucacugaguuagaaagggaaauuugcaaauucaucuggaauaacaaaaaaaccuaggauagcaaaaacuauucucaacaauaaaagacccucugguggaaucaccaugucugaccuaaaacuguacuacagagcgacugugauaaaaacugcaugguacugguacagugacagacagguagaucaauggaauagaauugaagacccagaaaugaacccacacacuuauggucacuugaucuuugacaaaggagcuaaaaccauccaggggaaaaaagacagcauuuucaacaaauggugcuggcucagcuguugguuaucauguagaagaaugcaaauugauccauucuuaacuccuuguagaaagcgcaagucuacguggaucaaggagcuccacauaaaaccagagacacuaaaacuuauagaggagaaaguggggaaaacccucaaagaugcgggcacaggggaaaaauuccugaacagaacagcaaaggcuugugcuguaagaucaagaauugacacaugggaccucauaaaauuaguuucuguaaggcaaaggacacugucaacaagacaaaagggccaccaacagauugggaaaggaucuuuaccaauccuaaaucagauaggcgacuaauauccaauauauauaaagaacucaagaagcuggacuccaaaaaaaucagaaaaaugggguacagagcuaaacaaagaauucucaacugaggaauaccaaauggcugagaagcaccugaaaaaauguucaacauccuuaaucaucagggaaaugcaaaugaaaacaacccugagauuccaccucauaccagucagaauggcuaagagcaaaauucaggugacaacagaugcuggcaaggauguggagaaagaagaacaaauccuccauugcugguaggauugcaagcugguacaaccacucuggaaaucagucuggcgguuccucagaaaauuggacauaguacuaccggaagauccagcaauaccucuccugggcauauauccagaagauguuccaacugguaauaaggacacaugcuccacuauguucauagcagccuuauuuauaauagccagaagcugaaaagaccccagaugucccucaacagaggaauggauacagaaaaugugguacauuuauacaguggaguacuacucagcuauugaaaacaauaaauuuaugaaauucuuaggcaaauggaugguucuggaggauaucauccugagugagguaauccaauuacaaaagaacucacaugauauguacucacugauaaguggauauuagcccagaaauuuagaauacccaagauucaauuugcaaaacacaugaaacucaagaagaaggaagaccaaagggucgauacuucgucccuccauagaauggggaacaaaacacccauggaaggaguuauagagacaaagucuggagcugagauggaaggaaggaccauccagagacugccccacucagggauccaucccauaaacagccaccaaacccagacacuauugcauaugccagcaagauuuugcugacaggauccuagauagcugucucuugugaggcuaugccaaugccuggcaaacacagaaguggaugcucacagucaucuauuggauggaacacagggccccccaauugaggagcuagagaaagcacccaaggagcugaagggguuugcaacccuauagguggaacaacaauaugaacuaaccaguaccccaugagcuugugucucuagcugcauaugugucagaagcuggcccagucggccaucacuggaaggagaggcccauuggacuugcaaacuuuauaugccccaguacaggggaaugccagggccaggaagcaggaguggguggguuggagagcagggugggggggauuaauacagacuugagaucaucucuacuucuucuugcaaaaaccauucuugagguaggaguugacugcucuguuugauaacuguaguccaccaaguaaacaaauuagacugaacauggaauauuuaggacuaaaugcagagagccugaugcaugucguuggggaauaguaagaagcaagccuggaauucagagcaccauuuguguuucucaguuccaaagucauaaugagacccuccauaguacaggugaucuguuucuuccuagggaggauugggauuggagcaguagugcugcuguaauacaguggggcauuugguggugcuggcuccccacuuccaauccauccagggcagaauauccugccccauucugaguguucauagguacuugccauagugugcaauugacaaugucugcagcacagugugaucaacagauaucugcaauuugucccucuaacuuuguggaauucuaguaaaguugaagacuuguauauaugcaguguaaugaauuccaguuuaauguuuuacauagguguuucuaaagaaaaggcucuuguuucuuuuuuauagaccauugugcugaugagugacuuggcuacuacucuggaugcacagggccacuuugaugaugccuacauuuauaugcagagggcgucagaucuggcaagagagauaaaucacccugagcugcacaugguacucagcaaucuggcugccauuuugauacacagagguagguugcuguggaaacggauugcauucugagaaaguuuucaucacugggcuuugaaaugaaaugguuuugggaggaaaaugacaaugaagaaaccccaaagucagugguucucaaccuauaggugaggccuuggggucaaaggacccuuucacagggcugccugagaccacuggaaaacacaaauguuuacauugugauucauaacauuagcaaaguugacaguuaugaaguagcaaugaaaauaauuuuauggccgagggucaccacaacuugaacuauuuuaaagggucacaacauuagaaagguagaaaacuacugcuguaaguuaaaaggcuggcuaaauaaggguuaaaaaaugcauguguguuaaaguacuauuuugcuuaauucacuaaacugucauauuucuguaugaccauaugacggcagagaacacuuugcagugauagguccuugucucuguaguguuuuacagaugcugaaguguuuuaacagguauaauuccucaguguucugaagccacaguaugauaaagcaucaaguuuccugcuauuccaaaauacucagggcuucuaaaguuuccauaaaccugggaucauagaucucuguugcauggaacaccacuguaaucccacagcacuaaguacuuuuaaagcugacaccuacuuacuguaagcucagcuucucuuacccagcugucauguaugcaggauaccagacagcacuagaugccauuuuugaagcauccagcacaucauacaguguccucacuagugguuccuggugaaaacacauauuuucuucuccccucucuuuggguuauuuuagagcgauacacacaagcaaaggagaucuaccaggaagcgcugaagcgagcagagcugaaaagagaugagguuucuguucagcacaucagggaagaauuggcugaacugucaagaaaaaguagacguuugacuuaauuuuguuaagcuauagaaguucauuuuguuguagagaggguaaccucugauaucccaaaggaguaacuguuccuucguugucuggaccucaaucaguguguaaaucauuguugaaauucaacguucgucaacucggcuucggagaaggacaaguugcauacacugccacuuuuguuucuaaauuuauuuuacuuugagauggguaucucuauggguaggcuggccuggaaaucacuauaugcuugaaguuggccuccaacuuggaguacuacuccucccucggcuucgaaagugccuggcccuacuuuuguuuuuaaaggugaaacagcuuuuacccuguacugacuguauauaagguacaguccaugcucaucugagaaauuuacagacuacaguuggccaaguuccucaccauauggucauuauaccuuccauaagauuuugauucaugcuuacuuuucuguauccauuucuggcaaacaaguuacuuguaucaugacacaggaggauuuuaguuagcucucuuacacacuauuuuauugaugcauuaugagauuuaaugacuaugaaggggaaugauaauucuaguuggccaucauuggcagcacuuacuacuaaaguggaagugagacauuuggacuguauaucuguuuguauguauauaacuacuaaaaaugaugguggcagaaggaaugaagcccucaucagcacugucugaacacagggcuuccuuuauaaccacaggcacagaguggaguaaaguuaugcuuacagcacccaugugcucaggguaaugugcagccucugaucuggauccuaguuagcucuacuuuuuuauuuugcaaucucugaagucugaaaccaauuagauuguuugucugaugacuuuaucacugccucagaguauauaaauauaugaugcauggauggaugcuuuuaccuuugcagucuggcaaauggcuuuuugccuaagagaaaacacauuuuucugggugccacgaaggaacccuggugguagagguaggcggugugaguacgauugccaguggacuuugguucauguguuuguucugggagaaucucuauaauaaacuagagacuacgcaauuguauggauucuaauaaucuuggaaucauagaaaaauaauggccaaguuacuagacagacauacuaagguccaaguccucagagcuaagagcuaccgcagagucuguguuguguggggagagccccacauucuguuugaguucauuuaccauucacuuccuaaccacaugugaucuucccgcuaaccaugaauaaccagguaagaguucaguuaccuuugcuuugaaaauguuuuuuacuuuuucacaauuccagaguuacccaaguuagcuguuaggcuuuuuaauguuccauggugacugaccucauguccuguggcuggggacacagucuguguauguucccagcagcauucguuugcacuauuauaaaaaaggcagugagacaaagggacucaucuccuuuuacugauuacaacuuuaaacaauuuacauuuaauuucauauuaaaguuuuaaacuagaccauguuacuaggguuuucagggcuuaaguguuuguaagacaaucacagcauaugaaaauuuaaaguguaguauaaaauuucucacuaaguagacuggaaaauugucagaauauuaccucugcuggaagaccuugauuuaguugcaugugcauguguuacagauauagugcuggcccgccuugauuugcagcugaggucgcagacucaguacuugcugcugcccgcgucgguaagccggccuccaccucucuagguaaacugugggguucuguucuguucugaaguaagaaacgauucuggacuucauguuguguugucgugaacacagauagcacaagcagucugcaggaggagcuacaagaguaggugaccaagcucgauugacugacacaguaagacagggccaaucaucaucaucaucauuuuuugggcuaguugacaaagugacuuacuaauaagaucuagacuuaugugacuauaacuuggcagggggacacuuucagcaguaaaucuaaucagaacacuuagucuucauuauguuugugacuauuguaaagguaaugacuuuacaagugauaagaauccuguucuggcugguccagaacucaucuuguaauccagacuagccuuguacucuuagugauccgccugccucugccuccugagugcugggauuaaaggugugugcuaugaugcauagcuaaaguuuaagaucucaaaugucugucuuucuuacuugcugaguuauauggacaaaugccuagccugcaccuucaucuauaaaaaagugaucagaaaccugugguguagauagaugcuaagaggugcuugggcagugguucuagagacucagaccuccugaagcccucccucucccuucuaguucuuaguggcauuaccccccccccccacacacacacacacacacuacuaagcaucuuuaugcaguggaaggaagccauaggagaacaaaucugaaucacagcaagcaauucuuaaugaauaaaggugauccuacagugccauaauuaguuuaaaauucagucuuuaaauuacuugcaccuuaagaaucuguucccuaggagcagagaaugggcacugaugcagaggacugugcucaacggucaguucacgaugcagcauaaaaacaagccuggaagacagaaaguucuauacaguguucucuuuuuaacuccgccaauucuguaucuaaagaaaagcauguauacuaauuguuugaaaccugagaaacgaagacucuuuacgucacaaaugauguacuguagcuauggacaggauagucaaaauuuauuucagaacagaaagaagcuuuguugggcugcaucaaaugcagaauacuuagggggcgugguuaaauuaccagugugcauaaacauugagguaugccucaaaaaagccuuuaaacuuuaaaacugaacuauaacauacccaugcaguaauuuuuuucagugcuaccaaugaaagccaagccugcacuggaacucacaauaugacaguuguguugcuccugucuucugaccucauacaggcuuuaugacaggguauguguuaaaaaccuaaauauuuccacaagauuuaaacaucacugggaaagcugaauuuagaggaaacaaaaguacaaugcccaugacagccagcacuguggaacugggcugugugagguuuagaggcugggguuaaaaagauacacaaagaauuuuaaaaauucuccccaguugauucgcugauuuaaauuuaaguacaccagauacuacagcaaggggauacacugcaaaaaagucaucuauuuacagaagauugauuuaaagacaucaugguuuucuuuacaaacagauguaagaacaagaauuguccacuuuaaaaaaacucuacacuucaacccgccacuguuauaauccauugaagugccuguauuagaggcaguuuuuuuguuuguuuuuucccauuugauuuuccaaaugaauuuccaucauuucuuccucauccauggcccuggcucuccugagaagucucugggcacaaaucaugggagggcagaauaauuuucuuuuuuuuuuuuuaaaucuucaauaaaaaccaaagccagagcgcucucccacgcacagcucagucgucacuaucagacagugucucauacugcgcugagaggagcggggcaggcucccucucccagaugcgguucuguugauguggagcugcuugggugauggcagauggggcgcaugcgaucuguguaggugguguacugcugagcauccguauggucagaggguuguaagggaacugaguagaaccugacaaaagaaaaaugagguuuucacugucguuagcauucaaugcagucuuuacaggauggaacaagacaggaugcugcuuuaguaaaacggucugcugaugccuuggguaggggugauaagucugugaugucauagcacaugucuccuuggagaauucaaguagggaacuacugaacauuaagcuguaaucagagaagcuuagccaugcuagugacuuuccaguggaaaucauaaauacagcucuuagaauguggcaaauacccagaacuuuuagccaggcugugugacccuuacacagucucacguggccaacuuauauaugagauuuaaauggggcacaacaguacuacuucccuaucagcuuaagaccauaaaaaauauauuuuaucaaagaauuccuuccuuuccuaaaauaaaguaauggaaccgugugguaagagaauggcgagguggagcagguaugggcaggaaaugagaaccaaguccacugacauacuucugugugaaguugcagcacaucauguuguaugcuaauguacaugcuaguggaguuugcauuuguaagaaguacagauacguaauucuuucuacacagggcauuagagguuuaaaaggcaaaagccuuaaaguguacagauaugauaauuaugaaauuguuagacacagcaggagggcucagcucagacuugagggugggaaugggacaugugcauuaauccauaugaaagaaaagcauacauuucuugaaacucuuacgcaacaacuuucuuugaaaaagaggcuaguuuuuaaaauauuuaauucuuguuugacuguguuguauauucuguauggacaugcuuaugccgugacacgggugaaaguugcagaacaacauuugggaauucauucuccucugcuaccuguauguggcaggcugagcucaggcuaccaggccugcaaucacuuuauacugaagucauuucaguaucucauuggcccuacaauuauauuuuuauauaauuguauuaauaaugguuuccccccacacacucuuguuaaaacauuacacugcgcagucacgauucugauuucuuaguaagagcaaaaggucagucagcacaguguaugggaccagacuuaacucgcacauccugguuaccaccauauagugcagacacagggauggaugggccauguaaauauaaaauccuuuuuuccaacaacuagacccaaguaauuacauagaaaaaacaucauucuugcccaaacuguacucacucacugagaggugaauuaagaaagcacugagacaaagugacucucauuuuaucaguuaaguggggcccucaccuguugaagagggccgaucuucccaugcccauccuggugucugccugugguaaucaccuucugaaugcacagaggagacagaagaaggccuuucaguuccuaaauagcuuugcccaggaauaggagauuuagacuuccugcuguuugauuuguugaucagcuuugguuugcauacuccuaaaagugaaauucaaauuaaacuauugauuacugauaaauuaucaguggcaacauaaguucucagugacaaaaccaaacccuaccaaaauguugacuacuaacgcuaagugaagacuccagaucagggcacaucaucaaccuauaaagguggcaaaggcugcuggccuuaagacuguagguaauguuaauaaauaucugcuucccucuaucuaucuccaccaacagcccaguuuaacagaaccaaguggagagaaaaaagacaggcugcagcagccaugccuccuaccccaggaccucacagaaacucuguaagucucacugucucucucuauucucccaccacagaguucacagcacugagacacgugugacuggguucuauaacaaacuaucacagacuuaaagaacccauaucacuuagcauguauuuuucaucagcuccaacaguugcaucuuaccccaguuauaucacuuuaacucccuaauaguugccaacugauuuuaaagcacagaaauauacaagcaauaaaaauuagaccagaaacaaaacuucaauguauaaguuacaggaggagggaggcaaacacuaaacggucauugcuuuuuacccuuuucuuaacaggaaacaaacacagaaaaacuuaaaagauaacugcuuaaaagauaaaaggauuauauauaaauagugaaagcaugguguucgcaagguucuuuguagguuugauuuauggacuguaaaugaugucauacacucuguggccccucccuauaguuauguugaggaauugcuauccauccaauagcuuucuggguucugggaucucaaggauaguagguugaaacaauuuucuauuugaauuaucuuucccugagauguaugggguaggaguacaaguaucaguuccuuccuucuucuguccaagcccagguucgcugcuggcccaugccuuugccacuauggccuuuugcucccuuucugugaucuccuguguggcucguagcugcacugagauuugucuauuuuuaugagaauaguaaaugacauaguaaaaaacuggggcucggggcuggugagauggcucaguggguaagagcacccgacugcucuuccaaaggucaggaguucaaaucccagcaaccacaugguggcucacaaccaucuguaacgagaucugacucccucuucuggagugucugaggacagcuacaguguacuuacaauaaauaaauaaauaaauaaauaaaucuuaaaaaaaaaaaaaaaacuggggcuggagagaugaugcaguagcuaauaagagcccagguccccagguuaaauucccagcacccacuugggaguugacacccuucuguaacucuaguucagguggauccaacaccuuuuucuagcacgugaguucucugugauccaucaggauggaaaguaccagagcaccaaaaaccuuaccugcaugaggugauggcuccccuucaucucuccgugccucgcugcucgucaccacugaggugcuggcacuaccaggcauaaugcccacaggaugggacaugacaacaccaugaucuucaacuuuaucaucaaaacuucccaugagagccuuucugaugaugucuucuagaccaagguuacuggcgggaucagcaaaagaauggcuucuugagcucacugcaccugaggagacaaagcaguguacuucuugguucugaggcagaucgaggcacagggaaaugaacagcuagugaauucacagcacucaaaaacgucacagaaauguuguacucauuggugucaucccuacuauugcuuuguuuuacucacuucucaucgaauaguuaagaaucuuaccugaugugguaacugcuggcagauugaagaucucuguuccuggcugagcagcugcuguauucaaacacauuagguuaauugagaagagauaaucaugauacgaagucucuagaaauucuagaauaaaaguuaaccuuuuaauuuucuacauauauuucauuuuuaauuuucuacauauauuucauuuauuauguggagaugaaauaaaaaucucucucuugggguagggaagguauuaggaaauaaagucaggucagguugaaaauucaaacacaaauaagauaauucagaacaguaagaaauguugcauugcuaaagggggaaagcacacacacauauagaagcacacacacauauagaagaggagaaaguucuuugcagaacaggaauccaagcuuccuagugaugaaagccugggcugaggagccaucgcaguggacaguguggcgcaacggugcucccagggcucaguggaagcucugcccuuagggacucccugaagaaggagauucugccuugauucaucaccuaguccugguaacaguacaacuuaucauuugcaacuugaauaaauauagaugaaaugaaaaccaacuuuaaaagcacuuguaccauaagggaagggaccuagugaccuaaguuauuucugucacuuauuugcuacugaggacauuaagaggcaaaaauuaauuuuuuggaaguauguagaucuguaacaaaugauaccugagcacuauauacuaugggagguagacuucugucaaagggugagagccauuuaugaagaacacaagccuagaaauuagcauuaguaauuggagcaguuugaaacugacaagaggaagaggggagaguauuuuaacagaaacuacaggcagcacagugggugaagucagccugaacuaacacaaaguugauaggacuuacauaguggugcaccauuacuaacagagccacaagagacuaaagaguaacccagugagaauagguguggugguauuuguuagcccagcacuugggaggcagaggcaguagggucucugugccaaaauuacuagaaacucuuuaucaaaaagccacacacauauacaaaauucagaugaauauaauuuuauuuaacucaaaaauagucacaauuaccacacuguccccccccccccaguuuaaauaugcuguuuucauauauagaucagaauggccugguaacaguaaacaugccauuuucuuugaaaaaaaaauauguacagggucugugcagccccagcuguccugguacucuguagaccaggcuggucuugaacugcuguuuucuacauucauggggccuuauaauuuaagugcuuaauaagcccucagauaaucaaaucauacugcagcuugaugccuccuuguguguuguuuuuuuuuuuuaaaugauuuacuuauuuuauauaugaguauucuuaucugcaugccagaagaggguaucagaacucguuaugguuguaagccaccauguaguugcugggacuugaacucaggaccucuugaagaacagccagugcucuuaaccgcugagccaucucuccagccccaaugccuccuuugaaaugugacgauuuguuuauaaaugauaggaaagaaaagcaccugagagcggaccuaacagaggagaccaagaaaggaguggauugacgucaauuaugaaagagcaggaacuuuguguggcaaauagaguucaguuuuauuaaagacccaguaauaaacucuaugaacaaaaaaaaaaaagagagagcuagauuucagauauaaauucaaggguuuucaguaugagauucaguuuuaaaugcuccaaaauuaguguguaagggaagaggugcugagagcccuggagaaaacaaccaagggccaggcuaaagaagaacuaacugcaaaugggagguggcacacucaaaacugugaaggcaucagaaaagugagugguuugggggcuuuugguuuuucaguucuauuucccaguucuugagacuagagagauggcucaaugauuaacagcacuugcuguuaauucucuugcagagaaucuggguuugauucccagcauccauaagacaguuuauagccagcuguaacuccaguaacagggacacaaugcucucuucuggucauuguaauauauaaacauacaggcaaaggcauucauacacauaaaaugaaaauaaccccagacucuuuaacacaguuuguuauuuuggccuuaaaaugucagcacacuuuaucuccucuuagguaacugcuuucguagagaccacucaucaacacaggacuuagauuagcaaaugcccgccaaaucaccagagcugcuauugaggacaguguaaauacacuaucacaggaaaagcuaucaggucaucuuuacuaacgcacagcauucucugguaagaauuugacacccacuagucagaaaagacaacaacagggugaaauguuccccaacaaccugcuguccuucagccuugggucucuaugcuuggaaaggucaucucugagauaagagugugcacagagagcaccagggguuuuuguuggugauuguuuaagaguguaagcagaagaaccuuuaagacuggagaugaaaggccuggcauggcaguguuuuagugauggacuggguguuaggcugacaguccuggucaacauucuguaauuuguugccacuucaagagaaucuagugcguuccuaucuugaaaccccuuccacuaauggagauuauugcucacuuuuccauaguagaucuauauuugauguacuaaaaugaugaaaaggaaagcaagguauaucuaauaacuagacaggguaaguucacaaguggugguggacucauccuuuuucucuuuaccauucaguagagacucaaauucaaugaagacuaaucacaaguaguagagguauaauuauacaucugccucaguucaguuucagagcccagaguuucuuuugacagggucaggagacuagcaaaucauagaucggagacggggcucucuauauucccuaucauugguaaauuaauaaagcuggcugguagcagaacacaugcaaaugauaguacagcagcgaucugaucagagcaaggacaucagcccaaaggaaagcaagagucugccauccagcauuaugaaugcauugccaacaacguuggagaccacauauagaacagcuaggguacacugguggaagcaagagacucagguugcaauguuggguuugaguuccauuccuauuacuacuuguguggccuuuaucaguuauuaaaucucucugacucaauuuccuuccucacuuauaaaaugaagcuaauuacauguaguguugugcacaauaauagcuauuuaaucuuuuucaagaauuacuauuuauuuuuuuaaagacagauaaguuuaucauaguugcaucuauaugcuacauaauugcacugagacccuugagaucccaucauguucuggcagguuaaaaagcagcuaagacgaagcaaguauaaauuggccuguccgauggauuacuaguaauccacaaaacagcaaggaagagguagugucacaucuguucuuagguauaaugucauguagcuuagcuauucagguuacuaagaagaauaggaagauagccuuaagaaugauacauuuaggacagauaauaccauuaauuugaaugacucaggagauucccaaaagauaagcuacauaaagugagauaauuuaacaagaacaugugaagaauaauugaucaaacaggacuuagagauaagacucaggaagaacaugcuuuucaaauauuugaagauaaaaaaaguaggccaaacaggcuuuaaaacaagauagaaaucaacaaaauacuauauaaaauuaauuuugucucagcucuccaugaagaugaauggcuuuagaaaauacccaaguucuugcuuccuaagaaggaacuauuugugaauuugcauagaaucaaaauguucuauaaaacccaucaaacucaaauauuauaaaaaaggcaacauuagagauagcauuguuaaugcauguuuuauuuggaguucauggaaaaaaaauccuacuuacccauaucagagucaccuccaccagaagaguucaacuuacgaaaaauuuccuguuucuuugauuuaaccaugggugaugugcuuucaagcuuggugaagaaugaaggcaaguagcuuauacuuccuggugaucgagaaucacuccugucaggaauagaauucaaucuauuauaaccauguacccuaggaacacuccuuuaaauaacagguacaaaauacucagaaaacuacugccuuccauucuguguugguuacaaaccguacaaagcauaugugaccaugaacucauaaagaugauccacaggacugccugccugccugccugucugucugucuaucuaucuaaugauuuuuagcucugagaagugaaaugguaaaauugggauuaaaaggaagaugauauacaguucucucuaucugguugguuuuuugagacaagagucucauuauguacucuugacugucucacuuuguagacaagaaaggucuugaacucagaucugccugccucugucuccucagugcugggauuaaaggugugugccacccaccaugcuugacuaaucuacagcacaaauucauauaagauaaaauggcaaaguaauaauuggaaaacuuaucaacguuguuguuuuguuguuuucuugcgcuucacagcucaaacuaugguuauuuaagcuaggaacuaacuuacuagcagcacugucuuuuaaguacccuaguugugacuaaugacacacuugucuauaaaauagcaaaagccaaucacugguuggauccuagcaaaauagcugcaguaucuacauaaaauggccuaacuauaagacaaacaacagaagaacugagucuuaauacaaagaaucucguauuucauugguagcuucuauauucaaaguucagcaagcugcuuugacagagaugguaacagaacacaccacugacaaccccaucaagucauaugugcucauuuaccacugaaacacaacaacauuaucugugaacaaagacaaagagagaaaaaaaugguucccaugcauaaaaauccaauuugggaaaacauaugaauguauaauuauuuucuuccucauuucauugaagguaauaacauguauuauauacaauaaauacucagaaauucaccagcagagucagaccuggcuuaaaacuggacuuuccucucuguacaagguuuggccaccaucaaauccugucucuaguguauuaaauaccaagaaaacuguucuuuugaagaaaaugaacugagagaaaagacaacagagaauauaacguaagggagagacagcaggaaaugaagcuuuguaagccuggcccugaaggaaugcaaaugccacgcuagcaacuguguucugcacauugugucucagcuaacucuggggacaaaugaggacugcucuguaauucaggucaacgugguaaaaagaaaauauacaaggaaggcacugugcucugugugcaggggaaaaaguacuccuagucuuccccgagucuuauccuuuauaagagccaaaaagagaagagaggcagugauuuaggcaaagccucaggcacagucugcaccuaaaaggaguuggggcaaagacaugugugcauccugcuuaccuuugcucagcaggguccacuccccucugugacaagagcaacaugcuguccugcuucucaugcacagcagggccuugggguggggagaugggcucauagggcucugaugggauaugacuccucucuggagauuuuccaggccugcugggguagaaaaugcaacauuuuagguuguacucggucugaggccaccucugacuuaacaucugcauuuaacuuauaaucuuauaaaugaugguauuuccuaccccaaucaauucuaccauucuuaaaauaguaguaguugugaaccuucaaucaccuauccaucaacacccacaugcaugagaaaaggccuaauuuaucuucaggucuuguccuuuuuggcauaaccuuuaguuuacguacacuccaaccauacauauguauuuuuuaaauguaaaaauaagcacacauaucuuccuaccucuuuuccccaauuaucagccauuuucauauggcucaugaugcacauucuauucuaaaacuacagggcucccugaguauggauuagugguaggccauuugccuagccucauuauguaaauauuuuagaugauaaauaaaauaauuucacuaagagcaaugaaaaaaauuaaccaucaucuuucagauucauggauguaggguuuaaguagagaagccaacuggaauccuucuucauaaaugucaucaauuguuccaaaucuguaacauaauaguugucuguuuauguauuauguaucuaauuauguaucuaucuguuuauggugugggugucuuauuguuuuucaggcuagucuaaaaggaacuccuggguucugcaugucuuccuuccucagccucugaaggauuagagccagccuucuguucaugaugacuucacuuuucuuuuuuaaaagagaaaaaaauacacugaguguggugguacacaccuuuaaucccagcucccagaagcaaagacaggcgggucucuucuaguuagaggccagccuggucuacauagcaaguucuagaacaguaagagcuauacacaaagacacaaaggacaaccccuaccucaacccccaaaaagagaauaagcacgcuuuuaucaugccuuuaagaucauuaagccuuuuuaaaugguuaugucuaguauuugcuucagaacacuccaguaaggcauggagaugggugggggaaugggauagggaagugagaauaaaacgaaaaagaggagccaggcaugguggcgcacgccuuuaaucccagcacucgggaggcagaggcagguggauuucugaguuugaaaccagccuggucuacugagugaguuccaggacagagaaacccugucucgaaaaaccaaaaaaaaaaaaaaaaaaaaaaaaaaagaaagaagaagaaaagagcuggccaccggcugcacugaaguauaugcaugugguuuuguauuguguuuuguuugauucgggaugucugcauagcccuggcuggccuggaacucacagaaaucugucugccugccuccacauguugggauaaaaggcgugagucaccauaucuggugauuuucuacucuuaaaaccagccaacuuguuuuuugaaacagggucaguuaucugccugucucuguccagagugccaucuguaccuggcucauuuagagcgacagucaucucuuuguaccuaagcauugauuuccacuugucucauuuauccauccucuguauauauucagaguauuugcuacaaucuuuguuuuauugauagucauguuccuguucuuagcauguuaugaauuuccuauuuaaauauaaucugaugcugauguuuagugugcuacucugaacugaaacugcugauuccuuuuugauaggauguagaacauuguuaacaaauauuacguauggucaagcccuggggccuuguccauaugaggcaagugugccaaaacugaacuacgcucacagccuguuuucccauuauugcuauugaguuuuuugaaauggucucauuauuuagccucgacuagcccccacgcccuugccuucagaguagcuagaaauauacgcauguaccugcccugccugagaaagaauuuucaaagacuacucaaacuugugcaaagacuacccagcuacuuuugaauauauauuuauccacauauacagugcuaaguacccagacaguagacauccugaaaagaacggacaggagaaaaguaccccuggguccccuuuccagagaauaagggcaaaugacauuugauaugagaaaugaaucuccuaacuuauagacauauuuaaacuaucuuguugcugcaaaauuuguuugguacaaaacaaaacuauaccuuccccgggauuuauccacaagauuuucuggagagacucuaggaccuggucugggaugcaagacagucugagacugugauucugggcuguagcggcuugagguuuuaguucuuacagguguggaugacaaagcagauggugaaguuuggaauguagaaguagaaggcugcgagggaacuugauuucuagcaaaaucuugugugauaauuugcuguaaaugagaagcggaggaagucauaaagcuguuaaauacccgccaagagagcucccugugaacucagcuucuuguucugcauucucuguguguuucauucugaguacaaaacagccuuagacucagcaguaguccugccucaaagucccgacugaugggauaugugcccccaugccagcuuaaccuaaauaucuuugcuaggauuuucuuguguuuuuaaaaacaaacaaaaaaaaaaaaaccaaaaaaaaaaaaaccaaaaaacugcuuucugcauaauaauaauaauagcaacaacaacagaaguagagaagacuuacacagauguggucagcaagugugaucagucgauggguccugggcaccugucccauucccucugacugggaagaugggggcagugguggcuguugcuguggagauggugauuccugcugggaccgauaaugaugcaguggaccuucauacugucgaguggacucaucuaauagacgguagguagauacauuauccuaaggaugcuacuggcccacacucaguauaacucagaaaaacguaagauaugcaccaauacacauaauuuauguauuuauaucuagaaacaaaaaaaacccacugauuuauucuacuaguuuucaugcuucugaguguagaagugagcagaauuuucagccauuuuccuacauguguauaugcacacauguuuguuagagugagugugcacaugcaggcaaaggcugcuugcugucagucucuuuccucuauugcugucugccuuucuauuuuugagacaaggucucuuggugaaccugaagcucauggauuggcuagcuagugaguggaagggaucuaccauucacacucccugcaccucuugcuccagugcuggggcuacagggcuggauucuugguauccaaauucagguccucaugcuuguguaccaguuacuuuagaucuauuuucaauaaacuaugcacaaaagaguaacaauaguuuaauaguguauuuuguuaguacagcuuuaaguguuucuagaguagauuacucugcaacaaguuaaucuuaccauggccuagacaggaaacuagaagcaaauguuaaugcaaauaagaaacacagaaguggcaaaacagacauacuuucugcuugauuugccuuaaccaugucuggcugauaggccuguggcuuuuccugggguggugcaggugagcuggcgggacuuaucaccucaauggcaucacuagccguuucauaccugugagaagacacuuuaagaaaagaaccucauuuuaaaauaaauccauggaaaguuucaaaguccaaguuauucaaagcuauuugcauauuuuaggguuuuuugauucugcuaaagagaaguccaguagcauuccauacuagcaauaaaaucaaacucaauccgacucaauagacuguuaaagcugcccuugugcaaagcuugcaggguuuuacagcaugagaugaaacagaauuaaaaacauauuuguaauaagcccaugggagcccgaaauaaacccugggcuaacaucaucagaggagauuaguaaguaaguaagggguagaucucaacaguugauuccaauauucccauuucuguggaacaaucugaucuuagcaaaacagaccacagagcugguucacugccaagacuguuacugcuuauaaagcacuagagugagagagcgcccuguccgucuucgagccaucacaguugugguguugaccagcuaggagccaauucaaaacgggauguugagaaagacaagauuuuuguucagaugugugcccagugccacacugugggaagggcagcaagcauaauacuagauugaaucucuaugguguauuugggcagaagauaggucaagcugcaagacugacuuacaaagaugccaacaagaagaaaggcaucaccuggagagaggacacccugacggaguguuuggagaacccuaaaaagggacaccccuggaacaaacauuaucuucgcugaaguuaagagggugguagagggcagaccuaagagcuaauccuucaaaaguuaucagucacuaauucugccaccuuauuacaaaacaaauguuucauggcuuucaaugugugucauaauuuaauuuguaaaaaccgaaauuaacaucauguguggcuaacaauguuuuuguuggacaguccugauuuuaguaaaacugauguguggcaaaaaaauaaaaauaaugauuuuucucaaau

SEQ ID NO: 6061 - RNA, 15274 nt, Mus musculus
ucuacauacaaauucgagccaucuggaaagagggaccacaguugaggaauugccuccaucagauuggccuguggagcuauguguagggcauuuucuuaauucaggauugauguaggagggccacacaugcugugggccaugccagggcagguaguccuggguacuauggcaaggcaggcugagcaagccauggagagcaagcccauaaguagcacuuccauggacucugcuuuagguccuucagguugcuacuuugcauuucuggcuuucuucagugauggacugugaccuguaagccaaaugaaacauuuccucuuguagcaugcuuuugcucaugcuugagcauagcaacagauacauaaacuaggacagaaggcauaguuucagccauuagagaaguaaaugauuacuuacagggcuccuuuaaagguaaauuuugcuaauuuggugcgucauauaauaaugcauuaaauaauccauugaagugcauguuucaagaugggccacaccugucauuucagcacuuaagagacagagacuagaggaauuuaaguucaaggccaguuuaugcuauggugggagacuagccugggcugcauaaggagacucugucaaaacagaaagagagucaggccugguaguauauaccauucccaccccucacagagguaggcagcucucugugaauuugaggccaacugggucuacuuaggggguuugaggacagaacuagauaguaaggcuuugucucaaaaaaacaaaaaacaaaacgacaaugaccaaaacaaacacagaaaagcugggugggggugcacaccuuugguuccagcacuuaggauuuggaggcagagguaaaaggaucucuugaguucaaggccagauggucuacagagugaguuccaggacagccagggcuacacagagaccugacuugaaaacaacaacaacaacaaaaacaaaccaaaaaaaaaaaaaaaaaaaagguaaaaguacaggaaaaaaaaaccaguucccuaaauguuauuaaagguccagaauaauuaaagcacugcacaacauuuuggggaaaaaaacaauuuaaagucuagaauaugaaaauaggcguggaugacaucaccauggacacauuggucgcuuucacugagcuugugagucagcagagcccuagagccucagcauuuuccucaaucaaaaugugaauccuuaacuuaucuuuaaccugucuuuaaccuuguagaaaaugcuaaaggaguguccugugcuuggugccuguuuccugccuguaggcuuguuuuguuugugggguuggggauggaacucagggccucaugcaaucugggcaagugcucugccagaguuauauccucagcaucuacuuauuuucccauuccgucgauuagccuacauaauucuaaggguucagcacauuaaaucaucuuccucucucccggugcggugcuuaucuuaacagcagcgaggcauuagaaagccugcggcuuuaauuauuuagcugagcgaggaaauagaaucgacuguccacaaaggagcauacauuaggcuagcuugcuagcacuuccuggaauucuucuccaauaaagccauauagaucuauagugacagagaauccaggaggcagagcauagaaccauuggacuguuuguuauacacuucaaccccugcuucuccugucccagaaccuuccuccuuaguaggaaaccaaaagagaguggacuugaggccaaagugguucggaccuagcauccccucuuacaugugcgggauuaaaauaaaaccugaaguccuuuccuccaaauucucagagggcuugggcugagguucaaagacacgguuucagcagcgcuggcaagccugggcugccggcugccaagaggaagcaaaggacaagaauguuuccuagaaaagaacccagcaaaggagaccacagugggccuucugauagagagccaccaugggcacacaagcugcuguccuguuucuuuaaacucagauucuucugagaacuaaggagaggcugggcuuccacauaacgugauuagaggagucagugcaaaagaagugagguggguccaggaagcgggucuugugcugcccuuuagucugcugcguuaguuacuuucccccaucagaggcaaccugaggaaggaagggguugguuuguauguuugggguuuuuacuuacauccccaaggggaugcagucgauuaggucugggaaggcaguaggaaccgggaguagcugggugcuuucgucugcagccagggagcacagggugguaaaugcuuaugcucagcuugcccuagccccuucucagacugggauucuaacccauggaauggugccacccaaauuuaggagaguucuuuuuaacucaguuaagcuaaucuagauacugucucacagacacaggcagggauguguauccauagugauucuaaaucccaucaaauugaucacuguggaacuggcacgauagcucagugaguaaaagcacuugaugccaaguauaaggaccaaaguucaugucccagaacccacguggcaggaagaagaacucuggcaaguuguccugugaccuccacacacgaacaacauauaaacaaauaaauguguguggggugucgugguuaagaugaacuauaacauguuuauaacuguacuuaauuuugcugggcagugguggcgcaugccuuuaaucccagcaguugggaggcagaggcaggcagauuucugaguucaaggccagccuggucuacagagugaguuccaggacagccaggguuacauagagaaacccugucucgaaaaaacaaaaaacaaaacaaaaaaacaaaaaaaaugaagaaaggaagaaagaaagaaagaaagaaagaaagaaagaaagaaagaaagaaagaaagaaagaaagaaagagagaaagaaaagaagagaaaagaggggaaaaaaggaauuguacuuaauuuuaaaguacaugcaguuuuacgugagaggacacaugccaagacgcaaguggaugccagaggccuuuugggaguugguucucuccuuuggcuguaugggucucucggguuaaacgcaggucaucaggcuuggcaauaaaugcuuuuacccacugauccauccggcuggccuuugguuuguuuuuuucugagacagacucucucuguaggccucgccgcugacauagaacuugcuauaagaccugucuuuucagugucuccuuacccuuccuugcagguuuaugucaccaaaccuggagugaugcuagagacuggagguuuagagaaaguuuucaaauauuauaaaaguaagauuugaagugguauuguauauuauggcacucaucaaagcaacuaguaaaauagcaaauaguugccaaaugucucucaguaggccauuaaugaaucucuguggugguuugaaugagaaugacucccacaggcaaacaaauuuaaauguuagucaccagcgaguggcacuauuugaaaagauuaggauuagauggugugaccuugauggaggaaguguaucucucucucucucucucucucucucucucucucucuggcagucugaucucuguaucugucugucucucucugucucugucucucugccucucugaguuuggaccaggauguagcucucagcuacugccccagcaccaugcaugcaaccauguucccugacaugaugauaauggacgaagcagcugacauucugagcaagccccuaggaaacauuuucuuuccuaagaguugcugcggacauggugacucuucacagcaauagaacaaugaccgagacaaccguacuccagagauuacuaugcauuuuuaauaaccauggaaguuguucgagguuuaagguaauauuaaguuuucagagacauacuuucuuuuuuacagcuuucuauauuuuucauagguuuaauaauuuacacucaauauaagaaaauuggccgggcggugguggcacacgccuuuaaucccagcacucgggagacagaggcagguggauuucugaguucgaggccagccuggucuacugacugaguuccaggacagccagggcuacacagagaaacccugucuugaaaaaaaacaaaauaaauaaauaaauaaaauaaaaaauaaaaaggaagucugggaugagcuuagaucuggaacacuugcuuaacucaugaagcucuggguuuaaucccaguuagugguccucacuaccaauguccaccaaccacaaagagugagguacaugccuaaaaucccagcacuacaccagaagcugaagaggaaggaucucaaguucaagaccagccuaagcuauuuaguuaugguuucuauuucugugauuaaacacugucaccaauagcaacuugaugaggaaagggcuugcugcaggaaucuagaaguaggaacugaagcaaacagcuuaccugccugccuucuuuccuucuuuccuuccuuccuuccuuccuucuuuccuuuuuuuuuuuuuuuuuuuuuuuuuuuuuuuuuuuuuuuuuuuuuugugacagaguuucauuguguagcccuggcuguccuggaacucccuguguagaccaggcuuuccccaaacucagagauccaccugcuucugcuuccccaagagcugggauuaaaggugugcaucaccaccacccagcucagcauugcuuccuuauaugaguuagaaccacuugccccaagccagcaggacccacaaugggcuggacccucccacaucaaucaauaaucaauaaaaugcccaacagacuuuccuauaggucagucuuauugaggcauuuucucaauuaagagucucucucccggggcugaugagaugucucaguggguaagagcacugacugcuuuuccaaagguccugaguucaaaucccaacaaucacgugguggcucacaaccauccguagugagauaugacacccucuucuggucugucugaagacagcuacaguguacuuacauauuuaaaaaaaaaaaaagaguaguuaugggcuggugagaugguucaguggguaagagcaccaacugcuuuuccaaagguacugaguucaaaucccagcaaccacauggugguucacaaccacucauaaugagaucugauacccucuucgggugcguuugaagacagcuacagugaacuuauaauaauaaauaaaucuuugggccggagcaaguggguuggccagagcaagcagagguccuaaauucaauucccaacaaucacaugaaggcucacaaccaucuguacaacuacaguguguacucauauacauaaaauaaauaaaucuuaaaaaaaaaaaagaguaguuaagagucucucucccaccaggcagugguggcgcaagccuuuaaucccagcacucaggaggcagaggcaggcggauuucugaguuugaggacagccagggcuacacagagaaacccugucucgaaaaaacaaaacaaaacaaaaaaaguuucucucggcaaaagauucuagcuuaugucacaguaacaaaaaaguaaccaggagaguaaauagugagcucauugaaaagucuuccucaaaagaagagaagaggcuagagacggcucagcaguugagggcuugccgcucuugcagaggcccuggauuaagggcacacacagcaguuuacagcugucuguaacuccaggucccggggacccuauggucuugucuagcuaaggagagcauuagacacacaucuggugcacuuagauacaauaaaacuaaauuuuuaaguguuaaaaauagugauaaauuauugccgggcgugguggcgcacaccuuuaaucccagcacucgggaggcagaggcaggcggaucucugaguucgaggccaaccuggucuacaaagugaguuccaggacagccagggcuauacagagaaacccugucucggaaaaaaaaaaaauagugauagauuauuuagguuuguuuugguuguuguuguuguuuuuuuaauccaaaauucagaagcaaaaugagggcuaagaugggaacuggcucaguguggguuccugcaagcuucagggcuggaaggaaaacaaucuaggugagguaggaaggaagcuugcuucagccugacuuagcaggugcccggccacacuuuugaagucugacacuggguguuuuauuuuagccauauuuaagcacagcacaauuuugaaggaaaaaaaaaaagcuuucugaugacaguuaaaucagucccuuguguacaacaaagcucaaaacauguuugcauuggaaccuuugacaaaguacauaugauuucuuccauaaagaugaggacuguugacucagaaacaauacucaaaauacaggucuagggccuuuguuuuguuuuguuuuguuuuuaaagauuuguuuauuuguuuguuuguuuauuuaauguaugugagcacccuguagcugugcagaugguugucagccuucaugugguuguugggaguugcuugcucuggucagccccacucgcucagucccugcucacuccagcccaaagauuuaguuauuguuauacauaagcacacuguagcugacuucagacacaccagaagagagcaucagaucucauuacaguugguugugguugcugggaauugaacucaggaccuucggaagagcagucagugugcuuaaccucugagccaucuccccaagccccaggccuagcguuaaugacugaggugaacauaugccuauaggagucaggguuggcguggcccuaagauacauacauaaacguugcuuagccuguuauaagugcaagugacaucucgcauaaggcuggguaauauggacugagaagcaaugcuuaagauuuagguggggcagaaucuagaauaaacaaguaauauucugggggauacagcugaagccuggcccuacaauggcaaagggucaccagguuguaaacuacauccuuccccaguguucugggaggaagguaggcaaaccucuucuuucuuugaagagagaagccugcauccacauguuuaacuuuccuggcuucuccagugcuucucugugugcacaaggaccacuuacucuguagugcucagugccuaacagcauuugcugugcaagcaggaagaccugaauuggaauucccagcacauaaaacaaaaaccaugugcccauaaccccugguucugagacaaagggugaggacagaucaugugcuugcugguucccagcccagccgacacaugcugagcucuaggaucagugagagaccuugucucagggaaauagaagacauuggauagccucuuuuggccucugcauaugcaaggcaaauaaaccugcauacagacauguacacacacauacacaacacacacagagagagaaauaaguccagaauaaguaaaaugaaaugccuugggagugcaguuugugagcuguuguuauuggugcuauuuugaccuguguuucagauuagcaaauuaaccuauuuucugcacauaccugaacaauuuccuagugaccuucuauaaguccccacaacaggcuaacuuaaaaacaaacaaacaaacaaaacagauuuugucaggcuggagagauggcucaaugguuaagagcacugacuccccuucugaauguucugaguucaaaucccaguaaccacaugguggcucacaaccaucuguucugacacccucuucuggugugucuaaagacagcuacaguguacuuacauauaacaauaaauaaaucuuaaaaaaaaaaaaaaaaaaaagaugucugcccaggaggcagaggccggggaucucugugaguucuaggccagccuggucuacagagagaguuccagggcagccagggcuacacagaaaaacccuaucucagaaaaaaaaaaaagaaagaaagaaagaaagaaaaacaaacaaaaaaagauuuugucaggggguuggagagauggcuccacgguuaagagcacuggcuuuucuuccagaguacccaggcagguugaauucccaguacccacauaaaagcucacaacugucaguaacuccaguucaaggacacaguucacacagacaugcauacaggcaaaacaccaaugcacaugaaaauaaaucuuaaaagaauauauauuuggugagucaugguagcucagccuuuagucccaucaaugcagguaaaucucggucuauaccuugagcuccagaagagccaaggcuacauaaugagucacuauuuuuuaaaaaacauuauuuuaauuauguguuuguaugugagagaauacuugugaauacaagugcaguauucacagaggucagagaaggugucaggucuccuagagcuggaguuacaggugguugugagcuccugucaucaguguuggaaccaaaccuggguccucugcaagaacaguaaucucucuuaacuguggagcacuuucugcaggguccucugcaagaacaguaaucucucuuaacuguggagcacuuucugcagucuccuucccuuuuuccuucuucccuuccuaucucccuucucccuuguuccuccuccccccuucuccucucugucucuauuuucuguguugguacuaggauuaaacccaggacccugugcaugcuaaggucugccagugacucuaaaauccacaacccuuuauuccucuuuuaaauaacuguuaaaauuaauuuuaaguuuggaggugcaauaucaagcaugcuugccaaucugucucaagguucuguggguucagucuucaccugcacauacauacacacacauacaguaaauaaauauguaaauaaauaaaaauuagauguagcuaucccagaggauuuuaucaucuccagaaacuauauuaaaaauuaaguuggggccagguuuuuuguuuuuuguuuuuuguuuuuuuuuuucgagacaggguuucucuguagucuuggcuguccuggaacucacucuguagaccaggcuggccucgaacucagaaauacgccugucucugccucccaagugcuaggauuaaaggcgugcgccaccacugcccagcuggggccagguuuuuaccuuuaaucccagcacuugugagucagagguaggaagagcucugugaguucaagaccauccugguuucagagugaguuccaggauagccaggguuacacagagaaaccuugucucaaagaaacaacaacaacaacaacaacaagauagauagauagauagauagauagauagauagauagauagauagauagauagaucgaucgauggauggacggacggacggacggacggacggacggacggacagacagacagacaacagacagacagacagauguauggauagauggacagauggacuugggggcuggcaagguggcucaacagguaaagcugacaaccugaguuugaucccgagacccaugugguagaggaagagaacugacuucuguaaguuguccucugaccuccacacacugaagcaugcaugcacuuguacaugcacacacucacaaauaaauaaaauuaguuauuuaaguuaauuuacuuauguguguagccauguggucugcagaggucagaagagggcaucagaucacaugagacuugugaaauucuuguagcagacuccugugaguacuggaaauugaauccggguccccuagaagagaagcaaguguuuauaagggcuaagacaucucuccauccccaaauaaaguaauuuuuaaaauagacuugggccaggcauagaagcacaugccuguaauuccaucacuugagaggcugaggcaggaggauugcugaaaguucaugaccuacuuggacuauaguguaagauacuaucucaagcaaacaaacuaacagaccugcaacuuaucucuagcaacaggacuuuagaucuggccucccuuggccccaugaggcaagcaggcacacccacacuccaaucuccaguccucuguucauaaaauaaaaguucucuuagauuaucgcuaaggucuuuuuuuuuuuuacaacaaccacuuuauuacuuaccagacagaacaauuaaccugcaaagagguaugugcuucaugaauaaaauacaaaaugcccaauuacguuugcauuuuagcuuaaaccuauuuuuagugguaaagauuacucuaacuuuucaugggauauaauuauccuaaaaagcuauuggugaucuaacugaaauucacauuuuuguuuuguuuuguuuguaaacaagaccuuacacuguuauuuagaucaagcuguuauuuagaacugacucacuuguaaccuuaaguagcucaaaucuauggcaggucccugucucagccuucccaguccugagacugcaagcaugagccaucaucauccaugcuuugaacuuuauuuaguuuuaggaguucauuagucuggccuggaacucagagagguucacuugccugagugguggaagaaaggcccacccacuggccacccagccaagccugaaauuugaauuuuaacuggugcuuaggguaccucauagaugucaggcagauggcccaguccugccgccuggcuuucccgccucuaucuucuuacgugugugugugugugugugugugugugugugucugugugucugugugugucugugugugugugugcgcgcgcgcgugcucgagugugcccaugccauagcacacuuguggagaucgaaggccaacuugcagaaaucaguucucuccacuguggucagggucaauagcaagugccuauaucccuucuaagcuaucuugcuggcucaaccugucuuuuaucuacuuagcuugaaacagauugugcauaucaaauuacugcuuacucuguuguuuaccuauuaaacaaauucccagaauucagggaggaaaguuacuggugaccuauuuucuagaacuggcugccaagacuacaccugacacaucuguuauuuacagcuucaucacugaccuuuaccacagaauuccugcuacuuggaauaugccuuaguagacauuuucauuuaccucucaacuuucauuguuuuaagcucuuucaacaucuguauaauuuuucucaucauuuaaacagggucuggcaagaugccucagcagguaaggguguuuggugccaagccugaugaccagaguucaauuccugggacccacaugauaggagagaacugacucccacaaguuggccucugaccccuacccacccacccacaaaacaaaaaugauaaaauuaauuaaaauaaauguaauuaaaaacaaaaaacaaaacaaagccgggcagugguggcgcacgccuuuaaucccagaacuugggaggcagaggcaggcagauuucugaguuccaggccauccuggucuacagugaguuccaggacagccagggcuauacagagaaacccugucucgaaaaaccaaaaaaagaaaaaagaaaaauuaaaaauaaaaaaauuaaaaaaaaauaaacaaaaaacaggcuacagguguuagcucaauugguagaauguuuguuuugagcaucaaguccuggcuucagucucaaguaucccauuaaagcaggagcgguggcacacuccugcacucccagcacuugggagaaagagucagaagcucaaugucaccguuaguuacauagcagguccaaagucaucaugagacacaggagagccugucucagaaagagaucuugcugccuggccuaagccagucuggaggucuuggcccuucugcccuacucuccugcacagcuggaauuauaggcauaaaacggagcguccggguuuaugagauuuuuuuuuuuuuuuuuuuuuuuugguuuuucgagacaggguuucucuguguagcccuggcuguccuggaacucacucuguaggccaggcuggccuuaaacucagaaauccaccugccucugccucccgagugcugggauuaaaggugugcaccaccacacccggcuaguccccuacagucuugucaacuaagaacaaccagcucuauuaccuguuguucuucagacuguuuugccacacugugacuagauaaauguagugcuucuaaugcaaaggcgaugcaccagcucuccaccuugguggacaggugaccugcccugagcucccuccuccgcccucgacuuguccuugguguccuuuucuuccauguuccuaagaucuaauuugcugcugacuccaguagucuuccuuaacgacagcugucggcucuuuacugcuuuccauuugccugguuacuaccuuugggcuagaucauuauaguuccuaaguauucuccacuuccccgguuuaauccuccaguuuguuuccuaaggcauccuuggcuuggcuacuccccuauugaaaccugcucauaauuccucaguguacaccauuugucugugacuggacagguaucucauacccccggcaaacugaauuuccuguucucaaaacagcuuagccccccaccccacuccuuagcacuccuucacuuuggcuguucaccuggaauuccagccuucucuugaagggucuuuuccuccugcuccagcagagcuucuuccuguaugaggcagggggagguuuuuaugucuuuguuguggugcugguaauaaacccugagcguugcuuguucuuguuccuuuuuuuuuuuccgagacaggguuucucuguguagcccuggcuguccuggaacucacucuguagaucaggcuggccuugcuuguucuuacucggcuggcugcacaugcuguccugcugucccuaaacuguguuugcucuguacuccagaagcguccaucuuccugcacuggaucuccggagcauuuuggucacuuccuugcaauccuuucucugaguugucauuauuugaaaacuuugcugguucuucugucuguuuaucucccuuacuucaucucuuaccaugcucagcagcucagucaagccuauaaugaaagcacauuucuaaauaaagcuguccuguuuugguuuuuuuguuuuuuuuuucccuuggugacuccaguggguagcacccagaucgccuaaugcuuuccauuuaacuguugaggauuuggaaggauuuggggcccaugucuucuggcuuucuaccuugucuauuuucuuuacuuuaaaugcuugucaaaauaaaaaauaaaaauuggucaggcaguggugguacaugccuuucuuuaauccaagcacucaggagguagagacagguggaucucugaguugagaccagccuggucugcagauugaguuucaagacauccgagcuacacagaaaaaccuugcuuagggaaaaaaaaaaaaucagaaauaaaaauugaagaaacuaaaauuuguaguauaacaugucaauucauugcuuaugacagaggugggaggaucaguucaaggccacccuucguuaacaggagagcucuaggccacucuguccuaaaugagaaccugucuuaaaaaaaaaaucagauauacccucuucauugaagugacuguaauuuuaguuucauuaaaaugaagaauuuagcugggcauggugccacacacauuuaauuucagcauucagggggcagaggcagauggaucucuguggguucaaggccagccuugccuauagaucuaguucuaggacauccaaagcuacacaaagaaacccugucuagaaagaaaaaggaggaagagggaggaagagaggaggagaggaagaagggaggaggaagaagacccaggauaugggugacaugugugaguguuugccuagcuagcauuggucccaaccccagcagagcguaaaggagauaacacaccugcaccuuaacuucagccacugggaagaggggcaggaggguuaaaguuugccgucauucucaucuacauaguaaguuuaaggccaggcuacaggagccccuauuuuuaacuauagcccuggcuguccuggaacuuacucuguagaccagacuagccuugaacucagagaugcuccagcuucugccuccugaguguugggaucaaaggugugcaccaccaucaccuugcaaauaaagcagucagagguuaagcuacuaccccuuucuucuccauuugaaacaagauagcacaaccuucucagaagauuuuuuuuucuguuuuuauauauuccuaaguauucuucaacucaggcagacccccaacaaauuaggucuggucacuaacaauagaaaagucaagacaagcagggcguguuggugcacgccuuuaaucccagcacuggggaggcagaggcagggcggauuucugaguuugaugccagccuggucuacaaagugaguuccaggacagucagggcuauacucgaaaaacaaaaaacaaaacaaaacaaaacaaaacaaagaaaggaagaaagaaagaaagaaagaaagaaagaaagaaagaaagaaagaaagaaagaaagaaagaaaggaagaaaagucaugacagaaagaaacuugauuuucauuaugaucauaucggacagauggaggagacgaauaaaaaagcagucucagacuguggucugguuagucauuggcucgucuguauccuaguugugcuugguaaguccuaggaaacugaccuaguucacaugcaaugauuguuccugucggggaagggagggcaaccucuguuuccacuucagucuagccuucagcuuugaagggagucugaucaacuuagggcaaacccucuuuguaucaaccauccuuagauauacccucucccuugccccuaucccagcccuaccccaaaucuagaaucuuguaacugcugaacaugugcuuucccacugaagugcauacccagucccuucaaccccauaaguuauuagagugccuacuugugaaaccgggcagaauccaaguaaaggagauagacacagaaugaagacagaaauggacgucacgcuucaagucugccuuuuggaucuugagagcucagagaugaaguguucuugugugcuugcuugcuugcucccuugcuuguuuccagacaggguuucucuguguagcccuggcuaccuggaauuggcucugcagaacaggcuggccucgaacucacugucaguccuugauacuuaccaggaaucagaugacagguuuauugugaggccaugcuaucaccguguuagguguccauguaggguccaggugagggaguuaaacuuuuccuuagucugguaugucugauaaguucuuuggccugguuaugauuucaauacaaccaugugccccuacugucucaauuc

SEQ ID NO: 6062 - RNA, 2742 nt, Mus musculus
agcuguaaaugaugcauauuuuagucaagaccaaucuuuaguuaaaucaugcccaaaauaaucaguuaagagcccccaccacccaagccaccacagaauuucacaagugacaccauauaugcuuaccaugcaacaaaaccuuuauuaacauuuuuuaacagagguucagcuauuauugaaacuuguaauuucuaaacuuaaauuggggcaaguggcuagagugcagaguaaugccaucacugcccacugggaaugcagaccgaauaauuaauagccaccccucagacggaggaccaggugcagggucgacucuuucuggauguuguaaucagagagagugcggccaucuucuagcugcuugccggcaaagaucagccucugcuggucaggggggaugcccucuuuauccuggaucuuggccuucacauucucgauggugucacugggcuccaccuccaaggugauggucuugccggucagggucuucacgaagaucugcaugccaccucucaggcgaaggaccaggugcaggguugacuccuucuggauguuguaaucagagagggugcggccaucuuccagcugcuugccggcaaagaucagccucugcuggucaggggggaugcccucuuuauccuggaucuuggccuucacguucucgauggugucacugggcuccaccuccagggugauggucuugccagucagggucuucacgaagaucugcaugccaccccucagacggaggaccaggugcaggguugacucuuucuggauguuguaaucagagagggugcggccaucuuccagcugcuugccggcaaagaucagccucugcuggucaggggggaugcccucuuuauccuggaucuuggccuucacguucucgauggugucacugggcuccaccuccagggugauggucuugccggucagggucuucacgaagaucugcaugccaccucucaggcgaaggaccaggugcaggguugacuccuucuggauguuguaaucagagagggugcggccaucuuccagcugcuugccggcaaagaucagccucugcuggucaggggggaugcccucuuuauccuggaucuuggccuucacguucucgauggugucacugggcuccaccucuagggugauggucuugccggucagggucuucacgaagaucugcauuuugaccuugaauuuaaaagguaaaaauuuaaaagccuacuaaaaucuucgauucccuacaaaauacuucuacucaaaacuccuccccuuuuugucauaacauaaaaccuguuuugucaugguuucaaacugcuaaaccuuuccaaaacacuaaacuggcauuuggaacauucaucaacugcggggcauccaaguucgcuaacaauagacaugauaaauugaaaauaaaaaauauccagaccagaagccaucgauaaaaauucaaguaauaaacaaugcccgagugagaaguaccucuuuucugccuccccccacugaaauaaccacgauggacucuccaucgguuaagcguccguuaagcucccuggcgcgcgcgccagggccgcccccgcuccgcgcacgcgaccaaggcccacucuucccggaaggcccguugccgcgucacgucaccucgcuccccucccccaccccaagaaaaaaaaggcccgcuuagcaccacguaagcccccucucuaaauccucccaugauucaaacgccguagacaaauaccuguuaacaaaugugaugaaagcacaaaccgcccagcgcgucgaaacacccucacagaaagaccgccgaaccggacaaagccucucgucacugagcucaguggccgcgcgagccgcuauuuaugcagcgucuguugcgugacugcucacuccuacguagcuguugucuuccugcgccaccgaaaguaguuccgcgggcccccaccucccccagaccaauuaggcguuuuugccgagcucccgauucuucagaaccaaagaaaagaguacuaccaaacgagagacacuguauucccggcgucucgucuccucucgugcaaaaaauugaaaaaaucaucacgcggaugaauccaaguuaaagggcccucccucgaaagcucuggaaaccuccuugcggcgccagcgcugauuggugaggagucaaagaugaggccgacgcugauugguggaggucgcgggccgcucgauuguugcugggcucgguucucgggcaguuuaacgucgacguugcuaaguaaccgagugcgcaugugcgggcgcucgccuuagcgaaauacugauguuuccugcuugaggugggggaggggcgucuucucuucccgcguccggaaccccgcgucccgaguuccccgugguucucucgcacccaucgcucggcggcuuuacgccacagggugaauugcgaccucacccugcucccccuggcuggacucuagcuucgcccaggcccccuccaguaugagcauugaugcuuccguagccaguguuuuuaguuguuuugucuuguggcuuagccgcccacgggcccagaugugggugggagugggguggcugccgggcuggaagcugaggauuuagccagagacccagcccagagcccggccggacuuacagauucucucccuccccagcaaucuacaaacaaaggaaggaaagaggagaaaugccuauuagacucaguacccgggguucacccaccucucccauugggaugucuauugugcaaag

SEQ ID NO: 6063 - RNA, 1696 nt, Mus musculus
acaaaaccuuuauuaacauuuuuuaacagagguucagcuauuauugaaacuuguaauuucuaaacuuaaauuggggcaaguggcuagagugcagaguaaugccaucacugcccacugggaaugcagaccgaauaauuaauagccaccccucagacggaggaccaggugcagggucgacucuuucuggauguuguaaucagagagagugcggccaucuucuagcugcuugccggcaaagaucagccucugcuggucaggggggaugcccucuuuauccuggaucuuggccuucacauucucgauggugucacugggcuccaccuccaaggugauggucuugccggucagggucuucacgaagaucugcaugccaccucucaggcgaaggaccaggugcaggguugacuccuucuggauguuguaaucagagagggugcggccaucuuccagcugcuugccggcaaagaucagccucugcuggucaggggggaugcccucuuuauccuggaucuuggccuucacguucucgauggugucacugggcuccaccuccagggugauggucuugccagucagggucuucacgaagaucugcaugccaccccucagacggaggaccaggugcaggguugacucuuucuggauguuguaaucagagagggugcggccaucuuccagcugcuugccggcaaagaucagccucugcuggucaggggggaugcccucuuuauccuggaucuuggccuucacguucucgauggugucacugggcuccaccuccagggugauggucuugccggucagggucuucacgaagaucugcaugccaccucucaggcgaaggaccaggugcaggguugacuccuucuggauguuguaaucagagagggugcggccaucuuccagcugcuugccggcaaagaucagccucugcuggucaggggggaugcccucuuuauccuggaucuuggccuucacguucucgauggugucacugggcuccaccucuagggugauggucuugccggucagggucuucacgaagaucugcauuuugaccuugaauuuaaaagguaaaaauuuaaaagccuacuaaaaucuucgauucccuacaaaauacuucuacucaaaacuccuccccuuuuugucauaacauaaaaccuguuuugucaugguuucaaacugcuaaaccuuuccaaaacacuaaacuggcauuuggaacauucaucaacugcggggcauccaaguucgcuaacaauagacaugauaaauugaaaauaaaaaauauccagaccagaagccaucgauaaaaauucaaguaauaaacaaugcccgagugagaaguaccucuuuucugccuccccccacugaaauaaccacgauggacucuccaucgguuaagcguccguuaagcucccuggcgcgcgcgccagggccgcccccgcuccgcgcacgcgaccaaggcccacucuucccggaaggcccguugccgcgucacgucaccucgcuccccucccccaccccaagaaaaaaaaggcccgcuuagcaccacguaagcccccucucuaaauccucccaugauucaaacgccguagacaaauaccuguuaacaaaugugaugaaagcacaaaccgcccagcgcgucgaaacacccucacagaaagaccgccgaaccggacaaagccucucgucacug

SEQ ID NO: 6064 - RNA, 1909 nt, Mus musculus
aagauuuauuuauuuuauguaugugaguacacuguagcuguacagauaguugugagccuucauggggauuaggaccucugcuugcuccagucaacccuguccacacgcuccagucagcccugcucuggcccaaagauucauuuauuauuauacauagguacacuguagcuaucuuuagaugcaccagaagagggcaugagaucucauuacgggugguugugagccaccaugugguugcugggauuugaacucaggaccuugggaagagcaguuauugcucuuaccugcugagccaucucgccagcccccuaagguuuaguucuuuaugcagaaauaagcaggcaccuccaucuugguaugugauuagcucucaucucuaauaagugguguacaagccagguaugguggcucaagccuuuaaucccagcaccuagagagcagaggcagguggaucucugugaguuugaggccagacuugucuacaaaguaaguucaggacagccagggcugguuacacuaagaaauccugucucaaaaaaaaaauuauuuauuuauuuauuuauuuaaaaaugguauacaauuagauagguagcugaauuauuuaaaauucuuugauuuacauuggcaaggguuuuauuuauaaacuuauuucauauaucuaaauaccuagggccacauaaaaguuucucaggcagccaggcguuugacguuagcacaggaggcagaaucaggagacucucugugaguuugaggccaguuugguuuacauaggaaacucaaggacaacuagaacuacauagagagaccuugcuugggggaaaaaaaucccucuuuggcaaagccugguugcaagucaaaaguuuaucagcucucaccuagucuguggaaacuaaccagaccacuggggucagcucuagccaccacuuacaaacagguuucuguugccucccaucuaauuagcuaacaacagaaucugcuucccuggguaugucccucuuaauguguaagguacuccuaggaccuuguuucgggaaaccuuugagcucuguaaaaccagagggagaugcuacaugguccccuccaaccccagcgcccaccagcucccuugcagagaugcgagacccagguugauacccuugagaauccuuggagguccaaaggcagaccuuucuucuuuuucuuugggggugggugggaggguucgaaacaggguuucucuguauagcacuggcuguucuggaacucacccuguagaccaggcugucucugucucugucucugucucugucucugucucugucucugucucugucucugucucucuccccacuguagcugucuucagacgcuccggaagagggagucagaucuuguuacagaugguagugagccuugacuucuuagaacagagauccaaguauaggcccggaggaaguaggaaaggggcgggaugcuggaggguagcggaaggucuagggguuggcaggagaguggggggugugccugaggcagaaugaagggcuaaggggugggggagaagaugggagagugggagcgaagagaggagggugugugggaugagggaggguacggagugggagggaccugggggaguggguuuagggugaggaagugggcugcaggcauguguugggugcaguaagguggggcugucgaccugccuucugcuucccggauccuuccuuggcuuggcugauugcuggauugucgucaucuucugccucacucugaugcaccuuuggcccagacugagcugccagagccuguccuucgucauucugccccaggaucauucuucuaccugugacagucuuucugcuccuucuuugcaccaauuccugccugguuugaucuguugcagucacccagaccaggaaaugucuuccug

SEQ ID NO: 6065 - RNA, 1936 nt, Mus musculus
aucugguuuauaaacaaauguuuauuuuuaaaaggcauagaagauccugugguacagacaggauuaccaaaugugcccacccagaacaaaauuggcagacaugucacuuaggauauuugcuuucaggccggcuggagacuccucugggaauauagccugcaaaagagcugaauuucagaaucacuccugccuggaucaauggcauuuagaacauuuaaugauaucuucagaaaaccauaggcucaccacuaccaaucugccgguaauuccagcuauuuuaggugauaucaucauuugauaucucucagaguaauaacagauagucacuguacagaccaacucaccucugcugcugccagcacagaucugcaguccugcguccguucugagaacuugaaaggggacacccuaaaauggauugcagaaaacaggacauuauauauaacagccuugcaaaaucaauggcugcccucccacccuggcuuuucucuuuuggauuucuuuguagcccuggcucacuacuguagacgaggcuggccugaacucugccugccucuucucaagaaagcuacaguucuuaacacauccuagaccuaaaagggaaguauuuuucaaauuacuaaaauacauuuacaacuagccaaaccagcccaacuggguucaauuguaagaccacauuaacugaaaauuuuaagacccaaguuaauggacuagaaggucuaaguucuuagaagaccagguuugacugccagcacuaauuguggcucacaaccaccuaaguccggugccauuuuuuucuagcaucaagacagcaaacacacacaaaaauggcucuauagggggcuggagauggcucugugguuaagagcaccgacugcucuucggaagguccggaguucaaaucccagcaaccacaugguggcucacaaccauccguaaugagaucugaugcccucuucuggugcaucugaaaacagcuacagcguacuuagauaugauaaaucuuaaaaaaaaaauggcucuacaguaagagcugugcacuguugccuuacuuaaccacccccaucagcuacaaccaguauugaguacaggcaaaacugaugcucauacaugaacacucuagcucaaaucaaaacggucuaaaaucccaagcugaaagcuuaccucaugggaggccacagcuguuggcaaucuuccacucuuaaauccccaaccuagaaguacagcaguuguuaaaaguccagcccaaguuaaaccuaaaccccagccaccggugugggcuugacugcagucagccaggagcaguuaucgucaguuaucgacucugacggcacuuccuacuuagucaucucaucacagcagucaagcuuucugcuguccuccaacuaguaguuccagccacuaaauggagacacgucuuaaauuuauguaugugcccacaugggccaggguauguugggagucccuggagcgaaagcuacacagccucuugucuaugaaccccaccugauacuccagaaacccuuaccucauggugggaugauacugcuccuauuccacguugucaacgucccgucugaaagguuagaagaguaagagucaugaggggcaauuagaacacuuguguucagcacugggucgccgaggcuuaaacgacugcagucagcuaacuagggaugucgucaguugucgcaucggacggcacuuccuuuuuuuucuaguuucaucaucauugcagccgacaccccgcccacgcgcggcgccccgcgaugcagaccucgacuuaccaggcuccccuagaucugugcagcgcacaaggcggagcugagaggcugggcccgggcucagcaucgcuccagaccgucaccagcaggccacggcgaagggaccagcucaacgagcgagaagagcacgaucccaugauggccgcagagaa

SEQ ID NO: 6066 - RNA, 1382 nt, Mus musculus
caggacucccuauaggguccugcugaucgguaccuucccuggcuucuuccccaguaccuggccccucacccagcucaaggaugguugguagguggcccuguuuuggagagcgcuuccggaggcugagcagaaagggcugggguagugagaagauguccacauuguugcccaggucaauccaugugacauuggggaauuugcugggguccuucagggugucagugaggucccucagcagagcccgggucagucgguugccauugagggcaagugugguaagacgaggcaggguacugagagcuggcaguagcugcagaaccaugucaucugugaggccugugaagcccagcuccacgcuguccaccuguucuccacagcgcugaagguagcuggucacucgcucgaggucccuugaagucaguggaaugccugacagauccaccauguugucuggaggauucccagauaggagggccuuaaggcugaaagaaaaggaaccagcagguuaagcaagccaggcaggucuuuacuggaggcaguagugguuaucaccauggagagaugggggggggggguccuguuugguugugaauccccagugucugcuucaagcugagcagaguaggcagagcguggucuuggaggcugccauuccagugacucuucaagccuauguuuuuauaugaugccugcaguucccucuuaacuccuuuguuuucuacccuguacucuaccuaguuaauuacagucugugcuucacuugccuaaaaaaaauauggaccuaccaacaucauaggguuaugaggaacacuaaacaaaguuguucaacaaugccaccuauaggaaaugcugucauuguuaaucacuuggccugagcuacaucugucuugccuccaagaguugaagacagcagguuggugagagggcuucuggagcaacagcugcuggaggaucgaugcucucagcuucucccucucccugccaucugcugccccuggccuuguucuggagcccagaccacucggccuggugguaggugugcccccaaccuaccacacccauuggugagcuacugguuccaagcaagccccgugucucuuacacugaggacaguucgacuugcugcaagaguguguuuacacugucagcucaaaagucacaggcagcuccccuugggcccucuugaagcugggagaugaauucauuuuguuccuuggaaacugaaggguaaaacucaaacgcgagauucaacugccucgaauccugccugcaauucguugguugugacauuacuguuggguucuacgucuaugucauuaacaaagucaacccagcauccugaagauggcugacaauugacagccuagaggcagguagguaag

SEQ ID NO: 6067 - RNA, 1382 nt, Mus musculus
cuuaccuaccugccucuaggcugucaauugucagccaucuucaggaugcuggguugacuuuguuaaugacauagacguagaacccaacaguaaugucacaaccaacgaauugcaggcaggauucgaggcaguugaaucucgcguuugaguuuuacccuucaguuuccaaggaacaaaaugaauucaucucccagcuucaagagggcccaaggggagcugccugugacuuuugagcugacaguguaaacacacucuugcagcaagucgaacuguccucaguguaagagacacggggcuugcuuggaaccaguagcucaccaaugggugugguagguugggggcacaccuaccaccaggccgaguggucugggcuccagaacaaggccaggggcagcagauggcagggagagggagaagcugagagcaucgauccuccagcagcuguugcuccagaagcccucucaccaaccugcugucuucaacucuuggaggcaagacagauguagcucaggccaagugauuaacaaugacagcauuuccuauagguggcauuguugaacaacuuuguuuaguguuccucauaacccuaugauguugguagguccauauuuuuuuuaggcaagugaagcacagacuguaauuaacuagguagaguacaggguagaaaacaaaggaguuaagagggaacugcaggcaucauauaaaaacauaggcuugaagagucacuggaauggcagccuccaagaccacgcucugccuacucugcucagcuugaagcagacacuggggauucacaaccaaacaggaccccccccccccaucucuccauggugauaaccacuacugccuccaguaaagaccugccuggcuugcuuaaccugcugguuccuuuucuuucagccuuaaggcccuccuaucugggaauccuccagacaacaugguggaucugucaggcauuccacugacuucaagggaccucgagcgagugaccagcuaccuucagcgcuguggagaacagguggacagcguggagcugggcuucacaggccucacagaugacaugguucugcagcuacugccagcucucaguacccugccucgucuuaccacacuugcccucaauggcaaccgacugacccgggcucugcugagggaccucacugacacccugaaggaccccagcaaauuccccaaugucacauggauugaccugggcaacaauguggacaucuucucacuaccccagcccuuucugcucagccuccggaagcgcucuccaaaacagggccaccuaccaaccauccuugagcugggugaggggccagguacuggggaagaagccagggaagguaccgaucagcaggacccuauagggaguccug

SEQ ID NO: 6068 - RNA, 4087 nt, Mus musculus
uagguugugccaaucuacugagcuuuuauuaucccagcugcagacuucagcugaccccuccuccuggagguguguuucagaguaaaagcaguggugggagcacacuugaccagugguuuccaggaagcgauaagcccaggaaccaucaaguacauugaaugcguuugggaauauggaaacucagacgcaaaaccauccaaguuacuuuuuccaggaauccccaccccucaagacauggcuuuugcugcuuggaaauuggcccaggcuagcagggugagcauaagagaggagaaaugguuuggaugggguaggacuuuucaaaggagaguugcucugugagccaggagaugggacucuugggaaugggaccacaggaggaaggggcgaaccuggaaaggaaagagaaggcauuaggauggaauuucagacaauuuuccagacauagaaugugucugucuguguguggcagucugucugucugucucucucucccccccaccuccgugugugugugugugugugugugugugugugugugugugugugugcgugcgcgcgcgcgugugugcuaucagaacucagaaccuguuucaauugcauacuaccacugaacucuaccugcagcacuaaaauuguuguagaaaacucaaaagcccaucuaggaaaccaaaggaccaggacgaccgugacagcagaugugggacagagagcaccgggcagguucugcccgcagugcuuaugcuggaagaugcccgcuguggggagugcugugggcagggucaaggacacugacugugagcacuggacuccugccaguccugugguucucgccuuuccccuccaccucacacacuacuucucccccccaccccccaccaguguccauggaaguuguggacacauucaggagccacccagaaaucaaagaucacucccauccucaggggacauggcugucuccucccuguagcuuugaaagcucacugcucccuuugcugcugcugauggugguggugguggugguggugguggugguggugguggugaugaugaugauucugccuggcugagggucccauggcuccugcugagaagcacauagaaggaccccauggcccucccccgcccuucccacugucgagcgugauugacagcugagcuccacucaggcauggccucacccucagcuuagggugcuagggaauccuuccuucucucuggagcugggagugagcaaguggauuccagccgaguuccucauccccuuugagucaucuucaucauccuugggcccaggaggaggacaguaagaagccggaaaccaaacccaggagaucuggccuugguuuuggccuugccucuaauguagagauuuaaagagauaaagacccucacuucacugugguguagugcuaguucugugugucccuugggcuagaccaugacacccaguguuuggucagccauuagucuagauguggcuggagguauuuuuaaauuuaaugaaucuuagcguuuuaaaaaggacgucaucuuucuacaguauggaugggcuguguugguugagaaaagaugugauccccacacccccgccccaagaaagacagauucugccuccaugccuccuguagcagcaaaaacaagacagugaugccaggucuuggguaggccuccagccuguccuccugcuccgcagauuucagaguugccagcccccacagucacaugacccaaguccuuaaaauaaaccaaguucucucucccuccucuacacacacacaugcaucuauugguuguuucucuggagaacucagucuaauauaaguaacucccuagggcugguguccaggagaggcggaguuagaaacuucugggggcccuggguuccuucuguccucuuccucacugagucaacccugcagaccucaguuucuuacucugagaaaugggcuguuccugggaaggcucccuugcagaggagccaguggguccuccaagucaucccucugccucguuccuugaauucuuuggugauggaacauaccuuucaucuaaaugggacagacuccaccguggaaagggauaauggacuugaauggguuugccugagguauaaacagcugauuuuauuauuucccaagaggaaaugcaaaaugccaagaauucagggaauucaggagccuagggaccucugggauucuugucccuccacccccccccccauccucuguuuucuacaaaauuucaguuauacaagaggcucugggaaagcaagggacgcgggggaaucaguugggagauaccguggaggcuauaccugucagaaucagaaagcacgggagggcagggagacucagcugcagggagagccuuacacacagaagucucuucuguccuagcaccaaaagaaaagagaaaagccagagagccagaaugucugaaagaaggagguggggggagcgauuuguugaauuguuguguucucugcucucucgugcuuccugccacugggcccccucccuuccaaagagugacuaaggaacuagcccggaacugggucucacgucugucuguccugaccuaugucuagagggggcugugacccggggggaauuaaugcagucaugcagcccucuguuuuucuaaagagauagcauccucuuggaguuauuugucaguacuguggcuccuuggguuauaauuaaguuacacuuggcaguagccagguaucuguuuccaaagggggccugggcugggguuuuuuuuuauuauuauuuauuuauuuaauuuuagauguaugaauguuuugcuugcauguaugucuguguauccccuauguaccuggugcccaugugggucagaagagggugaagaguuccuuggaacuggaauugaggguaguugugagccaacauaauggugcuaggaaucaaauccaacaagggccccuagccaccagauauggugguacacuaaggagauagggcaaaauaaugacagaauccaggcuagccugggcuacauggugaaucuuuaagagaaggauaaacacuagacagagcugaggcagcugcuaguguaauauagcauccuguuuugcagugacguuguuuucauaagcaggaacacacacuaaaauagaaaugaaaacagacuccgugcacauccauuccacacucaaggccaaagaagcugggcccacccaccaagaaucugcaucauuugauuugagcuucuagccuccaaguuagaagacucuccagggaaaguuaaaaggagccagccaagacugugaagucauucugaccuaggccuagguaacuuagaauacauuuuguucauuauaaaauaaaauucucaaguguguccgugucugcuguuuuucuuuuaaagucuuguuuuuauuugugugugucuauacuauguauucaugguguuggggggcggagggagcugugacagugugucacaaagugugggggaaggcgggagggucuguguaucacagaguauguggaagucagaggguaacauuguggagucuauagucuccuuucaccuuuacaugggguccaggaagcaucuuuacuuccugaccuauuaugccagcccuucuuucucuuucuuccuuucuauuuuucagagucaaggucucguguaaccuacacuguacucaaacucacucugccaccaaagcuggcccugaacuccagaccucgccucugccucccaagugcuaagauuagagauauucggcaccauucccagcuguguuucagccuccuccccccacacacacuuuuugaguaugcaguguaugaaaagcauaauguuaaacugagcaugcucacaugucccuugucuccaugugaugaugaauggguguguuucaccaaugagagcccccugauagacuugccuagggagacacugcuuugaaugguccccaguuugcuccuaguuugcugccagcaauaaaccuccccaugccgcuuguuuuugcuugagaggucuuacucuauaguccuggcuggucucaaacucaaagaaaucugccugccuccgcccuaucucugccucugccucc

SEQ ID NO: 6069 - RNA, 4318 nt, Mus musculus
cauacauacagguaacacauggaaucaaagauguaaggcaggccucacaucaugggagaauuaguagaauugaggaaccuuaaauauguaauauccauugaaagguuggcauuuuuaauagagaagucauacuaaagagacaaugugaaagcuaugaaugggaauaacuucuagucaacccaaaugccuuaaucaacugcaagaaguggaugcagccacaugggccaagauguuuacugccuucccugagcaugcgcagugaggcugcaugugugggcugccugccaggcuggacuguuccucgugauccggaccugucagccuaucggugacugaccugagcucgugccuggagcaugugugugugugugugugugugugugugugugugugugugugugugugugaauucugauuggaugaggugggguggagagagaugaggucagucggaggaggauaggaguuuagcccuugcugcaagaaggacggagguaguagauaguagaagcugcuggggaagaaagcuguagggggaaaacccagaaguaaagaagcuguugugugaacccgacuugguguccguguuguuccugucgccaccggcucgaaggacugcaucaaucaacaccuaaaaauaugcaguagagaaaaucuauaaauauaaugauaauuaaaaaccacuuguuuucccagcuuuuuucuuuuuccuuuggguaauuugugccaaaagaagaggaagaagaggaggaggaggaggaggaggaggaggaggaggaggaggaggaggaggagguggaggaggaggaggaggaggaggagguggaggaggaggaggaggaggaggaggaggaggaggaggaggaggaggaggaggagaagaagaagaagaagaagaagaagaagaagaagaagaagaagaagaagaagaagaaaaagaagaagaagaagaagaagaagaagaagaaauauaaauaaggaggaggaggaggaggaggaggaagaggacaaggaagaagaugaggaagaggaggaggaagaggaagaggaggaggaggaagaagaggaggaggaaggagaagaggaagaggaagaaaaagccguagaaucuguggauauggccaccuuaaccaaccucugaaaacccauacuagaaauuuuuguaugucaugagugucgugaaugauuacaucagacaucugaacuuacuaaauaucacuagauucacaguggaaagaaucccucaauaguggugacuguaggaaaguuugccauaacuucuguacaaaugagaaagcauucuuuuuuuuuuccuuugucuucacguuucauuuuucuuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuuggucacacauucguuacauuuaugugcugucuuuagaaugcuuucucaucaugagcuaaugagaaagcauucuaaagacagacacauaaauguaacgaaugugugacugggcaaaccuccggcaagugcuaggaagaauggggaccugaacugcagagaggcccaaagcucacaaggcccuucccgcaccuuagcgauccgacuucagggcaggacugcacuguaguaagaguuuggcaggugcugaccuuagcccaucugcauccacuagcaaagaagaaggcagcagccuaugggcacagcuugaaagaaagaguaagggacccugaaauugauaaauuagcccuucuccucauccucccacccccaauauugucauggcacaaaaggucuaucagaacccuggccccgaugcagcagaguguggaacaugguauagcauccgguuccaagcagcaaaccacaagccgaacaaaccguggagguagcaccagaagugugggagaggagucaagcuaagggacucccagcaucucccacucuggccacagcaggaagguacuguguggcucacuggaaguuugugacauaacuuuauagaguauccugacaaacaaaacuaaggaaaacacagcaggagcccccccccccccgcaagaugauaaagcauugacuaaaaacauaguaucucauguuucauuuguguacacacaacauauacacauacacacacacacacacacacacaguuguuuuugagacagugucucacuacgaagcucuggcugggcugaccuugaacucccagaguuccaccuuccucugacuccugaguacugggauaugaucaaaagcaugcccuacaaccccuguccuuaauauaguuuaguuuuuaauuuuauuuucuaucuuguagacauaccuuuuuugaauuuuucauucuauucuuuuuuuuuuuuuuuuagauuuauuuauuuauuauauguaaguacacuguagcugucuucagacacuccagaagagggcgucggaucuuauuacagaugguugugagccaccaugugguugcugggauuugaacuccggaccuucagaagagcagucgggugcucuuacccacugagccaucucaccagccccucauucuauucuuaguagauauauuugugcacuuuaaugauuuaacuuguaucuugcuagaaaagguugcucugccuccccaaggcuaauacacaguaucuucucugcuguguuucauuucacugaccccauacagcuacuuuccuacucagucucucugccccuuucacucccucccauauucaccuuucacuucaauucuuaaauacugauaucccugaagaaagaaagaaagaaagaaagaaagaaagaaagaaagaaagaaagaaagaaagagggggaggggaggggaggggaggggaaaggggaaggggaaggaaagggaggggaaggaaaggaagggagggagggagagagggaggggaggggaggagaaaaaggaaaaaaggaaagaaggaaaacagacuauaaccuguauuuugagcaacugggacccuagcuuuccuuucuccaaaccucuuaagagacacacaaguaaaggucaccuguaguggguuuggccuaauguuacuuauauuauguuaauuugagucuccaaaauaguccaaguauaagauacugaggagcccugcucccaguugguucugauugguaaaugaaguugcuagcagccaauggcugggcagggcaagcagaggugagacuuuuaggauuccugggcuagggaccaagggagaaggaggagauccgccauagcaggaggagaggagagacgccacacaggagaaggugcaggacuacaaacugaaagauguacacccuccaacgcuugugcaaaccacaacaaaaaaacaaaaccacaugggacucagcaagggcucucugcggagauaaggaacuuuuaggaugcagagccuugcuggauggcauacauaccacggguagccuuugagaguuugaagugugaaccacuuccucuucacccucuugguuuucuguguaguguggaauguaagcagacagcugccugcuccagucuccucaaccacaccuuccucacuguuacagacauccucucuggaacuguaagccaaaacaaucccuuccacaaguugcuuuuggucacaguauuuuaucacagcagcugcugcccugauaaccaucucuuuggccaacuccuacuggggucgaccaccucugguauuggauuuuuuuuagccaaccacuuuuaugaguaaaaaaaguucccccuuucuacccaugcaggguguguccuuuaaaccuuuaacugcugucuuuauugcuccuccugguguuuuuacaucuuuaauucacucaaggguuaacagguaaagaagccuuuuuauagagaguuggcaagaucgcugcaggcucaccauaauccguaucaagugucagcugaccuugggcagcaacagagauccuaaaaaagaaacauuagcaagguucaaugcaggaugaaaauaucccaucaguuguaucaagagagcaccggacaguggcucaguugguggauauuaccucauuugcacccccccauaaaccacggguguuuuccuuuuauccguuucccaucucagucagucucugagcuguccuggcuaaagccuaaggguuacacucuaccugccugccugccucaggccggcuuccugguucugauaagcuucagacuagcucuggagcacucaccuuuucuguuggcuacaccugcuugcugaaagug

SEQ ID NO: 6070 - RNA, 56040 nt, Mus musculus
gucucuggaguugcgcccucccaccaaguggcuuccuggugcgcuugugacgucggcuguagagcuggaucgcguggcagcuuugcugucguggcucucggaaguggggggcggguuggcgcagggucgucauguugucgcaggugagggauggcggccgagcgccgguagccggugcuugaguuggggcugggggucuugcccagucgcccgaggcuguuggguccgugugcccgcccacugccugagcuguaggaacugcagguggguggguaggagggccagccccgggcaaauugucgcuagaggguuuguggacugugagggauagggugcaccggcgaccccggaggcacagaggccuccugucagcggguguggagcacacucgcugcaggaucucugggugugaggucggggguaacccgucuucccauagccugcccggaugaggggaauggccuguagggcccugauacacaaguucagggcgauccuguagggagagauugccagagccuuggguuccaguguuacuacgcuguacacagauaaucacgaugguuaucgccuuuguacccguagaggucgauguagccaauuguccuucggccagagauuaguacauguaauauauuuucuuccuuuaaaauuuuacugugaagcugggcgugguggcgcacgccuuuaaucccagcacucgggaggcagaggcagguggauuucugaguucgagaccagccugaucuacagagugaguuccaggacagccagggcuauacagagauauacaggcuauacagagaacccugucucgaaaaaccaaaaaaacaaaacaaaaaaacaaaaaaaauuuuuuuuuuacugugaacucccauguagauugugucacacggguuucauugucagguugggauguucaaggagaugggaucugcaaagggcaggauggcuggggguggggguugggauggggagagguuagguuggggaacaacauauuuucagaucauaauaauaaagacauagugacauaccaagugucucaggaugggccaacuagaaucugugauaagaaaagucuacuuuguggaaauguggaguagaaaaaauucauugaugguuucagcucagcucugaaggugcauuuagauccgcuucuuccuacuccuaggucugugaccauaaguccuuccaccuguugggcauuugacauuuuuuauagucauuaccuuccuucccccaggcaaccugugcauuaaaauuucucugcagacuuaaacaucuguucccuugugguuuuuguguuuuuugguuguuuuuuuuuuuuguuguuguuguuuuuugucugauaauuuucuuucuuauuaccuagaagcagccccucccccugguauuuucauaccaacccccucccugcaucuuugcuaaucacccacagguucuucuguggauccuguguacuccacuguuggguuacagcugguuuaccuuuguucacugggaagcauucaugaguugcacuguugguagccuuccauuguucccuccccuuccccgccccucacaaaaucuuguugguguuagcucaaagccaugcuuuaauuucuucuuuuuuuuucacccuucuccaacugauuauaacugucuugacucagucuuucaagugcuggcauuacaggcagaaggggccacaaguguacucuauaaucuuaaaaaaguaaaaacucuccauauaacaucuuggaugucucuccauucauuguccuuaaaacccgugugcauacuuggaauucggucucauccauucuaguuggaaguucuccauucccugccgcucuguauccguuguucuugccuuuuuccauuacuuacaccccaaccuguucuuaggaguucacagaaggguguuagaaacccagcagucuuuuaggagucaucuuagcaguagcauucuucaggcguugggauccuccugggagcacuuuaucccucuuccaggaucaucgauuuggugugagagguuuuauauauuaauuagaaagagcuacuugaaagaauaggaagaaaaugauggagcaaguccuagagucacgauagugguuauucagccuccgauaagaagagaaagcauugugaaggagccaaaagccauuuaaguguauccccaguagcuucaguuuucucugugacucgggagagaguagcugauaguagauguugguauuggggggcaccaucuguuccucuuucagggcucaggcugguguuaacugguuauuagauucucacagggggcuuucuucagaugacuggaguugggguagaagaucucuguaggugccuuuuuuuccuacgcugugaaucccuaguacuugugccuugugacuucaccuuccguuuugaggauuguguagguuuguauguaguaggcacacaagcacuggauuucuuuuuuaucauagauauuuacuuuccucacaggacaguaaugaugacacugaagaugucucacuguuugaugcagaagaggagacaaccaauagaccaagaaaauccaaaaucagguaccagguugaguuggaguuauguuacugucuauucuguccaaauguuggcgcuagcugaugggauuuguguugacauuuuauuuauuuuuuuguuuuuguuuuguuuuguuuugacacaguuccacuauguagacuuggcugagccagaauucaaagaaaucgccugucucugccuccuuagugcugggauuaaaggugugugcuaccacacccagcucccugucccacuuuuugauaugagaaaacaucugacaaaaucagaaagagagggaggaagguguaagguguuuugggaagucucagugcaugguugcuugcaguuuggcucugcuucugggcccuuggugaugcaggacauugugucagagggcgucguggcagucuagaaacagaaagaaccauaaccugccuuuggugacccacuccuccuagauaggaccaccucuuagggucucccacaccucgaacaccaguacugcugucuaggggggagggaggcccugagguucaaaacaaggcagaguaggcuaggcaugccuguugguuugacauaggaugagggagggguaacuugagauuaguaguuggcaugcagauuuuguucaacacugagcuuucagauuagcaaaccuguaaauccguuauuugagcacugauauguuuuaaaguccaugcuuccugaagaugcgcuauuucuuuagcucagugguagagcucaaggcucuggguucaguucucagcuuaaaaaacaaaaaaacaagaaacaaacaaaaacuacaaaaauaaggagcuuauaauuucuauagauacauuuugauuucuuuuguaaauuucagaauuauaucuuguauaaguagcacaaaauuaaauguacauguaaauguauuuccuguaaagaaauuaacuuaagucaaaauucuacuugaaucuugaaaacacugugcuaagugaagguguuggccacaggagacaaaauauugcaugauuuuacuuucauggaguguccauaaugggugaauugguagaggcaggagaugauugguugcuuagcuccgaggggguugggaagaacagagggaugauugccaguggggacagauuugcuuuuuggaguaauauugauuguggugauggucacacaacugaauagauuaaaaagcauuuaauuuacaaaaaccccauacauacguguaugaugaugugugcauguacucccggaggcaaggacgggaagaguaugaaguugaggguggccugagcuaccuagugagauccuauuugucauaagggcagggggaggaaaagaaagagacaaaacuguauggcgacuuugucuucaugcuugaagugauuucucaccuuggggcucuuguggcaugauuagauaaucuaagcugguaaggucuggcuaggugcuuugauaguuuauacucaaugaggugucagagucaguucauguacuauguuuucuuguaacgguauaaccuaguguaguggugggcacuugaggguaagcugcuggcuuccuccuccccuuaucucaugguuguggguugcuggcucuugcagugaaguguaacggagcugcugugccuugcuuuuaggcaccccguggcauccuucuuccaucuguucuuccgggucagugcgguuguggucuaucuccuuugcgagcugcucaguagcagcuuuaucgccugcauggugacaauuaucuugcugcugucaugcgacuuuugggcaguaaagguagguucuguuucuauuuuaaaacuguauuuaauaugaauucaaauaacgaauugaaaggaacaggacagcauuguggauugauguuaguucauucauuacuuuagaccuucuguguguugaagugccaggcacaccguucacauaaacacugcucaguuguggugcccugugccaagcuacaaauaucacuagcagccauagaaucgacauauuuuauucugaugagauuuauggauauucuggguauagugucuauguaaaguuccaauauaguuugcaaauguuuaagaaguauccuuuucuuuuuuguuuuguaaaagcuccaggaacuugggccuugggaucagucuucacagccaagggcaaguuugccuccauagguuagauaacaucagaccaauucaaacacaaaauaccuugguacucuguaagacgaaaagaacuggggccucggaugggcaugugcuguaugccuguaaucuuaguacuugggaggcaggagcagaaggaucauaaacucagacuagcauggucuacauagugaguucuaggucagcuagggcuaugauaugagaccccguacuggcuaauuuuaugccaacuugacacaagcuagaguuaccagagaggagggaaccucaguugagaaaaugccuccaaaauauuggucuguaggcaagccuguagagcauuuucuuagauaguaaauuauaaauaaauaguaauuuaucagggaggacccaacucauuauggguguugccuucucugggcagauaguuccagguucuuuaagaaagcaggcugagcaagccaugaggagcaagcuaguaguuagcaccccuccauggccucuguaucaguuccugcugccagguuccugcccugcuugaguuccugcccugacugccuuugaugaugaacuauaaccugggaguguaagcagaauaaacccuuucuucuccaaguugcuuaggucaugauguuucuuaaucuuaaaauuaaaacuagaaagaaggaaggagaccguaagaaggaaauagggauguggcggaaggacaagcauucuguccuagggagaagaaagagugcugcuguggguaugcuuauugcuuauccuaugcgcugcaugcacccugcucucggcauggccauuuuuguuuaguucuuagucaggcuuggaauguagggguuaacugguuauucuggggagagcugaauuagugaaauagcacacuaagaaaggauuuauaaugcuucaaauaaccauguaaaaauguguguucauauuacucuuucccagaaugucacagguagacuaauggucggccugcguugguggaaucauauugaugaggaugggaagagccacuggguguuugaguccagaaagguaaauaaauaaagugugugcagguuccuccuggggaccgaaggguggaagaguccaggccgaaagcacuguguaucucacuugcccuguuagcacgaagucagguagccaccaaaguacaaugcuucugcugcuucugucuagaaacaaggcggacucaggccaggauccugagagcagggcaggcugccugucggccugcugacgagucuuccugguugcccccagcuuuguugccuugcugggcaucgccuuggauguuucuguguucagcagacacuuccucccauauauuuuucugucuuuucccccauggucauuucccauuugucaggaagaagauugcagcuggcuucagggucagaaugauugauuggucuauucuuuaagccggugcccucguaacuguggggaaccuguuuguuuugggucacccugcuuccuaacagugaacauuucacuuccuuguggaaauuuuuuuuuuuggagacaagagaauaagaaucuuggcaauccuaccagguaaaugucugcccacugcuuagaagaaccuuccaaguacugcuucucagaaagcaaccucgugcucagugagcguccauuccuggccuccgucuccucggaaaucacccauuuccuugucauuuccuggguugcugggacacgcagucucugagaggaugcguugauuuccuuaccucaccuuucuuacgaaugaacagcacuagugcaagaagaauugaguuucauggcugugaacggccaugucuuccuagucuguccugaguugcaaaguuccugagccaaaacaaagucugauaacucguuuuauuaagguuguuuaguggcagagccacuaauuugugcauucgguucuaacuuuggacuuggaucgccucuaucaaacuuagaauuuaagugcagugugcucucuauuuaaaaagcgacuuuuacugauaaaucugacaucagugguugaaaugaugcuuguguugguuuuuuuuuuuuuuuuuuuuuuuguagucaacgccucaagacaacaaaacaauuucugaggccgagucaagaaucuuuuggcuaggacucaucgccugccccguccugugggugaucuuugccuuuagugcccucuuuuccuuccgagugaaguggcuggugaguaucagcguucaggguuaacuguaguuagucaucaucugacccauccgccaggcccagccugaugggcagcuuucuuuuguaguucugaguuccgguccucaacucuguuuucccuugacccugggacgcagccacacagcagccucccuggugucagcgguugucguguuuuuuaaggaaacugguugguaaccucuucugcuuacuuauuuuggcuaguagaucaccugagaccucaggagcuuagaacaacugggugcuggcuucacggcaacacuugggguguccagcucacugguugaagucgcugugugaacccgucacuauugcugccacucaccggggucaaggaguggacauuggguucucuucucugggcuuaggaggauauggaagaccauaugagacagaaauacuauuccugcuguguuugaagccuacagucugucaccugagccaaacugagucucuguaauaguggaguuugcugcauuugacaggcacaggcuucaugcacuguagucauaaguggauaccugcuccccaggcguuaguguguccggccccuguuuugcugugacaacuugguuuuguguguguacacucauauuuuccuguuauguaggaguuuuguucauuuuuauuuguaaucaucucuauauauuuguaucuaaucuuugcaaauuaggcaguaucuucaguguuuauggauuuucugcaguauaguggagucaguauuuaugguuucucacuugugggucuugugaauuuaauuuaggcauagcacuuuuauuuaucacuccaaguacuaaacuugaauguuuuuacugacuuaaaguagugguucucugccucccuaaugcggugacccuuuccucauaguguuguggcccccaacuuuaaaauuauuuuuguugcuacuucauacccagaauuuuggacuguuaugaaucauaauguaucugauaugcagccccuaaagggguugagacccacagguugagaaccacuuacuuaaagacuugcuguagaugaaaagaaacacucuucugucccugucuuuuuuccauuuuuguuuguuccuauguuguuuguuacgauugagaauaauuacccuuuaaaguacuuucugauucuuuggucuugaucugcucgugagugugcauguguuccuguguuugcgucgaggcagcacaugggugugugcaccugugcuuuguggaagacagcacaacuguuucgggaaauaguuaaaaaaaacggcaccaucccgugcuacgcccugcuauucacugcuccggcauucucaccgccucugccucuaggcuagcccgagcaucgaccgaccgagguucucuugaggcgggccccacucauguuccuggccauccacccuuuguggucagcagucucaaaucccagugacccgguaaaaucaaaacuguagagucuuguaauuuaucagucagauugauaucaguaaauucucacuccacaaaacguccacacaguuuacucagagccaauggauaaugauauaaacugcccaccuagauaaaagacaaauuguccuguaauuauccaucuuuuauaugauauucauagcuaccuguggcuauuuaaagccaccggaaucuggauuguccuguucuuccuccauguuccuuccuucccuccuuugucucagucucucaaaauucuuagcucugccucccuuuucccuguucaaucacaggcuucuuguuguauugauuuguuguuuaaauugauugaucagggaaaauucugcugcacacaaccucagguggcugcuuuguuuuuuuaccagugagccccaggcucugccucaaagcacggauuacaggagugugacacuguguggccagggcuuuccugacuggaucugcuuuuacaugcaucgauccacaaguccuuuuauugcagcuucuuguguugcuugguuggcuacauucuacugugggagagauuuucaaacauaaccuguagguuuauccucccucagcucuuuaugccgaggcguaugucucugccuacucuugaaggaucgcuugcuuagguacuccaguguguuguagaguuaaaccuaaacgucugugugaauauucaaugagucauuuuguuucucuuuggugaucuuucucucccucauguccucccuccuccuccuucccuuucucucccuccccucucuuucuccuccucuuucucucucucucucucccaaugguaaaagugccacagacaggauaugucugcauuuauuguguaccaaccauucugguacccugugcccauucacugugcaaacucauguuuugcuuuagcaggaaaacuggcaucaguuaagccuuucauucuuuuucuguguuuuuugcuuaucugacugaguacugcuugucugucugucgucauuucuaugcgcuuuccaugcucuuucauuuuuuucuauuuauuuggucagcaaagguuuuaagaguucuccaucugucagcugcuuugggagugggacauaaccacuagaugagcaagguaacuguccugcagagccccuguucuagaggaaugauugacaggcacuaaaaaguagaguugggaugucaugaugacgucaggagccugggaggugcagccugcagggacugaggcugcugugccuccuguauucaggucagccuuaucucucgcucucuugcucuuagcuuaccuucacaugccuuggcucucaccuucagcuucuguaggcccaaaaccucggcccuuccagcauggauucugccuugccuuuggcagugugcugcuuugcugucugcugcugggguuuuguggaguggcuuuucguuuucucuguccauuuugcugauacucacaguggcagcucuucugugaccaucuugccuaugcugcugcccuguagggggauucuugauguuuuccaugcgcuuacuuagguucauggucacuacuguuaacugaaugguaaugccgugaucaggggucugcacauaagugugaggaagagugcagccaggcccugcugccuuggcuagcuuguguggggcuuaccuucuccuagggagugccauuucugucuuccgguuggcuguggacacuugccugagccucugauucugccauggcugcagcucgaggagccuuaguccugucuugcauuucugcauuguuuucucuuacagcugugcauguccuuugacuuugugcuucucuuugaguugugaggugauagucauuaguuucucuuggagcuucuugcagaguggcaccagacuggcccuuucucuaagcagcagcucuucucuguguuuaucuuaguuaggguuuuauugcugugaagagauaacacaaccaaggcaacucuauuuuaauaaaggacaacauuuaguugaggcuggcucacagguuuagacuuucaguccauuaucaucauggugggaagcauggcagugugcaggcagacauggugcuggaggagcugaggaguucuacaucuugauccaaaggcagccaggagaagacuacugucuuccaggaagcuaggaggagggucuccaagcucacuccaaaguaacacacauccuccaacaaggcuacucuuaccccaacaaggccacaccuccuaauaguaucacucccugggcugagcauauucaaaccacuacacuggcuuauuuuccuaaaaaucuacuaguggggccgggaugacagcucaggguaaagugcuugcugcucaagcaugaggacuugaauuuaauccugagcuuccccaguaaaggcuggugcagcagugugccucuguagucucaguacuggggaggcacaggcgagaggaacgaucccucaggcuuuuugcccagccaguuuagacaacuuggcaaauucugauucagugagaggcucaguuuggaaucagguggagaaugaauaggagaauacccaguuaacgugagccuuuacauacauguguacacacgcauguacgcacacauacacaaguagaauuauaaucauuuuaaaagccuacuaguugccuuucaaggagagggagauuaugaugugugacuucacucuccaucuucagcuuagaaauccauuuuaagguuuaucuucauuuuaucucgugguucggcaggauccgugcuccaucugcaaguggauuugccccauggcaugggcacauaaugcccaagagcaacccagugugcacuugggaggcuaccgaaguagacaugagguuuuacauuuaccuaggcaucugguaauugucuuuaaucuccuauguguuuccaugagauguaaaauuagaacagaguauaagcucugcuucuuuuugguuuucauuuuaauaaaguucuuucagauuacccuuaaaauauaugagcuagucaggccauuuuccaguguuucccaacuuggcugauuauuuuuagguuuguacauccauguuuccuuacauguuaucuucuuagauccugucuagcuguuuuguuuuucacagaggugguuccugcauguacuuguugcuaguagaaggacuuagagcaggggcaagggcgcuguggauuugagggcgguccagcgcacaucuguucuugcacacggcuguugaagcacagcuugcucuguuugcauguugccuguggcugcuuugaacuaaaaaaugggaauugagaaacaauagaauugaguaacagaccuugauuuuggcccaugggauuuaaacuguaguguuguugacagaaguuguuugaugauuuuuguagaguauuuaauuguaggaugucagcuugucaguuaauucuuuuaaaaucauguuuaagaguaagcaugucuccucucagguuuaggugucugggguggccccagggccaagcagcuuugcacaguacauuccuccugcugugggagagcagccugcccccuucccaugaagcagcugaucugugcucuguccgugcccugcagaucuccgugaccugcccagugugcucagcaugaagggaagaugcggcugacucuggauaguguagugguugcucccuacaguuucgggauuaagaacacaugguugccaguugguggugcuguuuggcaaggcuucagaguugugugccagcauuaguggguacaggccuggggaguuuaaggccccaaccuaccccugguuugcucucugcuuugggcuugugguuuggggugggagcccucagcaugugcuauagccgccaugccugccugagcuccugccucgccaucaccaacuccaucccucuggaaccaucagccaaaauaaaugcuuccuucucucuguugucuuggccguuguguuuuaucguguuuuaucguggcaacaggaacauagcugcaaguguggaugaaaauggcgauucccagugaaggccagcgccuuguacggagcagccucagugaggugucuucugcaggccgaggagccucauugguuugaccucugacacgcagcaccuuguuuuaucaccacagucaacccggucucauuuaucaguguagagaaaagucgguuuggagcuaguaacuguugcaugauuccucucuccuaggcuguggugaucauggguguggugcugcaaggugccaaccuauaugguuauauccgguguaaagugggcagcaagaagaacuuaaccagcauggcuacgucguaucuuggaaagcaguuucuaagacaaguagguguucucuggguguggucugugacugaucgaaucgugucugacucuuggagauuugcuucuuuucaaaugguuguuuucaaucacuuuaauuguucuuaacguauggguguuuugccucuaugucuguaaaccacaugugcucagugcccgcagaggcuagaagacagcauugauuggaugcccuggacuggcauugcagacagcugugagcugcugugugggugcuaggaaucagacgcuguccucuggaagagcgaccaguacucuuuaacugcugagcugucuccccagcccaccaaaugcuuuguagcucuuuaaguuucacaauuauuuugucaugaguuaaugacagagcuauuuuacuuguucuuuggaggcuuuuaggacauuccagaaauguaucauuaguucuuaaaauuaugauuaucucagguuucauuaaugauggcuguuuuaaaugaaaggucuggaagaauguauauugcauguuuuuaggcuuuauaagcacaaauaaauuaaaaacacuuaucauuaguguugcuuuaaaguaauccccccccagaacacaagauuuguuuguuuguuuauucguucauucauucauauuuuauuuugggugugugugaguguucugccuagcaugucuguguacuacaucugugcaugguguccacagaagcuagguggggguguccagaagacuccugugagacuagcucuauggaugguugugagcaaccaugugggugguaggaauugaaccugguccucuguaagagcagccagaguuuuaagccauugagucaccuuuccagcccccacaaagcuuauuuauuuucugguucucuaauaugaugguugaaauuaagguuuuccaugggauaaugaaguaguuaugcuuacaaauuuggauaaaugucuugggaaaacccucuagguuuucacauaaauauccucaaugacaugguuuaguguaguaucaauguuaggaaggacaguggaucucagaacacacccaggaggcuucuuauucagcagauaugggcauggugucaugguuagcauuucuaaugcauugaugucugagcauuacacugaguuacagagucccugagaggugccuugcucaggagggcggagccugauggccaccugugcucagagaguuaguccucauucuaccucgcaguucuuguuauagacgauaaggaguagggagaacuaauaguuuuuaaaaauuacacuuguuuauuaguguguauguauguguguuuauguguauauauacauauauguccguguguguguguguguguguauacauagacacacacacacauauauauauaggggguuuguguguaggcauguguguguacaagagcaugcauguggaggucagaggacaacuucaguucucuccuucccacucgggucauggagaucaagcuuagaccauccagugugguguuguacaaggcaccuuuaccugcugaaccaucuuagagagccaugauuuccacuguugguuuuuacauggcuaaucaugcucugguccacuuguuguguaugcuuuaguauuuugggauuuucuuuuuguuuguucggugugguuuuuuugagacauuguguacccuuggauggccuggaccuugcuaugcagaccaaccgggcuggccuaggagauccaccugcuagcuaggauucgaggugugugucagcacaucugacuguaguguuuuuaguugggagggacuuuggcuauugaaccuugguaaaauauuacuguuuuaucucauggaaucugucaacacuuuaauaugacaagcuggauaucugagugggugauggaauccacagguuuucuuuuacauugugucuacuuuuuaagcauaaaaauuauuauaauaagguauugaaaauaaugucaugaaggagcuggcacggugauagaugcaguuuuccuuggucugguacugugagcuccaugguaugugaagugaaauaauguugauauuaagagguaguuuuuuucucuauugcagaacacuggagauggucagacuucgugaguaaagaugaagacugucauggacucugggagcaauggacacgauucuuaguguuuagagcucagucuguugcagagugggguguguuuguuacuuagaagcuuauuuaaaagaaggaaaccccauggggccaggaagucugugugucuggaaacagugucaggugugccuugggugucugucuggauagaugguccuguagcagcagcaaguccuuugcacgugugaguggaccuucgcauccugacccauagacuguaggaauggguguucagucugucucaaauucuguguuugcauagcauuccuguacaugguuuuugggguaaguuuugauucagugguaagggugaacauguugguuuauguaugaguuagaaacaguuauuaauuuuaauguguucuguaugguaaaguuccuuaucuuagacuuguauaagcaaguaaaagcuaaauuugggcacuaauguuaacugauuucuaaaauuuugguuuuaguugguaaugagucauucacucaagguccauuuggcauaagugggaccuuuguaguugugguggauauacaggggcugcuguugcuguguuucuuugugaccauagaucucucuggaacuaucuaaaaucucuuaguggucuuuucguuaaguuaaugaaauacuaccuuuuaauaagaauaucauucuuaugaaauaaugagaguaauuacuuaaguacuuggcauaguaaaugccuauaaaacauuguaugaauuuauuuuuucuuuuauaauggggauauuguaaaucacauauuuguauuaagguuauuuccuaagacaaagcaauauacuauagacuaaaccaaauguaaacuauuguaggcagcuggauucuuuuguaguauuguaaauuuuguuggaaucuuuauauuaugucaugaauacacuuguccauuguuggcacauuuuaaaugucuuguuuauuaaguaucuuuauuagaguguagcuuggcagguguauagcuuuauauuuauauaaaacugcuguuuacaaagcauuagauguguggucccauuuagucauggcacugugauaccuuugaggggacacaaccucaggagcaucuguggaaucuaaagcaggaugaggcuggggaagaaaaucacacuccaaagucauugucuuccuuuggauggguuugcuaaguucuuguaugccaucggacucaccuccauccaccgcuccaccugacgaggauggccguacuuacuaaagaccguuuuuuauuugaucagaaagacuuaaacuuugaggacugggaggcuaacuggcaucaguugggagugaccaugguuuugagucugaaauucuaaaccaggauggauuuaccuuuggacucugcaggauccagcgcuugccccccuuaaguuuguucguuuuuguuuuuuuuuuuuuuaacuuuauaucucgaucacagccccccccuuccuucuuucuuuccagucccauccuuacaagucccuccucccauucucccucccccuucucuucagagaaggggaaccccucuuggguaccacccuaggacauguagucccagcaggacuuagguacauccucucccacugaggcccaacgaggcaguccagguaaggggaagggauccaauggaaaggaacagagacagcucccacuccacuuguuaggggacccacaugaagaccaagcugcucauuugcuacaaauguguaggguccagguccagcuccuguaugcucccugguugguggcccaggcucugugagccccauggccccagguuaguugaugcuguggguuuucucaugguguccuugaccccuccuccuugcucacuucuauccccaacuuccacaagacucccuggacuccuccugauguuuggcugagggucucuguaucugccuccaucugcuggaugaagccucaucaggagacaguuacacuagguuccugucugcaagcguagcagaguaucauuaguaguguuggguuggcucucuugcaugaaaugggucgccaguugggcagucauuaguuggguguucccucagucucuacuucaucuuuaucccugcauaucuuguaggcaagacaaauguuagguugaagguuuuguggguggauugaugcccccacccuccuggaagucuugccuggcuacagcagguggccacuuuagucucucuaucccccacugauaggagucucagcuagagucacccccauagacuccccauggucuugcuuuccccaucagacuccugucccaagccucaguuaguuaccagagaugccccccuccccaacacacaguauuuaguuucccccucugaguuuuuuuccuucccugcuggaacauggcaacggauuccuagauuucaucagugggacuugguguggccauguggccagguucuggccaguggcuacacuucuaggaaauggcucagacacccucaucuccuccucauuuucaucuuucugauguuuugaggauuccuucccugaggagauggaagcagguuuacucccuccuuagaaaggcccaguggcaaacuaagggugauuuucucaagaguucagugcggugagccagugcguuucuuggcuucccuacaccacaugcaaacaagcugcggugcuuacucacugaaucacaguggagaacgggucugagagaggugguuucuugguuucuucguaccguccccaucagccugcauccgauggcuggaguggaugccacugcagccccuggugucugcuccgcuccuugacucgugugaagugaacagaggugugauaggcgugaaggcacacugacuccaucacagugugggcucugcauuuuaaccguguguccacucaguguuuagugaugguccccuauaaccucaagagggaggaaggaaaggacugucaaccaaagcuaagcuaagcaaagcaaaaugaucaccaaagguuacuugugguagagacacucugccuaccagggacuccauuuguuguuucccaggccccuugauucauugaggucuugucuuuguggcuaaugagauuggggugaaagggcuggcuaccggaacugauucuccagucuuuuguuccuuauccuagcaucuuguagugcucaaggugguggggccucaggcagcuguagagacugggacagcagagucccucugccugguucagugggccagacuguuagaaaggagaacaaaaaaacauaacccaaaaaccuguguuuuggauucgaucgaauccauuggcuuuuugguuaauugguuacuauagcccagcagacacugcaugggagaacagcccacuuagccagcacaauugcacagccaauagagcacaguuaguauuuauuguauuuguguggaggucauaggacaacuugcaggaacugguucuccccuucugcccuguggauacuguggaucagccucggaccaucgggcauggcaccuuuauccacugagccgacucacuggcccuagaaaacauuuucuaagaagucucaguucagcagcuuuucauuguuugaugccaucuccuauuccaaagaaguuggauuccuugucccuuacugcaagguucagguggggccauaaagacuuugaugggugaggcccaccaggucccugucccgucugaguugauaagacgcuuugcaccucuagccugucgucacagaugugggaccaugccacuaggacuuccagguucucaaaagaaauggagaauucugacuuauaugaaauguaaauucaauuuaaaagggaggaaaauacauauggaaccaaauuaaauauacucgcaggucauauacagcccagcucacuuugggauaguguaauaaucucuagaccuucacacguagugagacucccccugugucaaagccugguggcacuaauaaagcagguuagcuccugugaaagcuugcuuggagguucaggaaccaugucagcccucuccaccaguuuucagcuuccuggguuucuugggagagaaaccagaguuuauccugaagacucugauagucaccugagacuuuaaaaaaaagaccauagaacaccaagaccuauggaaaucaucaaacccagcugaauggaucaauagagucaauagucuuuagcuagccugguaaggcaagagggaggacuacgauuaaaguuagaaacaaaaggggaugucccugcugacaguacuaagcuggggcagucacugaguaccacguacaucucgauggagcacggagaguuggcgucugccuuggugucacccuggccggugacuaacccagugcuuucuucacgucccgugaguuguucccucguuaguaagcaggagcugucguauuaaacaaaaggcaaucaugaacacuggauccacguuuccaccuggcugagagucugcaaaucaucagagugcuuacggugaggcaggagguugagccauucguguuuuugugccacaggggaauaguuccugaagacuaaacaagaggaucucuguaaaauguucagaguaguccaaagccuauagugaucacuguugguggucauguaagcagaaugggaaaccauuccuuagguggcuaaaggccagagcucaggaaauccaggcucaccuuagguucuaauucuaagccaggacaaagcacagaggcuccgaauggagugaagcagucaguuaugggaaaggagguggaccuuugucucuaguuugcuuaaaacaaguuagggaugguaaaaagugcgcaaaacacgcaaguaaguuaugaagugggcaacccucaggaugggcacagguccggcaggcucugcuuugaacacaagcacuuggcaggaggaaaacgcugacgaaacaggaaugaggauugucagcugacuggggcaucacuuaacucuccccugauuucgcagauggucagagguaaguguggcuuggugugacccacuggcaggaggugcucugacuugauuuuuuuuuuuuuuaaaguuuaggggaggguuggagagauggcucagcaguuaagagcacggacugcuuuucuggacguccugaguucaaaucccaguaaccacaugguggcucacaaccaucuguaagugagaucggaugccuucuucuggugugucugaagacagcgacaguguauuuacauauaauaaauaaaucuuuuuuuuuuucuugacaguuuugaaggauuguuucccucgaguuuuauuuuacacuguccugcucccuugcuuuggagcuaaaagguuuccuaagaugucagcagccauuugaugcuccaucaggcuaaucguucaagagcugcagauucuuaauuuuuuuuaaacuuuuuuuuuucaguuaaaucauaagcugauuuauuauuugaggucauuacuguucuguuuuguuuuucauuuauuuuuuauuuuauauauauauauauauauuuauuacguauuuuccucaauuacauuuccaaugcuaucccaaaagucccccauacccuccccccacuccccuacccacccauucccacuuuuuggcccuguacuggggcauauaaaguuugcguguccaaugggccucuccagugauggcuuacuaggccaucuuuugauacauaugcagcuagagucaagagcuccgggguacugguuaguucauaauguuguugcaccuacaggguugcagaucucuuuagcuccuugguuacuuucucuagccccuccauugggggcccugugauccauccaacagcugacugugagcauccacuuauguguuugcuaggccccggccuagucucacaagagacagcuauaucaggguccuuucagcaaacgcuugcuaguguaugcaauggagucaucguuuggaggcuaauuaugggauggaucccuggauauggcagucucuagaugguccauccuuuugucucagcuccaaacuuugucucuguaacuccuuccaugggugauuguuuccaauucuaagaaggggcaaaguguccacacuuuggucuucguucuucuucaguuucauguguuuugcaaauuguaucuuauaucucggguauacuaauuuucugggcuaauauccacuuaucagugaguacauuucauuugaguucuuuugugauuguguuaccucacucaggaugaugcccuccagguccaaccauuugccuaggaauuucauaaauucauucuuuuuaauagcugaguaguacuccauuguguaaauguaccaaauuuuuuguauccauuccucuguugaggggcaucuggguucuuuccagcuucuggcuauuauaaauaaggcugcuaugaacauaauggagcauguguccuucuuaccgguugggacaucuucuggauauaugcccaggagagggauugcaggauccuccgguaguacuauguccaauuuucugaggaaccgccagacugauuuccagagugguuguacaagcuugcaaucccaccaacaaugaaggaguguuccucuuucuccccauccucgccagcaucugcugucaccugaauuuuugaucuuagccauucugacuggugugagauggaaucucaggguuguuuugauuugcauuucucugaugauuaaggaugcugagcauuuuuucaggugcuucucugccauuugguauuccucaggugagaauucucuguuuaguucugagccccauuuuuuaaugggguuauuugauuuucuggaguucaccuucuuaaguucuuuauauauauuggauauuaguccccuaucugauuuaggauagguaaagauccuuucccaaucuguugguggccuuuuugucuuauugacggugucuuuugccuugcagaagcuuugcaguuucaugaggucccauuugucaauucuugaucuuacagcacaagccauugcuguucuauucaggaauuuuucccgugccaauaucuucgaggcuuuuccccacuuucuccucuauaaguuucagugucucugguuuuauguggaguuccuugauccauuuauauuugaccagaggucuuaggaucuugugggugauccuguguggguccuugcggguguccggagacucugcaggcaaggcaccccggugcuggaguggaccggaagggacuugugcaaagaucaggcuggcuuaucugcuucccuaguuaaugcagucucaggucccgagugauuggauuggagcagaugauguguuccgcucaccagaggucuuaggaucccgugggggauccuguguggguccuugcggguguccagaaacucugcaggcaaggcaccccggugcuggaguggaccggaagggcuaaauaaaucuuaaaaaaaaaaaaaaguuuagagacgagcucaguccaaaucaauggucccugaaaggguuuugagagaacuaagauaugagcugggaguguacuauaguuguuugguccuaauuauuuuuauaguugaaacacauccugcucucuguucuguuccuugacagcaguugaagcuugauaacgucuuugcaguuuuuaaaauuauuauauuauuuuauuuauuuaccuuccgucuaugcugauaucacccugaaugcccacgaucucgucgucuuugcaguuuuaaauagcucuaggaugauuccuuucacugccggauggucucucuuuguguaacucgcauuugguucacuagauggcaguauaccaacguaugcuguacauggaacugcuggguacuucagcugccaauugcuaguucuacuugggaaacuacaguagaguucuaguuugccugcaaaugauguagggcuaaauucuuuccuccuguuucucuguuaauugaaaucacuguuaauggguggauagaugcugagugacuaguauggugacaaaguaccagcuuggguaaauauagcaaagcaucugucuuguugcgcaugcccagugaggugcuucagacagagacucgggaaccgcugauauggcuguauggcuugugccuucccugauauugccaagaucucaguuggaaagugagaagacuguggcuggugggucugcagcuuucccagggucgugugaagcugggacuccuacagggaaagggaagaugagcagauaaaggaaguuuaggaggagccgguguggaggacaguggguugccacuaagcagaauguaaccuugggacugacugggccaagacuacagaguucagggcgucucaguuauccaagcagaaaauguaacacccuauggugucuguagcaaaaguguuaaauauuucaagugcuaaggggcaagaugaugagccaacagagcugagguucaauguggguuuccuaccaguuguguguucaugaacaaaacaccucucugauuccucucagagugacuccaggaaggagauagcuauuuacauucauaggcuuagagaaugcagugauagauccaaggucucagaacagcuagacuagacggaucuaagauucggaccugaacagucugcccuagguuaacagucacuacacacaaggucuccuuaaccuguagcacccaggccugguugugcaaucuccucacauuagacuuucccagagacaugggcgaacacaaagagguuuagaucaaggguuugacuuuagugacaauggcaguuggcaaauuccaaacccguagggcagguuagguaggccauccuugaaaacugccuguuguagccucaaggacaccucuucuucaggaaaagaagucucuugccuuuaaugccuucagcuggccagaccuacccauuuaaaugggcuaacuuauuuuuuagacagacuuucauucuuuagaccaggcuggccuugaaugugugacaauccugccucagccucucaaguucuagaauuuucuaggacuacagguaugaaguacuauaccaagcaggguguauaaucucuuugaugauguuaacucugucuacauaacaccuucacaguaauaacugauguuguuugauuagcuauccacuauuguaacauugacacagaaacagcacacccguccaguaucuguggacagugacaucaggggucucccuugucaucugcaucagugcaugggcaauuuaccuguuggcauucagcaaacaguaggugugugcuaccccauuccagccuuggugaaggccaccauguucucaccuguagaugugagcuaggcacagaggcucagugugucuaacucaugcauugcuuucucuugggcuccuuccuuagcacaguagaaggacuuauauggaagcaggugcguuucaccuuugagcauccuugucucaugguaaaagcaugaagguuuaaaacaacagaacuaaccuaggcuagaucagcaugugugauuguggaucuggggguaucuguagccaugguguuaauccuuuugaggucaggcuguccuuucugagacagcagauaggguuguggacaguacccacuugggguggaauuaucccuuggacaaccuuuuguuuuaguguucuauugcuaugaagaggcacuaugaccaaggcaauucuuagaaagcauuuaauugggggcuugcuuacaauuucagaggguuaguuuaugaacaucauugaagaagcaaacagacauggugcuggaguaguagcugagaguuuuauauacugauucacaggcagagaaagaagagaaagagagggagagagagagagagagagagagagagagagagagagagagagagagagcacgagccgaaccuguugggcuucugaaaccucaagcccuauuauuaccaguggacacaccucccccaacaaggccacaccucuuaauccuuccauugccugaagacuaagcauucagacugggaaccauucucauucaaaccaccaaaccuucuuaagcaccuaaucacauaccuugccucucugccccaaagagaaagacaucuuguaguugacgaguuuaaacucaucuuagaacacugucucagugcguccuuucuccucuuccugggauugcaucauacauaggcuccuagaacccacauuacacuccuuucuugagauuguauccacacagaugaucuggcaagcagccaucugugugcccguggcuguugcagauugccuaauaaagcagggagagcccauacugagaguaaagcacuucgggaggguguuacuguucauaaaaggugccaucuuuuaaaagguguccaauagauggugugaaauaaaccagaaagccaugcagagguagcacacaccuguaaucccagcauuugggaggcagaggcaggcagaucucaaagccagccugauuuauagcgugaaugccagacagggcuacacagaaagccccuaucucaaaaaacaaaauaaauaaauaauaaaaaauaaaggaaagagagaaggaaagaaaagccggagauguguccaggaggguaaugcaaaauuucaggacguuuuuacuaauucuuggaauaaaaaaggacauaccaagucacaggggccauaccugcaaagugggguucacaagaacauguacaugugugcacagauggacacguucuguuccccaccccucucugcugcaacuacggggaacaccugcauguucucagaaagugccaggcucacuuggcacagugacaugucucauguacaggacaugucccaagaguuaagaauauguuucucuggucuguaacuucacuuuuaacuguguucgccaccagcuccuacacauaauauuccucuccaaugggggaaaaaaaucauuuuccucacuauuccagcccaccacaaucccaucauagggacacaagcugcucaaacgccguagcuauguaggggagcuggccuccccuacccccacuuuuccucacugccaacuaaucccugcccuuugccgccuucugugucagaacugcccccauuauucgaagucucacuggcauuucuuccacauuccuggagcuguuggugacucagucucucaugucaucagggaccaucacugugcuguacacagugcuccacacgaaguuccuguuagcaguucucugauacaaaaugucaccaaggggcucugaagacuucauuugaugacccagaggcacaccugauggucuccaguuuuuauaacuggcaggguuaaauucaauaacuugcuuggccccucuugggagggagccaggucccagggucauaggauguucauuugaguaaggggacaucguguccuuagcuccccaggccuuccuuagagggaucugguugaacuuucccaccaaaguccuauugacacgcaggccucuuacuguaguguccuuauauucccuggguauguuuucacuucucugaaaagaaaaacaaaaaaaacccuucucauucacucagaugaauagaaacucagaagacugcugugagaaaaacaccaugcaucuuccuggcgcugauaaagccguauaaaauagcaaaguccuagaaguugcauucaacguccuagcuucauggcugcugugguaaucuucauugucaauuugacugggauuagauuuaucauggaaacacaccucugggugucgguaugaggguuuuuccagagagguuugacuagggugggaagaccucuguggugguuugaauaugcuuggcccagggaguuggcacuaucaggaggugugguguuguuggaguaggaaguagguguggccuuguuggagaaagugugucacuguacuggugggcaaugagacccuccaaaccauaugggagccagucuucuaccagugaccuucaaaugaagagguagaacucuuggcaucuccugcaccaugccugccuggacaaugccauguucccaccuugaugauaauugucugaaucucugaaccuguuaagccagccccaauuaaguguucuuugcuguugauacacauugcagaugucacucugaacuacugaugaacacugaaguuaucagucucauacaguuuuuuuuuaaucugucauaucugagaaucucuuacccuaagacuauauucuccuacaucaugccugaaagcuucaaacuucugccuguaaacuucuuacaugaguggccuugcuuuggauaacaggauaugauguauggcacacauacaauggauguaugguuuauccccuuggguuccucaccugcuugccccaggcggccagugcuccuuacaguucggcucagaaggccccguguuguacacuuuuaacuccaacacuccagaagcaaagcagggagagucuuuguaagucugaggcuagcuugugcuauauaguggguuccaggacagucagggcuaccuagagagacccuaucuuaucucuaaaaaauuaauauaagagacacauagcauggaccuguaucuaacuugaaauauaccaguugacuugguugagauuugucacauagcaucaugguuguaacauggcuggcugacacaacaucuaguuucuugucauuuuucauaaggauagucgauugcugaagcauccauucuucccacauugaucaccuuaauuggcucugucacacacccucuguaugggcaccuguuggcauuucaucuaggcuuugccccauaguuaccuagcaacagucagguaugccugcugaaauauagaaaggggcuacuugcucccuccucacuaucuucucuuguuccuguacccucuuccccuaucccuucuccccccaccccuccacacacucauguugaccucuacuccucccccuacccccucuuucucugccuuucucugucucuacucccucaacuccauuccccaugccuuaaauaaacucuauucuauacuauacuuucauguggcugguccuucagggggaagggaugccucagcaugggcccacagaggcacccccuuuccacacagcauaccaagcauccaccaaacauaucccuggcuucuuacacaacagugucugugucuggacucacuuuuuccuucuguccuucuaucugaacauccaacagcacacuaaaucaguguagaccuuuuuuaguuaauuuuuuuuuugauuuuaaaauguuauguguaugaguacacugccuaaauuuauguauguguacagugugugugucaggugcuuguggaggacagaaaaggacauuggagccccuggaacuggaaucauugaugauugugagcugcuauguggcuucugggaacugaacccagguccucuguaugaacacccaguguucuuagccucugagccaucucuccagacucuguuggaggguuaaacuacucuguaagaaacagcgcuuaaacuggguguuagaauuuacaaucuuuauuauuuugcauucuucuauauacauuuuauaaccaacuuuguuaaagacuaaagagcccuguuggcuucucuuauaauuuaguugaaacugugaguugguggaaggucccauguuugcaauauugaaccuucugauccauaaaaccugugacucuccauuucuugauuucuaucaauaauguaaguuuuucacaaagaccuuucaucucuuuguuaggauuuauuguuggcuuuuuauuuauuuuguuguuaucauaaauaguauuuuuuauaaucauauuuucuauuuucuuuucuuuccugagauaggauuaaguuuggacuccucaugccuugguugcuacaaugcugguguuauggguaccugcugccacaaccaacuauaaucauauuuucuuaauguuuuuaaauguguccuuugggacuuuuuucuuuuugaguauagauauauuugcuuuuuaauuucuaauauuuaucaauuuauuuauucuuuguuauacuagccuggaauaaauauuauaauaauguuaacauauuauaugaguaauauaauaauauuauaagaacaugucagagucaagaauucuugcuaccaguaugagagggauuaaaaauaauaauaucacauuuaaugguaagaauuugaaaguacugcuagucacuucccacuguggugugguaaacgggaggccuaacuggcuaggaagcugggcacacgcauuggacaagaggccauaugugccugggauccagggaaagggcaagucuaggaaggagugucagggaggagauggagaaugguccaaagaucaagcucaggguaggcuaggugacuggaaagucacaucuguaagaugggaacagggaagaugcagaaacaacgugagaacucuucggaggccacaaucagaggucacagugaccgucgugcugagcuuguguccuggaagacaccuugggaacuacuggagagauucuggcugaguuccagcaaaugcuuucuagccaccaugguugaagaggcuugccuccugcuccucugggggaugaaggaacugaaggagcaugcagguugaugcugguuaacugagcccacucuuagacagggacacauucauacuucaauuuuugugacuugauguuuacaacuuggccucuggaaccaaacucaccaucacauugugaaugguuucuggcagccuugcacacccugaauuuauagaugaacaccuaaccuuucaucccucaucaugggacugugcuuagagaugagaaaucuggagagauaaggagggaacuccaauccaauguaacuggugucuucguagagagguuuugguacaggcccacaaagagaagccaugggaaacuacagggagaagcugaccaccaacaagccaaggagagcagccuggggcaccuacugauacuugggucucagacuugcaguccucagauaguaagagaggaauuucuuucaagcccugcagucguguugcauguuauaguagcucuaacacuaauaaucugagcaucucuaucccaacucuuacauccaguuacucuugugacaaucgccagcgucccuucuccauuucugucaucguguccuggcucugcacugcuucugugacuuuaacccauacagggccuugaauucacccugcuaaggccuuuggcccaacuccguaguccaucagaggggugcauugguguaugcaucuguguguugguguggaggcaugugauagcuggauuuuagggugacuguagucuuaacuucuucaucugcucuucagaggcguauaaugauuccuagcuucauaguucaauuacucuucacaagugaaacaauuaaaaauacuguccuguucccacuccugccugaauccaagccucuuuggugacauuucagcaugaaauguuuucccaucgugugucucagccuucugcuuaggccucugguucugcuccugugacuggugaauuccccagcagcaccuggccugguguccacuucacacaaguguuuggcaugggucaucuccaggaacagacacugagugaauguuuuugugcaaacugaaguaagauucucuuaagugugugcucacggcuaggcagaugguccacaucagcucgaggguugagcaucucugcuucuagcagcuagcugaauguaaguggcugcuacuccauucagggugaaagaaggugcucuugguggaguacagagucugucucuugcuucugcggucuccuggcuggugacaggcucuagguuuuaugguuugaaugugcugugucccccugaugauaggucuuggguguucugguuagaaucuggugugucccccuggugacaggcccuggguguuacaguuugaauguauugugcccuugggaucggguauugaaggcuuaguucccaguugauggugcuagagguuuuaguaguuauuuuauccuuaacuaugccuagcaggaggaaguaguuuacugggaaaugggucuuuguggguauuuuaucuuugcuucuugccucauucucuguucccuguccaauaugagauuaaauagcuuuuaccacgaucuacucaccaugauguucuaucucaccaugggcccagaaucuguggcacuaagcaauauggacagaaaccauaagccaaaauaaaguccuuuucuuuuuaacuuguuuauaccagggauuuugucauaguuacaagaagaguuaacuaacuguaauuccaauacucaggaggcugaggcaagaggauagcaaauuugaggccagccugggcuacauaucaagauucugucacucacacuaagccaaaccaaacuaccacuuccacuauaaaagcuaccagccacacagguucuggucaugguagcuagaagggcuguuuugccuccuuuucuguuggcccuuggauucagggcucacuuaagaaaaccaucuuggacacugugugcauccuagcuucucucuuaccugacucagucuuacuuugcuauaauggauauuugccuuccuuauaucugcaaguguacauuaguggggacuagggagaaguugccuuuugucuccuuuccagucacugugacacagugcuuugagaaaggcaacucagaaggaaguuauagcccaucacugugggggaaaggaaggcagcaggaaucugaagcagcuagucacacccauagucagaacagagaagggaaggaauggacacaggcauaguuucagcucucuuucuacacucuuaaacccaggcaauggaaucuucucagggcaacuaagguagucaaaaaccucacaaccaugcccacaaguaggucaccuugauguacacuguucuucccucaucaagacucuccuagggugauucuagacugugguauuaacaaugaaaaguagccaucauugcugcauagaguuaagaucauggugguaacauagagcuauccuuuugcccggaauguuucagaccauugacaagcccaugauuugugucuugcuauggaaaaaucaagcaauaucagaaacgaaguacuuggcagacacaaauucgguuccugguugaaaauguagauguccuuugucucgcugucuggcaacaguguucggaugggaaagaacacugugcuucgaaaaugcaaaucauuuaagagauuaaaacuuagaaguuucuguccccugcuauggaagcaaggaugaaaagccuuuugggucuugauguucaccccagcccuauuggaggcucaugcaaucccggugaccaucuaaaugcaggaaacagauaacucucaaagaagaaacacucgauuguuuucacaaagaacauuuuuuuaaagcacaguuuaaaauucaguucacuuuuggaggauauuuuuagcaucuugagaauguuccagaucacugacucaguaagcccaggcucuuaaaaaugcauguuuuuaaacgccacaaugcagcauugucuaagcgccuugccauuuaagacugacuguauauucugaaguccgucuugguugccuagggacuguucacagccuuucugggccccagacacucccuccuucccaaaugugaugagagggcacguucccagcauaguacagagaagaggggccccaggaguggcgugugaaagaacagaaaguuacugcgcuucgggcucaggaccuaaggggguuuucaucuaaugaaauuuagcauccuagcuuuggagagaaagaaaugaaggcccgggagcagcggcccaucuccaugaggucccaacugagccuaauuucuuucucuccaccagccuuuugggagggagagugccaugggauguguggaccaucucccuucugguuuggugcagccccuacuuggguaucguuccaugguuugguuagguuugguuagguuuggucacaagcaguaagccugaagcacaauggcuacuccaggagccagaagcaggagguaugacucaguggccccuagucugagauacaccacauuaauaaaaacauauccacugucuucuccaguuuguuuaaaauguacaugacucuacagacagggaaguacaaguuugauugguuugauuuacaaugcuuugacuucgugagggugcagaagccaacucauuaccauuggacugccuguguucagaagguguucaauaguacccggcuuuugcccagcuguaggcacucuguagcacccuggcauguugaaggcagacaaggcucagcuaucguguuuaggaggcuaagcauauuaaaacacaguucugaaauagaacacuuuaaacucacugugggucuaucgggauccaaacugaggacuuaccugucuaucuagguuauccaaacaggaaguuuaucaaagcacagcagagggggugacccucuauagucuggggauuaagaaacagacaacuuucugccaccuggcaggacaacaaagcccuuccugugaaccccuaaacauugcaaggguuugggggagaacuaguacuguuguauccucccaguaaccuuggucccacugaguucuuucaggggaggccccguauaaccccagcaucauauggaggcagaacaaaagaucuaguucucauaaccccuagauuagcagcagaguaugccaggaugugucugaaauaugccaggauauaugucugaaaccauaugccaggauaugucugaaagcgacuuuaaggacaugccaugauuugacugagaaguguaccccagugguucauguaauugaacacuugguucacaguuaguuuugccauuuggagagguuugggggucuuuaggagguugaaccuugcuggaggaagucauugggaugggcugugaagguuuauagcccugccccgcuuccaaaucacucucccuucucuugguuaugguugaagaugugaucucagcuuccuucucuggcuuucugaugcuaugccuucuuucacauuauguacucucccucugcaacuguaagccaaaauaaacucuucccaucgcugcuucugccacggugcuuugaaucacagcacuaaaauauaauuuuuuuuuuuaaaaaaagauuuauuuauuuuauauaaguacgcugucagacagcuaccagaauagggcaugagaucucauuacaggugguugugagccaccaugugguugcugggauuugaacuucagaccuucagaagagcagucgggugcucuuacccacugagccaucucaccagcccugaaauguaauuguuauaggaagacuauugacaaaguuuucacagaugcacccugucagcaugcucugugguacauugccuggguucagucuccucuacacccucccuucagcaugccaacaauccuugucucaagagaaaagggagaagaagccucuggauuuguccucacugauucuuccaauagcuguuuuaaugagugagucucugagcagguucccaggaccaguaguuuuagcaccauccugggaaguuccuagagagaugaaagaccgugucccauccaccuccccagguuggccacucuggggaggaggcacggugggcuguguuugaacacgaaauccaggugaacucuggagaaucacuguuguaaauaaccacaguuuaagccacaaucuacagccaugagucuucuuggcuuuucuauaauuuaagucugauauugcauguuaaagauaucaggucaacuuuuaugacguagacacuagagagucuacuaugauacuaauacuuaauaauaucauacuagacacugcaaauaucuagcguuuucccagagaacuucaaaaugccauuuaaagggggaaaucgaguguauuugccauuagagugaauguguuaauauaaacugggccauucugauuuggagaaggagagaaauggcaacaauuuccuauuuacagccuuaaagcucucuacaaucugauuuauuucugugugggcgcuuacacugcagagcuacaggagcauaucuggcuacuuuguaucauuugugugcuccaggaccucaaaugaguuuguucugguuucuggaaccuagaaacuuaaugaauuagaugcucaacauuuccaaaagcuagaauagcagggcaaagcucaugucuuuagaucagggaugcuaucauccaagaccacaccucaaaacaggauaacaggcacuggcuggucugugcugcuauuucucugccucgguaguucucugagcucuugggcauuuacucuucuauuuugccaucacaggaaggucuucaauguggaccaagagccuuugauuaguguuuguaauccugugucuuugguuauaaguugcaagaagcugcuggguuaagggucucaggagcuguggauggugccucucccgucuuuugaaaauaaaaacauccagugauucugcaguuucauuuuuaugaaagauaaauaaaucuguacacauacacacacacacacacacacacacacacacacacacacacacuaagcguugcuagaaguuggugaauggaagaaagcaccaucucaucauuuagucuggggacucagcuuuuggugccacauagaccauuuuagucagaaugauaacugaagacuggaauagcuucagacuuccucccccgaauccugagccaguagagggcagcacagauaccucaccuuaaucuccugcccuggucuuuggucccucaucuuacugccuugcacuuguuuuucuugcuccuuuccugggaggcuacccuagacucuuuccuaagccuggugcauacaaaugccgagagcgccauaugucccucguucugaugggccgaauagcauuuauaucuuuuaaguuggcugugguagcacacgccuguacucucagcacucaggaagcugagacaguaggauugugaguuuaaagacauggagcuagguacauagugagaccuugucucaaaguaaguaauguaaaaaaaaauguaaugaaauaaugucaaagucucugaacugaggaauaucuuacauauggacacgugcgcuaguuguuuuauugcugugggaaaacacggugaccaaaagugauuuauggaaggguuuauuuuggcuuuuggugaggagagagagagagagagagagagagagagagagagagagagagagagagagagagagaaagaagaagaagaagaagaagaagaagaagaagaagaagaagaagaagaaggagaagaaggugaagaaggagaagaaggagaagaaggagaagaagaaagcaugauacagguguccagagcagggaccuaagagcuuacuucucauuugcacagcgaagcacagcagagcagagaggggaaacuggaaguacaaagcggcugugaaccccccaagcccaccuccagcaaccuacccccugcaggaaggcugcaucucuagaaggcucuguguccucuucaaauaguaccacuaacuggaggccaaguguuuaaauaccugagucugagggugggggcacauuuuuuuauucaguucaaacaacgcuguuuguuuaaaacacugcucucuucccucuugaggagccucagucuucaugguaugccuggagagagucugcaagccagccacccugcuacacagcagagagagcugagggaguauuauggucuggauaggaaauguccaacagcaggcucaccuguugcugcgguucaucuagaggugcaauuuagggaaguuacagagacuuugggagguggggcccagcuggaaaaaaguaggucacuggguagggccacugggggucauauguuuucccaguccucaucagguucucuuugcuucuuguuugacauugugcaaguagccucugucccaugcucccaacaccaugauguucugccucuccacagaccagaaucagugcacccaagggcuaugggcuuuccccuuagaaacugugaacccagacaaauacauccucccuucggcuguucucucagggacuuuggcauaacuacauaagaugagcugacaugggagagugccaaggauggauaggaugagggaaugagcacuucccccagccccagagaaccagaggguuauggaugggaacuggauaaucugaauuugaccugaaagaugagugguaugcuaauggguaggaguaggcagggguggguguuggaggagguagaacgccuucuggaaaccugcaaaggugugguccguagaagccaccagugaaaggcuggcagucagaguucgaugguuaacguggcuggaaucugucaacuuucugaaauaguucuucacugcagauggguguagucugauuuguggugugaaacugaugugcauucaguacaaaccguaacuucaguuaagagccccucucaugaugggcagugguggugagccgaagcucugacccagccagugaucaugaggggaaacacuuacacucaagugucccauguuucuaagcuacagugauggguagguugaguggcuuggauuccacuuggaccugauguuuucaucucaugccguuuaucaggacaucacccaucuuaaacagaggagcaccugucgcugcagucaguggcugucucaagucuucccaugugugucaucaccaucugcuuccacuguccuccaccccccaaucuacccauaaucaagcaauaaaaucuugaugcugcuucauccuggauccuucagguccccugacugcuaguaccagacuuuucucuuuacaguuuagugagugauucucauacugcuguguguguguguguguguguguguguguguguguguguguguguguagggggagccacugaugaaaucugcccugaagccagauccagagaaugacacaauccuggccaccagcuuuugaagucgugcccuuccauguuugcucaccacaguugcacauccucaguagcuauguguuuauuuacagagggcagcagcaauuaccaggcugugcccaaacagaaguuuaauaggugagauucagcaaggggacaucuaagagcagcuuugguccacccgacagugagcuggggggagggggagggggaagaaggcaagcacuccucaguugcuaaguugcuaggacacuguugugacucugcagacacuagggcuaaugcuggucagcaggguccucgacucuucucauugaacaauugaaauaggaucccacauagauuugcagaaguaacaagaccacuucagagugaaucaguagugcagaucagagagggguaccucucaagauuguaccaauggguaagagcacuugagcccccacuacugucuggguuuuccuuguaugggguucaagaggaagagcuuaguuccuaagggguacagucagggugguucucugcuuugacugacacgauuagauuacauaagcccuuagucacugagcgcaaccccucucauaugcaucugauuucaaucauagacaagcccgcuuaugcauaugcauaagaugguaaauaagggauuccuucuaaaaggucacuugaggacucacuuuuaccuuacugugcauguaccccaaaucaguucagguuggcuuaacccuucagccugagauuauauuugaauagaaacugucuaaguuugacagucauuaggggaggagaaaccugugcuauuauucagguguguguguguguguguguguguguguguguguguguguguguaugaccugauggagguguauaguugcuuugcauuagaaaugagccagaggaacacagcagagagaguggccauaaaagacccagccaagaaagagauccagaaauguuuucguuuucagacacuacaaccacaccuuguccuguccauuuagguuguuuugaggcuauuuuccugguccaaagccauguuacuuaauguaagagagugguuuaauaacgcagcaauggucuggguaccaugaaaaguaccagugguguggaggcagaaaaggacuagaacagccaggauggggucccuagcucccuaaggggcaggaguacagcuccugaccagguaggaacaaggcaugagugucucaggacuggaggaggaugcugcagucuuggccugggacacgugggacagugacaugggucugagcugacuuaggugggaacaggacaaaaagucgaugcuguucacauucuuagcuucccaacuccagagcuaauccaggaccacagacaaaggaauccaagggugucaggaccagcuggaggagcuaagauuucucuccaccagcagauugaugccucggaccuucuacggauggaguccacccucaggagagauaaaacgcacacggaguggaaguagcaguguugggacucaaguccagauaaucuaaccacuagggagggaucacugcccaagacuagcaggggaguugguacccaccugugcuguauaguuuuaugucaagcugacauaagcuagagucacuggagaagagggagccccaacugagaaaaugcauccguaagauugggcugcaggcaagccugugagguauuuucuuaauuagcaauugauggggaagggcccauuaugggugguacuaucccuggacugauggucccaggugcuauaagaaagcagacugagcaagccaugaagagcaagccaguagacagcacuccuccauggcuucugugucagguccugcucuuagguuccugcccuguuugagguccuguucuggcuucuuuuggugaugcacaguguuguggaaaguguaaaccaaauaaacccuuucuuccacaacuugguuuugguaauaguguuucaucacagcaauagcgacccuaaguaagacacuauccuacuuggcccccugcucaagcucccaccccacucagagacucaccagugaccaugucucucagaccaauauucccagacguguuggaauaacuacuaguccugguaaagaaauugacacggggcuguuucuccuacaugaugggacacauuuauucuaacaagagaauaaaaggugugggaccaaguaaugucuuacuauccccucguccauccugagaacuaacuugcacugaauguugguaugguguuggguguggcuugcccaaagguccaugugcuagaagcuggguucuugguguggugauggguggguggcauguugagauaucuaaaagugauacuuaggcgguccucaggcuggucucuccuucgcucuggcuuccugugugucucuuucuuuugcauguuuuuccccaugaggugaugaagacaagggauucucucaucugagaagaugccaugcuguuuggauuucuagucuccaaaguuuuuucuuuuaaguacucagccucagucauucuugguauaguaacaacagcggcccaaccuaugcaugacguugacucagaggaguagccguucuucuucucuucuccccucaaaauggcaauugaauuaauuucuagguuuuaguccuucuagagaagcacugaaggggaagggggaggggcaaaaucccuuuauaaaccacaacaaaucacuguaccuuauugaaauaaaucacuguccuccacuuuaaaggugauuugauauacacucaauacauuuuucugugguuaugagcaucugcuauucuugcagaggacccagguucaguucccagcaccuccuguggcaguuuacaaccaucuauaaugccaguucuggggaucugaugcccucuucuggccucugugggcaguaccugugguauacacacagacaagugcacacacauacauacuaaaaaaaaaaaaaaauccccaaaaaacaaaaauuaaaaagugcauuuucugggauugguucuuuaucucagugguagauuucuugcaagauccugaguuccaucuccagcauucacccugucuaaaagggagugcauuuuuccuccucucuaguuauuggcacugcuuuccagaacuaucuaacucccucccccucgacuccucaacauaaauccuggcugaaagcucacccugugcucuucaacgaucuucucgguuuuucauuucuuauucaagugaaucuuggccuguucagaaaccacaggauuucacuuaugccuucgaucugcccugcuugcuccuucugugucaccaaacaccaggagcugacaaagacaaagaugccguuagccagaagaaagggggcauagcauuuugcauguugaaacaguccuuucuguagaugucugcaugagaagccugugcugguagagucacaugccacagggccccucagucccugguucugggcuuccuggcagucucagcauccuggaugcucagccaggucucccuugauggagccuggacugugcuugggcuucauacagcugucaggucugguuuucaugcuacucauggggccccagguugggccuccuugcuuggcacuggaacuucauuccuggcugucuuaugaccuccccagcccuucucucccccaacugccaagagaucugauuccauuuccaagaccuggcauaacccacuauauucacagccuccauaccacccugaaaacccuuccaauaacauuuccuuaacuacagugggcgcuuucauuuccugauuuuuuccuuuaaauuuuccugcugacuagguguugccagaccggucacuuaaaaguuaauuuacagagucccgagcuuccuuuagggaacacaagcugagacgccaaaaucucuguuuuucaaagaaugugauguuaaaaaccacccggcugggucccagacuguaauuuaaaagaaaaagaaaaggaggaggaggaggaaggggaggagaaggaggacagagugggggaggaggaggaggaggaggaggaggaggaggaggaggaggaggaggaggaggagaugacaacgaugaugacuacuacgaagaaccaccaccaccaccacuacaaccacuaccggaguguccauggguugaagcguuuugauuuacacaccauuuucucccagauaauccgaauuuuuccaaccgaguacaucacgccaguuacaagaaaccauuccugccccaccuuaaccgccucccgccuuccuuaagcuucuggaagcugccagcagauggcgcuagcccaccugauuuuuccuuguguggccuugggagucagacagggagguaggugggggagaggccugaagucagaagaacgcugagcccaggccaagauuucuucuggcaucuggaaugcauuaaaaacaacccacagagcugaauauaauucuccuucgaagagagugggguggggagagaagaagaaggagggagggagagaggaagacaggaaaacagagcggggaggggaagaggguugaaaauggcagcgacaggcagagaagcccgugggucauccuggagacgugugccucaucucacuuguccaugacagcugccagcauuucugcucugggugaacagggcgacaugguugagaggaggaagcaagcgacaaccagaggguucugauaggauggugggaagggauucccagccuucuccagcaggcuccuccucacuggcuuggcgguaucugcucuugagggcgccuccucugcacgcagcccuaucggcuuagagcacagcauacccgugcuuauggaggcugugagcagguugaauuccagggaccgaucggccuucucugccacuaacccucacuccuccaacuuccaauucaauuuccuuuucuccugggccuugacggaaauaguuuuuaaugguugcucaaccgugccaccuagugcuuagcagauucugugugaagagcaagcaaaagacaguggggacauaccaucugggaaggaggcagcuagcugacugucaguggggaccagucuuggguuugcagaccgguucuucuuuuuacuccugauaccaaaggacaaagacacccauuccgcuaagcugggagagagcugggccggguugugucuguccacugggaggccaugccgagguacugaagagaccgugcagagagcuaccagacagaacuaccaggcugggcuaagcugccucuggguguccuuuguccuucacgggagcagguguugggagucugauucuugguaagcgguauugggaggugauguggaaacuuuagguucuaccuagugagaaggcugccaccgugugguuuguccaccaguaccauagcacccaccaggaagccuauacuagaugcuaccaucuugucauugaacuugugaaaccuugaacuaaagaaaucuuuuuccauaauaagguaugcaaucauggguguuucguuuuagccacggacaauuaacuacuaguacaaccacccugucagacugucuaauuuccaugaauuuaaucaaggacaugggccaccaggaauggugcuuucacauacaacagcuaccagcagggucuuagaauccuccuggcagggcuugcugagugacacagcugagcccccagccuaaccuuggagcccacugccaucuucuugcccuuguaauccuaccagcugcccuccuggcucuuccugcuccgggcuugcugucagcccccucaugccaugccacccucagccccaccucuccucuccuccugcucagccucauguagacgucuacaaagagcuggcagugcuucauguucauguucauucuggggucaacucaaaguagugacuggcaccacggacuggagccagugugagaggucagaucuuguccacugcuggguaauuugagcccguuguguaagcugucauagccucaguuuccucauaggaaaaaugggaugaugauagcagcuaugccauuggguuguuuugagggcugaguugacacauuuaaguugcuuacccgggacaaacacuugauaaugguugcuguuguuaauagcuccccuuuucucaaaucugguugucuuuaaggaguucugcuuuaugggaaagggaauguggguggcuguguuagucugugccugguccucuagacugauaguuuccaaacagcaaaguagguuuggaaacauguaacuacucucuuaggauauaugagggagcaggggacuuaacuuucuguggcagaguuaacugucuauuccccaaaccccaugaccuuuucccucuuagacacaagcuaaacuacauuuccuagccucccuugugagacuucauucugugcaacuuaaucagagccucugugauaccagagugcugcucgcuguccaguccucaaggcuggcuucgucuccaucuuucauuugauugaagaggacaccaaaguucugggagagaugagacagaaggguccccuguucagagggaugagagaagcaacuccaagcaaagaaagacaaacuuuaccccguuaagcccauaaaauguaucuuaggaucauuuuauacuaagccaacguguuaaaauaaauuuugcgauguuaucuguuaauuuuucugucuuaggguguucaaguuuuaauauguaucgaaagaugaagaaguucacauuuacaagucaaugcucaacauuuuaauaacguaugaacaucuggggucuccucucugugguauuugagugacuuaagcccuccugcaggcaggugcacacacaauuggugaccuuuggaaacacucugccaucuuuucauuucucugugugaccuacugucaccuggagaaagcucagggaagaugaucaagaagucaagugaaacaguuugccgagggucuuaaguggguuggaggaauagcuuagcauguccuguaggacaguagaguaaguauggcugacagcaguuaauuucacaauaacacaggggauuuugaauguucgugaugcaaagaaaugauagcuuuuuagggugguggccugugccaaccgcccccacuaaccauuauauaccaauaucacgaugucacgcuagaucccauuaaaacguaauuauacuagcaauggaggaaagcagacugggaauuagaacacuaaagaguuuuaucucugauucuaacuugguaacuacaggcaggggauguuuccaaguccuggguguccaaguccuugucuucagaaugugguuucucugcuggaugggucuacaagcacuucuuaucucuaauguuccacggacucugucgacgucugguuucaagugggugugagcuuccuuugggacuaagaguugaacagcuuuaaagcauccacagugaagcccuugcucugcccugcuucuggcuaagcugccccauggagacauuuccuaguugcucucugggaacuugcaucugcaugggcaacuuaagacuggaucugagauggccuguuuucucccauugagagggauccauggguccucagaacuccaacuucuuguagcuaucuccucuuuccaguuccugcucccacacugcuuccugugaagaaaauucuuguguuccuaaagaccccaacgcccaagcugucuguuccaaggcgauguucugaauuccagauguuuguucucaauggccuccaaacaucucugaggccagcaugcuccuggcacagccguagagcauguguucauauucuaguuaggaccaaagucaaagcaggaguggcuguccucaggguugagauuuuaauaugaugcuagagccucggugugagcacuuccucuucugagcuuugaccaauccacagauaaaaagcagauuaguguguaugaaaggaguuccauuuucaaagcuuguguuuggcuuaccacaaggagagcugugcucaucauaauuaugucauuguuagcaucuucauucuggcucauuccaguucauuccaguucauucugguuucaguuucaccugaugauagaacauauaaccuugccaagcaaguucacuuagucauuucaaauauuuuccuaauuuucuuccccuuaauuucaggucuagcauucuucaacaucuacugugucucuugcagaaauauugagaaaacaaagguuggcguaguuaugccacugugacaaauugcccagcaaagacaauauaagggagaaaaaggaauucaucugggcucuuuucagagaguuuagucuauccuaccugggaaggcaugguggaaagacuccguuuguaguuugaaguagaggaugcuggcaucagagguugagcuagaaccaucaaaggccuaccccaucgcucuaccucagccagccaggcuuccuaaggauucaaaauaucuacacccacugaggucaagcauugagguccugggcuuggggacauuuuacauucaaaccacaauagguggagugagcgggagugagagggaggcaucagcuguagggauguuguaggucggugcugccagaucccuggcagucagaccucaugccugacggcuguccguuguuucugcuccucucuaugcaucauuggagcauaagcccacagcagcucacuaaccccugggagaugugcaggacacucucuaugagcacuugagguucaguugccugggcaccacauuccagaaucuauccaaugucuuggcaaucauuugucugucagaggguggaaauuucacuuaaauagaggcaggaacucuguuuggcagagguaggggggcagggcaugggggagggaaagagaaagaaagaauggaucagugaaucagaauaaauucagacgaaaugauccuuauauuccuuucaaguccuugucuugcauagguuugaggguggguugagagcaucauaggucagacgacaauugcugacccagcaucaguguaucgucaacagcauagacagcaaggaaaaaaagcccucgggcuuuuaucuuccuucuccccuccucucuccugccccuucugcugucuucuucccuguccuuccuuuaggccuccuguagccagcacagucgacucaugacaguggggguggggguccuugauuucagcagcuuccuuaacuucccuaguaccaguagcucugucuuacccaucacccccacccccagaaguaacaagcaaaaaucaauaccacacauugucagacaacccuuuuggguagaacuguucccuggcugagaaccacauuugcuuagacaaauuacaaauguaaaaaaaauuuuaaaaaucucagcaguaacugcuuuuacaugcuguauauuacggugucuaacaguagcagaugauuaaaaauuacugauaaaaauaaaccucuggguuuuauucuaagccuuauacuuguuauuuggaauaucccccaccucagcaucucagaaacagugugagaacuagagaggugucucagcaguguagaucacuggcugcuuuucuagaggacucagguucgauucccagcacuuacauggcagcucacaaccgucugaaauccaguucccggggauuccaaugcccuuuucugaucuccucuuacaccagacaugcacauguauacaggcaaaacauuuauaugcauaauuuaaaaaccaaagaaacaaugugaccuguuuugcuauucaaauaucacuuaguuuaugucuuuguguuuuacuuucuucuuuaccuuuagugaaaaagauggagguuuuuguuuguuuguuuguuuuguuuuguuuguuuuuggaaaguguaaaaaauuaacugauuucccauaagugacuuaacauuuuauucuaaaccauuaaaccucuggagucugucauggauuagaguucuaaagaaauuagacucuaagacauaaauuguaauuccaaccacacauuucuuuuuuuuuuuuuuggcaguguguagaaaaauaauuuacauucuugauagucacagacaaauagauuuucagucuguauucuuauugaggccaugcuuacagggucaguuaguauguacuucagauuuuguuacauuuauuacauuauuccagauguauuugaugucaccauuuucauagcuguuuuuuauagaggaauuuuuaauccaguaacaugacugcuuuggcaagggaucacauccaaagaccuucuaggucuuacaugaucuggcuggaaugcagacacacccuuaguacacaccuuuaaucccuuggacuggaauacacacacucccuuaguaaacaucuuuaaucccuuuggcugggauacagauugcucccuuaguacacaucuuuaaucccaagcaauguauuuuguaaaaggaaacagccaugcuugaaagugauguuuaauugaggggcaggcaaugugaugaaucaaggaaagauuugacagaaugacucucacaaggacuggagagagaggugacuuaagagagcaggagagagaaagagagagagagaaagagagagagagaaagagagagagagagagagagagagagagagagagagagagagagagagagaguuuuaccaggaacguuuuacagagacagguugcaggugaagacagaaugagguagagaaugagaagccagaagauuagaacagauugccaggguuagguagaggccaagcagagcaauucagucagaacuggagagaagccaguuugaaucagucagcuuggagaggaguuugagccagaacagcugaguugaaucagccagugagaauucagaaagaacuagaaaaggugagcuuauuccguaguacaucuuggaggcuaauucuaagcauagcuuaacagaaaauggcuggaagcugaagcauucaagacucagguuugcagaagauuagauuguucagaggcuagaagcuugcaggccuagagaugauagaacagagaaggaaaugcacugggcucagcccaagccauguauucauacagcuugcuuauggcucucaucucaucucugaggaaauaaacuacauuuacaauuuuuuauucuacauuggauuauauuucugggccuuuggucuauuucuauguugggggcugcaauaagugucagcagaacaaaauguaaguaguacaaagaguagcaaguaaaugagggaauggcucuugagauggaucucuuucacccgaugcaugucagccuuaguauaauuuguaccuaaaauuuagguuuaaccaucuagguuuuuuuuuuauuagguauuuuccucauuuacauuuucaaugcuaucucaaagguucccccauacccaccccaccaauccccuaccuacccacucccccuuuuuggcccuggcguuccccuguacuggggcauauaaaguuugcaaguccaaaccaucuagguuuuaauaauuacuagagaaaagauacuucuguuuaaaaaugugugaaauauggggcuggagagaguucagugguuaagagcacuaucugagaaccuggauuugaccccacccauguuguggcucacaacuccauuuccuggagauccgaugcccaguucuagccuccuucugcaccagguauaugcauggugcacagauauacaugcacgaaaaccaccaaugcacauaaaauaaaacaacguuuuaaugaaaaagaauguaugaaauguaguaaagaauuagcgucaugacauucuuaggcuagcaucuuuaucuguuugggcuaguguaacggaauacacugacugacuuaaauagcagaccuuugcuucuuacagucuggaagcugugaaccgaaaaggcagagucuggugagucuggagagucuccugucuuugcagguagucauuuuccccugagguagagagagaaauaaagcaugcacacacuugcucugaccucuucaccuguucauaaggcuucaaucuuacggccgaauuaccuccaaagccccauuccaaauaucagaauuacuugugcuuuucagugcccaccagaaagauauugccacuguucuugagguuuuguuugcugauuuuuuauuucuuuuuuaaaauuauuauuuauuuauuuauuauuagauauuuucuuuauauacauuucaaaugcuauccugaaaguucccuauacccucccuccacccugcuccccuacccacccacucccgcuucuuggcccuggcauuccccucuauuggggcaaauaaaguuuuuguuugcugauuuuuauuaaugagaaagagagaucucaagaaagacagugcuucaaauuccagccuggaaaaucacagaugcauuaauugacuucuacugacuugacuuuugcugacaaauucucccuucuaauuucugaaagucccuguacuuggccacacccuacaauaugugaaauagaaccuucuguguuucuuccuuccccuaaucuuuucuaagacuuugcauaaucuaccauuauuuagcacaaaucuguucagcugcuuuacucuccuggaguaaaugaaugauaauggccuauggcauucauguucaugcgaugauggaauagagcuagcuaacaggugagagcaagcaauguguggggggccaugaaggugcuaaaaucauuccaaucacaagaauugcucccuucaccccucccucagcaccccacucugcuagguuuguggaagaauuaagaugcagagagguucauuaaauaugauuaucaacucuuuggaaauuuggagcaauauucugguuugguuucuucuguccagaaaucacacacagggcugaguaacuugaggcuggcuccuacacugggagugcucagauucuuggcucaaggugauuuaggggacuggaacauuccagaggaagcaaagguaaaacaaauaaagaaacagagagcuaugccugucaggccggacgugaauggaugagggugguugcaaacucuccaugacugguggcuucucagguuaaagggcaccaaaggaaauacacagguucccuggguuacgaggaaggccugccugugccuacaggguaugcuguugugagaccucuaggcuuugagagauggaccaaggugacucacacuuccugagaagugucuuaucucugccagacagacaucugugccuuccuuugacuaagaagucacccaugcagggccacucccucucaggcagaucagcaagucuuuauugcucccuaggguugguccugagaacagccucaaugacaacaaaggaaggagagcuugcugacugucucucggauuucugcuuccuuuugcuuucuuggucccucauaccccauacucagcagcugccuauagaccagaagggauugaugagcuucuugccuuuaggaggaauggggacaucacuagaccaaccacauuuuacuaaagggggauggauaugucuuacuuaggguuucguugcuguguaaagucaccaugaccaaggcaacucuuauaaaggaaaacauuucacuggagcuggcuuucagguucagagguucaguccauuaucaccauggugggaagcauggcagcaugcaggcagacaugguacuggcgauggagcugagaacucuacuucuugauccaaaggcagucagaaggagaauguguucugcaggcagccccaggaggagggucucuucugcacugggaggagcuugaguauuaggagaccucaaccccugcccccccagugacacacuucuccaacaaggcaacaccuccuaaaagugccaaucuguaugggccaagggcuuuaauaaagaugcgcccuucuggucauugguagcuugagauugcuuagcuuggcuuuacagauguguuccauugauagucuuugccucccacgcccagggagacagaguggaguguauacaaagcacaagcaaguugucccugggccaaguugcuucuucuuuacuaagacagaguuuaccacacaggcuucucgagagagcaugugggaagucacgagagauaaguaaucacugcuuuugcuguuuaauggugguggggaccauagagcuuuccugccagagacaggauggacaucagagugcauuugugaguguguggaaugccacacagagaaaggcacugcugcuacauagaaggggcucaccgucuggugcuggagacaggcauccuaacaaagguugcugcagugaugguggcagaaguguuauugguguaaauaaaguucuguugaaacuuaagacauugauucgggucagggaagguuucacagacaggucaccgucagacuggguucugaagcaagagugugauuucugcaggcagggaagggagagaauuuuaggaacuugaaugagggagcacgaggcauguucugaacugccaggaguccuguuugaugagggcaacguucuuacgacauguuccauggaacucugcuccuuggagaugagccauuguaaagggauauuaggucaaaguuuuugaaguucaccuccugugugguucucuuaaaguucugagauucacagaagaguacugaaggccuguauggaugcaaagaaagcaaggcaaaaccacucagccauuuaaagugaacuacuccuuccucucaaaaaaauucuuucaacuccuguaacuagaaccugauuggauuccuuuaagcauagggcugggcacagagaaaggagaggggcaugauuugggaaaggucugcucaggugucuggagucuccuccuggaucugaugggagcaguaguggguauccuuucugccucagcaaacaguuuuuauucuaguacacaaguaauauagauuaauguuagaagcaaggagaaauaaaagaucuaagaaaucugagcuucucuacaaaggagaacacagagauauucuuuaacuaugauguauguaggucucgagugggggcuguuacugcucggggcaacucccgaucucauuuaacuuaucaucugauuguggguacacacuaugggcaagugaauaaaccugcaauggaauaaauagagaggagaaggugagggcgcgcgcgcgugcgcgcgcacacacacacacacacacacacacacacacacacacacacacagagagagagagagagagagagagagagagagagagagagagaagugaggagguauaguaucuggacuaggcgacuggauggguuugagaugaaaacuugggggaggcaacauagugaaaucugcagagaaugagagagaaaauagaaacaacacaugcaaaggaccaaguguggguugugcacacaagaggcacagcaaggaagaguuguagacugggcauacugggggcaagcaaaggggagauguagguugugucuaggagucacaguaaggggacaaugguggcuggaauagcugaggcagauuggaugaguagagauucgaagcuagagaguuaggaggggcagcauggggccuugcagagguaggcuuuuguuuauaccuuaggaugcugugaugacacuuacaaauggcuaaauggagauauaauucaugagccaccauguguaccauuaaguggucugaauaguacucauagagaaguuaucacugggauggaauuuuagaaacuugacccccaucagcagucauugucuaucuaagccuugcccagcccuuggcaaacaucgaucugccuucugucccugcaguucuagucauuucacauagauggcaugaacguugaauaauacaguauggguucuccuguuacugguuucacucacgucagguugacaaguucaaguuuuaagcauguuggaacauauccacauuuauuuuuagaguucaaauauuccacuguaugauguaucauaucuaggguuuuuuuccauggugcccucuggguagaggaaggaugggacccgaguuugguaagaacacuguggccucuugguggagaacggacugaaggggaguacguguggaaccagggaggcugacugggagguggcggaaugugguugagggugaugaguuuggagcuagauaaagugacauggaaguggcaaggaggggcauugucccagggcucaguucgggguuauuuuccucuacuacacuuacuucuuagguuauaguagucuccuagggugugugugugugugugugugugugugugugugugugugugaaaaaauguaugccuguauauguguuuacgugugcacaggugcaugcgugugcagacuagagguugauguuggcuaucuuccaucguuuuacuuuaugucuuugguuuuauuuuauguauggguguuugcccguaugucugugcaccgcaugcaugcagugccuacagaagccagaagagggugucgaaugcccuggaacuggaguucaagaagguuguaagcuggaaucaaaccaaggaccuuuggaagagcagauggugcucuugucuccugagccacuucuccagaauccucuaucauuugaucacucacucuguugagacugcguucucucugaaccggaagcucacugacuuggcaagacuagcugucccgcuagcuccagcuguguuccugucucugccuccccaguucuaagauuauagguagguaucaccucgucugcuuuucuacugugcuucuggaaauccaaacucauguccugaugguugcacggaaaguacuuuaucaacugagcccucuccccagcccggccuccucaguuguuuuaaauacuguuugcuaaucaucuuugccuucucuaaauccauaugcugaaauccuaaugccccauagggugagggugagaccuuugaggaguaauuaggucucaaggguggaacccucaagaauggaaguagcagcguuaagugagggaccuuccuuguuuugccaucugaagguacaaugagaagcuagugguuugucacccaggaaaggguuuucaugaggcucaugcuuuacaaauaacagaaaugcacaacacaaaguuacagacuuugaaaauacaacuccagacagcaguaacucaaacagcuuuuauuuuuacaagcagcaaauucauugggagucaggcaaauacacaaaacucuaaaauuauaaauuccauacuuuggguuguaggaguagaguucuggccaacaggggaugacaaaggaugggugugguaguugcuaugaaauaggagaaagugauccaggcucagagaugccguuuuuacucuguacaccuucucuguacagaaggugaacuugacccuagacuccuagaguccaccuuguugugcagccccguaguagagcuucuuugaccuggcucauuuuccuugcacaucccucaucucauggaguccuuggcucuuuaagcuugaucauuuucaucucccugcccccugaauuugccacuucuaugaccaguaagagaaaggauaagcaagcguugguauagccaugugauauacuagucaacaauaaaaagaaaugcaccagaaauacacagaacaguuuagaaaagucuaaaaucuuuaaaguuaaguggaagaugacauuuugaaaaggcuucuguuuuggucagaauuucuauucaugcacaaaaugucaugacuaagauguaaguuggggaggaaaagguuuauucagcuuacacuuccaaauugcuguucaucaccaaaggaagucaggacuggaacucaaacaggucaggaagcaggagcugaugcagaggccauggagggauguuaguuauuggcuugcugucuuuaccacugaccuccacacacuccauuccuucuccugggaagguucucauuuucuuuugaacugaucuucuacucagcccccuaaacuuugaaggaguggucauuuuuucuuuuuuuuuuaacgagaagucuucuuggacuuuccugacagggucaagucuccaccuuagggcuucaugugaucuguaauugugugagguggauggaggccaguuuccagguuguagaaacaguaacuggguaguuuaguuacuuuugcaaaguggugaccgaaaaccgacagaaacaacuucaggaaauauuuauuuuggcucauagugucagaggguucaggcuguacccucuuggccucauggucuuggcuagaaauuauagcucagaaaaggauauguggauuagugaagauagcaauuaccacugaggacucagaagguggaaaugugccuuaaagccagugucccuucccucacauuggugugggacacuuucucgguggcucagggccucucaggagcuuauguuccagaacucuccccccagagcuuacgagcugagcuguaagcacucguugcaucugugaucucauucagggagggagcacuuuggaccugaauacauuuggcuguugcacgauccagauugcaaaaucgggugacuucaugcuccugucuuuccuccucagaguggacacaguucucaucacgcuggggaagcugggcaagaagcucguugggggaauggaaaaacagcaucgaaaagacauccagcuuuaacuccauaaaagaaucacugacauaag

SEQ ID NO: 6071 - RNA, 657 nt, Mus musculus
aacagaauaaucauaagagcucugccugggcuuugaguuggagaagccagcauuagaaaauggugaugguucugaggaaggccagguacuugcuuugcagacagaucacgugcuuguuugagucucagaagugcagcuucagaucccuucuggacaaguugaggguaagccugagagcagaggaaaagaaacauggucccaucaagaaacauuugacauaaaauugugacuaggguuagaggauuaaaagcagagcucuccagucugucuccuaagugccguccaaugucuuugaagauaaaaauucucucuccaauuucucccaaaguaccuuguuaaugcaaccaauucuuuguuuccacugcaggucuuggagccagacuaucauguaggguguggcuggggagaggaccuagucauaugcaccauuauuggcuuucuaguugaucuuggcacaaaggauuugaacuccuggacucacuugucuucagaacuggucaggucugguucagaguaauuuuguuggaagugagauucaagccgguaucuucuucauucucugagucugaacaccccgaaugaggucauuuaugcagagugccuggucuuggacucucugucuaggucaaggauggguugcccuaacauucaccuuua

SEQ ID NO: 6072 - RNA, 1271 nt, Mus musculus
cuuuuuuuuuuuuuuuugugggugcagacagacuuuauugaugguauucaagagaguagggagggcucccuaggccccuccuguuauuaugggggucugguauggaaauugugagggagaugcucaguguugggggccgaguugggauagggacuccucagcaaccgagggccucucucuugcucaguguccuugcugggguuggugguccaggguuucuuacuccuuggaggccauguaggccaugagguccaucacccuguugcuguagccguauucauugucauaccaggaaaugagcuugacaaaguugucauugagagcaaugccagccccggcaucgaagguggaagagugggaguugcuguugaagucgcaggagacaaccugguccucaguguagcccaagaugcccuucagugggcccucagaugccugcuucaccaccuucuugaugucaucauacuuggcagguuucuccaggcggcacgucagauccacaacggacacauuggggguaggaacacggaaggccaugccagugagcuucccguucagcucugggaugaccuugcccacagccuuggcagcaccaguggaugcagggaugauguucugggcagccccacggccaucacaccacagcuuuccagaggggccauccacagucuucuguguggcagugauggcauggacuguggucaugagcccuuccacaaugccaaaguugucauggaugaccuuggccaggggggcuaagcaguugguggugcaggaugcauugcugacaaucuugagugaguugucauauuucucgugguucacacccaucacaaacaugggggcaucggcagaaggggcagagaugaugacccuuuuggcuccacccuucaagugggccccggccuucuccaugguggugaagacaccaguagacuccacgacauacucagcaccggccucaccccauuugauguuaguggggucucgcuccuggaagaugaugaugggcuucccauugaugacgagcuucccauucucggucuugacugugccguugaauuugccguggguggagucauacuggaacauguagaccauguaguugaggucaaugaaggggucguugauggcaacaaccuccacuuugccacugcagauggcagcccuggugaccaggcgcccaauacggccaaaucaguucacaccgaccuucaccauuuugucuacgggacgaggcuggcacugcacaagaagaugcggcugucucu

SEQ ID NO: 6073 - RNA, 981 nt, Mus musculus
uuuucugugcuuugaagggagagagagccaccaaucaugugagauuucugguagaguggccauuggcugcauccccgacugggccugggguagcaggcaggagguuagaaaugcaacuaagcugagggcagauuuaggaugccgagcaagaagaaguuaaggcaacuaaguugagagcagacuuagagauguugagcuacgagugaagguaagggcacauuagccaugggaggcuuagaaguggccaaccauuaagcuaaaaagcauauuaaaaauaagcuaguguguguguguguguguguguguguguguguguauguguguguguauguguguguguuuauguguguguguauguguguguguauguguguuuguauauguguguguguguauguguguguguguguauguguguguguguguguuucauccauggauccaagggaaccugggcagggcugauagugugguccaccggaguucaaagcuugguaguaggaacuacacguuaugaggaaaugcuuuugguuucucuccaacaaguauaauaauauuggcuauggguuuguuguauauaacuuuuccuaaagucuccacaauuuuauuuucaucacaaaugccauuuuggcaaugucuuuucagcaucaacaaaaauaauuaggugguuucuguacuugucuacuucuauguuguacuacuuuuguugauuuagguguguuuaagcaaccuucggggaugacacgauuauacauuacuugguuguaauguauacucuucuuaauuuguuccuggauuugguuugcaaguacuuuguugagaauguuugcauauguucaucaaauaaacuaaucuaucauuuucuuuuuuuguagugucuccuuguuugucuuuguagugcaguuaguuuuaguaucaggauaaugcuggcuuaaaaaacgaauuuuguaguguucugucucuuuugauuaugugggggga

SEQ ID NO: 6074 - RNA, 2612 nt, Mus musculus
uaaguuuacaccauuuuauuauaucaggaauuuuugauauuugagcugaggcuuuccacagcugugcagucacuugugccugggauacgcauaugagccaggugcugugacuuugucgccuuacauucugacggaagauaaguuguggagauggcuaaguguguuacuuuaguaugcuuugcaugaaauaaacacugaucuuugaacuccugcagcgcagagcuguggucuguacagucuuuuuaucccccucugcacuaguccuuggccgugaggaguggaauccgugagguggcuacacaagagucucuguucuuacaucucucucuguagucgucuccuugucacuaaggaaugcauuuuagucuugcagagagauugcucucucuagaguguucuuaugaaauaguaauucucagucauuguuugaacuuguaagcaguuggucuguagaaagggagagacagcucucuguagcaugaggaaugccugugccguggaggacuccuggcucuguuuaauuuuccuauguccauuuugauucuguaucauagcuuggcauauuaaauuuuaaaauaaaauacugauaaaaaguguacauuguuacuugcugaaauuuaauguucaaauaauguagaagggauuguguaagaauguuaaauacuguuuuacguuuaguucauuuuagauuuaugcaguuccaaaaggggcacagcccaguggaucugagcuucuguugaaaugguucaacuguguaacaugaugagcggcaccaugugggcauguguaucugagaugaugugugccuaggaacauuugugacguucccccagaaaaucacuggcaacccuuggccuaguucauuuaauaaaauuccuuagaacucgccguagauucauuuuaaaaaauaagccacuuguauucaaacaagucacuacuuauuuuaucagugguaauguguagaaaucuguguucucauccaguuaaauagagcucaaggaaguuucuguacuuccuguaaaaacaaaauguggggacugugagugaccuguuuucaaguuacugagagugcuauaaaagugcacauuuaaauugaagcaagugaauuaauuguuaauaaaauuuuucugaccuucuuuaaaagagacuuuaagaggcccucuggcuaccccuuacucuguacugacuguagcuaaauuacacaaaauuagacuaucaggguuuauaagaaguucagccauaguauuucugaaaaaaaauaaauguuguuauuuuaaaauugaguuaaaaugaugauccuugaagaauucucaaguggcgggucucaucuauuuuuguaugccugauuuaauugaauuaacagauuauaaauuauaauugcauucagcgugugauguaaggcucuugguagacucaagcuguaccauugaugaucaagccuuuuaaaugcuaucacugauaccaaauguacuaaagcugggagauuuuaucuguugaauaaguuggcgaucccuuacauccugccuuuacuaagagugucaaaaaaucacucccuaugauguguaaauugagagacuuuuaucauaauugaaauuaaggaaauaccuuuugcuuaaaacuugucuuugauucagauuuuucauuaguucccaaauaaucucagugaggcuuuguaggagagcaucaugggacacgcaugacauuugaggugauagacaggguccuuccauuuuguauagaugcuuccugucaggugacacugagcugguguuuacagacuggacccuguggucucugcgcucuuucaguuguauguuuugcuuuguuguuagagaauuuccaucuauuucauaaaugguauuuuuauuuucuucacuaaacugcuugaugauauagauuccacagugucuuugaguucagcaacuguuacaaacugaagaggaaaaggaaagaaugagucuuuguaauuguuaaauacccauauaaaucuuaaggagugcagggauauucaccaggacauguuuacauggacaggaaagcauucuuaaagaaugaagagacaaagauacaaauguguuguguuguguuuuguuuuguuuuguugcacugauauuuaaaacuaucuaucaagaaaucuggcaaacaacuuaugcuagaaguauuuguuucugaaaaaaaaaaaaaaaaaaaaaagauuaacuagggcccgagaugcuuuaguggcuguucuuacuggaagaugaaacccauccacccuugucggugguguuucagagccccagacaagccuguaagguaugagacuuaccguguguguggaccacagaugucuucacccccagaaggaagagcgcagaacgcacaugacauggaagagacugagccugcucuccaugacugugugcugaguaaaacaggacugaggaggauacgcuacaaaacagcccuguugcugaacucguggggcgaaccgcuucaggaguaggucuggacucggcauggacagauuauguugccucaguauuuucaauuaaaauccuuguuugagaacaucagagucucaugcagcuguaagaaaagcuagaggucccacaugccuuucuuugguucag

SEQ ID NO: 6075 - RNA, 3542 nt, Mus musculus
gguguuccaauaugguuucugcucuucacagagugccacagaggucaauaugcauaauagccauuuauucagcuuauguuucugcaugcuaggaaaagucugggggcuuggggccacaucauuccuaugcacgauguauauacuauauacaauaucaccuuaugaugaacuacaguugaacugggagcucagugcuuuccagaugagaaaacauauauucuggugaccaucugcacaacgacacacuuucagagcaacuuuuaaauggucucuguuuuuguugucuuccuucuacaaaccagacugaaauacacagaggaaaguuucaaaacacauuaaaccuuaagcuucaaagugguuugucaauauccaauuuucagacauaauaggacauggaaacuuggcaaggcauguugcucauccugggcaaagaccagugcuuucuggucucugcuucuaaacagaucuucauuggucugggaaucaguugugacugguaguuuaugaacacggcacuauucuuacccaacaggccacaugugauccaguucuauccaagcaaacuuagaaucaguagggccccuguggaagcugaaaggcaacccccuaacuuacacuuccuuggucaaauggggaaugagcaggaagaggagagaaaaucugagugucaaagcuaggcagccaggauuccuaagugaguuuccugagaccuagcucucuugacugcuggacucuuauuagcacagggaggggagggguuagggagcuaggaagaugucuacagcgcacaggauugggcuacagugaccagggcacagcccacauugccagguaucuugcaggagacagaaauaaggaagcaauacgauuaggacaaaaaugaaauaucuggugguggaagagauggcucggcaguaagagcccuggcugcucuucuagaggaccugguacaauucccagcacccacaucuaggcuaacaacugucaggaacuccaguucaaagagauuuagaacucuccagcuggcaccagguacccacguggugcacagacacacaugcaggcaaaacagccauacacauaaaauacaaauaaaugaaaaauugaaaacaaaaccaccacagaguaacagccaaagaaagcaaucaaaccuucaacaucuccugaagauuuuacuacucaccuccccaggagccagcaaggggcagauuuuaccucuuugugacuugcuuugggggcaugggaaggguaucuaggggucaggggaaauaagagaaaaaggaacccguuguuuagggaaggacucuuaacucucaaagagugaaaacacauucacgcauguggguggugcacauaugcaaaguauuaaacuuuaucaacaacugguuauacggauuuggaauuguacuuauuauuuuuuaaauauaauuucuguuuugguguauuuauugaucuaguuucuaagggguuccuuuccagguccuaugagacucuucaucuuuuuaaauaaauccaaaggaaaaacaagcaagcaagcaaacuaacagacagacuuguaagggcccucaguggacagggaaguagaaggcaagucuguacugaagcugucucuuugcccagacaaaugggggcguggccugccaagaacucuugggaacaaaacuucagaagucucugggaugagaggggaugggaugggugggcuggagaaggguaggaauacagaagcugggaccagagggaaucaggaaguggggaucuggggguguuaaggcugcuaaggacuaagcugagcuggagaggucugagaacccccaauccggcaagggguggacuggcugggcguuagacucaggcaaucauacaggcgcugucaaucugacagcgcccagagaccuagggguggaggaggaggaaggaggaaaggagagagggagugcgaggaaggggcgucuccucugucguccgcgcccucuccaguguauugggcggugccucgucaccuuuuuuuuuuuuuuuugucccggucccaccccuucugccucucuagcccggccccugcgccucugcucugcacccuagagcggauccccgcguuggucuggccugggccguugacgucaccaccaaguuugcuguccuucgcgucccacguguggcgguagcggcugaggaggcugcggggagagcccaagagcacaguggcagcgguggcugacaggucccgcacagcggggccccuccaagcuguucccagcuggggccccagaggaguggguagacuuccggagcgcucaagaggccagaaggcuugagucccauucggauagagggacuagggggacuuugcuugcucgguugcugagacgagcugagccaggacucagggcacgcuccugggcgggccaggagagcagaagcuggaaaaagggucacucguucuaaccggagcguacacaauucuucggcccgagaguccugcgcccgcuccacgggggacugagccaaggauguguuaucgcugagccaaguuccgcaccgcucaggacccugcugagccgagcaccuucgccacugccgccgcagagacucccuugccgggcgacucucggagacccagggcgcggagcucugcgcagcuaggcucaggacucgggcgcguuucagacccaagaccaugguuucuuaagcacggccccgcaccccuuuccuccucgucgcccgaagcccaggaccccaagaagggcucgcagugcuuggucccuaguuccagccccugcugccgcccagcggggcagcucucaggcacgcagggcggcucaggcgaugcggccgcggggcagcacgcuggcuggcagcggggauggcggagcucccagcacagucguggccuagcauggcccgcucgccguccgaggucgccucuggcuaggauggcccccucgggucccaccggcgcccagcccagcccggcggagccacugucgcgcagcaucuucaggaaguucuugcugaugcucugcucgcuacucacuucccucuacgucuucuacugccuggcggagcgcugcccacccggcucgggccccgucgcgggggucccggggcgcggcgucccugcaggacccagggaacuggcgauguggcccgcgggagcgccaaggaagcgccuccugcagcugaggcaacggaggaggcgcgggcggucggggccaggagacagcagcgaccaggaggagcagagcccugggcuggccgccgcaccaggaggcuccggggcgggaagcagcguggccgaggcccagccggggacccuggccuuacuucuggacgagggcagcaagcagcugccgcaggccaucaucaucggcgugaagaagggcggcacgcgggcgcugcuggaguuccugcgcgugcaccccgacgugcgugccgugggugcugagccccacuuuuuugaccgcagcuaccacaagggccucgccugguaccggugagcgcggggacccccauggguacuucugagcgcuggcugugcagag

SEQ ID NO: 6076 - RNA, 23042 nt, Mus musculus
aagaguaauguuauuaaaauagauuuauuaacccugagcuuggcacauggucuuguuucggugaaggcugcggggcagucacaacauccugugcugccucaugaggaagugagcagagcgccgccaggccagggaaggcaggccaaguccucgccagggaaggcaggccaaguccucgccagggaaggcaggccaaguccucgccgugucacacucgcgcuccuaaaguguuugccacgcucuccuggguggggagaacacgcacauguuagagucgacuuugaacauccuuccaaguuucagucacuaaccugcuuucagguuccaacaggcaucuagcccaaggugacauuucuucauacuuucauagugauugucacucaucauggaccaagagcacaacaggcucacaggcacgggagaugcggccucacuggguaacccagcccacagaagaccccacacugaagcaggauuccaaacuugagcuuuauugagucugaguccuugcaaauacuaugcuuggagccugggacauauacacccaaugucacuuguaacauggcuugacucuggcaugcagagaaaaccccugugcuagugaguaaggggcagacaccucaauuuccauaacuucuuuaaagaccggcuugcugucuucgacuguguucgccuccaggagucggaggccccuggcagaugggagcucccagccaugaccauggaguacugcaggcugacuccauacugccuccuggcuaguugugugcgcuggcucccaccaaggugacagauguggcuuccacacagggcagagaacagccuacaguccaggauggcuuagacuucacugggcucugaccuucuugcucugugggcugugugguucaucugugugggcccgcuucuguugggguucucuguccucugggcugucugccugcugggucaggagggcugcucgcaccagccguagcucccucuucucccugcguuccaccaucucuucaaugucaccugcaaacagggccuucagugggggaaucagcuugggcacugucgggaagucuccaaagcagaccuggaaggacagacaggacagaaagaaacacugaaagagugugugagcugggguaugggugggagcacuccuccuugcuuguauucccucagaccaauggaccuuagcuuuaaaaaaugcuguuuagaaggggaauauacacaguaaugaggaagggccaauuccccacaucuagacuaagggaaaagaaacaaaaaguccagacguuucuguccaguuccuaacaaccagaacuggcucaagccccacuccuccauuugggaagguaaaaggggcagggccaccucugcuacucuaggggacgagccccugccccccggguuugugcuauugcugcaaugggaauggcccaggugugagacauucuggaaucuccagggaccccaagagaaggaaagcccuccaggagcagacuuuaucagucugcuuuugguuacacauggcuaguuucuuccuucgguggucuuauaccauaaaagaagcaucaugagagggucacuuucuuaucuggcccugccccucagagcccccacaguccacugugacauacagaccuucauguggucaaaggcgaugccaacuuucucguugaagucagggcugaaaagggggaucuuggcguaccgcugacugaagugguucagcaugaugaacuccgcauucauccgcauccccacauuaauagccugggagguggugcuguagcaaagaagaagcaagaaggagccuuggggcaguaguucacaagccuguccuucccaugcugacaacaccaaggcaggcugguaggacuccucagaaggcuacugagccacagagaugcugagggucagagccugcucacacuugccaaggaaggccuugcagugagugcugccugucagcuugucaggauguaccugagacaaccccugggaaggucgcucuucuuaaaacagccuguauucauucaugaccccaccuuucccuaguggcaauuauuccagucgguuuguucuuuuaaaaaccccaugccucauaagagaacccuagcuggggauuugcaaacacagaggccuugugccuaggaaaguuaauguggguuuggaaaauggcacaagccuggaagaaagccagcccguccuccauggaugugggcaccagcucucugcagccgggagggagggcugcucagcuuucccuugacaagaaaagagaggguggaaggacaaaacaaagcagcguuuguaccugugugucuucucuacugcuuccucuuccaagccauccuccagaguggcuucauguaucaggaggguggcaucuuucccuggacaggaacauggacaucaaggaaaaggcugaacgagcagcauauaugccugggauccacagccauguucugacccaaauacucagcucucucgguccugugauguguccucaggacaacaaccaggagaccgacuggguaagaaccagucugcuaugugauagcaucaccuacacacccaucugcacacacccuacacaugccacuuguccuaugcaucucaaggcccacuucccucacuuacccaucuggaccagagccucacagggcaugguaucccccgaguagacgacuuuccagccagaugaauguaccagugcacagccaaaagcaugcuugcagugccguaccaggcaggucugaaacugagggagcagaguggagggcucaggccucuacuccccacccugcccacccucuguggguucuguaccuggaccacuuacuucuucuaagucacauguuuccaacagcaagcuuaucagccuuuccaauguaguauuggagaccucugccccuuucugaaggcauuuggcaggaaucauacugagagaagacaaaagcauuugaaaauugauaauaaacguguauuuaacaccugcaaccaacacuucuguucuuuggaugaaaaaccuuaagugguucugagaauugugacuguagucuaguaauguagacaggaaaacugaucaaugagaagagcuaggccacacauccagccuacccagcucacugccagaaacguaaacgcugcaggugacaggcagcaucugucaggacuccuucucauccuucccugaaagugaggcugggccaucccuauccugugccaccuggcuuggaugucugugcuagcagcugcuggugcacuugacccuggaucugucagcugcagagacaguggccacagucauggcagugcacagcagcagugagaacugggauacuuaugcuccaagggcagagcugccaggacuucggcugccacccagucagcuggggucaggaaggaggcaguaguagaaggcaacagccuggcacccgcccaguacacaugaugcucaccugacguggugcagaaucuccuggcagugguugugauacugcugcagccaggcccugagcuggguaggagccaccacaagcaagggcuggaaggguuuccccagagaugccugaaaaaaagaucucuguacaguugaauaaggggacuuuccaguaaaaaugguaagaaauaauuagugguagguacagccaauaaugaagcaggcaauuaacaaugucagucaggugccucacuuaccaacgcaugcucucucugcagcaagauauucagcaagcccuggggaggggagcacaggugauaagccagucucagucgucauccccacagcuuagggcucaagucccucccuguaagugguuccuaucucacugauccugugucacagguggguggcacaugcugacuagugacugaaacauuucaggcuguguuagaaggcgggcaaugggguaagaccuaggaagccuaaaaaauccagaucuggaugguccugcuggacaggcugugugugaaacaaguuuuauucagcaagaaacgcugagucaacucaaaaguuugguacuagagggaaagaagcccaaggggaaggcacccccacaugcucacucaccgugugguggucggcgugcaggugggacacaaacacagccgugaggcugcauaagacucggucuauuugcuguccguaaugacggcacaacugcccaaaagugccuucuccacaauccaggagcacugacuugucagggcuguagaagacaggcaccaacuggcuuuacucuagauauuccagaauggcauugaugcagaagacauagaacaggcagcagcuguggguaccacccccaucuuccauagcuacaccugccuguccuuuggggggcgcauaugaaagucaacuauuuaaaccacaugggucauuugagaccagucuaucuucucuuuauaagagaaagauccaaagaacccugaagccuuuaaggauaugcaucaacacaaugcuggguaucaaaaacagaaaaaagacaagcagacuauaaggcuaggagucugcccccgcagcacgccucugccuccccuaaauguguuacacuaagcugagagugccagagacagcaauaggucacaggagauggcucaguucccaagugagccugguccucaaacugucuugaggcagaauuggcuucaugaacauucucugaggagguggcuagugugacucucauacugucugcugggcaggucucaaguccaaguucagcauuccaaugcagaggcucuacuuccaggcagacagacaaaggugucccccuggcuuccuuccucucuaaaggaagccacaaagaucggaagggccacacccaucuaaagacagugagugacuucuaggaaaaagccuacaugagaaaaaaaacagauuuuguucaucucgacaaaggugccagguuguuuagggaucagaaaccauaaguccuaaauacaggccagccaaugauaacccaccuuuguauauuucucacucauaaagccgccaugcuuagauuugaaagcauuugagcucagaugagccuggacugcagugcagacagucugaccucgggugcacaugggccguacagcucaggggaacacagguaucaguuaagauaccagcucagggccuagacccgaagcuuaggcugcagaaccgaagcaaccucuuccagcaugugcuuaccagucaaacaaggcuguagucacccguccuucacaggcuuaaaguacaaguucauugggacaccccucagcaauauggacagcauaagcacaccagucaugagggaugggacugcauguuucccagaauuaagcaaguagauucaguaagcccaacacuugggaggcagacguuccaggccagccagcacuauauagcaagacccuaucucaauaauauauucuaaaugaaauaaagcacagaaaacuacuacuucugcuccaggacaaucagccuggugaguggagaggacuguucagcggcaagcucugauggacagcagcuucugaggcaagcauggugugaugguuugaauaugcuuggccaagggaguggcacuauuaggagguguggacuuaauuccuagccaaauggauggaccuggagggcaucauccugagugagguaacacauucacaaaggaacucacacaauauguacucacugauaaguggauauuagcccaaaaccuaggauauccaagauauaagauacaauuuccuaaacacaugaaacucaagaaaaaugaagacugaagugugaacacuaugccccuccuuagaagugggaacaaaauacccuuggaaggagguacagagacaaaguuuggagcugagauaaaaagauggaccauguagagacucccauauccggggauccaucccauaaucagcuuccaaaugcugacaccauugcauacacuagcaagauuaugcugaaaggacccugauauagcugucucuugucagaguaugccugggccuagcaaacauagaaguggaugcucacagucggcuauuggauggaucacauggcccccaaugaaggagcuagagaaaguacccaagaagcuaaagggaucugcaacccuauagguggaacaacauuaugaacuaaccaguaccccggagcucuugacucuagcugcauauguaucaaaagauggccuaggcggccaucacuggaaagagaggcccauuggacacgcaaacuuuauaugccccaguacaggggaacgccagggccaaaaaaggggaguggguggguaggggaguggggguggguggcuaugggggacuuuugguauagcauuggaaauguaaaugagcuaaauaccuaauaaaaaauggaaaaaaaaaaaaaaaggagguguggacuugcuggaguagguguggccucguuggaguaaguguguuauuguggcauggacuuuaagaccaucaucauccuagcuccuuggaagccagucuucuccuagcugccuucagaacaagagguggaacucucagcucauccagccccaugucugcuugcauucugccaugcuuucaucuagauaauggacugaaccucugaauuuguaagccagccccaauuaaguguuguccuuuauaaaaaguugccuuggucauggugucuucacagcaauaaaacccuaacuaagacacaugguaccuuagguugacgaguguggaacugacauuucggaucuucauugggauggcagaccccguacccaggaagacaauuucaggauacuggcuucuuuucucuguugaaauacaagugaauuuacaagcuagcauucugucaagagguagacaagcaauccgguacaauccaccuucccagagggcgcugggugcaggcguuccacguucaguaugaggcccgcaggcuguugaagaaaagcgucuggaaaagaguacuuccucaggcugccuuuacaaaaacaacaaaacaaacaaccccacgaaacaacauaggcugccuuagcucugacuuaccgcuuuuuuccuaggcaugguaccucuaccuugcauuaagacugcacacgucauguguguguacccucauaucugcuguacagguacacagggcugguccucagccucacuuggguggccaugaacuaacacaccagggcaccaauuuuaucagaaaggauaaagcaauuuucaggcaauaguucuucccacacacacaggaugaggaauggcugaccuggcacuaaccuucagaaaagcaaggguggggaagagccuucugguuagauuaaaaccuacccucuucuauuccagcauucucuuuaucaguaauugaaaacucagaaaccccccuaguguagaagucacaaaagucuccaauugcuuucccugauagagcaaugaaacugguuagacggcagucaucuuucacagcccgucuuagccaagcaggaguagaccaacagcaaucauggcgagggaggaucuccauggucucacagggguucuccaaaccguuuuccaacaggugggcccucaagaguaccaagacucugucacuaaaggcaguuuacuaaauggagagcacaggugccaaguuccucuaacaccuuccccagccuucuguuacaauacaaaaaagcccagaguuaauuaaucaggaugccauuuguccaacucccugcuagagucugucaggcaaugcuuaggagaggcugcccagggcuuuggcucaccugcuggggcuggguuuuccugcacguucuuccgauacuccuccacacucuccuggaaacuggggagcuccaaggccucagcuaugaauucaucaguauugcagucgagugugguaucccugaagagaaaaauaacuuggguaacccaagggguuugcacagccucucaguaaaugcuaguuuggauguucagaauaaauccauguguauucuugaugguuuggcugaaaaacauaccaucccuacccccgacccccaaucccaugugugauuugccucuggggaagucauggggaacugcagccuugcuggaggaagaacauaauuggggaugaacuuuaggcaugcauagcucugcccgcuccccucccaguucgcucucucugcguuguuuuugcgacuaaggcuaugucucucaccuccugccagaccaugcuugccacuugcugcugugccucccuaccaugaggaauugucaaucaaaaugaacagucuucuauaaguuauguugcugaugguguuuuaucauagcaacagaaaaguaaccaauacagguacagaacacuccuacagauaaugaccugggcaguucuagucucuggaaccuuccucaacuaaauaaggugaaugagucccgaacaacucuagcuccuugugaucucuccagccucaagucugacaaucagggcuuccuggugcucaggcaagaugaaucuuucuuuauaguagaguuguucccugaagcaucacaucucccaaccaaggcugugauaauuaaauguggccacauaugagacccuguccaggaggagcacagggcccuagcugagcagcuggucuccaggaagugccucucaagcuaaagugagcgugcacacagacgacugggagccuuggugagcugcagaacccaagcuggcaucagcucucgggcggagucagggugccuuccuccuuagccagccgcagggagugcuggcauugcuggcuuccuccacucagcaccaauacugagagggcugauucucugagcuaaguaaggagaaaagcaccccaaagcuuaugaagcagucccgugucaaccuuuccagaucaacucacgggucugggaucuuggaauagcauuuucacuggcacauggacugaugaagguauucgggaugcccauggccccaggcauaccacuacagagcaauuauucaaccacgucagcucauagugacauccuaacacaugaucuacucuaacaaugaugcuaggaggccagaaguauuauaaaccccauacuuauucccaacacugaggacaagcuaucagguagucagcaaauacuucucacuugccuagaaguugauaggcaggggcuuuccagguggcaauguaugaucacugggugccuaaagaagucauucacugaaacucacauuuagaaauugccuuuaggaagucuuugaguuccaaucaaagacuuacuguugcauuaaaacaaggaaaaaaaaaaucccagaugaguaaaacaucaguaucagaaauuccaacagaaaccuuuuuacuggggccaggcauaguggcacauacuuuuaguuccagcacuugggaggcagaggccagaagacagcugaguuugaggccagccagggcuacacagugggaccuuauccaauaaccaccuuguggcuggaacugggcucuuccugcugcugugcaggugacaacugugacagaaaccaaggggcuggaaaugcuucccagaauaccacuacugaucauuuucagaaaacccucccaacccccgcccagaaguuuccguagguucagagcugcacgcaccucugccacucucucuuggggcggagcugauacuugaggaggcauucaccccgaacuguuggcacgcugaggguggacccuuccuccuggaaggugagaacgcacuucucagugagaagcaagggacaagaacccacuggcuagggaggaugugggacgugcuaccuuacuauagaagcugguaagcugggggaagaugucaggguggaugaggcugagcugggucugaaucuuguggcugcgcagguuguggaccgaggggcaauucucauucagaaucaggugcugugugucaggcccgaaccuaggaagaaacagcccaucguuacagugucugucagggaaucucuccaccucagggaaaggacaguagauaaaaagccuuauguagaaggacagacacagaguuauaucauuucgcccccaauuacuacccagccaggcauaacccugcagcuucugugucauaguccaggcuuucgucuuucuugugcugauaaugauagaaagaacaguggggaacuaaggagauguaagaccuucacgugcagaugugaaaccaucaccaagcacaggguaugaaaaaggccuaaaaggaaaauagauaauuuguguucugacucagacacacgaggaaugaaagacagagccuaagacccuaaacugcucagggcagagaggggcugugagaugacacagcuggcagggaagcugaggagccgcuggaggucaccagcuacucaggcuccaacauucuccuggagcuaucccuggugcaggguuauaggguggcaaaccuucuccuuacagaccugcuaagacuuagcagagcagcugaggucaaacaugugcagugggaggcugguggaugugccaggaucuccucugccccgacugagcaaaguguaagagaugugacaaggaguccucagcaaguggggacugggacacugaacugguuucuuagcagagcuauagcuuuugcccgagccacaugguuccuccccaagccacacagguuuggaaagaggacaaaagguguguuaaacacauaauucugggguccauggcuucaggaugagacccacccaggccaacgcagagacauaggugaugggcuaugacucuguuagagcugaggcagcaaaugcuaacggcuccugcugaggaggaggaggccacugagagcuagucuaaauaagauacagaaauggaggacugauuuaaaagaaaauuaaagucuauguucugcaagcaaugggagaacucccauggaacgugggcuccaugggaguucugggauugcuuagcugacauacgacaaauugauaaccugggaauaggcuguacaguaaaccgaagggauuuaauucaaguuauauaggaaaggauauuaauuuaacucauauaaagagaaaggugauauaauauauccacagagauauuaaucuccaaagaagggaaaauuaaugauaauuuauuuguuaauaauagagaaaaauaaugguaauuguuuuaaaggaaaauugugaagucuaugcuuugcaagcaauggauucuuugaacaugggcuccacgguaauucugggauugcuuagccuggcauaugacauugguagccugggaauaggauuauacaguaaacagaaggaaauuaaagucaaauaggaaaggauaggaaguaaaauagggaaggauauuaauuccauggaagggaaguauacauggaggguuuugaucuuaaaauguauaucaagauaggggauagggaaaauaaccuuaacucagacagauaguagaaacuuaggcauugaucuuguguaggaacaaggcaggagauugugguggagcacuaucucaaaagauagugauuauuuagauugcuucauauuaacucuuaaaaagagaaagaggauauauaugcccacagagguauuaaucaccacagaagagaaaauuuaaaaauacauugaugaauaaauauuuacgccuugaucucaguauuaaaaguuauucauguaagaacaagacagagaacaguggaggagcacugucucaacagacaaugguaaugguuuagauugcuuuguguguuuugaauuguuucaaugugguuguaaguuuggugguuaugauauuaaaaaugcucugggagaaaggucaaaauaagacaggccggaagagaaaagaggcuguaucuugaaucaaucuauaccuuugaugauuuugggugacuggaccaaggacaugcuauuaugguagagaggcucucuauuuguauuaauaggaaacaagaaggaucagauaugucaggggaagaccuccugaagaucuuggcuacagaaaagaacaacucaagaaaaucaaacuggacagguagguaacuugacuugcugauuccucccuguaauuggcuuagacauaaaaaugucucuggccaaaacuucagcuaaaauuagacaauaaaucuugcugguuaugaaauccuuaagauucauagugccauccuucauauggcaaauuaaguuguaaaaggagagcuggcuuucaccugcucaaacaaaggccaaaaauucauucuuacaucaucugugcaccuugcacaagccauacaaauauuuguaauaguacuacaauuuugguuguaaaauuaauauauugcagaauguagagcucugacaagauucauccacagggacacugaaaugaccugcuguuccagcccccuaccugcugauacuauuuccagagacuugcuuccagaacaacuucgugaauagcugaugccccauggucucuguucauccagccuuucagacgaaaccagacaaucccugagacuucuaagcaugcagaggcuagauaacagaugcuaaggcuggcuuucuuaagucuaaccaauuuucuaauuuucuuaccauucccuacccauuuaaacauagauaucacaguuauguaaacuauaaggcauuggagcaggcagcaaggagcacgcauggaggagauaaaagcagauuaaucaccuagagcaacacccacaagaguugcccucugugccuuggacuggucuccauaccucuccauccacugcugguaucugcugucgaugaguacagauucuggggcuauguggaccaccagcgccacaggugcaucagccucugccugguaccugggcagaaggaagaaugaguuuguaucuaugacgagauacaaacucaauacaugcaaggaaggggacugugcagcuauuucuuagaauacucacugcugccacacauaccaccucccacccaggcauggucugcuaaccuggugacacuuauuucuaguucaguggcuguuuccaucaccacccacccuugccccaccacacaucaucucuuuuuaguuccucuggcugcaauaggcucuguugcucaaagcagauuacgauaagucucuggucagggcacugaccccacaaaggacaaaguggccuaggcagagcccuuacccugcuacagaaaagcacaagaacacaagggauuugugguacaugaagaauaaaacagcucaugaagaaaacaagccacuacagaggggacaagcuuagaacaaacaugaggcuuguuuccuccuagggugcugguaagcaccauccccagcacuacaaaggcugaggaaggacaacgugaucagggccaagugagccuacauggggauaucuugucucaaaagggcaaggacuggagaugaaggucaguggaagggcacuugccaaguguguucaaggcugaccccaagcaccagaaaaacaugguggagggaugccuacccaggacugaagcugcagaacuggcuguuuuccaguagacacaacacuugagccagagagauauuucaaugcuuagacugucccuagcauagaguaggccacagggucuuugacacucugcccuaacuuauuagucucaauguaggcgagggaagaaaacucauauaggguagaaauagguaaaauaauuuauuugccugggcauuuauucugaaauuugcucuagauuuagaugccucucucuugcuuauaucuauguuuucucucucucugucucucucucugucucucucucucugucucucucucucucucucucucucucucucucucucucucauuugcaguuuauuugucuagucuugugauucucaguuguuuauuucaaagcccacuaacuacuauucuucuuaaaucuugccaguaagaucaagacacaccaaaaauccaggccuucccagaaacacacuauaugucaaggacaugaguaucuuugggacaugaaugucuguacuaaacagugauggcauucaccuuucccagcuaaaaucacuagccauuaccuuuuaaaggugucguucucacagaugggcaggaugaauccuucaucaggacacucuaccacaaugaauacaagaccaggaucuggggguguacaaagcucuucagcagcaaucuagaaaauuagauaggccauuuauugaagcagaaugcucucucagaacaaucucagcucagccucagcuccgaagcugaacccauguuuaauacaugaagcauaaauguggcacacacccuuuccugcucuguccauacuucagcagauaggcacuaguuuaugaagacauuucaaaccugaguggcuagugggaggguuagcauguaaaguacuuuugacaccagaaacaccuucuuagacaaagagcauaacucucuuuugagacuugcuaacgaagcccauccuugaaggcaggcacccugagggaaagcgucuacacacagcaagaacccccacguauaaggagacaagauacagagaugcccaggcagagcaucacaggguggaucaaagguuuaguaagcccacugugcagccaagagaagacaaucccacacugucccacacauccuucaaaguggugucaguaagcuuaagccagagagcugcucugcucaguguccaggccccaucuguaguuucaaaaucacagaagccaggagccucaccucucuuccuucguaagugauacucuucccguccuugacagcagcaaugaugggugcaauggcggccgucccacugaaagacaggcaagcucugugagaaaccuucauuuuaccaagccuaccagggaguucccaaggaccugacacucacacaggaaggcccagcuccuuugcuuuaagcaccaagaaguuuccuuuccucaagugaagcugugacaaagggaacacaaacaguuucaggugcugaagcucaucgucacacagcgcauguacuuccuguuacuuccuuagucauuaaaaugcagccaguguacacacugagcaagugcucauuugaaagccuuggaguaaagccagauaaacuaagaugcaguguguacucucacucuuccacgucacaguuaacaaacagcaagaauguuagguguccccaggggaacugcaggguacuuagguuguuucaggaucuaaucucacaccagggugcuagcacccuggucuuccaggaccagucagugcugcacacagucugagcagugacccuggcaagaagauaacggaggugguggugguuuucuauguccuuuaaaucagguuuuauuggacagagacucuggaugccauacugggaacaaauguccaguggaggccuuucaccagaugacacagcaacccuacagcaaauccaucucucucuguaagcuucuguccaaccuacagaguucacacaugaugaugcagaaggccaccgucaggucucugccgagucacauuugaaccuuuucuuccuuaaaucuugauaaacuacugaguuugcuuuuaaaaguuacuccuaggaccaagacuuauuaucuggaucccagagucucauucucuagagucuagaccuucccaucuuacacacuagguugcuggugggaggacuaugaacccauaguucauacugugugcuugcagaccacagagacccugagguccagguggcaccuucaagugugaacaaaugccauagugaacaagucccucaccucauaccagaugagucugaguacaggaaggacauuucacagcaagucacuuguacuaucucugagaaggguucagcccgacuccugcucaacaggcagaagcacaauaugccaaggagggcccagacacaccacagcugccgagccaacaguguccuauaugacaugcugccgcagggcuuggguuuucucuggcuaugacuggagcuggcucauugcuguccucacccccagaugauaagcaccauaaaacaagagggaaagcgggaugaggcugaccaaggucaguaggggcagcuuagcaagacccugccuugaaaucaaaaacugaaagggacuggggauguagcucagaggcacagagcuugcuaagauaugcaaagccucuuagacucugccucuagcacugcccccaaaacaaaguggcaacagaaaaggaggacaggaaagccagggcacccgucugcaucuaguguaucuagagcaagauggucugcaggucccggacagcugcccugacuuacaguucaaacacucgacauacaggaaacaagcacuagcugcucugaaugauuucugaauucuucucagagggaggaccagauacccacagcauaacacaugacagacagggcaccccacuggaugagaauuugaaacaccaugaaagcacgggugggguuuggagaaggauguucuguucuuugucaacacaggcaacccaagagcuaccugcaaaugacugcacagugcuaacagaaggucucagaacacaccacgcgcuggccaccagccacaugccccucacugcccaccuuugcccagucuuaccuugcagacaaaagcuaccacuaaggaggggucccugccccaugcuuuccuguuggcaccugaggaaaagcacauuuaacaaggugaacgugaaggcugugugugcuucucacaucaccaucccguaaucuuccuucaguguguuuuccuuaaagauuuauuuuauguaugugaguacacuguagcugucuucaaacacaucagaagagugcugggcguugguggcgcacgccuuuaaucccagcaaucgggaggcagaggcaggcagauuucuaaguucaaggacagccagggcuacacagagaaacccugucucgaaaaaaaccaaaaaaaaaaaaaaaaagugugcaucagaucccauuacagaugguugugagccaccaugugguugcugggaauuaaacuuaggaccucuggaagagcagucagugcucuuacccacugggccaucucucuuuauuucucuuuaacgaagccccuucauuaaucauguaccucuuuauccuucuuaugucuacaauaacugaauagaaaaugugaaacuccagucagggcuggaugugcauggcuaaaauccuagugacuugagagacuaagacagggggaugaaaaguucaaagccagcucagaguacucacucaaaauaaagaaauaaaaagaaaauuaguacagugagagaacgcuugcccaguaggcccagggcacugggcucaccuccaguucuauggaaagaacagaaggaaaaggugggaaaggaaacuccaaccagaaaucuagcauaaucgcaacuaaaacuuuacacgucccauuuggcuuaacacuugagagcaggauaaaauacguuguaauauuuaauuucucuuuuacauuuauuuauggagguggggcagguauaacuguagggguaggugacacugugcuuauguggaugguagaugacaacuuuguuuauucaaaguuucuucucuccuucucccaugugggcuuugggagucaucccaggucucaaggcuuggcagcaagugucuacccacugagcauccugccagcccucacuguaauauguuuuaaaaacaaauaccuaaauguuaaagaaaugagacaacaguuaaaggaagccuaaaggaaauaugugggcuuuaaugcucucagcuugccauauaaaagaggcucgugaagccagagggagcuggccaaucugugcccaacacugaagagcagacgaguauccaguuccucagacagagcaaaccccgacagcugucuuggggugguggggggccucucucucucucucgcuaacuugugugcugugauaagcaaagcagccugucccugcagcauugucucauuaacgaaaacaccaaggaucccacacccaagagugggccagggccugcugcucuaugaguauaaggacuggggcuaugcaaagccacaaaggggccugauacuuaggccugcauccuuuuucauccuuccgauagaccagagcuuuucuugucaaagaaaagcaucuacuugugcaaauagcuuccucagugaagauccuaacuuagaguacaggagacaaagaucugccauuggcaaccuuggauagaggcaccucacccauucauagaaucuaaacagaaaaauccguaucagagaagguuaccaaaggcuggaggauggggacagagggaaagccgaucaaggaguacaaguuuuuaggugggcgggccacaggccacacuauacugugaucacagaaagccaugugguugcugggaauugaacucagggcugcuggaagagcagcuaguacucuuaccacugagccaucucuccagccccuagagacaaucuauuaaaaggaccaagcauuaaaacuccaaggccuauuccacagcuuaccugcacugcuguccucuggagggcacugcccauuuucagcugauccagaguccgaugacuguuugggacugagccuguugggagauguucuggggcucugggauggcuguugcuuuccacaccuccguucaccugcgcagcacaggaagucaucacaucacacaguucccauaacugcggcccagguguucacaugugcgaauucccuaauguauuucaaaccagaacuccuuucccugcagcaguaaauaaccaauuuccaggccugcuggccucucccuggcuccauggccuugcccacagaagggauucgauacugcuugacugaaaagcauccaggcuacagauuaguucaguuaucaccacuguccgaucuacaaaggcccacaggauacucaucaccaaaaggagcaaaauucugcagcuuguaucaaaaucaagaggggaacugcuguuacgagaagccgaaacacagcugcuggucucaacagaaacugcauuugcuccucugggcacaucacacgaucagaaccugcugggcuccaaggaaacacuggccagcagaacugggcaaguguagccacaggaaaacacaugccaguaaacuacgcuguguguuuccaacucaaagccaugaagcagggcuggagcuucccagcccucaaugacucucuucuaggcuauaguuauuaaaauguuucugagaaagacacuuauaucugcaucaaacaaacccuggggaaugaacuugccagccugagugcacauaguauuguccacaagagguuaaggucccaaacaggccacucacaccaagucuucacacacucuccucacccucauaccccaugauuaggaaccacaacaauguacuccagagaaaucuggcucucagacucacuguggauagggaccugguaaacagucauggucucauccuuguauucuggugcagagugaggccgcacggcugcagggaaaacacaggucaagaaaugcagugcaugaguaacggcguggguucucaccagccgccacugacuuuccuuacagugcuaauggaaauaugccagcaaaaccaggcucucuaauagcuauaacauuuuuuaggaaaaaaagcaaacauaaaaaggaagcuguacuuucaucagucauuuauauggagcacagucagggaagucaugcuaugagcacugcauaaggauccagcaagaaaagagcuuaaaugcaagaguucugaguuaacaagaccaccagccagccaggaacuuuaccuucucagccaugagaacuaguguauguucugaaauaaaacugucagugcuuuauaaaagagcagcacugacaggccaauggggguaggggagcugggggugcaggugggggugcagguagggguggguggcugcuugcuccaggauccugcuauaucuucuucauugagaccucuucucaucaaaguuaugggccucccagcagagcuggagauaaagguuagcuacaagauagccaaagacuccuuauacuacuuccuccuacaaggcguucaaggcccuaagaaacaccucucggacuggggaaggagccuggggccagaguggagguugagagaugcagaaaggaaugcaggcauauaccagauuauaguacuuccugccuacccagccaguauucuugaggcaugagaggagcaagaggggcuggagagaguuaagagcaguggcugcucuuccagaggacucgguuuaauucucagugcccacagcagcucaguacugucuguaacuucaguuccaggguaucucacaccucauacagacauauauguagacauaacacaaaggcaugugaaauacaaguaaaucaucaaaaagaaaagagaaagaaccaacaaagaacagaaucacagcucuuaaagaaaccauggcaugcugaaaggaagcaugcgauucuaagucuugcuuuaaggcagcucuugauggauucuaauuuacaaagcagggcucauguaagaaaaaacguaagacaguaggucacagucaacaacauacccaguucuauuccuuucaauggaccagaaaauauuuugauugcuucuagauauuucuccuaaaaaauaaggaagaaguuauguuuuaaacauagggcacaguaauguauucaaguaaguacuauauguacucuaggcaaacacaaaacuuagcuaguacuuuaaauuucaucuagacaguuauuuguugugcccagugucauuagaugccaccauuuagcaacaguaagagauaugaaguuuuugcucucauuagaacagagauggagaggaagccaacgauaacacaaacaacucaguaacaaucagguacucugaaagaaaugaaagacggggcagacaccaacuugugugguacaccuccagggggaaugacuuuugaaagcaagacaaggggcagggcuggcccucguggcuccagcucgaugacacagguagaaguaugaacagcagccugggcuugugggacuuaaagaccacccuguggaucacacacacaccacacagggaaagcuuagggcgggaagcagugcccugcauguacaccauguucuggcugccacacaggggaggacugcugagaaguaggaacugacaagcaaggcuaauuugguucacagagagugaaagcucaaggaggaagaagagaagcuagagacaaaguuagaugucuuaaguugaauaggaaagaaagaacgcuguaauucaugaaguccuucuuugguaccauagugagugauuuagucccucccauguaccacuucacgcaauucaacuuuaacaaccuauggaucauucuggccacuuuauaaauuaagaaauuggggcugagaggcaaaguagcucacccaggaccacacaguuaguauuuacauacuaugaaaggagauguguuuaacuccacuaccuguuauccuugagggcagaagguuaaguuacaaaaaugaagacugcuaccauuuuuaaaggaggugguuuuaacgggugaccaggagacacucaccagcuguggugguccagacagaacacauuugggaagcccgguuuccuuuaaaguuaaaaucauuccuuaaaagaauguaaagagaaaauaaauaaaaauccagcacucucaacuuagccugcaggcccuguccgguaugugguaugugugugugugugugugugugugugugugugugugugugugugugugugugugcauggugguggggugcuucuggcuauacuaguuauuuaccuacgugucccuguucuaggguauaagcaacuauacaauacauaaagagaaaauaauguuagcauugaucuaaccaugcaucagagcagggucugcuaugcaagggggaggagggcacaguccacuaccucauucucuccucugcccauacuacuaugcuuucaaaaucuggcagccacacagucuggaugacaguaugugucugaauccagcugcagagucugaucagcacccaccacagcacucuguuguuaaaucugugguccagguggagguuguaaccauaucaaggccuacuuuuccgagucuagguuuucacacccccuacucaagcugacuaagcuaguguaccaggaauucuaucuccccugggcuaggaagaugaacaaaugagcugcaagccauguuaagcccccagaaacuucccaccggccccugaccuccaaacacauacucaccacacaaccccccaacauuugaccaaugcauccgagucagaaagauguuguccaagcgagcgacuuucagucuaagaaaaaaacauacauuucagccagaugaaacaaagacgaccagagaccgugucugcugagaagucucaucugccucucaccucagcuuucaagcccauaaucaucuccaccccagaagccaggaguugacucacuuguguuccugcauaagucguuggacgccuucuccgcaguuaaaaagguaccuacaggaggaacauuacuguacuuacaaguauacucuguaaaaugcuuuacuguagauacagcgacauaaaugacaggguucucauacugccuaguagguuuugagcccucuuugguuagugacggaagaguguaguuugguauagaucaauggggagugaugucuuuccccaucgacuuaugaaaccggucuagcccacacacucacggugaggcccccgcuuugggauggugauggugagagucggggcacgggaaguuuugcccggauaccugaaagccaugcugacuaagggagguaagggauauauacaggauuggacaggaggccucccgagcacguggcgcuggggccaaucccccagggcugucggcccacucugaccuguuguauuccgagaagacauagagagcagcccccgcgucccggccgcccgccgccaccaccugcagguacacgguguucgggcccccgggacccgggccgcgcuucucccgcguacgcaggugucgcagugggucuuuggauggccgcggccgacgagccgaacccugcgacauggugcgcaggccaaggggacgcaacagugagcggagcgcccacaugcacccgaccacaccaggcugacaaggcagccagaccccucacgccgccacaagcaccgccccuccaccgcauggcg

SEQ ID NO: 6077 - RNA, 50811 nt, Mus musculus
ucugcuuuuucccagcuggccccgggugguccccacgugcugcugugaaccagaucagcugaggagccaggaccaggugccuugcaacuuugggggauuggagugagggaggggaaggaauggguggggggcuugggcguggccugagagacaccagaguggaggcuucuggugucugagaacccuuucugcccauaugguggccaguuaggaugaaugccauuaugucccugugauaggugacacuaggcauuugcuauggugccuuuuuucugaaaacacaguuaucuucccucaucuggauccugaucaccuugauuugguuuuuauuuccuggccgccugcuaguauuucuuggaggggcggggagcuuuuuggguucagacaaguuuaucugggcugauggagagacaaucagggugaggcaaugaugucaugccggacugaacaagugaggggcuuguuuugaagucuuggcugcuucuaaaucgcucaacuccugacgggccagcggcuucuuucguucugucuucuugccuauggauggcgaaguauuuuuauuuuauuugaacucguccagagcuuguaggacaaugguuaugaaaguguuuccuacacuguaaggagguuguguuucucaaggcuuggggcucucuuuauuucguuuucuaaauggaacuagacauacuuuuuccaugauacuaucuuauuugauaaaauacaagcuauccaugcagagacacugacaaucuuuguauaaguauauccucaaauaugagcacuuugaccuacaaacauagacauuuuaucuauuuuuauguguaugucuguggguguguaugugcacacauccauggguucccuuagagacuagacacuugaauccccuagaacuggaguuaaagacacuugugagccuccaugugggugcugggaagcaaacccagcccucugcaagaacagaaguucucguaaccauugagccaucucuccagccccccccccccccccagucaguccccuuugagccaggggcucacaucuauuagucuuggcugguauagaauuugcuaugcagaucagguuggccuugggucugucuugauuuuccugccucugccuucugggugcuagaaucacuggugugugcagccucacccgcucccaacaaccucaccuggccucaaaauacacaugcuuuugagacaggcuaugauguugaccuugaacccugacuccuccugugcacacccauccagugugaggauuacaggcaugagccaucacacccagcugacauacacacuuucaauaaauuuuuuaauguugaauucuacuuaccguccuguaacuucuuugcauuuaaugucuuuugagucaucguaugcugauucacaaauauccacccuguccuggacugcuguaccauaucccauguguggauguagcaugcauggcuugguaaaguaaacugauuuguggguagugauaggcuuucagugugagucuauaaaaguaagcuguacugcagaaaacaccauuaaacauacaaucuucacauaccagcuccggcauuuccuuagaaugaauucuuaggagauagauuguugaggcugugugguuggaagacccauugaagaauucucgguccugcugccuggaggagguugucaacauacugaggcuucccagggaggagggugagacauccuggacuuggaggaguccuuucuccucaggcccccuuucucuuuauggugaagugacuuagcugcucuuuccaguucuucucuccuucuccugcugggcuggggugaggcaaugcuuugguuugccuacucccuggacugugaggucugcgucuaaauguucugugaauguaccaccuucaacacaucgucuucucuuuagcccaugccauaugguugcugaagcagauagaaccucuaucccaggagccuuucuggaguucagaggcacagcacucuugcuuuggcuagcuucuggccuucagguuccucugucuguugcauggcuaccacccuugcacaugcuuuuaggcuuguaauaguauaugcguguggacaucuuuuguuuguuuguuuguuugguuuuucgagaguuucucuguauagcccuggcuguccuggaacucacucuguagaccaggcuggccucgaacucagaaauccaccugccucugccucccgagugcugggauuaaaggcaugagccaccaugcccggcacuuguuuguuuguuuuaucaacguaucuauguauccaugucugucuguauauuuuuaucuaucuaucuaucuaucuaucuaucuaucuaucuaucuaucuaucuaucuaucugagacaagcccucucuaugcggcccuggcuaucugcccuggaauugucuauguagacaagguuaggcuugaacucacagagaucugccugccucuggcucucaaaugccgagacuagaagcaugugccaccaccaaguagacaucucccugccagugcucugcuguguugugcuguguucuuuguaacauguguuuuguugggaggaagcgaugguaugugcacucauccuaggaugguagccagggugguuacagcauguuuucacuuggauuugaguugaaggggagcaaucucuucuuacaauggauguuauuacuuguuuuaaaauuugagauuccgauaaaaaaaaaaagugagcuauaauuccuauuuuaauucaagauugguugauugauugauugauugauugugcuagggaaggaaccagagucuuuuuuuucuucuuugagacagggucucacuguauaccucuagcugcccuagcauuuguuauauauaaucaggcuggccgugagcucauagcaguuuuucugcucuguuucuugagugcugggauuaaagguguuugcuaccagguccagcaaaacccagagucuugcucauacuagacaaacaguauaccuauaagcuauagcccaggccuuacuuauuucucuguuuaugagacagggccucucuuuguauugaggcuugguuggaacuggcucuguuguccaggcugaccuugagcuuacagaauccucuugucuuagccucccaagagcucaaauucuagaggugagguagcagcccaguagcauuuauuuugauguugcagacugaaugcagggcuucauaggugcaggcauccuaccagugagcuagaguccuaccccuguuuacucagucuuuauaacugaagucauaagcauaaugacauaaacagcaauuauacuaaguacaaagauuuauuuauuuauuucauguauguggguauacugucacuaucuucagacacaccagggcaucaggucuuauugcagaugguugugagccaccgugugguugcugggauuugaacucaggaccucuggaaaagcagucagugugcucuuaaccacugagccaucucuccagcccuuaucuguacaacauauuaaaaaauuauuaauggcauaguggaggaccuuguuaggucuuuauugaccuuuguaauucuuuuaugaucaccuacuuauuuauacccaguagguuuggauaauuguuaaauugcauagccagcuccauaaagagccuaugguugaucuauuuuucuagcucuuucucccucccuuccuuccuuccuuccuuccuuccuuccuuccuuccuuccuucccuguuccuucccuuuccccucucuuccuccuccucccucucugaugggucuuauuaugaauccccagcuggccugaaauuagcuaugcagaccaggcucaaacucagagccucugauuccugagugagccacacggcuggcucccuucuuuccuuccuuuuuuuuuuuggggggggggugcaagggggaguggacaaggcuucucuguguaguccuggcugucacuccauagaccaggcugaccucuaacucagagauccgccugccuaugcuuccuaaaugcuggaauuaaaggugugccccaccacugcuccccccaccuucuuuuucuuucuuggaauuucaccuagaaccucccaaaugcuaggcaagcacuuagcuuuauucccaucccuuucuuguauguucagaacucagggaccagggaggcuucggaaaccagcaacucuuagucuagaguauuuguuuauuuuucaucagucagaugaugaaaguacuauggguucauuguuaaaaauagaaggcacacacacacacacucacacccacacucacccacacccacacgcacccacacccacccacacacucacaccuacccacccacccccccccacccacacacacucacacacacacacacacacucauacacacacacacucacacacacgcacccacccacccacacaccacacacacauacacucacacacacacgcgcacacacacacacacacacacacagaaagaauagcuuaugcugagcuucucacggcucacauccuccuaaccucuucuuuccgugggucuauaucaauaaaaacagaaguggagccgggcagugguggcgcaugccuuuaaucccagcacuugagaggcagagacaggcggauuuuugaguuccaggccagccuggucuacagagugaguuccagaacagccaggacuauacagaggaacucugucucgaaaaaccaaaccaaaccaaaccaaaccaaaccaaaccaaaccaaaccaaaacaacaacaacaacaacaaaccaaaaaaccaaaaaaccaaaaccaaccaaccaaccaaacaaccaaacaaccccacaaaaaacagaaguggaggcauucuccugauaaaccuaucaccccccauaguguguagcguaauuucuagugauuguacagucccuauuauguaaguaugaccacuaguuuaccugauuccauauugauagauagauacuuacccacuuuuaaaaaaaagauuuauuuuuucuuauuaauuguguaugugugugugugugagcaugagugugccuguguuuguagagaccagaagaaggcguuggauacccuggagcuagagugagugguggcugugagccacugauggggguacugggagggcccucugcaaaggcagugugugcuccuaccccccucccucagucuccucgucagcucuggguuuauuuugaaucauaugugcauguaugccucaauguggauuugugcccgucagagugggaugcagcagaucagcuggguacaucagcuggagcuggugcagugaucugcuugcuguggcugcagagaacugaguucugguccucugcaagagugcugccgugcucccccagcggcagaaccauccucccaccccaagacuuucagucccugcaagaauuuccauucacgagugccuuuccucacgaccuccccuaaucauguuuccaucaagcaacugcuuagucuguuuuuuggagguuaaaccucaauccuuuuucuguuaaauuacuacuagcugcaggggcuggagagauggcuuagcagcuaagagcacuuguugcucuggcaaaggaccugaguuugauucccaccacuuagaugauggcucauagacaccuguauuuccgguuuucggggaucugaugccauuuccuuaccuccucuggcauggagcacaaaugugcacauacauacaugugggcaaaaucgucaugcauaaagugaauaaaccuauaaaaauuuugaaacaauuaugauuaauuccuaauuaauggauguagauucauggagauuuucuaguacuuccgcauucuuuccugugccagagggaagccuagaggagggucagccugggaacuccuacacuacccccacagcuucccuuuuacagggaacugauaaagggcaaaggcaccagggaaugagguacgucuguagagaagaaagugccggaguaggcagcugaagaaaaaagcauagcuuccagccaugugcaguguggaugcuuuuaaucccagcacuugggaggcagaguuaggaggaucucugugaguuggaggccagccugaucuaaauaaugaguuccaggcuaguuagagcuacauaaacucucagcaauacaaaccaagccaaacucaacaaaccaaaccaaccaaccaaucaaccaauaacaacaacaaaagaaaaggaaaagaaaggaaaggagaggagaggagaggagaggagaggagaggagaggagaggagaggagaggagaggagaggagaagagaagaaagaaaagaagucauggcuccaaagagaggaagccugaagaaagggacuggccugagguugauggucugaauucuguccccgagucugcuaacuuuaugucauugggcaggcuggucaaugucuaaguguugucauuugucugaugaucuucacgucuccuuguauuucugaaguucucugaaaaaucaacuuugucauaguaaccucuucugacacaguccucugaucuguaaaguggggcacuaauugguccuucacgggcuuggugugaacuaaugucagaagcaguuaccucugggugugauccauagcaagcauccaauaccugauaguuauuuuuauuaucugcugaguguuauguaagaugaggauaauuaugucauccuacacuguuuauagaaagaacgcugucuucucaacucugguuucgaaguucaaguugcagcugggaaagaugccaaggggcauaguacaaagucaccgcuggccgcugaccuuccuuuucagcuuagucuucccugggaucuggcugcuguccagaugugggucaaguaaacaggcuacuguugaacacagauaagucagaucaccagauauaggucggcaggggagacaauaggaaaccccacuccuggaauagaaaacaaagcucuggguacccgugaguauaacaaaagggaaggaagccaggccuuaucugagucacagaugccugggaugcucaucagcaaagcugauguacuuucaaguugugauuaauaaggaccgggacaggagggagaagcuguggggguggcugagguuuuguugguguggauucucggaccuacucauuuuuucuguaaaaccaggaagcugcauucuauuuauagucccugaaggguggucucugugcuguugguggcaagugaggugauuuagauggugcagagaugagcauuggauacauauuucuuuucucagaucaaggggauaugauuguuaucagcuccuuggcuucauuggugugccaggacgaggcaaaggugggauuuaaguucauuuuuagacaggugagucaauuuaaagaugaugugcagaaauggcaaagauuguacaggggauaaaacuaaaggucagaugugggagacagaauaauaacuccucaaagaugucaacguccuaguccucagaccuguauguuauugugugcaucaaaaggaacuugacauauaugauuaaggauuuugagauggaaagauuagauuagauuagauguguagacccagcauaguucgaaaagggaugcagggguuucaguaucagccauaaugggaacagccugugaggugauaacgccccaagucuauccaguggccucuagaaaccaggagagccaaggaucugauucucccccugcaaccucagaagagccaauaccuugauuuuauagcuuacguaagccuuauuuggaaucuuugacuuccagaagcaaaagaaaauacguaugugcguuguuugaagccaccccauuugaggucaucuguuaccauagccacaggaaaugaagacauugaguguuagaggaacuuaaagugauacagcauuucccuagggcagaggacugggcauuggccaccuaacucauccaucucucaggaggcuggcccagucaucaugucuggcagucuggucaaaaguagggagagcccucauuccuacaaggagaaugcuuggaugggugacauaauggguccugacucauggacacugucaacggcugucauuuaguucagucugcucaguuuguggauggagacaucgauacccagaaaugggaaguaaccuagcaaagucaccagcaauggggcugguuaggccaggaugaagaaaaaaaaaaagaugauucuguaccccaggccaggguaaggaguuaacucugcagagacaugccuggguucccacgugaggguggggagcccuggugagggguggggccuaugucuggagguggcucucuccaccuuuuggccaccucucugugccugggccucugguucucaugucccucccucuucuaucuuugaaucagaguuuuaguagccguucuguaaacaggugaucuucuugaaacagcgguguccuggggccgggcuccugugcucuccccucacccugccugaguccacagugcugcugagaguccccccucuucccuguuugcuccccucugcagaugcuuauuuucuuuuuauagacagggcauucuucugcggugaacaugaaaccugggaugcuucaucucugcagcucagcguggggaaucaaaguuggcuucugugguaggaacacuccugcauaaagccagauuccuagcuuugagcagaaacuguucuccauauaaugcuuuuaaucccaguaauugggagguagagguaggcagagguagaggaacugucuuugaguuccaggcuagccuagucuacauagugagacccuaucuaaaaacaaaaaacaaccaaccaaucaaacaaacaaccagaaaaaccucaaaagacuguaggguggaaauuuuacaucuuuagaauaagcauaugcauauuuagaauaugcauaugagauaaguuacacauaccauggcagaagggugggaauucuuaugaaccaagcagaagaacugggaaacuucccagugaaacucuggggccguggaggcuguuguguuuuauaaaaagauagagaagaagggguauguuuggcggaggcuugguaugguguggggaagugggugccuauguggggcccaugcugaggcaucccugcccccugagguaccagccacaugaugguauaguauagaauagcguuuauucagggcauggggaggggaguugagagaaaggcagaaagagagagagagagagaagcaagaagaggaguagaggcugacugaccaugagcuuggggggggggggaggaauggggagagagggggaagaggguaaggagcaggagcaaggggaugagagagugaggagggggugagcagccccucuuauagugaguaaggcacaggcauacauggcuguugccagguaacuguggggcggagccuagaccaaaugccaacagaggcccaggucaccuaccacagucaccaggcucaaagagugcaguuuguuuuguuuuguuuugagacagagacuugucuugcagcccaggcuggccucagacugcugcgauuacaagugugugccaacaacaccuggcucaaagacuaccuuaaaaacaacaacaacaaaaagagcccuaaauccaucuguuuaggaaacuucagagaauguagaggaaaugaguauacuuuaagauuagaugcaguauugcuauaugacaaugaaaacguuacucacuuaauauauauuugucaaaaugcagaaagaaagguagggagugagagagagauggagcagggaggggugagggagugagcuauacucacguucugaagguaagcacguagauguuugacauuugaggucuguauuucuagaccuuuuucuaauguucaauguguguuguucuagauuaaaauggaauccuaugcauauuauuaacuacuuucuuuguuuaacuggacauuggggccauuuucauuguuaauauucuucuguaacauuauugugauauuaacacauuagucagcauggcuaucacacgguuccacuucaucagugcuucuugcucucucucucucucucucucuccuuccucccuuccuuccuuccuuccuuccuucuuaaagauuuauuuauuauaugugaguacacugucacugucuucagacucaccagaagagggcaucagaucucauuacagaugguugugagccaccaugugguugcugggauuugaacucaggaccucuggaagagcagucagugcucuuacucacugagccaucucaguagcccccaaugcuucuuucuuuccuuucaguaaaaagaaauucauguauaugaauguuuugcguacgugcaugucuguguaccaugggcaugccguacucacggaggucaggagggcccacuggcuccccuggaacugggguugcagaugagugugagucagccaguggguguuaaggaacugaacuuggguccucuuacugggcaccuagggcuguuagacacugagccgucucuccagcccuggcaacuguuucuuguugcucacuucuuauuguuucauuagagcucuaaacuagaaaaaaauauuuucuuuaguaaaagaaaaagaaagaggaguaagauagaguagcagaagagagcugaggcagugaauuggguuuugaaaauguccccugagaacuuucuagucauuccacaaacauucagugcuuccggacaccaggcauugggacuagaggccaacgucauggcugcugcccuaaaugucaccuuuauuaaaugcaaagcccugaaaagcugacuguucucauugguacaugucagggccugacaugcugaugugacuuuggcacuuucuguuucccuucgucuuucuucugucuuucuucuuucuuucuuugcaaggggcuugggguagggcuggagagaugguucagaaguuaagagcacuggcugcucuuccagaggaccugaguucaauucccagcaaccacacagcagcucacaauugucaguauaacucugguucuagaggauggaacacccucacacagacacacacgcaggaaagacgccaaugcguguaaaacgaaaauaaaguaaaagaaagcuuacaggaagcagggaauugugacacauacuuggaaccccaccacuuagaaaacugagaaaacuuagaaaauugagauuccuggagaugagcuguuucaaaacccaaaccagaugagugguggugacacaugcuuguaagcccagcacuugggaggcagagacaggcaggucucuguguguuugagaucagccuggucaaguucuagaauaucuagagcuauagagagaaacccugacuuugaaaaacaaaauagaacaaaaccaaccaaccaaccaaccaaccaacaaaaaaaccccaaaccaaacacaucaaaauaaaccccagaaaaccuccaggaaggguuucuucacuucuuuuguuaguugcuucucccuggggcuaaggacagugcuagucagucaauaaauauuuguugaauggcugcauacauaaucuuugggugccaguaacugacucacugccuuucccaguggugggaauuaggcugagauggugugauacaaucagcucaggcuggucggaaacauuccauuucuuuucauuccugucauugcacagccuggguugagaguaggcaaagcagguaggugcccucccucccugucugugcaagguaugugaucaggcaccgucuuuuuuccuccagggacagucacaguguuuauguaaguacgaugucaacagcgcuuggcguugccagguguuaaccaaauuagcaaugaacuguguuggcgauacuuucuugggcagguagcugccacucuaaggaacaggcugugguuggaaccagcacagagccugaagacugaagcuugggagaucggaggcucugcagcugggcaaaccacacgguuucagguugggaggaagucccaagccagguaggucacuggggaaaaaaucaggacagacuccagguugauggguggaucacaguagaagauacauggcugugcagggguucuccuuagacuuuagcuuaucuucucagauaaggaagaaagcuuguuccugccagggacuagucuucaggucaggccugugagggaaaggucuguacagucucaaccuaaaucuuucucaccuucaagagccaccauucagcaagugacacuugcagacuuaaaacaccucuuggcaaaggguccaagagccagaagugguggcauaugucuccaucagacagaguggaaaggcaaaauagaauggaggcugggaaccuaaaacaaccuguacugacugcaguggcaugugccuggagcuuuagcugcuugggaagcugaggcaggaggaucauuugaacugagauuuuuuuuuuuuaaacauuguuuuauuuuuagauuuauucauuuuauuucaugauauggguguuucgucuguguguauauuugcucacugugugugugugccugguauccucagaagucagaagagggcaucagaucuccuguaacuaggauuacagaugauuguaagcuaccacaugggugcugagaaugggaacccaguucuucucugcaagggcagcaaguuuuagcucuuaaacacugagccaauacuccacucuggaacucaggacuuagaggccacuuuaggcaacacaguaagacuuugucuuuuaaggucaacaccagacaaacacaccuccuagggaauccacucacagacagcuggaguuagaaggcagaagcucugacggcagagcugaggucagaguuugagcugcuuucaguagucuguggauauugccagcucaagaaaguacugagggugcauugaagacaaggaaugggccucuccuuucaggaaguaccccaggcauacugccuguggcuucccccaccugucugucugucugucuugaggugggggcgggguucucacuauguuguccaaguuguuuucuaacaguacugcugcuuuggcuucccgaguagcugggaccaggcaugagccacuguaccaggcuuagaagugggcauuugguaguaaacucaacugagcgucauccacaaucuuggaagaggaaauccauugucuggucaaaggcucugcccucuguagguggucauucauucauccggccaucguuuauugaguaccuauuccaugccaggaacuaugaugaaaagguauauauuucuuuauggaagacaucugcauuuauuacuaauuuguuuaauuuuacauaucuuuuguauccuuuuggauacaaugucauuaaacuuggcaacuuagugaaaaaaaaauccuauggacacuauguccuguuuucaaaagcaguuuuuuuuuucuuuuucuuuuucuuuuucuuucuuuucuuuucuuuucuuuuuucuuuuuuuuuuuuuuaguugggguuuuacuauguaucccaggcuggccuugaacucauagaaaucuucuugccuuaucaucuuaggcaugcaggauaaucacaugcuuggcuagagagcacguucugucccucuuuguccacugaccuuaguuauuuuucuuuguacuucuaucuauuugcuuaucggucgucuucuccauuagaauauaaacucugugggguggaagguauguuuuaccgugaugucaggaagcccaaggcuuagaagagugccuuggauccgcaagcacuauacucagagcauaugguugacagguuugcugcucuguauaaagccauuucuuaucucagaggcuauaguuguuuguuucuguuuuuuauuuuguuuuuuguugagacagagucucauguagucuaggcugucuuugaacucacuaaauaguuguauagcugaagaugaucuuacacuucugauuuuccucuuucuacuuccugaguucugggauuagagggaaacauuaccauaccacauuuggacagugcuggugauagaggccaaugcggggcaucaccuuaccuacugagcugcagcuccaacaauuuauuuuuuuaacaguaaaaaguaguauuucuauugucuuuuuuuuuuaaaacuuuugaaacauaaucucuauguaguccugguugaccaggaacuugcuauguagacaaggcuggcuuuaaacucacagagauccauuugccgcacuguuuccugaaugcugagauaaagccaucagcaauuucaggccuauauuacuguugucuugaaugacaagaguauagguacuaaaagauuugguuuaaaauuugaaugaaagugaaggccuaggguaugacccaaaccucagagccucuguaaccuggcaucaguuacaugcaaccuuuguaccagugaaagucuccgucuguguuaaguucucaggauuugcaacauuuuccagacagugucgguaguugugcacugggauuuaucacuaccuaaccaucaauucccucuuucauuuucacugaggcauauuaaaugagugugugcuaagugccuggugcugugggcuauuacagcuaaaggguccuuguccuggcugaacuuaaguuugggugguggaggaggguuggauaccuccauggcuaaaaggcaguauuuuaauuuuuuucuauuaauuacuauucuuuuuuauucauuuugagacagggucuuaugauauagccuugacuggccugaaacuuacaauauagaugaggcuggcuucugccuucugaguguugggacugaaggcaugcaccaccaugccuggcaauauuuauuuaaaauaauuugugugugugcgcgcaugugcauacuugaggagaucagaagagggagucagaucccauaaagcuggaguuacggguaguugugagccaccugauuuggaugcugagaacagaacucagguccccuggaagggcagcaagcgagugcuucacuggugagcuaccccuauagcccacauugauuguuugucuauuaauuuauuuaguuauugguuuauuuuguguguguugucaugguacauauguugaggucagaggacagcuuaaggaguuaguucuuuucucccaucaaguaggacccauggaucaaagucagcuggucauacauuguaggcuagcaacuuuacuggcucagccaucuuguuggaccccagaggcaguguuuguaaguuugcuuuuaacuacgcagcccucuauuuguguucugaauauccaggaaggcuuccuggaggagcuacuuugugaauaagacuaaagaaggcagaccuagccucagagguagucacagugcauagggcagugagaguugauaagauaguccucaaaaggaagggaacuguccugggacagggggucuuaguuacuguccuacugaugugaagagacacaaugaccaagaaaacuugcagacggaaacauuuaauuguggggcuugcuuauaauuucagagggcuagucuaugauuauggugggaagcaugacugcaggcagacauggccagagggcagcugagagcuuacaucugauccucagaaucaaggcaggaggcagagagaaagauuaagauugggucuggcaugugcuuuugaaacucuaaagccuacuaccccuggugacacaucuccuucaagaagcccaugccucguaauccucccuaaacaguccaccaacugggaaacaaacauucaaagauaagcacucauggggccauucucauucagacaaccacaacgggacacaguggugcaucugguuagacucaggggaacuucuggaugcagacugccaggguggguuggagcggcugugugggcucugauccuucauggcaacaguagcaaggagacaaaucaaguuuggaagcagggacgcucuguauacaguggaauuuuagugauauuauucucaaagcaauguagagaccgcuaggguggaacaagaagucguucaagggagggagauugggguggagaugaauaggagacaauagauaaacagguaagcaggagggagaugcaggcagaauaaaguggaaaaaugaaugaacuugaguuuguaaggggaaaguugagacuguguggugaccacacuggugaacugaaagccaggcaggggaccauuacaggagauucgaugaaaaguuuguguuuucaugacuagaacauagcacaacugagagcauguaaauaauucuagagaauucaguugaagcagaaggaagaucuauugggguuuaggaaagugggcaugaggcagguuguuagauuacugagaucccucgaucugaucuccaccuuuaaggauuagcaaaaaaaaaaccauaucgauuaaaggaguauagaaaauuagauggaaguauucccccccccccccccccgugugugcgcgcgcacacacaggcuuuguuguuuaaguccagguguucuuauguagaacuguaggcuguccuggaacuuuccaggauuacgggcgugcaccagcacacccagugagccuuugauuuuuguggugucuuauuuaccugaucccuaaguuaaauauguuccaucuccucagaguuuccgcagcagguuuauaugcacugcguaacugugcuggcuagucuuaugucaccuugacacacaaacuagaguuaucugaaaggagggaaccucaacugagauccagcuguaaagaauguuuuaauuagugaucaaugggggaggauugugguuguuuucaucccugggcuggugguccuggauucuauaagagagcaggcugagcaagccaugggaagcaagccaguaagcaguacucucccuccccaauccccauggccucugcaucaccugcagcauccagguuccugcccuguuuugaguuccuauccugacuuccuuugguguugaacagugauauggaaguggaagcugaauaaacccuuuccucaacaacuugcuuuucggucaugguguuucauugcagcaguagaaccuuagcuaaaauaauugccuuuuuugaguaugggaugggccaaaguccagcauucucacuagcuggaguuuggacccagaucucucuuuuaguagcugaucacccuuuacccaucggaaggguggaacuugaucuguuucuugcauuuuguagcagagaagauguugggauauuuacacguguucucagagauuguuacauugaacuuucugggucaguccaaaaaggaccuuguacuggaaccuaugggaagugcccuggaaugcuuuacaaaguuugaaggguacagcagcucucaccuuuucuucucuuacaaugcuaguuuuauaacuugugcuuccuuuugagacugucaucuucuuuacugauuuauuucccauggauuugguguaauggaaggaggucgggcaguuugcugacucuaggguacuauuccagccucugggccaacgaagaucagagcagggccuuuggcuucugagggcucugccaagcuaagcccauucauuaagaaggggaugaugccaguccuaggggcagagcaaaugggaggggcagcagccugggagaugaugucacuguuuucugaagggccuggccagccauuaggugacucaguguguuucuuagcaccucagccaggaggcaggacagaagcuguggccuuuuuaucuuuuccuguuugggugggacgguuccugucuuggcaccgggucuauaggaaagccuucauuaaucacuucucugccuuaagucugauuagauugagcagaguuucagguagggaagccagacugaguuucaaagcuguuccaggccacuggccuguaaagcagaccuuuuuuuuuuuuuuuuuugagucuuauguuacaauauagaucuaaugauuccagcuucaaauguuguugaugguuaacaguaguguauggaaggcacuuuagccccacggucuagccuauguuucccuucuugucagcguaguaguggauaacaguguagcuucugaguuugaauuugcgcuguaggugagugaccuuggggaacuucaucuugcuauuucuuacuuguaaaugagagugacgugggguuacugugacaaagcaaugcaccccagugacugguacaacuacgggcgcgacaaaccgcacagugaacucauaaucucuuuuuaaaaacccuauauccuucauaguguaguucaagacgcucuagaccccaguaaucuuccucugcucaucaguuuggguucuccuuaaaaauccaucucgcaccguuuuuuguuuauauugaccuuucccaaccguauacgugggcucaccuugucuuucuuaggcucagcauaugucuuaugcuauguuguuuugucuucaaacuucaaaaccaaucccaacagcacugaaauaacaauuacauugagcaugagacagcuaaaguuccuauaguuguuccccaaaugccuuuuuuaaauuuaaguuucuaguuccaggacaguuguguauuucuccugucuccuucgugagcuaguacucuauacuggcuuuauacuggcuucccauuuuagccuagggaacuacucuccugcgcagcacagcuuccggagacagcacagggcuaaaaaacccaccuccuucggggguccggggcggcgccugcgcaggacgcugucgcagaucucacgucagcgcgcaaagccuaggucggcuccacgugacucuggccucccaccgcuccgccccgcacgccagccugcuucugcgcaugcucuugacuccgcccccgugcgucacagaauggccuccgacacccagggagccccugacgugucggggaggagcccggugcggggauacgcggaguggagcucagggcugcggaagggagcagagcugagcggcugggcgggccuggccaggccagcggagcagagacgucggccgagcggcggcgaacaugcgcuuuugacacauuggcggugagcucccgugcgacgcagccucugggguucgagccaggcgggcagcgccgaggccugccccgggggagccugccugaccgccgccgggcuggggcucagcccgcugggccaggccgggcuuggguucuggggcggcccguaccgagacaacuguuccaaccgcuuuaacuguccccuccuuacuggcggagguguggcccaccgggggcaccugcgggagagcgagucccgggcuuccagaggagggacggaggccgggacguggcaccgggggcugaggcgcugacggcucgaggaguggcccaguugggguggcggaggcgcgcccagcuucucgcuccacccauccuugauucccuggagcugccggggugguuaggagccgggcaggaucuugauuucccagcgccccagaugcgggaggcgagagcaggagcagcccgcguuggcagagacuggcagucucgugacugccugccccgaacugcuaaucauccucuuuggaguuggggaaagucucacuaaccaaccgaccccgguugcuuggauucgcuucuuauuuuucucugagaaacgaugaggugacuaacacuuuuaaguuuaaggcgagugaggguccuuuucauuacccgggcccauuccuguagcguuuguaaacauuuuagaacauuugcuguuuguacuugcgacggauacuguaagucacuuuuugcuggauggggaaauugaaccuagguacaggagguuggggcaacugagugauuuuuauuuggguuccacuaacuggugagaaguuuagcuuggguuacaauuuaccuuucuaagcucaggguucugguuucuguuuucaugagauuuuuuuuuuuuaacuucuucagccggaaagaggacugaacauuggacuuguuaaagauaauaccagaaguuacuagaugacuuauuuauuuucgaguaaauugaccaaaaaaaccaaaaaaaccccaaaccaaacaacaacaacaaacaaaaaacccccaaaagcucaguuacuagaaaaaucuuauccugaagcuugcucaugaguggcugguuguuagucugaaaauuauguugcuuucacugcacuuaagagguaggguaaugucugccaaaucagaaagcugagagggcaaagcucaucauuaaguuaaggagucaaaagagaccaaaggacacccaguuggggguaucucuucugaauuguuguuaaaaucuuagaguaggaauacauaaagaacaaagaaaaccuuuagcuccaguuagagacaaacuuaaucuuagaagaaguugcuaaaucugcagugccuugguuuugaauugaauugaaguuggauccagagcauuugaaauaaaaaauagaccugaacaugcuuuuaugagaccaacaaaauuuauuuucaugcguauuuuaaaccaugcuaaaauagacuugaggauugaggacuuaaguuaaaauuacuuucuaggcacuucauaagggagagaaauaaggccuauuucauucugcauauauguuaauagucauguaaaauuaauuuucuuagugcuguacagaguaucuuugccaguaagcucuguuagaugauaacuguuuaaaguuucagugagcuaauugucaguuguucacaucuaaaggucguagagugugagcaugucugcugcagaaguuguaauuguacacucacacuccaugugagaccuagaauuaaggaagauggagaggagcagaaaguccuugucugcuagccuugcagcuguagaagauuguagauaugccauuugagcacuuuuuaaaucagugaaagauuugacauuggcuaacuuuccccacuuacguaaucucaagcgacagugagccucuccgaguaccuggaggcaaacuccacacacacaguuuugagaucaccugcaaggguagcacauucguuacuugaaccugguucuuagaaggaugaaguugaugaauagguguagggauaaagcuggguacugccaggcgggaagcaacagauacagcgugugaugggagggaaagaacuuguuuuagucuagcgcauaaagcuuguuccaggagagacguuagggaugcuuuuguaaugaaaggagucaucugcuuauaaauuuggaagucuguuuacucuggucuaacuuaaagguccacuucuggccuaguaguuucuuagaguugaauuaacauuuaugugauguuuaugcaucaggcucuguuacacguacugugccaauaguaacucaccucaucuuccaaauacaacugaucuuccuguuuuauaggugaggaaaugaggcacugagaaguugaauagcuugcccaaggucucucagccaggccauaguuugacucuagggccugagcuuugcaugcugauuuuucuggcuaaauuaauuuucuuuuaaaaccuuauuucugugugugaguguuauaugugugaauguggguggcugcagaggccagaagaagagcuagagcuagagggagggaguugcccuguguuggugcggggaaccauauucuagucuucugcaagagccacugagccacuuuucuaguccccucagauuuguucuuuuaaaaaguagauauauuuauuauauuuaauuuuguguagguuugugucugcauguggguauguucaugugaauggaauguccacagagacaggaggcaucugaaucucuggagcuagauauauaaucuaucuaucuaucuaucuaucuaucuauauguauauauauaugagcugccuggugugggugcuggcccucuggaagagcagcaagugcucuuaaccucaaagccaucucuauucccauacauuuuuuuaaacuuuuuuuuucuuuuuugaaaaagucgcauguggccuaggcugggccuccaacgugccauguagccaaggaacuuaugaucuuguuuucucuaccuacugaaggcugggauuacagaugugcuguaccacacugguuugugcagugcuggggauugaacccagggcuucaugcaugcuaugcuaggcagguacuuuaccagcugagucacauccuuggccuccucugacuuauucuugauuaaauguuguuuguucuagauuuuuuuucuuuuuucuuuucuuucauauuuguguguguguguauguguguguguguauguaauagggucuugcuguguagcuucuggcugacaagcacuaauagaacuggcuauguaaaugagccuggccugacauguguugauccuccugccucucuggauccucuuaccucugucacuucagagcugggaucacaucugagcuuggucucugccuugcacauacaugugcacucaugcaugcaaauuugcacacaaaacacauacacaucuaccccucuucaugaacacauacacagaagcacacaaaaucauauaaaagaauauguagcuuuaggcaauuauucuggauuguauauuuuaaagagcuagaaggauuucaaaaguuuuuaccagagagaauugauaauugauggagguaaauauauuuaacccuacuuacauaguguguaguguauuuacauauugaacauuacaugguacucaauguguguaacuuuuuauguuuuugaguaaauuaaaaaauauggaaaaacaaucucagcuaaagaaccuugagaaccagaagcuggagacaaauacacaguuuacagcauguggaagucuuguuucccagggaccguugcugcucugagagcuaccaguaugucccuugacaucguaaaaucagaguucaagcaacaaaagccaccccaucuucacacagaaagugaguggacaaacuuauagauaaaacugauucugaccuuacuuguagaagacuuggcuccacauucaaacaccacacauuaacauaaauguuagauguccagggagccacuaacagcacuggaccuucccauaaggacacugguccaugguauacaucaucaacaacaauauuaaaaggugcauaguaaaacauuauauaaaacuuaaaagauaaagucccugcugaugaauaaaaugucaguacucaaaugcagcacugguucauccauacaaguaaucuaagaacagucuaaaguucaacaaaaaauguuuaggggccugaaauggcugcugaauaggauaaacuauccacuuggggaagagcaaggcuaagauguggucugucaucagagucuaccaaggucagacaggguguaaacauggggaacacaggcuuguuuaccaaauccuggaagcuugcagcacagcaacauacaaaacuuagaacacauucaagaaauagagagagccaggcgugguggugcacgccuuuaaucccagcucuuaggaggcgggagacagaggcaggcggauuucugaguucgaggccagccuggucuacaaagugaguugcaggacagccagggcuauacagagaaacccugucucccugucucgaaaaacaaaacaaaacaaaacaaagaaaugaaagaaagaaagaaagaaaauaucugauaaaacacacacacacauacacacacacacacacacacacauucaagagugaaaauagguagcucauugauggcuguaguuaauggauuuauccugguugcuuaaaauaguauauaaucuauugaguuaagaacuucaucugugggggcugcaaaaauggcucagugguuaagagcaccaguuacucuuccagaagaucuggguucaauacccugcccugacaugccgucucuugaccaucuguaacuucaguuccaggggaucugaugucuguccucuuuuggccuccacagacauuacacucauacacagaucaaaaaaguccauacauaggaaauuacauaggaaauaaauacaaauaaagcucuaaaaaagaugaaaaaaaaauagauuucaagguaugaguuaaaauuuuuauauguagauggagacagucuuaaauuaucucaccccagagguaguuagguaggagugugugugugugugugugugugugugugugugugugugagaguguguguguguauguguaagagagagagagagagauugagaggaguguguuagaguacaaaguguucuuagggcuuugcugauugacaaaagaguaaggacauuugcaguuucuuaguuaagcagccuuauagucacagugccuacucugugugauuacuauccccccuuuuuuuuccagcgccgucucuauauuugagccacucugggcuaucauccugggcguuaccccaggacuucauugcagucuuggguugcagcugcuauguucuucguccugugcuuuccaggucauuuauuucaacugauuuggaagaauuuauaaauaagacacagaucuugcccuggagaacuaacuagagagacuuaaccuuugauuucuugucauugguuucucuuggaaaacaaugucaguagcagaggagcugcguuucuugugccgucucuggucuuuauaacaucccaaaaauauaaucaaaaacauaauuuacuggcuuuuuuauuagaaacaauauuuuagcuguccauugacacaugccaguguucaaauaauauaaauuugggggcaggguuggauuuauuuauuugcugaggauguaacccaggccuuauacaugcuaauuaaaugcucugccacugaccuaugcccccagcucuugggaguauuuguuuuuaacuauuuugucuauauggguauuuugccugcguguaugugugcauaccacuugcauuccuggugcucacagagaccagaagaugcugucagauccccuugaacugagucacagaugguugugagcugccauaugaauacugggaaugaaauccuagucucuggaagagcagcucuuacugcugagcacuauacauggccucuauugcauagauucauaguuuucaggacacuuugggagaucuguuauagaacauuagagaacacucagggguuguugcuucaacucuagaugcuuucacacauuuccugugauucugucuucaucuggguuguuacaauguacuccuuuccuaaggagacuucagugugaacccggaagaguuuggaugccacagggugaugccugcacuuggggucuuuugaaauaaugaguacuucuggcuccugaagagcccauucuuacccauugacuaccuaccauaggucaaguaguaaccucuguauuugggcaagggaaguggcaauuucugggacuuugacaacgggacagaauuacagaacaaaucaguauuuauuaaucaguauauauacuugaaauauuuagucacccaguguaguccauacguuuauuagaugaaacaugaacaacugaagcccuaagagaguaagcaguuugaauaaguaauuuaaugguggaauuggaacccuagaacucagcuucagcaggacuccuagccuugugugguuaacauauuaaaguacuuucaugcucuaaagacaucucuaagaauagagcagcacagacaaucuguagacguuaccguaucucuuuuguuguguggauguaguguuguaacagaaguugagcagcaaagaguggguuguaggaagaauguggcaggaaucuagagugggccagucaucuuggugucuguaccuguccuaugauugggaguuuuagccaguugaaauggcaagagcaagugacuagaucccuccucugugaauuccuuggggaagaacugagauaaaggccauugcagugggagaugagugaacuuggaguaaacuuggauugaaggaugacugaggaugucuucagaagugugaucugagaaugugggucuugccugaugugguagucucacuuggcaugaagguuucuaagcagccugcauguuugugucccucccucugucccuuccucuguuccucuguccuuucuuccccacuuucuuuugagauaggguaucauguaacccaggcuggccuugaacuuucuguguugcugaagguuucugugacaucccucaccuccacugcaauucucagugcugagauuucagguggugccagggauccgaccccaggcaggcauuuuagcaaccaugccacauccucagacccuuacaggugcuuuaaagcaauuauacagcaggaaaucguguagaauggcucaagucugauguuuguuucugucauuggauuccuugaagacaguuggccauaaacuaacugcuggaacuguauguagguuaauucuguggucaaauuaucuagcauccagugcuauagaugaaaaugcuucaugccuuugcuucaagggacccuguuaccaucuccugucauaccuuauccacuguguugguugugcccaagugagguaauaugugccuaaguuacaggaaagugccaguaacuccuagaaccuuugaaacuaccaaaugcagugcccacucucauucacauccuggcucuuugucuuuacuuucacaggcuuucuugaucauggauggugaagauauaccggauuuuucaaguuuaaaggaagaaacugcuuauuggaaggaacuuuccuugaaguauaagcaaagguaauguuugaaaacauaaaauaggggcgggauuuggaauagacuggguagcuuacgcaugcuuuucccuuuggagcauaaggcuaaauuuagaguuucgauuccgcaguaaaacaauguuuguauuuaaauaguauaaaacuacuaccaaucuuuauauuguucagcuugaacuaucaggaagcuuuggugcccccugugacuccugauugcccgccuccguagcuagugacuagcugggcugucuuuggccugcugugugcucucuguugcucccucauuauuugcuuauuugaggugcuuaaaacagacuuuagucuucucaugugugcauuauuaguguugggaggcugcugaacuaagcuauggaauauuuuagaaaauuuauuauuuuacuuaguugggaagaaaauagcucuuuggacucaaugaaucuuaaugaaucuuuuucuuauaauuuuuuuugagauuuguuuuuaucuuauguguauggguguuuugcugcauguaugucugugcaccuugugccugucugaugaccauacagaccagaagauccccugggacuggaguuaaagauuucccccagaggcuggaaagccuaugaaccccuucucauauaguuuaaaugcagaaaauuaaguaauggaauuauagaggaaauuaguuauuucaaaaauugucuaaauauuaagcuaguuugugauauuauaauaauguauuagugcauuacauaaaaaagauggagaagcugggcagugguggcacacgacuuuaaucccagcauuugggaggcagaggcaggcaaauuucugaguucgaggccagccuggucuacagagugaguuccaggacagccagggcuacacagagaaauccugucuuaaaccccccccccccccaaaaaaaaaaaagauggagaaaccuaguaacucccugauucugaauuagugguaagaaugagugaugcuuagcuuuguaccagcuguugugacuuuagaauauuuguugauuucugguuagauugaaaaauaugcucaauuuagauuacuucaguacagauacacacccuuccucuuucaguuuuauggaagaagaggcuaaugguuucaaaccauguagaacuauuuuuuuuguaaauauuguaauuacugauuuguguuuugggggaagcuuauaacuaauuuucauugaauccugcguauauguggaacaagaaauauaagacauuuucuuugcuguuuaacauuucacgagaauguuaauuuucaguuaggaauuacugacuugcuauguaauuaugugagaggacucaacuacuaacuuguuuuucucacuuugcuucuguuuagcuuccaggaagcucgggaugagcuaguugaguuccaggaaggaagcagagaguuagaagcagaguuggaggcacaguuaguacaggcugaacaaagaaauagagaccugcaggcugauaaccaaagacugaaguaugaaguggaggcguuaaagguaacugcagaagcccuucccugagcccagugcuguuuggguauuaaagugggaaguguagggccagcgagauagcuucaugggaaaggcacuugucacuaacccuuacagcuugaguuugauuucugggccuuacaugguauaagaagagaaccuuuuccuuaguuguuuucugaucucuacacaugugcuguagcaugaacauauauaugcaguacuuaaaauauaguaauguuuuacaaaugagaaauuuauuaaccaaacaguacuuaaaaaaauuaagcacucucccaaaaauguguguguauauguauauauguauaauguauauaagauuauauaugucauauaacauuuuaaaaaaauguauaugaguacacuuuagcugauuucagaagagggcguuagaucccauuauagaugguugugagcaaccaugugguugcugggaauugaacucaggaccucuggaagaacaaucagugcucuuaaccucugagccaucucuccaguuugauagauuuauuuauuuuuuuaauagaaucaagagaugguucagaguuuaggacuucccauaggaaguuuaugguggccaguuuucugccuguccuucauuacauuuuaguuccuguauuuucuaaagcuucugauuauuuguuuggacaaauugcuugccuuaccauguacucucuuaaaauuauauuuacaugacacaugcauuccuuuccucucuuuuuuguauucauagcuucuugaguuuuggaguuaauugggguuagaaaucuucagaaaggaguugucaggccccagggaugggucagugguuggcagauguuugccugacacgugcauggcccugggcuccguucuucucuacaucuaugacuuggaggcuuaggagaguauuuccuuccuuuuagaaauagaguaugguuuuaaaauaaaacaauaucuuuuauauucuuugaccauuucauguaaauaauguauuaccacguccaccccuaguuucccccucuuccuccucucaacaugguccccuaugccuugucucuuuuucucuccuguaacccggugaguacaauucugucuguuguaauguuaacuaaucuuguuagcuugcucuuauauaggucuuguuuagguaacuauagcuuuuuagugauugcaagggccauguuguauccagaagacaacauuuuaaauauuuuacagaacucuuucucauccuuuaguucuuacauucuuugcacugucucugugguguuuccugagccuuguuggugggauaggauagugguguuagagauguccccuuuagggcugagcacucagucuugcucuggccagugcugaaggcaguacugaucuauggguauaaacacauguuuaggcagauagacauugguuagcaaaaaauccuguaaacaggucccucaauauggccugugaccuuugaccugguuuacaagaccaggcaugaauucccuuccauaaggcagccucagauucaauccaaaagugguugguuacaccuuuaaccuucauacuguuauugcauuagugggcacaucuagccuggcagggaaauuccuuuauuaauagaugauuacauauuaauaacacaucuuucucuguaccucuucuuucaggagaaacuagagcaucaguaugcacagagcuacaagcaggucucaguguuagaagaugauuuaagucagacccgggccauuaaggagcaacugcauaaguaugugagagagcuggagcaggccaaugaugaccuggagcgagcaaaaagguaaaggaugcugugcauucuaugagcauacccaguugucagcucaagcuuucacaugcgucuuagcaacccguuucuccuucagugucuuauguccuuugucacucauuggauuuaaaggaaacgaaacaaaacaacaugggagacugaagcagguggaucuugaacucagagaucugccugccucugccucuagagugucucuccucuccucuccucuccucuccucuccucuccucuccucuccucuccucuccucuccucuccucucuucucuucucuucucagauuuauuuauuuauuuaauguauaugaguacacuguagcuguacaggugguugugagccaucaugugguugcugggaauagaacucaggaccucugcucucucuggcccgguuuguuccuguuggucccgcucauuccggccuaaagauuuauuauuauauguaaguacacuguagcugucuucagaaacaccagaagagggcgucagaucucauuacagauuguugugagccaccaugugguugcugggaauugaacucaggaccuccggaaaagcaaucagugcucuuaacugcugaggcaucucuccagcccucuguuauuuuuucuuaaccacucuaacucauacuacuuuauaauuauugccuaguauuuuucuuuuauacuuauugauugacucuugguugacaugaugcuagucacuguccuuguagcugauccauaagaggcuugcucugauaaaagcucugguaagaagaauguauagccuguucuagagcagcucuaguaucugugggaaccgaggaagccuuuuuacaaguuggggcaugucugcaaagacuaacuaggcgaagagacagugaaaaggcugagaggcgagaagguguuugacguauguuauuaagagguuauuuuaggggcuggagagauggcucagugguuaagagcacugacugcucuuccgaagguccugaguucaaaucccagcaaccacaugguggcucacaaccauccauaauaagauuugacgccgccuucuggugugucugaagucagcuacaaugucugaaguccgcuacaguguacuuauguauaauaauaauuacaucuuaaaaaaaaaagguuauuuuagggugugucugaagucagcuacaguauacuuauauauaauaauaaauaaaucuuaaaaaaaaaaaaaagagggcuggugagauggcucaguggguaagggcacccgacugcucuuccgaaggucugaaguucaaaucccagcaaccacaugguggcucacaaccacccguaaugagaucuggugcccucuucugguguaucugaagacaacuacaguguacuuacauauaauaaauaaauaaaucuuaaaaaaaaaaaaaaaaaaaaaaaagagguuauuuuagggccgggcagugguggcgcacgccuuuaaucccagcacuugggaggcagaggcaggcaaauuucugaguucgaggccagccuggucuucaaagugaguuccaggacagccagggcuacacagagaaacccuguuucgggggguggggggggagaguuauuuuagggcucuagaaacugcucagcaaaagugcugacugcucuugcagagguucugaauucaauucgcagcacccacauaguggcucacagccgucugugauggggucugaugcccugauagguguguccaaagacugcuacauguacucauauccauaaaaucaaucagucuuaaaaaaagauuggaauugguauucugaguuguaauuuuagguuggagaauuuuguauuuguagcagauaccagggaaugggagcccacaagaguagguccguguuaauuuuugcugacugaagugaagucauucuccaaauugggucaggcugacuggguuaagaauggcaggagauaaacugauugcuuucuuuuguacuagcuguuugaacaugcuguuuaauucaugggcuucaaauaauuuuuuuuuaaagggcaacaauaguuucacuggaagacuuugaacaaaggcuaaaucaggccauugaacgaaaugcauucuuagaaagugagcucgaugaaaaggaaucuuuguuggucucaguacagagguuaaaggaugaagccagagguaagcucuaucacuuagccaguguuuacccauugccugugccugaguaagcacaaggacugacuaaccccucugauggugcuaggggucaccccggagcuugagcaauuggguaagcacucugcuccugagcuguguuccagcccucaguuucucggaagcucuaguucuauaugcuuuuacauagcuuucaaucguugugccaagugcuuuuaaccuggucaauuaucucauacccauagcaucagugcugaggaguagguagaaccuccauguuauaggugaacagaaggaggcacagagaguuggagcuuuuucacuguuguacugcucucaguugggauuuuucuccuuauuaauuguauuuaaauaacucguuauuuacauagaaccauauauauauauauauauauauauguguauauauauguugcuguuuacauauuauucauguaacucguacacacuuucuuuuaaacuucuuucuccucagaaacaauaaaauugagaauauuauaaagaaguccccuaacagugugacauaguuuacuuuuuuaugauuguauaugucuguauauuuucccuuaaauaauuccugacuuuccuaugagcagacagaaauggacacauacauuucucuuuuuuuucuacuuaauauagggaauauacauggcaucacaauuuuuuuuauaaauuuauuuuauauacagucuucuaucugcaugaaugccuguaggccagaagagggcaucagaucccauuacagaugguuguaagccaccaugugguugcugggaauugagcucagggccucugggagagcagccagugcucucaaccucugagccaucucuccagcugugguauggaaaauuuuaaagcaggcuuugggucuggagagguaauggcucagcacugggagcauguacugccccugcucuuguuuccuauauaauucucugaaucucauugugcuaaggaggagagagagauguucuacagaaaguguguuuaacuauaugucgucucuucaucucuuuuuauagauuuucagugucuuuuaauuuucuuuuuccugagggugaugcauucaucugaagguuuuuuuuuuuuuuuuuguuguuguuguuguuagaguuuuuaaaagguugauuuauguguaaggguguuuuggcugcaugcaugugugccacuuggcaugcuugcugcucucgggugcuggaagguggcaucagaucccuggaacuggaguucagauaguugugagcuacuaugugggugcucggaaucaaacccuagucuuuugggaaagcauugagugcugagcuaucucucuagccccugaggaacuguuuuaauuuuuguaauauauaaaguauuaacuugguauuguuuguguauagauuuuguuuuacagugguaggagugaacacagggccugugcaugacaggcuccauccauccccagucuuguucacuguugguuucucaagugcuagaauuaaaaauuaaaaguguaccacuauacugagaugguuuuuaaauuauuauuauauuuaugugacugguuaguuuaacuuuaguguccucacgguuuguuuauguuguugugaccugauuuuuuuuuuuauuuaaaauuuuuuuuaucauuuuauuuuauuuuuuuauauauauauuuuuauuacguauuuuccucaguuacauuucuuuuuuuuuccauuuuuuauuagguauuuagcucauuuacauuuccaaugcuauaccaaaagucccccauacccacccacccuuauuuaaaauuuuuuuaaaauggcauuugugugugugugugugugugugugugugugugugugugagugugugugugugugugugugugugugugugugagagugugugagugugugugagugugugugugugugagugugugugugugagugugugugugugugugugugugugugugugugugugugugugugagaugccugugaugucuguaccugcgucugccugcauggguauagaagcauuaguauggaguucaaaggacaauuuuugagaauguguucauuccccuaucuuacagaaaguagauuaaaaauuccacucuagaucauuuuuuuuuucucuucugugaaugggcugugggguugcuugcaucuuuaguucuugugaacaaggcuguuguggauauagauugcauauaucaguuuguaauucuauuuuuacuuuuuugaucucaaaagugaaauaacauauaguauccuuuguuuuguuuuugcuuuucuuuuuuuuuuuucaagacaggguuucucuguguagcccuggcugucuuggaacuuccucuguagcucaugcuggucccaaacucacagaggucugcuugcaucugccuuccaagugcugggcuuaaaggcaugcgccacugccgucuggccuguuuuucuuuuucugcaauagggucuuucugcauagcccuggcuauccuggaacuuucuguguagacaagguuggcuuugaauucucagagauuugccucuuuauauccuuuuucuuuuaacauaugaagauauuuucaggguagguauauaauuggaaauauuaaaaauucaguauugaaaaaugauuucauagugguaguuuaaaaaaucugagaugugguaaugcaugccuuuaaaccugguauacuggaaacaaaaacaguugcaucuuugcaaguuugaggccagccucaucuacauagagaauuccaggccuaccagaacuguauagugagaucuuguuuaaaccaaauaauaaaaaaauaaaaaaaacuauaaaacuuuguaaagcuucauuggcauuugguaguaaucuucacggcaacugcauaugcacaguugguuagggaugucccguguuacuuaguuucucugugaguucuaguugugucuuuuuuuuuuaagauuuauuauuuuauuuguguauauguauaugccacuuaugugcaggugccugcagaggccagaagaggguaucagaugcucuuggagcuagaguuauaggcauccgucugacauggauugggaacuaaacuuguccaguggaaaagccaucucuuuagcccucacugcucaauuucuuuuuaccuuugggcauaauacuguucucugagagguuauagcauuuuaaaauucuuucuuuuaaauuauuuuuauuuuguguguguguguguugugugcguacacuagccacuguggaagucagaggacaucuuguagggguugguucucucagucucccaugucugucucagggauggaacucugguugucaggucuggaaacaagugccguaacuacuaagccaucucacuacuuuguauuuuuaaguucuaggggaguucacauuuuguuaaagagauaaaaauuuuuagauaggaagcuuguuuugagaacuaguaacauaggaggaauguuuauaugauguuuuuguugggacuugcaggguauauuugcucccucuaaugaggauuccugcuuuuguuugcgacauuuugcagauuuaaggcaagaacuagcaguucgggaacgacaacaggaagugacccgcaagucugcccccagcucuccaacucuggacugugagaagauggauucugcgguccaggcuucacucuccuugccugcaacgccuguugggaaaggcacagaaaacaguuuuccuucaccaaaagguuuguauuuucucuugaaggccauguuagaugaucaguuucaaauguauuugcugguguagcagagcugcuacaguucugcgugaacggcaguuuacaaguuacuguaguauccaggaagcagaggaaggaugggcuuuccaggucacugaucugucgcagugggauggugucugcgcucaacacaagagcagcuuaaguaaaaguuuuaaaaaguuaaaaaguuuuuaaguuuuagauuuuauuuuuaagaccuuauuuugguuauuauagaaauauauguucaugcagauuccuucuuccuccccccucccuccccccucccucccucccucccucccuccuucccucccucccuucuuucugucugucugucugucugucugucugucucugucuaucucucugucugucugucugucugucuuugucgggccuggguauugaaccuagagcucuguguuugcuuggcaaaagguacugacacugaucuauauucucaguuccauguaguaaauuuaaauuugaaaguacaaaaaaagauaaguuuuacaaguguuuuuuuucuucuugauuugaguuauuucuuauacauuuuuuugcuaccauagauuggugguuaguuuugagacacagucucaccaagccuaggauggccugaagaugaccuugaauuaauuccugaucuuugagccucucccucccagguucugggauuauaggcaugugccaucacacccagagucucguauuaaguuuuuugguccuaccuaaauaauuauuucuugcuuuugccauuuaguaugucauagaaaaacagauacgaagagaacuuugaguuacuaucuagauugauagaagguuggcucaaauagaacauucuguuacugggucuugaacugcccacaaagguaacaugcaggggaacugauaagauucuucuuguuuauuuaguguguguguuaaaugcgcuuaaugaggugaagccuucuguggccagccugagagccuugcagccuaaccccagagcuuuccaaucccacuuguuuagguagucagcaguucauaucccagcuuccacugccccccaugccuuccugcccuucucaaaauacauuuuauccucuagagugagaggagguucucugggcaauugggacagcauuuccugcauuugugcugcucaaguagccagaagugacuguuaaacuuuauacucauuucaaugaacggugaaauucaauuugcugugucagucacauuucauuauugagaguauuaucaugcugacuacugguuuggcacaguauuucuuuuauguguguguguguguguguguguguguguguguguuuagauuuaauucauguaugugaguacauuguaguuuucuucagacacaccagaacagggcaucgaauccuguuacagaugguugugagccaccaugugguuguugggaauugaacucaggaccucuggaagugcucuuaaccacugagcuaucuauucagccccucggcacaguauuccucuuaccuucucuuugucuugccuuuucuuuucucuuuucuuucuuuucuuuuuucuugagauaugguuucacucuguagcccugccugccuugguacuugugaaugugugcauucuuucucucuacacacacucacacacucacacacacacacacacacacacacaccccucaggcuggucucaaccucagagaucccccugccuauacuguacccauauacuguacucaguuugccauauuuuuuuaguuuuuuucaauugcaaguaauuuuuuauacaauauucugaucauguuuucccucccucaucuccucccagaccuucuccgucuccccacccuuccaacucuauacuuucucucugucuuaggaaaacagggaaauucaaacaaacaagaauaaaacaaaacuaaugaacuaacaagaaaaacaaaaagagcaagagaaauacauacauaugcagacacacacccaucccguaaaauacaaaacuaaaaaugguaauguacaagcaaaagaccagaaagguuuaaaaaaaaaaaaaaagccaaaacaaagcaacaugagaccagaaacacaaacacaaauacaaacaaacaaacaaaaacuacaaauacuuuuggauugguuuguguuggucaccugugcugugagcauagggccugccuguaaguguggugugucagcccugugagaugcccauggagacuagcuuuuccuuuguggauguuugucagugaguuggcaauagcuccuugguuagagauggggcucaugucuacuuccccaucuuagcacugggguccuggcugguguggagcugugcaggcacugugcaugcuaccacagucugugaguccauguguggcaugaugcucuuauaugcauccuuguagcaucuguuagggagacagugggcagcccucugcccucaguucuguucucaggaucuccagaaaagccuguugagauguuuaaggaucuuuguccuuggagcaguuuggagaagugaccacugauguagucuaaugguuaagcuucuuuauacuuugucuguaccgugaaacaguaugauauugcuaaauguguuuugcuuugugacaucaucaauauaguccaaauauaaagggagcugcugauguuauuccucugcguuucucuuucuguagcuauaccaaacggcuuuggaaccaguccacuaacuccuucugcuaggauaucagcacuaaacaucgugggagaucucuugcggaaaguagggguaagcauuaguuauuuaucacuguguuuccacugcggagguaguauugaacugucucuuuccugugcuaagaaccauaugaagcggagaagccccugagaaaacccccagccugggcuucaagguuaccuauguaacucuucccauugcuguccucucuacagugcagcaccucaaguuccguucuuugccccuggcucucuuacucuucuguuuuuuccuucaucuuuuauuuugugggcuaguguguggcuuggggcauugccagccacucuuaucuggggcuuacugcucucgaacaccucagcuucagugccucaucucggcccuaagcuugacuugagugacuugccuuuugaaauaugacacugguuauuucucuaucaguuuuuaauugugugugugugugugguggggucugcugaggucagagaggguguuggauccccuggggcuggaguuaacagaugguugugaggugcugugugguugcugaggaucaagccccagucaucugcaagagcagcaagugcuguaaccucugagccagcucgccaauucuggcuuuucuuucugucuuuuuuuuuuuuuaaacaaaguuuuaaaaaauuggcuuuuugauuuaauaaguuuuuuauuuuuuaugugucuauaugugucugaaugugaguauguauauaagaauucagguguccuaugagaccagaggggucagaucuccuggaacugggcuuaacagccaucugauaaagggaucugggaacugaacucagguccccugauuacauuacacucuguuaaccacugagccggcaccuggccccaggucuuuuguuucucuguuaaaauaugaguuccagggaucaaacucagguucucaggcuuguggggcaagcacuuuugucugcuaaggauuuuacacugcacugucuugcuggaaccucuugaauguuaagucaguacucugccacugagcuguaccccuguuaagccugaccucuuucccuuucuucuuucaucuccauuuuauuuuuuucuuuuuguugagacacugucuauugugaacauaguucacacuggcccagccuggacuagaacucacuauagcucaggcuggccuugaacucaugguacuucugucucugugugcuuagugcuugggauuauuuagcauaccuagcuauucuuuucuuuucuuuuuuuagagacaaggucucacucuguagcccagauggacaugguauuugcuggcuuccaacucaaauaagucugucuguuucugccuccaaagugcuggguuuaaugcaguacuccuccaugcuuggcuuuuuaaauuuuuacaaaguaaaacuauagaccauuuaaaaaaaauaggccuuuuuaaaaaaacauuuauuuauuuuauguauaugaguacaccauuucucucuucagacauaccagaagagggcaucagaccccauuauauaugguugugagccaccaugugaauugaacucgggaccucuggaagagcagucagugcucuuaauggcugagccaucucucuagcccaaggccauucuuuaucuuacgcuucucuuaucaacacccuuguggcccuugacugcguguauacuuuagacauagacauucuggccugcuauuccugaucaagcucuuuuuuuuucuuucuuuuuuuuuuuuuuuuuucuuuuuuuugguuuuucaagacagcguuucucuguauagcccuggcuguccuggaacucacuuuguagaucaggcuggcucgaacucagaaauccuccugccucugccucccgagugcugggauuaaaggcaugcgccaccacacccggccugaucaagcuaagacugcuuggugaugucaauguggucaaauccuaugugugcacugcucugaguuuuauuugaagcauucaaugccagugugccccacccuccucagaauguccucuuuucuuggcgucucugaugcuuucucuugucuguccccacccugcuacgaauuuaucuuucuuuccuucguccuuuuuuucagugaagaucuuacuguucacagucauggcuucaucuaccacuggaugucaaguuucuaagucuuaaucucuagaacauuuuuuuccuuugaaagacccagggcuuguaccaccugugugugucacugaugccugaaacauaauuguuuuucccugccaugugaaagaugucaacagauauuuacauggauggacaaaucccuucauugaauauaggaaauucaagaguucaguaugaacuuauuuacaagucagagcauccuagagggucauuauuccugucauuauuuaacuagcgcauuguacuuuuaccguaagaaaggggcagaagaaaaagaaguuucaguuuguuuugguccuguuucaugugguuuuuuggaaaugaugggguaggcuguccauacagauucugaaaguguuuacucucuguggauuucuaguccuuuagucuugugaguuggaauggacuauauucuuuuuuucaccauggcauauauuuuuccuuuuuugggagcuaguggaaagauaauucauuugggagaaauuuuguugggaaagagggauuccaugauauccaggugugagagaugagaagucccuguucuuucacaucaacuguuuguaggugacaggugugguaacagguguaaaggggggauaagauuuagagguaaaugauaagggggcaguaucauuugcaggugaauuaauuauagacaaaagguaucagguauacaguuuauaguauacuaucacaaagaaaauggaucgcuuuaugugagauuggaaauggaucuguucugaugcaguggaaaaaauacacagaaggaccucuaggaagagcagacagcaugagaaacaccucaaacagaugauugugugcagugcuugcugcacaaacuaaucucaaaaguccuaaucccaaccaguauugcagaacuuaacaggcaaugaaugaaugggguugaaaggucuggggucuuuaccuaccuacuggcaccgugguuuucuuagguguggauuguauguguccucagugauacugagaggaaaaaguuacauuucugaggucauuagaaagagggucaguguaaaugucccucguuccacuagaaagacaagugauuauagcuucacugguggccauuauccuggaggcugaagccugaaaaagaaaugguuugagaugcaguuuuuuuuucaguacagucacuguuuugacagccauuccuucuuucuuuguaggcuuuagaauccaaguuagccgcuugcaggaacuuugcaaaagaccaagcaucccgcaaaucuuauguuccagggagcguuaacugugggguaaugaacagcaauggcccagagugcccaaggucagggcgagcaacuuucuuccauaaaggguaaguccuugacuuuauuuauuuauuuauuuauuuauuuauuuauuugcaguucuagggcugagacaaagcuagggcuucauaugugccagacagucauccugucccugagcuacagccccaguccuuagacucacugaugaggucuagugaguuugcagagucuuaagugagguuaccagaguccugaaggucacacagacuaauaaguuuccugcucuucuuguucaagucccagaagagagagaucuguuauugucuugugguuuccaaggaguuugcugccccuggaaucuacagcuucuuuccugggcauagacucuuacaggcaacugugcugggcucaggaggaucugcagagcuccugugggccugcucuccagauccuuacagcgugggagacucagcaaaucuucuuuaaggacaggggagauaguuuguacauagccuguaugucagaccuuuuauuugaagauuuuagaaaaauacaaaguucuaaaguauuuagacacuggguaauauacaagugagaguccaaggccagccugguacuuaguguguuuccaacuggcuagagcuucauugugagacugacuuaaaaaaaaaaaaaaagugugugugcacgcuuauauuuaaaaacaaaaaagcuuuaagcuuaaagcagugguauauuguuagugaaaacauuucaguuggcauagaguaugugcacuaaaaaguaagcuuccuauuuucacacuauuguggcucuuucuuucucucucucucucucucucucucucucuccuuccuuccuuccuuccuuccuuccuuccuuccuucucucucucucucucucucucucucucucucucucuuucuuucuuucuuucuuucuuucuuucauucauucauguguaugaguacacuguagcugucuucagacacaccagagagggcaucagaucucauuacagaugguugugagccaccaugugguugcugggaauugaacucaggaccucuagaagaacaaucagugcucuuaaccgcugagccaucucaccagcccguggccauuucuuagaguuaauuuucaggcauguaaaaaucagauuuuuaugcaucugcuguaagcuguuuacagcacauuuacaagagugcaguuuaaauauugcucaguagcuugccuguuuugauuuacauugccgguaucuuuccaugucagucuguuucauucugccuuguuuuguuuucucucuaauaugcauagcugucuucuuguucuagguagggagcuaguuagguccuauacucugucugcuaggcacaguaccucagguagcuguuguuacuggaacagcagcugcccugcucaugaucccucaccauugucucuugugagccgaauaggcagcuuuaaaaacaaaacagaacaaagcagggacagcucuagaaaacgucacaguauuuuuaaaggugcuuauauuucugauguccucaguauuuacagcuugcuuauggaugacccgauuguuauauacaacuuugcuguuguuuuugguuuugagacagacucucacuaucgagcccugguugucacggugcucacucuguagaccaggcuagcucuagcccacagauccaccugugcuggagcugcaggcauguaccaccaugcucagcugcagucugcuguggaaaagaguuuuaaggccaggcuugcuuacaugcuuuuaauuccugccacuggggaggugaguucaagaguggacuacaaagugagucuaggagagccagggcuacacagagaagcaagaaaccccgucucaaaaaaccaaaaccgcaucaaaagauggccuagucggccaucacuggaaagagaggcccauuggacacgcaaacuuuauaugccccaguacagggaguggguggguaggggaguggguggguaggggagaggggguggguggcuaugggggacuuuugguauagcauugcaaauguaaaugagcgaaauaccuaauaaaaaauggaaaaaaaaaaaaaacaaaaaacaaaaaaccaaaaccaaaccaaaaacaaaacaaaaaaaaaagaauuguucauccuguaguggagaaucauggccuauuucugucuugaaaaggauacaacaaggaccuccuacuaaaagcacauuguaaaauaucaauuuguaagacagaacucuguuuuaacucuuaaaguuucuuggguaggcuaaguagaaaauuaacucucaucaggcuagggagugcauauuugagcaaggaacaugcucuggauaggcauguccacauuagacuagccacuccccaaaugauacagagggaaaauaaaggaagucuucaagagcguuggaaacuugugauuacucuguagugucucucugucucuggaaucauguuucuuggugggccauagguggcaucuuacagugugaggaggcaugagccauugucauucaggucacugcucuucccuugcacuugccugccaucccagugugccagggcgggcauugcucagacagagggccugcccuaggauguggagcagcaguguaagcugaaaggagugaccgggaacucugcugaacucuugccccaggagcagcuaggaugcggcucuccccaucuccugagcugugcugagacgaagggcagagcagugccuuuuccuuuucugacagaaccacuuguagucacacuuuguguuucguuuuaaauuaugaaaaauuuaugguauacuguuucaaccaagagugaaacaugcuuuuauggauuggcucucgagaguguuugcuuuaucuaacaaguggauuguggaugcauauggcaguugcuugagggaucaccauguccucacuaugcucuggaggucacucucccguguuugcugugugaccccauccucccugcuuugcucucauucaccugucuuggggucugccuggcuuccuaauuucucucauguguugacuagauaacagccaggauguuauguuucagcucuaagaggaaagggccaacagccugguuccuagauacauuaucaacucuggcauguuaaaggaaagccaguagaaauaagaaguguggcuugggacuuuagcaugugaaaagacccaucuuaaaaccuuggcuguggcugcggugcuggucuugcuugcccuuugcuccugacaagugugucuguagcuccaucacaguagcuuacaagugugcccggagccugacaggcaggugguugugagcaugugcacuucaugcugcucacagucuucagagggcaguguagcccuugacacguaaaacugcacacaccucacugggucuguggccuuauaugagucacaaguacuuuugcagauucugauuauaugaggacuucuuauaacuaggaguuugucuucugggauuucucucagccccucggaugcaggccgcugugccugguugcccugguuacuccaccacugauccucuuuauauccuugaggauaugcaguuuguguguuacuugaacuugcucuaaaacauuuuauuuucuugguuucauuuguguuacuugcgcauggugcaaauugugggcaaacaagucagguuuuucugggucauaaguagguaggugugguggguucauuucagggcaugaugugaaaauaguguuuguauugcuguuuaaugauuuuuccuuuuuuuuauuaggcaagaaaaagucauauuucccacguuguucauggguaacucaauuuguuugcugugcuuucuucucugucuuaaucaugcugugugguggaagacacauuaacaaacugguuuuacuaacugcaugggguggacucagcuuuaaccaacuuuuagcccaugaauaagcucucuugacccuguuugacuugauuaccauugcugugacuugaucacacacacuguugcugcucuguagaacaauagcccaucaggaguugagugccugugcucucagcuaguugagggcugaggcggcaggggcuugagcucaggaguuaggccagcuuggcaacagggugaggcaccacuucagcaaaagcucagcacaguggucuggguggcugagagucucccuguggcaggaugaaguuugaguugagggguggaggcagugcuggguuccaggaucucaucucacugccuucauggggaugagcuccuccugccuuggaguugcuucuguucucuccuuucagaagcugaagauagugaacucucucucccuaugcuuuggucuucacauugaacugggaugguaaacgggagguguguagacuugcccuucucuuucugaacuguugcuauagccuggcuagaggccuggagcugccuggaagugcuccagccucuguuuacacacagggagaaugggcucuggcugcccuccuacuacauucacagguacuccuuuucugcucugacaggccaagcuuugcucuuuguauuguuagaugguagacugcccacuugacuggcuaagaaggugcaguuucuguugcuagagcaucuuucuggauuugcagucaggugguuuuuuuuuuuuuuuuuuuuuuuuuuuuuuuccucuccucuccccgagacaggguuucucuguguagcccuggcuguccuggaacucacuuguagaccaggcuggccuugaacucagaaauccuccugccucugcccccacccccaccccccacccccgccuccccaguguugggauuaaaggcgugugccaccacugcccggcagucaguuuuaccuuagcuagacuugggguauaaauucaugaauuacaugucuggagccuuuuuuuuuuuuuuugcauauuugauuccuaguacugucuccauccuugccugugccuuccauuuaauucugggcauuuauuucuucacauuugcaccugguauauucaaagguuuuucuucuuuugggaaucuuucucauugaaugaauuuaguuuccuggaaggaccucuucaguccaaaaacacuucuguaggccagcuuucuuuucuucugguuuuaacuucuuacuucuugauucagaagagaagugcuaggugagagccucagcucagccuacugccaaguucuccuauucacacagagauguuacuggcuuucuacuagagcucauauguacuggggcauggaacugguuguucacugagggcuucugaguggcuugugacuagaggcugggaagagguaggacgccuggagauagcuggggcugaacaacucacuaacagcucagugggcgaaccugggcuaaugauuggaucuucucuagguuucccucccucuguaacaguggagacgaacuugauccuacuuuaaaagugcauuuaacuuaguccuguguccuguaccauuucugugugagggacuguccuuguggcugcugcuuuugcauaccccagcagaccauaugacaaacucuuggcaaccuacagugugcccaugucugaguuggggguauccugucaugugguugaggacaggaauggagguuccugugucagauacuaggucuccuagguaguucuucgucugguggucgagagcaucaaagcugcucagggucuguacaggcagugacaggugggguugugcggcaggcacugcacgggcggacagacagagugcccgagaccaggaggagccaggccugcagcucuugcaaaaggagauuuaaagagcgagaacucugcugccgagcauagaaguaggacaaggaaugaggcuacgggcuggaguaggguguauuucuguguauggcuuaauccagauuucaaguaugggcuguguucagucucuuaaaacaugaacuuuuguuuuguuuuguuuuguuuuuuugaaacaugaacucuuguuuccugguaguuguugucaaguuccucugcaugucuguuucugugugccauuggugacugcuuaugaaccaguggucuuugcagggaauauauggcuuacuuuuuagagaaugucuuuccuugugagucuguauucagguccuugaauccuucugcaacaagugggggacaguguugggcaagaaugaugcauuguggccccucagagucacuaaugggauggauucuccuaccaagugucuuagacuagaaaggcugagcugccuccugaggucugugucuugcccucuccuuucuccucucccggcuuccugugacugcaugcugguggguggguuugggggugcccuccaccuugcugggugugccugaaugcuggcccuuuguggaacuggguugcuguguuuaagaaacaacaaauuuucucaucuagcuuugcuugcuaagcauuaauuuuuuucaccuugagaaacugguauuagaauagauuuauaacauaauaaauuauaaaccaguaaaauuuaucuacaacucagagaagaauacauuuuguuaaaauuuucuucuaugacauagaugauuauauauguguauauauaauauguauguauguauguauauauauauauauauauauauauaccauagauuauauguuuacauauguguaugcaucuauauucauucuagacuuaacuacauagaucauagugucuguguaaaaggcuagaauagaauagaaccuaggcuguacacugcuugcauuuucuuucuuuuuugggagggguuuguucuguuuuuuuguuuuguuuuguuuugagacaggguuucuccaugaaguccugaaacucucucuguagauguccuugaacucacagagcucugccugccucugccugccgagugcugggauuaaaggcgugcaccacuacugcccugcucuuuucuuucaaauaaacacugaacauaggcaguuuagauagcuugacccuuuuuccuuauaucauuaaauacauucugaauauguuccuauuaaaaguacuauagaauacauucuuaauaguaguauuuauauuucauuguuuguuguauaauuauuuaaugagcucucagaaaaucagaauuuguuuaugguggcucauauggcaaaguugccuagaaaggugcacauggucuuaguaccccaggauugagaacaagccauucuccagugcuuugaauagcugugauccuacuguggguaaggaagaggacuaguuacagaaagcagcuaaguuuccuauguguagagugauuuuaaaugagucucuuuuucuuuuuuucuucccuugcuauucuggucaccccacagggcaguaaauggcuuugauccagcuccuccuccuccugggcugggcuccucacgcccaucgucagcaccggguaugcugccucucagugugugagugcccggccuccagguggggccccugcccucuuccagcagcccaggacaccuacgccucgucccucggugccuggguccagcccugugccccucuguccgccucuucaccgcuggcagagggcaggcugcaugcaguggcggcugcugggcccugcccagccccaggacucugcgcgauaucaauacuggcuauuuucucuucucgccguagugccguugguuucacaugauugcacuuuugugggucacaagugauacauacguguauuacucgaucacuggauguggaaguacccauucaucacaucugccucauagcccccaucuuugcugugcugauaggauuuaguuguguuuaggacauugcagaucuucuagaaguuuccccucaaucagguugauaagaccuucuaagcuucugccaagcaucuucagugcucacaaucauguguccccuagccucaccccugcaguucaggccuguuucugucagagucaggaacaucucugaauuauggaacauugucuguaccuucugacuuuauguaagcaguccauuccauugcuuguuucucaaagcagcgagauaccugucugagcugcaggaggcaggggcagccgggacaugggcacuucagggccgagccucuguguugccuucuccucuguccucagacucaggaggcagguggcaaucuccucgccagcauuccaggcccucaguucaaugacaucucucagagcauuuuuguuuucuccucugaagguccauccaguugcauugggaaggguugaggggccugauucuggggcuggcuaaugccagcucucgggggcagacuggcuagguguuugucccuugcacccuaugauuauucucaugcugcacuuacuguuuacauuuguuuuauuguacauagguuuguaaacauuauugccuaagauauuuguauauaacuugggcuuuguagcuuuuauuuauucagacucauauggcauguuaauuaaugacuuacgaugguguccuacucugggcagcuguauaggaucaucaugugguuaaaagaagauacuucccuccaaaaaaaaaucuuuuaauguggaaacaauaaauuucacagaaaaaaaaaaaaaaagggucgagauugcuuuauuugguuccugcuguuccaugagaaaagacuacauggaggcaguucagugucucuucucccacacggauaugauggagaacagguaggaaaugauaagauugaggccacaggagagacuguagucauguauguuucucgucuuguaccauucccaggggcagccugagaauggccccacaggauggcaggacuggugggcucgccauggugugccuucgugggcccaggcacggcucuuccguuugcacugcauacgacauuguuuaccggaagugcugcaguuagagacauugcaugggugugggcuguccucacacuucuuucccuggguugauguuagcaagugagagaaaguccugguguuugguag

SEQ ID NO: 6078 - RNA, 5469 nt, Mus musculus
uaaaaggcuuuuauuuaauaaacuaaucgacuaauugaauuauugacacaggguuuuucuguguugcccugguuguccuggaacucacucuguagaccaggcuggccucaaacuacugaggaaucaucccugccucccgagugcugggauugaggcaugugccaccacgccuggcuugagaauccuuuauuaauccaguucaugggccugagcaacaccuucuucuaggucuugagagccgaacagugcauggguccuuugccuggaucacagucaucccgguucugagcuguaagccacaguuggcccuucuaaguuagagcagugacuucaagccaacuuuuauguugugcuccagaagccuguuguuuccauggcaauagucacuuccuggaaugcacugaccugugccaagaauacaacauaauuuuauauucuugagguguacacgagaggcagauuugggccaagauccagccgauucuggccuacauuugaaauacuucaagcagaccacacaauucuuccugcauguuacuguaagagcaguuucucuugauuuaaugagguugggagcugcuggauguggguacugugaacucaaccccgggccucugcaaguacaauguguagucuuaacucccgagucaauuccccggcuuccaaugugacuuuuaacuuuuaaagcuuuuugcguuuuuauacguauauauuugccugcaugcaucuacauucccagaguccagauguuaucaggaucccuagaaauugugccaucaugagaugcugcaaacugagccugggcccuaugaaagcuucaacacaaguuuuugagugcugaaucaucucaguuccuaugcucaauuucuuugugggugccggggaccugacuugagguccaaaugcauacauuacacuuuacugauaagagaacuaguucucaagccaugcucucuccugguuuuggcuuuggcuuuuucugaccuggaaugucauaccacagggcuuucagaucagccacaucccccaugcgcuaagcaaguccagcuuccaccucuccuucacugaacccgcgucacuggcugguugcucucuuucuucaccuggaucccuccucacagcuauggaggacaaagugcuuaaggucuucaagucauggucaaaaggcacagccuacaagaacauggcaguguagcagugcagccaugccuacacuugacaacuccuuuccugacuuacuaggggaaagcuguugggaguuuuuucuuuuguuuuuucaagccaggguuuguguauagcccuggaacucacucuauagacuaggcuggccucaaacucagaaauccaccugccucugccucccuuaaaggugacauuuucuuauuuuaaaaaaaaaaaaaaaaaaaaaaggcaauguagccaggcauggaggaucccaguuuguggccagucuggccuacacagugagacccuaucucaaaugagcaaaaaaaaaaaaaauaguaauaauuaggcauggccucguacuccagccuuucuauuccaccugugcucacugugcugccccaggguaugaggccuuggggaucugcugaggcaaccaucuuacuuggagacccugccaggcuuugcugaaacaucagccaagugcuacagugcacgguuccucugguuacuguuagauaccuaaacccuccaacccggcaacagcugccaacugcaggauacuccagacaugguucugucaguccuuuuaggaaauuaucuugcuaauaugacccaggcuagccucaauacuucugcuucuaccucagcuggaauuucugaugugcccacugcugccugcaacucaguuauagcacugauccaacauuagcacagggaaauaaaaucuuaucaccaguaauaaaauucucacuguauugaaaucucagcagccagguuuucuccggugagacaacacauguuuuuccagaguuggagagcuggccagcugcuccuucagaggaacuaagcucaagucuggggacccaacaauuuaauucaaggggaucuggugcccucuucuggcuucuguagacacugcagggauuugauauacagaugcacacacacagguacaaauaaaugucaggguucucccaauauuuuaggcccuaugagaugguaccagccuccaagaccaaacaaccuguaagacucacaaggugggagaacugacucuuaaggguccuuuccagguaccagucgauuaggaauauuuucaacuggcuauuccuauaaauaagggccauuccaagguuuaaauucaucauagcuccugauuccacauaacuugucauagugcuaucagaccaucugaggguggcuguccuuuccagaccccaaagacugacacagaagcagaguaagccacagaaaacaagguacuuggaaaacaccacacaagacaggacuacuuaagcagucuuuaaugaaagccgugcacgagaugucucuacuccugcaucuucucgaucguuucuuccuuguauuugcccuucuccuuuccuacuugucgggacuuggcuuuccucuccaggaucuucuugcgguccuuguccagcuuuagccuggugauaacgaccugcacaaaaagaagcagcccuaagcuuuaagcaacaacguaggcccaauuacaggucccacuuuccauucccugaacccaggguaguagauaccuaaaugucucuuucuaaaauacaaaugaugaugcagcuuuggagcagaagcucagaguuuauccagcuagucuaaucuuaucacuugcugcacuaaggaccagagaccaagaacugaccacugcauuuuccuugaaaacugagcuagugguggaaagcaaaaaccaaacccaaaaaccacuacaauguuacauacagaaaauguucuuucuguuaaagguccugaguucaacucccagugaccacacgguggcucacaaccaucugugauuggaucagaugcucucuucugguaguaucugaagagagcaacaguguacucauguacauuaaaagacaccuuacauggggcgugcauuguggcacaggacuuuaauuucagcacccaggaggcugagacaggcagaccucugaguaccagaaaaacaaaaacucagagcucacuaaggucaugugcugggcuggagagagggccaacagacccacaucuuugaucuacauggguuccacacacacagaagcaaccaugacauguacuaugugguggggaagggaaagaaaucaugguacaauuuuaauacugauguugucugucggucuuuuggguuuucugcaguuugaaaauuacauuuuuagcacuaauuuaagucugagaacccccuuaagugguugcugugcacauuaaacaauccaaucacaaauuuggaauaacugacaugaaaaguauauauaggacagguauauguauuaugggauguucuacuuuggcuuauauaaucaguuuaugggaucacaaccucagcuccagguugcuuuuuacugccaauaccuuaagcccacuucauaaugguguuaucaauggccucacugaucacaggggccacuugcaggugccauguaaacagcaaucaagcaccaaagcuagugguuuccuccuucaaaaacacccaccuugcugggguggaugcccacauggacgguugugccauuagccuucucucgcuggacucguucgauguagaugacguacuucuuccuguacacuuggaccaccuugccaaucugcuggccuuuguaguguccgcgaacaaccugagugcaagugaaaaaaaaacugagcaagggcuagaguguaacccagagaaccagaacugccgaaucauucauacacugugcaccuccagcagacccacacguccccuuuuuggggugggaaugggguuacugggacucaaauccaggaccuguauauacaagguaagcacuaugugaacagugagcuaaauccccaaccuuuucaucuucacagacuggaaacaaaccaggccaaucaccuauagcaaagaaaggcuuucuaaauaacagacaaaucaagacuguugccauccuauagcuguuuucaacccaugucgauccucccaaagaaguguuucauuuuauuaaguauucuuaaaaaguguuaagaugugccagucucgaagugcacacccuuuauccuagggcucuaucuuaucucuuuuccaggucagccaagggcuaccuacacaaagaaacccacccugcguucuuuuaaagacuuccagaacuuaccaaucacuagcuauaaauuacagcuacagauaaucucuccccaauagagcuaauagaaccccacacaaagacauuagcaaaccgcugaggcaggaccaaaaagcacacugcuuuccaguucuuuugaugcaaagcaacccuuucauacaucaaaugcagguuuucucacccccccccgcgccccccaaauaaucguaaaauuccauucagcuucgccucgccaagcaaggacacauaccugaacuucgucauccuuccgaaugggcauagaccgaacguuauacuucugucucagcucuuuggaaagaggggaagacaugaucuuccuccgaaugugagagggcgcauugaaaugccguuugcgguucuugcuucggucagaagucacgaagggauugaacuucauuuuggcuuaaaaacaaacaaaaaaaacaaaaacaaaaaccagaagacccuuuaacguuucaagucucaaccaguucccuaaacagcaucaacuccacucugaaagcacacaacguucacuggaagguaucaugcucgguuacuccagaccuucccaucugaggguuuuuucgucuuuaaagacugaaaacaagaugaagacucugccauuaguaacaccuauccuacuuuuaaacuugacuuuccaacuucagcaucccgggaggguccuacacagcgucggucuuuaccuucucauuuaccgcuucuggugcucugcauuuugccccccacuugagcauggaagcaagggcggaucuccaagcccucccaacuggcgagagggcaaccgcacggcugacccggggcuuaugauuauuuaacuccaucuccaugggccccgccggccuucgaguccacgaaccugguccccuuaacccucuccagccccgcgggcccuggcuaggaaagacacggaccgagcccgccccaguucggcucccuggcugaugccgggccagcaaggccgucucggggccucgggacagaaaagccuccucgccucgccgcggauggcugcggauuaccagcgacaacccgccgagaacucaccggcugcgauccaccgauggccgcaaaaggaaagagaacuacacgcgacuuccgguucuguaaguugccgcgagaucucgcgagagucucggagcgaaagggg

SEQ ID NO: 6079 - RNA, 14329 nt, Mus musculus
cuucaguucccgccucagagacgcaggaacaguuaucuggagaguuugggcggcauuuggugcuccgaagggacaggggaaagauuugcugaaaacaaaaaaacgaccucaaaccauagagguaaauuccugguggggugggguggggccucugcagaugugggggaggguggagaagagaggaucccucagugcaaagugugguuggcucacaccaagguuggaagauggggacguagacaguugugcaagccagacaucccuuagcuaagagggaggcaugaagauggucaugccguucugccagcccagcuugcccagggcugcccacccucauuugaacacccucccacacacacacccgcaccgucacacacacacaccccucccgccacgcagcaguacaggugagggugcaucggaaacuagccuccucugcauaccugcgugccagucuucucuaaccuccaacaucuuggaugccggauuccucacauccucuaggcccggugugcgcauguggagccugguguggcuggggguggugguguccgguugggaggaggaucggauuccuguuuccugccccuacucacucagcucucggaggugacugggaguggagggaacuggaggguaagugcuuggggucccccgacucucugggcucauucuggaguggguaaggaaguaacaugcgguacccgguauggggaaggguggguucccugaaggugcagagacuggggaacaggaggccaagcuuggguaaccacacugacugguugguuuauuggcaccaugcaggggccacugagugagcugcaaucuaagggguuccugauagccaucuuuucucaacuuaaccugggacuggaaggcuaugauuucugacugccauagggaauuuagaggcucucuugugucccagcucuucuccccauccuccugauccucaagagguagaguagcacaggucccaccgucccugggcugcugguucugugccucagccugaacuuguagccaccucccuggcauuagacaggacccagagucaaacuggagccucuuucuaugaccagacccagguguggcaggaauaagaggaugggaagcagaagagaccaggcuggggccuccuggucuccuggggucagaggcuccaggaaucuucagggcaggaaaaggagacuaaaaauaauccggaaagggagaguccggagagaggaacugggaaaugggaggggggaggagaggcagccagaguagggaaacagugaugcaucccucagcuccugcaccacacacacacacacacacacacacacacacacacacucacucacucacacacacacucacacauacacacacucacaauacacacucacacacacauauacucacacacacauacauaccacacacacacucacaccacacacucacacacacauacacaccacacacucucacacacacacucacacauacaccacacgcacacacacaaacacacacacucacauauacacacacucacacauacacaccacacaacacugucacacacacacucacacauacaccacacacucacacacaccacacaccacacaaacacacacacauacacaccacacacacacacucacacauacacaccacacacacacucucucucacacacacauacacaccacacacacucucucucucucacacacauacacaccacacacaccacacacacucucucacacacacaccgcacacaccacacacacacacacacagugcucgaaccacauauuucuugaugugucugugaccagccacgacugacuccacucuuccacaacacagcuucccagggcacacucaacucucacucauccagcccugguuaacagcgcacacccgcuuacauaaacuccuacacacagcaacuacaccagcaaggugauuucuccucauugaaucuugcuaccccugccuccccauccuccccaacggccugucccuaccuccccccccccccccccccccguccucuuggcuugacuguggcagcaaaaauccuagagaagcuggacauugugauacagcuccagaggacggaggcaggaggaacagaaguuuugaggccaguccgggaugcugaaugagagaugcugucuuuaaaaaggaaaagcugcccaggaagguccaggggcagaaugaggaggggugaggggugaagagagaagacaguagagaugagaagggagggaaauguaucagccuucucuccugacuuaaaaacaaaaacaaaacaaacaaaacaaaaaaacguggcuucagacagccucagucucuccacccaggggacaauaaggggcacuuucucuuuccacccuccucaggggaugacuuccgcagaacaccccacuccuuggaaacacucagaagacgaugucugcacagucucuuccugcagcaacgcccccuaccuugaagcccccucggaucauccgcccccgacccccaucucggcauagggcuccacacuccccggggccucuccacaauggcuccucuccgaaagcacuuccucaaauauccaaugaugcaucggccucagugugcaccuccaucuucugggagccccccacggcuucccugaagcccccugcucuucugccucccucaguuucuagaaccagccuggacucucagacuuccccugacucaccuuccagcacaccgagucccagcccagugucccggcgcuccaucuccccagaaccagcucccugcucuccggugcccccacccaagcccucugggucuucccgaacaccucugcccucgggcccuacgccucuccaggauggcucugcuucggccccuggcacgguucguagacuggccggcaaguuugaauggggagcugaaggcaaagcccaguccucagacucccuggaacgguguucccaagggagcacggaagugaauggggagaaagagacucccgaagccgcccuuucugggaaugggucccaggagaacggcacucccgguaagcauacgcacccggugcagcggggugaccucaacauagcuuuguuuucaaugcuuaaagacuuuaaagggcuaacauuucuucuaguguagauuuuauguaugagaaaucuauuuucuguguuucuuagaguuugcagauagucggggcgcaggagaucuauagauacccggguuugguccuugaugugggacgaggcaggaaugagccaggccccaagaacuuccugcuuaggcaaucccuucuucacagaugcugcccuggccugcccuccaugcugccccugugucugccauguagcaaagccuggccuggagcuccggugggugccuguggggaguucugaggacauccucaggauccccugccgggcauccccacuccgagccucccgcucccgcaucaauccuccagucaucagucacccuccaguugugcucacguccuaucgcuccacugccgagcgcaaacuccuaccuccccucaagccccccaagccaacuaaagucagacaggauaucagcaccucugaggagcuuccacagccagaucugaaacugccuucagaagaugggauccaaacugcuacaaaggccugggaagguggggagauggggcggagccuggagugguaggaucucugggcuuugggaacaccgggguggggugggauguggggugggggauguggaggagggugggaugugagggguggggauggggcugaguggucagcuacaccccuaucgcgcccuggacucuuccuuuuucuauccucuguggcucuggaguuacgggagugguauucucagugccagucuucacuagggcuggggcucagugucuggaggucacucuggcuucucucugcaggggacagaccugaaggagcuccucugaaugcucccccuguagccuuggagggaagguaccgaacuccccaccuuugcucucccuucuugccucaccaugcucucaccuaagggcagacuaacuuuccgaguuuggaugaauacuaccuuauucagguagaaggggaagagccggggcuccagacacaaggagcccagguuucuaaucugaccucuguuccuuauuaguuaugcaaccuuaaauggauucuuuuccugggucucagaaucuuucucuaagaaguagggauaagcacacucuguucuaucggguuaucaaggcauaguaacccaauaucggguuaugaaggcacucagcagauugaggcaggaaaauuaggaguugaggccagccugggaucuguaucacaguucauauucaaaacaacagcaacaacagaccaaaaacaaacaaaagcaacaaacaaacaaacaaacaaaagaaacaaaaggcagggccagguucugcuuaaauuuucuuauugugaguuuauauuuaaaauguuuuaaagaucuauuucuauuuauuuauuuaucuauuuauuuuauuguguuuuuguuuguuuguuuucagacacaggguuucucuguggcccuugauguucuagaccuugcuuuguagaacaggcuggcuucaaauucauauagaucuuccugccucugcuucccuagugcugggaugaaaggcauacagcaccaugccugaauaaaauuuauuuuuaaauaugugugagugugcgcucauggugcagguccuccccaccccacccccacaccauaggcugaguuaugaacaagugugagcuaccugaugugggugcugggaaccaaacucgaauccucugcgauaguccauucucuuaaccaccgagccauuucucaaguccucuauuaaaauuauuguuggccgggcggugguggcgcacgucuuuaaucccagcacuugggaggcagaggcagguggauuucuaaguucgaggccagcuuggucuacaaagugagugccaggacagccaggacuauacagagaaacccugucuugaaaaaaaaaaaaaaauguuggcaaaaccauuuggcaaccauggccauccauuguuuuccggacuugcuaaucacccuagauuuuuuuuuaaaucagaaguaauaaucuaaguaugcucauuuguuagaaaauauuuacuacagcagccuguagcuugagugaauggcuggcaaccaggaaagaggagacagggagccacaggugccaguuugaccauagggaguuauaccaagccacacagaucuuccagccugugcugcugugagagagggcuggggggagggacguggaagcaucuacugcauaguaguugauacagcaggaaugcuugaggaccugauuugucaagggccucccccuccaaccggcacaaacaucuggaauuugaucuggggaacugucaggaucccuccacacauugugcaucucucucgucugguauccugugaauuaacacguggaccucacauguauuccuuucuuucuccucagggaggaggaaggauuggaugggcugaaggggcugcagugggaacugccccugcaggacgguaggucuuuacugggacaggcaggagggaccgguuccgggggcccuggacuucccugauguucucugucuaccuuccagaaccuuuauaccagacuuaccgagcagcugugcugucagaggagcuguggggugugggugaggaugggggucccucuccagcuaauccuggagaagcucccaccuucuccaggcucccuggaccucgaaacacucuguggcaggagcucccggcugugagaggcaguggccucuuagagagucuaagcccccaggagcggcgcaugcaggagguggguacccccggguggaacugagaagggugggauaggggauagggaagguacgugaccagagucuuggggugguugugagguggcugcccucucgacugacuguggcccugcucuccugucuagagccuguuugagguggugacaucagaggccuccuaccugcgaucccugaggcugcugaccgacaccuucguccugagccaggcucuccgggacacacucacgccucgggaucaucauacgcuguucuccaacgugcagcgaguccagagcgucagugagcggucaguggggccccaucuucccaggacucugggccuugggcugaugagcauccccucuggcuuucccccucuucuggaucuuuccuuucacugacccaguuaaugcuuagcacuccccugaaagacuaggaaaaccagacuuucaguacgucuauuaaucgcuccgucuauacuuucagguuucuaggaacacugcugucucguguucguuccuccccacacaucacugaccugugugauguggugcaugcccaugcaguugguccuuucuucguguauguggauuauguucggaaccagcaguaucaggaggagaccuauagccgccuuaugugaguauaauggcuuccuccuuucucccugggaauguguuccaaagccaccgguggauauggcggcuaguaccgagcuauauauauauauauguauauauauauauguauguguauaugcauauguauauguauacauauaugugaaaacaauuuauaaauuaggcccaguaauagauuaauaauaacuaaugaugaaauagaaauauuagagcaauauaauguaauaaaauuauccacaucacuagucuccuaacuuuguggacauuaguaaguaaaauaagaauuuccuggacauagcuuggcgauaccgccaagagucaauuugaugaguaggauauauauagcacuacuaagugauuaaggggugggugguguauauacaugaguacacuggacaaagggauugauuauuaguguuccagauaagacaucuuaagauggggcaucuugagguuuugucguugcuaaucagaaaagcauuugaaauauaugaacuguuugucucuggaacauuccauuuaaagauguugaguaauugaaguuaugaaagcaagccuuuaaucccagcauuugggaggcagaagcaggcagauuucugaguuugaggccagccuggucuacagagugaguuuuaggacagucagggcuacacacacacacacacacacacacacacacacacacacacaaagaaagaaaaacagaaaaaaaaacccuaugaaaauguaugaauuuuuuguuucuggaacauuccauuaaaguugcuagauaauugaaauuaugagaggauaagggguuucuguaucccagaguuggaggaacuccugaaaucauguuaaggcugaggccggagcuggcugggggccauucccuaagcaucugggcuuucuuugcagggauacaaacgugcgcuucuccgcagagcugcgaaggcugcagagccuccccaaaugugagcggcucccgcugccaucuuuccugcugcugcccuuccagcgcaucacccggcugcggaugcuguugcagguacugacucagccuccugccugucccaucccaccaagccugcuguggaaacgcuacagagugucugguguaguuaucaccauuuccuaccccaccagggccacagaaguccucguggggcaacagcucccagacaguccucagcucccucauugccucgggggacagacugguguagagaaggacuccagacuuuuccacucaccucuaacuaguugagauauccaaaggaacaaacagugguuugggggaggacugaaaaaaacaaaccuuagcuauuccagcguuugugaacuuuaaagggccaugguaaauaugcagauuuauaguguaucuauccaguucuauuuuuuaugguggcuguagaguaggcugagagcugcagacagcuugccuagccuguacaaagguaggccuuggauacaguguaacugacuaaaacaguaagugaaaaaguuccucagugggauaauacugaggaaaaaaaaauggggguuuugagaaacacuguuuuguuuguuucuuucauuuuuccagacaggguuucuuuguguagccuuggcuguccuggaccuagcgcuguaguugaggcugaccucaaacucagagacccaucugccccugagauccagagagcugggaauuuuuucuuuccuuagacgaggucucguuaugugguuuuggauggcaugcucugcauuccaagccggccuggcaccacagagaugugcuugccugugccccuagagugcugggaucaaagguguguaccuccacaccuggcaguauuggaaucuuaaugugaagaggcuccaacucgaugcuggaaacaucuuuguuuugagauaguuggcguugguguuugucuuguuuuguuguuguuguuguuguuguuguuguuuagaauucaacacacagcucaggcuggccucaaacuugcagucuucugcuccagucucuugaguguugggauaacagguguguacauauuauuguuuauuuaguuaguagguuaguuuuuccagauaaaguuucucuguguaucuggcaucuaacucacagagaucauccacuugccucugccucccaaguagaaggaucaaaggcuugugcgccaccacugccuggcuuuaagauguauuuuauuuuauguauaugaguacacugucgcugucuuuagacacaccagaagagggcaucagaucccauuacagaugguugugagccaccaugugguugcugggaauugaacucaggacuucuggaagagcagucagugcucuuaaccacugagccaucucucuagcccccuuauuuauuuuuuuaaaauuuaauucuuuuuuuguaggaggauugaacugaugccucacucaugcuaaacaagucucugcacugagcugugaaaccaguugccuugaguuuuauucagccuuguccggcauucauguagacagcauacuaacuauaauaccauacuaacucagugauugcugagugugcaguuagagacccccuucuaaaugugccacaccucuauaacccccgugacaaaugugcaagggcaggaaccaucauuuacaagaccuuauaagggaagaaacagaggugcaguuugaauaacuuggcguaguucauguaaaaauaauggauggagccaggugugaugguacguccuguaauuccagcauuccagaggcugggcagaaggauucagaccuaaaagccagccagggcugcuuagcaaaaaaaaaaaaaaaaaaaaaaaaaaaaaagaaaagaauaaaauaaaauaauuaaaaagauagaaauguagguauuucuaacugucuggcucuauuguuaggcuaguaauuauuaaaacccaccaccaccaccaccaucuauguggugugccaagaacuauacuaaauccuccuuauaaaucacuuugauuccuucuaauguuaacaugcuaaguagauaucagcuccaucuuauaaauggagaaaccuaggcucugagcacuaaccugauuugcucaggcucuggcagcugguaaguaggucuuaauagaucucaacccuaaacggaacaccuagcaaagcugggcugggcgcugaggaucucaguucccuuccucuuuguuuccagaauauccuaagccagacagaagagggguccagucgucaggagaacgcccagaaggcucugggugcugugagcaaggugggcaggagggaagcugcggagggaagaggugccaagugacagaggggaaugggagggaauaugcugcgaugggugacuggaugcuucucaccagaucauugagcgcugcagcgcugagguggggcgcaugaagcagacggaagagcugauacggcucacccaaagguugcgcuuccacaaagucaagguuaguccagcccagacucuccauuuagccuuuacucaccaugcuacccugaggcuagagcaucucucucucucucucucucucucucucucucucucucucucucucccucccucccucccucccucccucccucccucucucucucucucucucucucuuuuuuuucuuucucccaggcucuaccccuggucuccuggucacggcgccuggaauugcagggggagcugaccgagcuggggugucggagggggggugugcucuucaccucccguccacgcuucacuccccucugccuacugcucuucagugaccugcugcuuaucacucagcccaagagguggguccugcgugggaggggagggagccugaaccggaguggugaagaggcaucuagcaggaccccugcucuccucugaacgcccucuucccugggcagugggcagcggcugcagguucuggacuaugcccaucgcucccuggugcaggcccagcagguuccugacccaucuggacccccuacuuuccgccucucgcuucucagcaaccaccagggccgccccacccacaggcuacuccaagcggccucacugugagucacgucuauagaaagcacucuugggggcuggggaugugguuuaguuguagagagcuugccuagagugcugaggauucaauccucagcagccaaagaaaacaaaccaguaugguagccuuaccuuuauucucugagcacugggaagacagggauagauagggggaccaugaauuugaggccaucuugggcagccucaucaaaacaagcaaacaagccacucuuaggacccucagacucuguauucuauuucuuuucucucuguugcucuuacuuaccaggaguguaucucuuaggccaaccaugaauccuccccacccccucuguucaccacuagaucagacaugcagcgcuggcugggagccuuccccaccccagguccccuucccuguuccccagacaccaucuaugaggacugugguaagcaucucucaaagggaggagggaacaaaaugugagucuaaggggaaugugaagagcgagggguccaacugacccacauuucaccagaguguucccaggagcuauguucagagccauccacaccuuccaagacugaggggcaaagucuggaguccaaggccccccgaaagcaucugcacaagaauccagaaggugagcaagccuuucgucuacucuuucagcaaguauuuaucgaacagcuugagccaaacccagaaugugucaugcucuacccuguaugauuuuuuuuuccauuccagcagugcugggaucaaguccuugccuuacacaugaugggcaaaugcugcauuaaugaaccacaagcuggcacuggagucugcuuucuaaugagaagcagacaguaaaggcuaagugagccugguguggugguggugcugaugcuggucucugauuuuaucacuugggaagcauaggcaaucggaucugugugaguucaaggccagccuggucuauacagugaguuucaggcuagccagggcuacauaguaagacucuuucuccuuuguuuuuucaagaugcagguuucugucuagcucuggcuguccuggaaccugcucuguagaccaggcuagccuucaacucugaaaucuaccugccucugcuucccaagagcuaggaugaaaggcaugugcucccacugccuggcugagacccuuucucaaaaaacaaacaaacaaacaaaaacaauaguggccaauaguguaacucuguaguuucaguacuagggagguugaggcaagaggaacaauauuugauuggguugcauagugaauucugaaacagccagaaguagauagcaagauacugucucaagcaaaacaaaucuaggauaaguaaaguuacauguaguuacauguaguauguuagaaggggauggaugcaaugggacaaaggauggagaggaguaagguaggcggggguucuaggguuccauggaauuuuacauaagcaggagguggaguagguuugacagaggugaccaaccuagacauucagugucuggaggaagagugaaccagugggagggcaugaacagggcaaaggccuaguaccugcugugcaauaggaacugucaggaggccagugugcccagacugacucagagaagggaaugauggaagcaaacgaggucacagagauaacaaaaaccuugcagcccuugcaaggauucuuucuuuagauugauuuuucuuuucuuuuucuuucuuucuuuuuuuuuaaagauuuaucuauuuuauuauuuuguguaugaguguuuugccuguauguaugucugugcacaugugugugccugcugaggucagaagagggcacuggaucccuuuggcacuggaguuccagaugguuguugguuaccacguggaggaugggaaucaaaccuggguccucuggaagagcuccaauuucucuuaaccacugagccagcucucaagcuuagaagcucuuccaguugagugacgugagcagucacugcaggacccagcagagaagugacacagacccucacggauguugauagccuuuccaggagcacuagugacugaaguugaaugcucuggucuuuuccacuaauccccagccugggaccugagaccugaggaucccccucccucauccccaucaccugaccucgguccugcuccacacaaaccuuucuccccucuucagguuggcuuaaggggcuuccuggagccuucccugcccaacuggugugugaagucacaggagaacacgagaggaggaagcaucuucgccagcaccagaagcuccuugaggcuguaggacccucuucaggcacuccugacaccccucaaccuuaaggcaggcuagggaggagcacagauugggauacuggcagcagcauggggaagaaaaagucuauccauccaucuguccaaccguccaaccguccauccauccauccauccaucuacuugcugucaguggaaacacuaccucuagaggcaaccaauagggauagagcagcuaaugaaacaagaccaucugagcccacgacaaggaagaauggggauggcucgaauguguugccaauggagacaggggaugaguacagaguggccaaggcugaggccacggccagaggguaucaaaguauguccacaaccaaggaagauuaagcaggggcauugcauugagaaaugacgucauugaaguaguccuguagacaacagggaugggaugggaccuauccagccagagaagacggugauuugggcucaagagagcaguagucacccuuguugguuuuacagaagccacugguccugcuuuuugaguauaggaaguauuaaauuaaucuaauacuucuguuugagggcuacuuucuuugcccauuuuaaaccacuuccuuucuucuagaagaauccagagugcaucucagagaauaugagugcauguguguucauguauauauguaucuaggaaggcaacugugcugaauguggugugugugugugugugugugugugagagagagagagagagagagagagagagagagagaacgcaccucuccccucuccuguuggugacugaauacuuccuuuccucuaucaucucacauuuauccucuuauuuucuccaaaaaaagccauaugcccugagaucuaaaaaaagaguacugagcauagcuugcccaaggacugggaccgugaaugcaagccauggauucagggucucccgggugucucuggguucuaugacaguugaaagcugguauuaugaagcagcugguggcccgcaaggaaggcacugaggacuaagccacugggauuugagauccucagcagucuguggaccucuuccugucccaggcauugaccucugugauccaugucugcucugugucaucucccgacuugaauugucaucaugaugucagccagccucgggcugcagaacaaguuggguccugggucagcuggcaaccauccugaucuucuucuauccugauccucucagaagcagaaggcugaacccaggagggaguagagagcugaugguguuacucagacucaaccacgguuucugcuagagaaccugcccugugugaugcuggagcggugaaggcaaaggcaguagaauagacaauugcugggcuuggggcccagaccugggcaaaggcuuucuaaaucuucaggacugugcaauacuguuccuucauguaugacaaccugcccagauggagacugcuuaggugacuaugggagggguaaugagucuggggacuugaaggcaauagggcacuuuguguguccacagcuuucauccagcaaagugccagccacaugggaaacccucaauaaauguugcuggaaagagcag

SEQ ID NO: 6080 - RNA, 676 nt, Mus musculus
gguucuggggagauggagcgccgggacacugggcugggacucggugugcuggaaggugagucaggggaagucugagaguccaggcugguucuagaaacugagggaggcagaagagcagggggcuucagggaagccguggggggcucccagaagauggaggugcacacugaggccgaugcaucauuggauauuugaggaagugcuuucggagaggagccauuguggagaggccccggggaguguggagcccuaugccgagaugggggucgggggcggaugauccgagggggcuucaagguagggggcguugcugcaggaagagacugugcagacaucgucuucugaguguuuccaaggagugggguguucugcggaagucauccccugaggaggguggaaagagaaagugccccuuauuguccccuggguggagagacugaggcugucugaagccacguuuuuuuguuuuguuuguuuuguuuuuguuuuuaagucaggagagaaggcugauacauuucccucccuucucaucucuacugucuucucucuucaccccucaccccuccucauucugccccuggaccuuccugggcagcuuuuccuuuuuaaagacagcaucucucauucagcaucccggacuggccucaaaacuucuguuccuccugccuccguccuc

SEQ ID NO: 6081 - RNA, 676 nt, Mus musculus
gaggacggaggcaggaggaacagaaguuuugaggccaguccgggaugcugaaugagagaugcugucuuuaaaaaggaaaagcugcccaggaagguccaggggcagaaugaggaggggugaggggugaagagagaagacaguagagaugagaagggagggaaauguaucagccuucucuccugacuuaaaaacaaaaacaaaacaaacaaaacaaaaaaacguggcuucagacagccucagucucuccacccaggggacaauaaggggcacuuucucuuuccacccuccucaggggaugacuuccgcagaacaccccacuccuuggaaacacucagaagacgaugucugcacagucucuuccugcagcaacgcccccuaccuugaagcccccucggaucauccgcccccgacccccaucucggcauagggcuccacacuccccggggccucuccacaauggcuccucuccgaaagcacuuccucaaauauccaaugaugcaucggccucagugugcaccuccaucuucugggagccccccacggcuucccugaagcccccugcucuucugccucccucaguuucuagaaccagccuggacucucagacuuccccugacucaccuuccagcacaccgagucccagcccagugucccggcgcuccaucuccccagaacc

SEQ ID NO: 6082 - RNA, 6247 nt, Mus musculus
uggcgcugcguuccaaggacccgagaguggccgcccggccucugcagacuaccucggguaaaggugcucuagcucccgcagcuacuuugccacgcuuauucuuagccggaauccuaacuucuuucacaacccuccucucgcuguugucgagccaccuucggcuuuucccucugauucuuuuucuguuguugcuuuucuuuuuccugcuucuccagcuaccauuucguaacuccguuuuccuaagauacgcucugguacccccauccuaggcauucccaccugccagcuucuaacuucugcuccucccugaucucaguucccuugucaacagggccuuguugccauacccuacuacacuccucuuucuuuccuuuugcuaccuucugauccccaaacucccucuaaccucacuugacuucuugacauuugacccagacaauuuagcucucuuaaauuucuaccuguugcagccugggcuucaaagagccagguguuguucauauccaucccugcuuucugaagcuguuucuaccuuuaccauggacuucuuaaugagugguguagcagccuguggagccuguguguucaccaaucccuuggagguugugaagaccagaaugcaauugcagggagaacugcaggccccaggcaccuaccagcgccacuaccgaaacgucuuccacgccuucuucaccauuggcaagguggauggccuagcugcccugcagaagggccugggcccugcgcucuuguaccaguucuugaugaauggcauccgacugggcaccuacgggcuggcagagucucgggguuaccugcacacuaaugaaggcacccacaguccuguccgcagcgccgcagcuggggcccuugcuggggucaugggagcauaucugggaagcccaaucuacaugguaagaagaggggucugucuggucuggggcuuucagaaaagacuuuuggcagagggugggagccugcccuuuacaaaggcauuggugacagggugcugugccccauaagcagaaaauggcacaggaaaaugcuggcaagcuucaaggccuucugaucugccuuauacacagacacccaacagacucugcaauguguugaugaagauuacagacuuagcguaaggagaacuccuuugaguuggggugucauuuguuuguugaggcagggucucccuauauuguaguaucaacacuugcucuuguagcccagccuggcuucuaacuacaguccacccugagucuucucagugcuucaguuaacagguaugcauccuagcgguaugcauucaacugaacuuugaaucacacuuccuagcacucauuguugccauguugauaagacaggaauaauuauagacucuugugaaguugcugagaggacugaaggagacacaugagauguacauaugaaggguucauauagaucccggcagauggugggcaucugacaauauuccucucuucucuucucuucucuucucuucucuucucuucucuucucuucucuucucuucucuucuccucuccucuccucuccucuccucuccucuccucuccucuccucuccucuccucuccucuccucuccucucucucucucuccucucucucucuccccucucccccucuccucucucuccucucuuuccucucucuccucucucuccuuucucuccccucucucuuucccucuuuucccuugauacaggcagagccuggcuauaugacccaggcuaaugggaaacucacuaggaacccaagcuggcgugaagcucuugcuccuccuugccugugccacccagaugcucugauuaccaauaugugccaccaugcccagugcagcuuuuacugucuuauuccuggggcugacuuuguguagaaggaugaggaaucugagaaacaggcgucacgaaguguaggucaggaaagucccgggcaucacagaauuguacacacucucacaacuugcuccugugaguuaucagauggugaagggcuggaagccuggauccagagaggguugguguccugcucaaggucacacagcuguucguuacugggacuaggccaggcuuagugagccaaggagaugaucuuacaggagcgccaacuuggucucacuccuaguguaugagauuugaggacaaaggcaucuucaaaaaucagcugaauuugugcccuuaggguagucuugacagggaggcugguggagguggcagcuggagaucugaucuggaaugggagcuggcauaagaggcaaggcauccagaacuuuccuaacaugaagucuuaggaaauauuaccauucuccgaucuccacuccccacccccagccccaagggaaguaggaugugaagggggcggggcaucuugcaggccuaagagauccguccccugggacugcagccaagggacagagccucaugaccaauuuguuaagugggaaaaacaguaauuaccagauuaaaagaauauauucauugcuuaauacccuagaggaagugugagugagggcuuuggguguuuuggucuccauggugggaaagugaccccugggacacaggcugugauacuuucuugucuccaggugaagacacaccuacaggcacaggcagccucugaaauugcuguagggcaccaguauaagcaucaggugaggguuccccaaaccacuggagcacccgaccaucuccccccauuuuucccuaacuuucugccuauagcuggcagcuccaucuagccacugcuuugcccgaccccaucaagccccgcucggucagacccuagagcccguccucacccucauaucccuugugccucaacucuccugcaccuguuuauccugccccguucucuugaccugcugagguccuccauuccauaccuccagccugaacucuggguuggugaguaucagcagacaccugagggccccuacacuggacuugcugucuggacaacaggugcauagcacuugucagcuuuagcaggaggcagucgcugaugcuggggugacugaaccucaaccacauggucuucccccccagggcauguuucaggcacuaaccgagauuggccagaaacauggucuagugggguuguggcguggggccgugggcggccugcccagaguugucaucggcuccucuacccagcugugcaccuucucaucuaucaaggaccucuugagccagugggagguacuuccugggaacggguggggccaucccuggaaugggaaacaaggguggaaaaagggaggugggcccugguucaaaagugagggagcuauaggaggacucgaggaucagugaucccuuaggaugcugccaucaucuccuaacagaagggguaccugagcccucuggacacuccuucaguuaucacuguguuaucucugaugguauggaagcucccagaauuaccaguuguguucccagggcagugcucauccugcccuaaaguuaaacaacugugugguugauaaaaaaaaaaaaaaaaacaaaccaaacaaacuuuaucuuucuuauagaucuucccuccccagagcuggaagguggcucuggccgcugccauggugaguggugucgccauagucguggcaaugacacccuuugauguagccagcacaagacuuuauaaccaacccacugauacucgaggcaagguaaggaaguacugcaggguccaggcugacagggagagcugggggugggcaagcagauccucagaugcugccuggaaaggugucuggccccggcgggcucugacaugcaccuccugugcucucccuuccucucugacgugcuccagggccucauguaccgggggaucuuggacgcucugcugcagacagcgcggacagagggcuuuuuuggcauguacaaggguauaggugccuccuauuuucgccucggcccccacacuauucucucccucuucuucugggaucagcugcgcuccuuuuacaacacauaugcuaaauaacaaucacucucuuguaacuccagaucaacacucuuugggcaccucugccucuacuuccuaucacagugacugcugacagauugaccucucaaugccccuaagggggacagccacgcccacuccucuguucuccuaggguugagucacugagugggucuugcuuuaaauuuuuccacaaaucccccgauauauuucauacccaucucaggguugaaucagucacuccaaaguauauuucuacugccauucuuggguuccccccaacucccugcuccuauacacagcuuuaacuccccccccuuccaagaccaaagggaacugggagacccagguguccucuuagauuugaaggcacagaaauuauguucuucauaaagcaaguuuauuucugcagaggaagugucuuauguuuacauccagggaagaagcagaaagaaacucccccucucagaacuggguccccgaguccucaguagcacguugugucucaacgaucuuuacuggggaccaaagagguugggaucaugaagagucaaacuaguuaccagcuguucaaaguuacucaggcuccaagguggacaugacagauuuucagggccaagagaccugcugugacaccuuaggguaagggaauagagggagaaggaaaaugguccggcuugagguuugcaagaucacacuuccuaucccccagaagaccugacccuccucccccaaagccuguggcuuauuucugcuuccuugaaggaauuugacccacccaacuuaauugucguggggacccaauugggagguucccacccgcucuuucguccuuacgggggcugauugaaggugagcaaaagaucagucugauacuggggcagccgcagcaaggccugaugcagugugacauccuuugcuaccuaaagggaucagaaucagcaugcuuaccaggauaccuggaguuaucccuccccgacuccagggcgucccauucgccauagcccucaccugcugguuuucuuuagcuaccugcugcuugccagaaagggaccaggcauccugacagcagccucucagggauaaguucuccaaacagagaggcugcacagauagcacgugcacagcccuagcccccugcacccggccaacguccucaaaaugguaccuggcaugggaggaacagugguaaggaggagcaugucugaauaacccagccccacccucgagccuggucugcuauugcccuugggaguuuucguccugaauaaccguccagccacagaccccgcccacuuucucggcucccggccucccguuggcuagcuuucucaccgcgcagccgcuucgcccugcacgugggccugcagcuccagaaguucuaugaucagacucuggucggucacaggauggcagaaaacuucuugguugucuggcaccggucggaggucacuggagagggacagggaacccucuugucucuggcuuuuucccauaacccacccgaucggccuccggggaggcuggcuuucucaccucacaucaauggccccuguagggaggauggcggagaaggcgccuccgaacaguggacaguuucuguugggcuccauagaucuaguacuugagucuggacauuagcgagguuuuaaagaaaccuacaugagccuuugagacaucauuuccccugguguucccggagcacccacuaccuccucccguccuacuaagcaaugggaccuuuaagaucuggucacgcccugcgagcacgcugaccaaucggcgcccgcgcuucgggggcggggcuauccuugggggcuagucucugaagcccggcucuuuggaaagacccaggaccgcuggggucugcuuugcaguuguacuugaguuuaggguuggugaugcuagugauggguuaaucccucgugcccacuugcuccuucauuguaaaggaguuauaccuucuaagaaggucacuugagaccgcccuuaaggacaguuguucaguuaaagggcggguugugggaccacuugacuccaguggagcgacaaccagaccacuaacuccaggaucuaaugcugggacuuggggaaacaacaggcccaggugugggucuagguuaagauucagaccucaagccuugauaccuaacccgaggauuacgguucuaauccccucaaaucuuccccuagggagggcaaggggaagcucucucccacaccugagccaaagcacagauuaaacuauuguuuuuccuuuacgga

SEQ ID NO: 6083 - RNA, 1698 nt, Mus musculus
ucuuguguucuuaugcacuuuauuccauaauguacaaacauuuuucugagugaauauucaugaccuucaccaacauuucaaagagacucauggcagggcugaaggcuugaagcugcugcauacaggaacuauguugccuuaacucuuccauaaagggaugcuuggcacugauuugcugugucucugggggccagggcagucuuuguuuucccccauuuagauuuauauauuuaauuuuaugagccugcaccgaugcucuccaucuggucuaucuggugucugugaaggucagaagugggcaaauacccuggaacuagaguugcagaugauugugagccaccgcguaagugcugggaauugaacccagguccgcuacaagaguaacaugugcucuuaacugcugagcuaucucgccaggucccuccaagccugucuuuugguucuuucaaagggcaaggaccaucccagagcaccaaaccaaaccuguuccaguuguagguuggcuguccccagcagacugagagcuggagacacucacacaaugagaaggacagaugugugccaucugagacuuguccaugacaccugcccuagcugcagcuggaccaguuuucacuggacucuggcuuccgggaagaugcaaguaggagagcuugccaaauagguucuuucagaucaaaugacaacaaacugacccagacagcuccaguuucuucaggaguuugagguugaacacccugaggugucagcauugagaagagcacaagagauggcagauaccaagggagggauggugaaucaacaguggggauauagagaucugccaagacaagcuggucuuccaccccacccuccaaggagagaucuggcccugggccuuggcacaucucugcuccccacccuugucauaucccaagaacccagagacuggagaaagcugaggucuccagcuaucuuaguccacugcagaacuugaggugcgccaggaaauccuaagaggaaagcugaagaaacuuucuccucccucuggcucauuacagggcuccauuccugguacuuaguguuaugaacuuguuaauagcauuuauguccuuggaggucccuacccaaggauuucugaucugccugacuguguacaaagcuauucaagcuguuguugcuccuggugaggaggagagacagaaaggucuacauggagagacguucauggccagcuccuucuauuccaugggggcugcaccccuucucuuacagaguaaacuaguuacaggauacccccccccgaaacagauugaucaagcacacccacaucuugucucuucucucccucccucccucccuccuucucuugccugaggaagggucucaauauauaacccuagcugaccugcaacucacuauguagaaacaagaaacaggcuggucucaaacuacagaucugacugcuuuugucucuucagugcuggaugugccauguggcgugagccaccacacguggccacacuucacuccuaacagugcuuuagagaugaggaaaaguucagagagaagccagaugccuacaguaagaaggagucaccgcacgccuuuaaucccagcacucgggaggcagaggcaggcagaauuucugaauucgacuccagccuggucuacagagugaguuccaggauagccggggugggggcacauacugaguac

SEQ ID NO: 6084 - RNA, 20565 nt, Mus musculus
aucuguaauucccgccuuuaggagucagaagcggaagggucgcugcaaauuuaaggccaguaggcuccuuacggcaaguucaccgcaaaaggucccugacgccccaguacccugguggaugcagagggaagaggcagugcugcucccugacgucacagguucccucccgugagcacuugcgcccggaguucgcgcguucuucaggguagggguuuggcucaucauggcugcuugccgagcacaaccaccuaccuccgugagugcuguuugugugauucucguggguuuuuuguuuuguuuucccuucuuguccugaauuucuuuucuuccuauacuccuuccauccauugcccauggucuuggccuggggagcggaggcuuuuccggcccuuuguuccagggucgaccuagccuggaauacgucuccgcccacugucgaagguuuacgcucugugggagauuagccuugcugguuguugugguuacaggggcccucugauuuagcugguuugggaaaggagaaacgccccaguccuuggauggguaccccgguuagcuaagcgggaaagcaucagaaaacgguacuaggcagcagaagccauuuugcuaagcaagaguuaaagcaaauaucguuugaaaagcuaaaugccauuggguggagguggaggggucagaaggaauagugaacugucuugacuugcuaagcaacaacuucuugguaguuguuaguggucuuuuuaugacagcgucacguuaacaucaccuggugcuugcuauguaauucacugggcuagccucuacaugucucgcacuugguggcccuuuuuggacaaaggagugguuguuugagauuugggucuuacuuuacugaaguguacuguggacgguugagcugaaagaccaugguugaaaacagagucuaugguaucuucuuccacuacagcaguguuaguguugggguaccagagguaaagagaaggccaagcauggugguuuacaccuuuaaucccagcacugagaggcagacagaucucuugugaguucgaggccagucuacauagugaguuccaugacagccagcgcuaugaugagaaacccugucuugaagaacaaacaaacccaaaggaguaagacauuagaauuuaaagggguggauauuguaaaugacagggagccaguuaaggaguagccaaggauucaagcuagcuggcugaucagugaacauggcuuuagugcuggagugguuuuaaagaggacauuugugcugcagugcugggcagagugaugagaccagcucucaggagagagaacucucagcuaaaggagagauccuugagcaacaguccucuuuuaaaggucguucguucaagguagacgaugcagucggguguggugguccaagccuuuaaucccagcaguugggaggcacaggcaggcaggccugguguauauagcaaguuacaggguagcaagacuccauggugaaacccuguuuuaaaaacaacaaccaccacagcaaacguaggcaauucaaguauuugaggguauaguguuaggcuuacauuauacaaaaugaaucuugggguuauccaaaauacagaccuguuucauuugauucgguaaauguccuuaguuucccuuuuccccucgaacaaccaacggcaaaagccaaagucuucccuauguaacugagucuucccucaaaauauacuguguaaguagggcaugguggcgcacgccuuuaaucccagcacucgggaggcagaggcagcggauuucugaguucaaggccagccuggucuacacagugaguuccaggacagccagggcuacacagagaaaccacccuguuucaaaaaaaaaaaaaaagugacaucugccuccccccaaauuugauuucacuuugagguggugucacuacuuugagaaagguugucaaguaaugggcagggcaugagaggacuaacaaccaaaaccaagcaaaccugaaugaaaacaauguacuucuagccuuugauuaugucaaugaaguauuaucuggguaguggauugguccacuguccaaaacucugagagugaaugcaaagagagaguguuuguccuagguuuaagucaguaggacuguuuacacaagaaugccaaaauaauuuaggacauugaaagugguuuuucaagguguuaaggaugugcugaauaugggauauugaccagagauggagcuaugaugauuagaacuagcugaaaagacagaacagggaucagaucuagugggaguauaucuugucuauauuuaguuuauagggacucgagugcauaugcuucacucaaaaaauggaaugauuaaaaauuacacucaguauagucgugaugguauguacauuccuauaguccuacugacacuuaggaagcagaggcagggggaucugugaguucaagaacaguuuggucuguauauuggguuauaggccaaccaggguuauguaggaagaucuugucgcaaaaaaaggugggggugcucuuggugagaaugcucagggguuagagcacuggcuguucuuucagaggacccagcaucaguucucagcacucacaugguccacacccauucuuaacuucaguuuuaggaguuggaaugggcaccagcauccacgaaggccaaacauccauaaauuacucuuugacccuuugccuguguucuuucuuguguucuauuagacauuacuuauauuaagauuaguaaugugguuuuuuuuuuuuuuuggaggcuuaauuuuuuuuucaugcaauguauuuugaucuuacucuuuccccuccaccaacuccuagauccuacccacucaacuucauucuuucucucucucucucucuuucucucucccuccuccucccucucucccucccucccucccucccucccucccucccucccucccucccagaaauagagacacaaauucaaaacaaaacucaaaccagaaaagccaaaaguaaacaaacaaaaaacaaaacggaaaaaccagaagcacagagugugucauauuggccaaccaauucagagcgcgaggcgggcgugccuuagagucugugugauauaucuucacuccacuggagaaaccugauuucccuucucccaacacacaucgcuugcagauagcuuuuugguuaagcaugggacuugguccccauuuccccuucuugcaggguuuugucuugauugaaauaguucagggcucaugcugucacacucaccuuuaaaaaaaaaaagauguauuuauuuuaucuauguguuuugucugcauguauaugaguaccauguguguaccuggagcuuguaaagguuaaacagugcauagaauauucuagaacuggaguuacagauguuugugaucugcuacauaugugguccuggguccuuuguaagaacaagugcccuucaccacugcaaucucuccuaguacuguggcuuuuguugucaccugccaccuuuguuguugugugucucuggcuggcaccacacucaagauccuccagauccagucuucucaacauugggucacaaacucuguccuuuuuuuuuuuuuuuuuuagauuuuuuuuuuuaaugugugaguacaauguugcugacuucagauacacaagaaaagaacaucugaucccauuauagauggugugagucacaacaugguugcugggaauugaacucagaaccucuggaagucagaaccuggaagucaggcucuuaaccccugauucauugcuguguuacacagcgccugcaccccccccaaacaauuuuuaaaggauuuuuccccccaagacacaaugucucuguguaacucuggcuguccuggaacuugcucuaaccaggcuguccuagaacucagaauucugccugccucugggggauuuuuuuuuuauuuuuuuauuuuuaaagauuuauuugccgggcgugguagugcacgccuuuuaauuccagcacuugggaggcagaggcaggcggauuucugcguucaaggccagccuagucuacaaagugaguuccaggacagccagggcuacacagagaaacccugucucgaaaaaccaaaaaaaaaaaaaaaaaagaaaaagaaagaagauuuauuuauuauugcuuacauauaugccugcagggcagaagaggauacaagaucucauuauagagauaaccauauagaugguuaucaaccaccaugugguugcugggaauugaacucagaagaacucugagccaucucuaccccaaaaguguggaauuuuuaaaagcaauccccccccccccaacuuagaaccagacucaauguuagagaagauaacccugaccaugggcccagugcuguauaauaagccaugugugcaagguacuguggaagcuccaaggucagauuggcaguuguccuaggauggccagagaaaggcucaugggggaaucucucuguaucuuuuuuuuuuuuuaaauguagauguuuugccuguauguaugucuguguacccugugccuaccaauuccacuguccucuagaagacuuaaccccaucacuggagucuugaguuucuuuucuuuucuuuuucuuuuuuaaagauuuauuuauuauuauacauaaguauacuguagcugucuucauacgcuccagaagagggugucagaucucauuacggaugguugugagccaccauuugguugcugggauuugaacucaggaccuucggaagaacaaucggugcucuuacccaaucgguacucuuacccgcugagcuuuucuuuuuuaagauuuauuuauuuuauuuaugaguacacuguggcugucuucagacacaccagaagaaaguaccaguucccauuacagaugguugugagccaccaugugguugcugggauuugaacucaggaccuucagaagagcagucagugcucuuaccugcugagcuauccuccagccccauuaugucuauucuuuuauuccccugaaaauccuccagcuuugcaguggcaguauuguagccaaugagguuuauuuaaggccugauagaaaauccuaguugaaaauccuuuggugggcaggauauugugaaacuguuuuaacuaguuucauuuuccucaggagcaagccuggcuugaggcugcccagaccuucauccaagagacccucuguccagcuggcaaggagguggacaaagaguugacucggucaguaauugcuugugugaaggagacguggcugucccagggggagaaccaggauuuaacucugcccuucagcuacagguagggugagguggggcuuggugggugguugacuuuaggguugggaaggaaggaugaguggagaagguggacccaccacauccuuuucuacagaacuuuccuauucuucguucaguuucuuuccuaaaguucuccuagcuugucuuaagucauguuucuagagaaggggaggagagauuaagacagugauugagcugaugugacgugugcaggcgauacucuauauagccuuguccuugcugccugccuuaagacuuagugcuuugucguauuugcuuuguucauuuuugaagaaaaagaguugguaaggucuccuaauaacugugucagugauccuucucuauaacuucaaagguuaucaccagccggaagggaacuacuggucccuucaaucucaguaucuguguacguauuguucucagugaagucuuaccaguuuauucauauaacugcauauguguguguauauauauaugcauauuuauuuaauuuauugaauuaaauuuauuuuacguauauggguauuuugccugcauauauguauguguaccacauauaugccuagagauguuggaggccaaaagagggcaucagauuccuucagguuguagugacagacaguugugugccacuauguggaugcuggaaaucgaacuugguguucuggaagaacaaacagugcucuuuguuuuguuugcuuuguuuuguuuuguuuuguuuuguuuuuuugagacaggguuuggguuucucugcguagcucuggcuguccugggacguacucuguagagcaggcuacccugaacucagcggucugucugccucccaagugcuggggauucaaggugugcaccaccagcgcauggcugcagacugcuuuuaacuguugagccauugcuucagccccuguuuguggaguuuuuaguguucucugugcacauuuauuuucucagacugcuccugcaguuuacuucaugucucuuggugucuccuuguagagagauucaucccaggguuucuuguuucccuuagagucauugcccaaccuuuagauguagaguccguccuuaauuucacagcagcgaucacuugguccccauucuccuucagccccugucuagggugcguggugcucugucggggcggagucuuuucucggaugaagcugacuuucuucacuuuucagcuuugucucgguacagagucugaagacccaucagcgccucccaugcugcagccaccuguccuggagucagagugcuuaccaggcguggacccgcggaggccggccgggggacggcguccugccccgggagcagcugauacuuuuagggacacuaguagaccuauugggagauucggaacaagaauguaggaguggaagccuguaugugagggauaacacugggaccuuggacugugagguaaguagaaaggggacagcugccucuggggugagcaggagcgguaggucagcugcuaagguccuggcuaaccuguggcuuugcucuuuucuagcucauugaucuagaccuuucuugguugggccaucucuuccuauuccccaguuggaguuaccuuccuucugccaagaggaauuccuugggggaagggcacuuggaacuaugggguacaccggugccaguauuuccuuugacugucaguccuggcccucucauaccuaucccuguccucuacccagaaaaggcgucccaccugcucagauacagguaauuuuccacucuuaggaaagaaaggaacacugagagauuugagaaugaugguacuuaccguggcggaagacauauugauagugauacagauaauagauggaacaagggagcaaugggauuugaguaucaggaaaguuaugaggaaggcuuggagcugguugugguucaccucuagaaucccagcauucaggacacugaagcaggaaggcuguggagccuacagugcguuccagguuagucagugcugcagugggagacccuuucucaaaagauggaaaaaauagguuggagagaugguucgcugguuaagagcacugucugcucuuccagaggaccuggguuugguuccuggcgccaucauggugguuuacagccaucuguauucccaguucuaggggacccaacacccuuuuuuagcuucccuauguaccaggcaugugguggacagacauauauccaggagaagcauucauacacacaaaauaagauuuuuuuucaagacaugguuccucuguguaguacuuacugacuguccggaacucacuauguacaacaggcuggccucgaacucagaaauccuccugccucugccucccaagugcugggauuaaaggcgugugccaccacgcccugcugauaacuuuuuuuaauagaaaaaaacccaccagauucuuuuugaauauguauguguacauacaugauguguugaucaagcuucagugccauuccucaaacaguagggaaauaggccccucauuggcgugaguggucgcagagucccacgcgugucacguccaccacagggauuaugucaucacgcuggccuuuucaaaggugguucuggcaauagagcuuguauuuagaagucagacaagcacucucucccugguccccaagaggguuuuguguguguguguguguguguguguguguguuuaugaacaucccaucuuagcauacagacacacagaggucagagagcaauugugggaugguucccaggaucaaauccaguccucauccuuagcagaaagcaccuuucccaucgcagcugccuuugacugccaaggacauacauuacauacccugugugagugcaagaaggguuggacuguuuuuagguaauagcuuggaauuaaugguuauuuuacauugcuacaagauuguuuuuuacaguggaagggaagacuuccacuggaaaaggagaaaucaaaaugccuuuuuucuucuuuccuuagaaagaaauccaguauaaaggagauaaaccucgcuggaaaacugguccaucugagugcccugauaauaacucagaacaaaagguauuucaucaugacacuuggugaauuagcccaagcuggcagccagguguccaucauuguacaggugaggaccaggguaaaguugggcauaugggaguagagagggugauccaaagacgagaacacaagggagauaagccagacacagaaggacagaugucaaguuuuuauguguaguaucuggauuaauauauaaaauauggaaguagaaacuauggaggaaggaaacaguguaaaggcaggcaaagaggaugaugggagaaaagacagaacuaaggagaugauuuaguuaguaaagcccuuucccuaugcacaugagagccuggcugugauucucauggaaaaagcugggcacaguagcauggccuguaaccucugugacagugaaauggaggcagcagagcccuggagcuuguaggccagcaagacagccuaccucaaaagguagaagaccugcugagaagugauaacugggauuguuuuugacauccacaugaaugggcauagggcaucugcccacaugugcaccugcacacgcaugcuagaaggauggaugcuggggugguggcucaugcuuuuaauccuuacacuugggaggcagagaggcaggcagaucacugugaguugaggacaaccugauguacauagcaaguuccaggccagccaaagcuacagagagacagagacagagacagagacagacagacagacacagagggagggagggagagagaggagagaagagagaagugguaacuuuucucuuccagaggaccuagguuugguucccagaacccacaugacaccucacaaguguuuauaauuucaguuucaaaggaucuagcuugaacacuucaugcaagugguacauagauaugcacgcauguaaaacaucaaucugcacaaaaaugaauacauuaaaaaaagaaaagacagagguucugggagguaguagcacacgccuuuaaucccagcagucaggaggcagaggcagagguugugacaccugcaaugugagcccccugaggaggaggaaauaguggccagcggaccucugucuccugugcaggaaacagucacugccugauuuacagaaugaguuccaggacagccagggcuacacagaaaaaccaaaaaaagcaaaacaaaacuacccccacacacacccaaagaaaccuaaacaaaccugaaacccacaaaaagaaagaaagagagagagaaagagagagagagagaaagaaagaguguuuuggugcaugaucacaugugucucuguauuacuguuuagguuuuugucuuuccaugaucugaaacauauuaaagaggagugaauaaccuguuacuuaacguuugucucaauacuggaguuuuguacucagcucauauuaaugaaauaaaugguuagcuuguauguuguggggugagagagaacauugaacaugauuuccuggaugggauauuuaccacuuugaagacauuucacagaugguuuccaucuuuaugaaaggcuuaggaaauauguggcauuuccuguugcuguagagagauccuuaaaguucaguggcuuauuauaauacuaagaguucaauacuagccuuggguacauagugaguuuaaagccagccugggcuauaugagaccuugucugaaacagaacaaaacaaaacaauaacaaaauagccaaccagacaaacagaagaggaagaauaagaggaaagucaugaggucuuuggagugaaauuguugugggaagggccuuuggccgaugggcagcauuaugguuaagggcgggggucucauguuuaauguuaccucccucugccuaagccagaucccugcucagaugguguggcaccgaguccuccggccuggcagggccuauguacugacaaaauugcaaguaaccaagacccggauucaccuuuccuguauuuggacaaccauuccaucuucaacucugaagccucugagaccagguuaugugcaagagcuggagcuggacuuagaguucucgaaagcugaccuuaaaccaccaccccagcccaccagcuccaaagacagcagagggcaagaaggucuuguccgggcuuccaaagucuugcauuauuuggugagugcaagguacugaucuuagagguugugacaccugcaaugugagccuccuaaggaggaggaaauaguggcagcggaccucuguuuccugugcagggaacagucacugcuguguugcaugagucugccggccucuacauucuagaugggcagcugauucucugccucgcauaccagaagauccauggccucaggcggguuauucgaccaggggucugucuggagguaugucagaaaucggauggcgaugagaagaugcucaguucaugggagauggugggugaccucggagagaguggguuuugguaggaaaugagauaggcaacacuggggaguuucucuuggaaccuaugguggagaaacaguagccaucuccccagggguuaagcucugcccuugucuugucuugucuugucuugucuugucuugucuugucuugucuugucuuguuccagacagggauuuuccaaaguuuaguuguugugagccacccauaguggguacuagaacugaacuugaguccuauucaagaguaauacuuuucuuuuaacugcugagccaucucuccagccuuuagguaguuuuuugucuuguuuguuuugagacagggucucacuuggaagccuuggccaaucugagacuugcuauguaaacuaaguuggucuaaaccucaaauccccuuccucugaucuggagugcugcaguuacaagcauguuuuuuuuuuuuuguuuuuguuuuuuuuguuuuagaucacaguagcucaaacuggccucaagccucuguguagccaaaaauggcccuuuaucuucgagucuuccugccucugccugccaagggcugggauuuacaggcaugugcuacguacucagcuuaccucugcuuuucuguuuuccugcagcuccgagauguucaucuccuccaggcaguggguggagcaacaacaaaaccuguccuggcgcucugucuccauggcacuguucggcuucaaggcuuuucuugucuuaagccucugacuuugccguccuccaaaguuuauggugccuccuuguaugagcaacucguguggaaaugucaguuaggacuucccuuauacuuaugggcugccaagacccuggaggaucucaucuacaagugaggaggacggaguuugagggucugggguggagauguuacuuucucuguaggggaagcaggguccuggaagagacagaucuugggaaaaugacuauguuucuccuccuggccaaggcuguguccccauguguugagaugucaccaguuccugaagcaacccucuccugggaagcccagcuugggccugcagcuccuggcucccuccugggauguucugauuccaccuggcagccccaugcggcaugcguacagcgagauccuggaagaaccacacaacugcccccuucagaaaguacgaggacguggggaaagauuggcuugaggacacagggcacagggacccagugugauuauuucucucuccccacacacaguacacuccacugcagacucccuacucuuucccuacuaugcucgcccuggcagaggaagggcagcacagggcuugggcuacuuuugacccaaaggccaugcugccucucccagaagccagucaccugaccagcugccaacugaaucgccaccuagccugguccugggucugucugccauccuguguguuccagccagcccagguaagagaauucuagaaggcucgugggacuacuuguugccaguuucaucacuacuacuuguucagauuauguguuuuuuguuguuuuuuuguuuuugucuuucaaucaugcucuguguguggguguaugaguguauguguguguaugugcacauguuugaaacagggucuguauagcccugacugucucguccgggaauucacucuguggaccaggcugaccaugaacucacagagauccaccugccucugccucccaagugcuggguucuggguuuaaagucaugcgccaccacccggcuaacugacuuucuaauuagacugcuguaucuguuccugcccuucacugauuuguccuuuuuacagcaacuaggaagaaugaaagaaauuguagcuugagucaggugugguuacacaugccuuaauccuaauacucaggagggagagaugaauggaucucuuugaguuagaccaacuggacuacauagacccugucuaaaacaacaagaacaacaacuaaaaccauguuggacauggugguuagccuguuucgggcuagcuagagaugcacagugagaccuugccucagaaacaaacacacaaacagaacaaaacaaaagagggugguauguauggaccuggagacugcucagugguuaagagcacuggcuauucuuucagaagguccuaaguucaauucagagguccugaguucaauucccagauaccacaugguggaucacaauucuuucuuugaauuauuucauuuauuuuguguaugaguacacuauagguaucuucagacauaccagaagggggcaucagaucccauuacagaguguuguaagccacaaugugguugcugggaauugaacucaggacuucugaagagcagccaaugcucuuaaccaguugagcccucucuccagccccugcaacucucuaugaagggaucugaugcccucuucuggaauacaggugcauacacagacagagcgacucauccguuagagaguggugaccugagcuuguucccagacucugcauggugagagaagagagcugacucccacaaguuguccuuugaccuccacaaaagugaaaugauaccccccacccccaguaaauguaauaaaacaagcucccaaaacuguagcuuggaauauagaauucuguuggguuuugcuuugcuuuguuuucguuauugcuuuuuuuuuuuuuaaccugaggcagucuuguuguauagcccaugcuggccucgaacucccggagguccugcuaccucagcuuucugauuacugggacuacaaguauguauguauguaccaccguguucaagaguguaauucaguucuuacucuuacacgugugagugcuugccuuuguugcuguuaguguuuaaaacagcacaugacacaugguagaugcucaguggaguuuuucauuuuuuagagagacaggaucucucugugaacccuagcuggccuggaacucauaauguagaccaagauagccucccacuuagagcaggcuugacucuguccucuggguucugcucaugcccagucuuugcugauuguguaauauuuaauauuuaucagcuugaccuuuauuuccuacagguuuuacuugggguccugguggcuucaucucguaaagguugucuggagcuucgggaucuaagagguucacugccuuguauccccuugacugagaguucacagccccucauugacccgaaucucguaggugcgaaguugagaggugggaagguggugguggugggagauagagcucagcgcagggcgcagugagagagggagcgccugcugggcuuccuuaaugauauuggucagcuacauggggaagugugaaaggcuggugcugauggagagaaggaagaggagccagagcuacagcucccagcauacaucucuccuacaccacauagcuccuaaacauuuaccuuccugcuuccuauauucauaauuagaagaacacuggucuuauucgacuuguugaguuccauaaaaaggaggcugggauggugggccuuuaaucccagcagaggcagguggaucucugugaguucaaagucagccugauuuacauaguaaguuccuggacagccaaagcuauaaaauagagagauccugucuuaaaaaacaaacaaaacaaaaacaacaagggaaacccuagagaggaaaauuuguuagauucagaaaaaaaggcaugucacagguuuagggaacaaacaagaaaaggccuggaguauucucugcuuggugugguugccuaggggcugagaugaugaguugugggcgguggcccaggauggcacagaucuaucuacccaggguucugcuucccuccuuuccacaguuuuuuuccugcuaagauagaaaccuuucuucaucuaggcugccuggugcggguagagaaguuccaguugguaguagagagagaagucaggagcagcuucccuuccugggaggagaugggcauggcacgcuucauccagaagaagcaggccaggucagcucucgggagcggggcuucccuuggagaagaaccugguguuuggggauccagggucugaaucacugaagagcugccucuuccaacagagucuacguccaguucuaccuggcugaugcccugauccugcccgugcccagacccaccuuugguucagaaccaucucagacagccuccuccugcccagagggaccccaccugggacagagccggcuguucuuacugucccacaaggaggcccucaugaaacguaauuuuugucuccuuccgggagacaguucacaaccugcaaagcccaccuugaguuuccacgugucaggaacuuggcuuuguggcacacagaggaaggaagguucuggauggagcccacccgagucucuggccguugagagcaaggaucagaagguaagcugggacuccagguuccuagggccugaccucccauauguacccuguguuccacaccggaguucgaugcugugcuguccuuccucauaggucuuccucaucuuucuuggcucuucaguucgaugguuuccguucuuguacccaaaccaagucuaccgacucguggcuuccggccccucagugaguguguuccucuugcacaucagaaagcuaguuggguuggacucuggagcagacaugcgcgugcuggguccccuaggucuccuggaauaggcagaauuuagggggacugaaucgucugucuguaaggaccccuuucuucaccaggcucuaggaagaagucagcacgggaggacuuaggccuaggcacaugcugaggcaauugucuucauguuuccuagcagacaccaguguucgagacagagggcucagcuggcaccucucgacguccucuggaacuggcugacuguggaucuugccucacuguccaagaggaguggacccuggagcuugggagcucucaggacauaccuaauguacuggaggucccuagaacacugcccgaguccucacuggcccagcugcucggugacaaguaaguauuguccauuaccucugguccucuuggcugugcucugcucugcgcuggcugggcugagccagcaguguguguguucugugugaugucagugugagaggggguucucuuucagucuuucuugucacugcaggaauagucacaaguagugucuccuacucucucgcuccucaccgaacuguuguuauuguugagccagggucuugucuuuuggcugguuuugaaguugcuauguagcugacuuugauuccgacccagcugagcagauguccucacaguuaaggaaaagcuuuagcaauaaaaggaaacaggaacagaaaaugcagggaagaagguggcaguguagagaaggaccugcgugcacugcgugcggucgguaguaaguacagaggcguggaacuucauagaagauucucuaagcgagaacaagugaaaauguuuccugugugaaaaacucuacuggauuguguuuuuauuacuaaaacugaauauaagccagacauggugguauacauguuuaauccaagcauuuggaaggcagagugaguuugaggcuacauaaggaguucaggcuguccagggccaaauggucagucgcugucacagaagaggaggggggaaaguggccauagaggacuggaaagauggcucucuagaacuggcugucauuucagagggaccacacuggggguuggauggugguacaugccuauaaucccuguaauccgaguacacccagccuagaggagagcuaccauuaguuuuaagauagaucuugucuaaaaaauaaacaagagaaggaggauugugucuuuuuuuuuuuuuuuuugguuuuucgagacaggguuucucuauauagcccuggcuguccuggaacucacucuguagaccaggcuggccucaaacucagaaauccgccugccucugccuccaaagugcugggauuaaaggugugcaccaccaugccuggcugugucuaauuuuuaugagacugauauuuauuauuagaagugaaguaggcuggaguuuguuugcagggugguaaacacuuuuaaucccagcauuugggagacagaggcaggcauaucucugagucuaacacuagccuggucuacacagcauucuaggacagccagggcuaugcugagaaacccugucuccaaaaauaggaagagaggucagggaggaaguuaagguaguauauacuuguagucauuuucuuuggggaccugagacaggagaauugcugaagguuugaagccagccuuccaccuuuauguagcaagagcaugcuacauggugcuaggaugucugugcaccaagacccucagaagccagaagagcguacccaguccucuggcacugggguuacagacaguugucucaaaggauuagaaaaagaaggagaagaaggaagaagaaaagaguuaguuguacuuaaagugaauguuuccuaggaaccugcaucuucagcaaguguaagauguaaaugauggagagcuggggacggcuccuuuucugucuuaggagcugaucucucaguuguguuuccucauggaucucugucucuuucagcucccccgauuccuugguaucuuucucugcugagauuuugucucggauacugugugaaccaccucuggcccuucgccggaugaaaccugguaaugugcuaucgucuggggaagacgguuugaauuggagggaugggaccuuguaguccuggcugaucacuggccacccuucccucuguccguagggaaugcuggggcuauuaaaacaggugugaagcuaacaguagcucuagaaauggaugacugugaauaucccccucaccuggacauauauaucgaagauccacaguugccuccccaaauaggacuccuuccaggagcccgaguccacuuuagccagcuggagaaaaggauuuccaggugaagauguauaucguauggccacaccuucuuugcuuacugauguccucuugaauauucacccccuccuaacugugccacaaggacguguuuucuuugcuuuacuguuuuguuuuguuuuaggacagggucucacuauguugucccggcuguuuugcaacuuccugugucgcucaggccagccucaaacuuacaagcuuccuccugccacugccugucuccagaugccgaguacuaugcucagcuuugcugugacuggcugcuagucugcgccugcuguucccucugcuuugauagagcucuggauaugccccugggguagacgaguuagcccagccuggaaguugcgaccccagccucgccuccuuccccagccugacuacucuguccucacccccacuccucuucucucugcagauccaacauuguuuacuguuguuuccggucauccacuucugugcagguccugagcuuccccccagagaccaaagccaggucggugcugagccccuaaugucugcauuucccaacuucacacugacauuuuacucacgugccugacccuggaacgucugccacagauguagacgucucugaucacaggggaguacuuuuuugagucagaaggauuucauauacuccagauagaaaaaauacccaguacccauuacuuggaaaaacuugaaguucuaagcucuuggaggcuuuuuucucuccguguuugucauucccgacaaacgucuugguauucaagccugagaaauacuugguggcucuuggagaugaggaaccagaguguggcaagggcuguuggcuuccaggcguacauagaacucaccacugucccuacucccaucccugugcuuguuaaggccagcgagauuaaccuugcuuucagaacuccucugccuugacuuaggguuuugagauuguuucacuauguagccuugacuggccucaaaaagaucugaauuuaccuucugagugcugggauuaaacuuccaugccugggucugugcuggguuguagguaugugucggcaugcccagcuucuugccugucugcugcuugacauuggucucucuguugucagugcuccucugccccacaucuaucuggcugaacuucuccaaggugaccggccucccuuccaggccacuaccucuugccauauuguguauguccugagccuucagauccugugggugugugcucauugcaccagcaucugcccccagguacugggagaggacaugcugagcuggggguguagugccagagugcugugcugucauuggaggaagaggacuuuuccaacaguguuuuguuuuguuuaucccaggguaaguguagucgccgggaccccaguuguccaucucagagggcuguaagccaggccaacaucagguaggcacuuguuacacugcuuacuuccaguuaugcagcuucugaugucuacaguagcgucugaugucuacaguagcaugauuuuuuuguuuguuuguuuguuuuuuucgagacaggguuucucuguauagcccuggcuguccuggaacucacucuguagaccaggcaggccucgaacucagaaauccgccugccucugccucccgagugcuaggacuaaaggcgugcgccaccacugucucgguagcaugauuuuuguuuaguacuuuuuugaguaagugggguaugguggguacaccuguaauccaagcauugaguagagagggugguguugagaaaggagaauugaugugaguuugauaucaggccagcggggcuacauagcaagaccccaucucauccucuuauguccaauuuuuuuuguuugguuguuuuguuuuguuuuaaugaagauaaagugagcuauguagcagcagcacugugcgacaggaggucuguugggucuggggacugucccugugggauugcuccgggaguuuugcuucccuucccuuaggcuccugguagaagauggcaccgcagaagcgacggugaucuguaggaaucaucuuguggcaagggcacuagggcugaguccuagugagugguccuccauccucgagcaugccagggggccggggagaguggccuugcaguuuacagggcuaggaggccaaacagagguaaguacugcugcucugauagauguucaaauucuuggaggguuugcacgugguuagaaaccuggguuccaauuaauccugaguuucccuuucuagucugcaagcaaaacccaugagcccuugacccugcuccuccggacacuuuguaccagccccuuuguccuccgacccguuaagcuuucuuuugcacuugaaaggagacccacugauauuuccccacgagguaugaacaagguggacagguccuaaaaaagaguguggauggggacuggacaggggcuuucuagucugggaaggaaaauggcggaaaggaacuaaaaugcggaacacacaggauguuugcucuugcugucucagaaccgucccggcugcagcaguuccaguguggagagcucccucugcugaccagagugaaucccaggcuccgacuggucugccuuucucugcaggagccggagcuccccaacccuccacaagcaucugcugcuucgucuugaugacacugccuaagguggccccagaguuuccaggaccccagacacuggagugaggaacuccugccccacugugauuucuaguuauucuggugucagcaugccuuggagacacugaaaacggcagaucacagcaugauaaugguguuuccuccaauuggguuagaacaccuacacucagaggugacccucccugagugcuuggguucugccuuguggagaaagcaggacggagaccuugccccuuaugauugauuguauugugauaggcccuuugggcuacaauaaacuucucugaggacuuucugac

SEQ ID NO: 6085 - RNA, 6030 nt, Mus musculus
auucaaaaacaugaaacauuuaagacuuuauuauaaaauguuguucuucauaauuuuucugaauuuaagacagacuaggcuauaccauguuucaaagaaaaauuguauuaaauggcuuauaauauuuuaaaaauaacauucaacauuugacaaauugaaaggaaucagacuagaggguuucuuaaaagucagugcauggguguuuugccugcauacauguauaccacauccaugccuagugucugcagaggcucgaaggccccagauuccccaggacuggguguuacagacaguggucgugagcaccauguagugcuagaauugaguucuagguuccugggaagagcagccagugcuuuuaacuaccgagccaucucuccagcacuaucuguguguuuguuguuuguuuguaacuucauguguuuggugugcauauaugugcaccacaggggugccuaauuuugccuguagaggucagaagagagaucagauccccuagaacuggagcuaggaauaguuuccaguucccaccccuucucagaacacauacacagacauacaaagaacacugaaaaaugacagggacaaaaaaccaaggagcaggcuaaagggcagagggaggcagaacccuccuugaguuggcccggacccaagggugagcugcaaccuccgccaggggcagccguugccagggguuauguuugagcagcuuggagaugagguccugggcgcccgaaggcacagaagaggggaacuucagguccaccugcgaguggagaaaggaaaggugucaccuguguuacucugaccacauucuucugacuacucaucccgucaggagcuagaggacacccccagagagguguuauuggcaguggacggcagcuaggggaaaagaggcauuguugggguuuuuuuuguuucuuuugagagcauggaacaggccucaguggggcuauaaaaagaaagaagcugugaaaguagguggggcacguguuggggaggaguccaggggagugggaagugucguuagggguggauaugaucaagguauauuauauacacguaccaaguugucagagaauaaauaaaaaguauuuacaaagcaggaacauuuuugcagagccguguacauccacuuugaguguccccagacccuggcuccuacaguacacaaaggcuaucgcaccuugacaauccgacgauacgucucacuguggcuagggcucucgaaggguggguuccccaccaucaguucauagcagagcaccccgaugcaccauagaucuaccauuucauuaugcaugcgccccucaaucaucucugggggcagauaguccagcgugccgcacauggucuuccuccuggugggaugagggaagagagucccagaagucagacggcuucucuuuucucuuuacuugacagugagcgucccagagaccccaggauguacucucgaguaagaggugguaaugauauaagccaaaagccagagguggacaugcacggcaccagcauggucacaaauaaugaauuaucuuaaucuuaauaaauaaucagagacaagggcaaugcuuacgucaaggaaaaaaacagaaaauaccaacacccaccaaacauaugcuacuuaaagaaaacagauuagauauuuuacuaugcaauacucugaagaauuaaacaaugaaggggucaccagauacucgcucacaucuacacaucuaaucccaacacuugguguuuggcuuuguuucuaugagacaggcucucucucucuccuagccuuugcuggccuggaacucacuggccuugacuucaucuguuacccugacuaccacugccucccuacagcuggauuuacaggugugugccacaacaccuggcuuaaucccaacacuugagcagcugacauaagauugucaguuugaggccaucuugggcugcaggguacucuugggaagagguuuugaagccuguagaugagucagagagcuagcauggagccuagcagagguaagacccucgguuccacccccaauacccuaaaaccaaaccaaaccaaaccaaauaaaaugugacauggguaagcaggcacuguaggguacgccuggaauagcagccauucacuuaaaccuggaccuuuaaggcaacauagggagaccauauuuccuucuaaaaagaacaggauuuugcaaggguaaacuuggcauggugauauacgccuguaauccuaguauuuuuggaggcagaggcaaggagaaucagaaauuaaaguuaucuuuggcuauguaaugaguuugaagucauccugugcuacguaagaccagauccugucucaaccaaccaaucaguucucagucuguagaaagggaguuuucucaacaauguggugagggaggguccacuauauuuaauuaaaaaaaaaaaaaagaaguaguagaacauuuagggcaugaauuccuuuuguuuguuuguuuuuuucgagacaggauuucucugccuggaacucacucuguagaccaggcuggccucgaucgaacucagaaauccaccugccucugccucccaagugcugggauuaaaggcgugugcccccaccacugcccggcuagggcaugaauucuugagucgccuauuucuguaaaguaaucacuaugucuauacugcaaggagaaaaaaacaaaacaaaacaaaacccaaauguuccugaggaacaagacacugaagacuuuuauaaagaacgucacagccucacaucaggaacagccccccaagucccuccauaccucagggauggggcaugcaccgaccagccaaagucugcaaucuucaguucucccugcagaccuaacagcagguucuccggcuuuaugucucugugaauuaccuucuucuuguggcaguaggucagggcaucugacaguuccuccaugaucugugaggguccacacaagaggcaauuaggcccucuguuuccagcaauggcccaggcacuagaucccacaccagguaggcccugaccguggcaguccgcugcucaucgaagguccgacucuucugcaguuccuuguagaguuccccgcgaggggcguauuccaggauuaaguagauccucugcuggucguagaaguaguuguagaguugaaggauguugggaugucugggggaugcaaggagaaaagaagcuucaggcugcaucuaggagcuggguggggcagguggucuaggcggaguaagacagagacagucgagugaggugaucccguuagcagagggaccagggucagggugacagcauacuucaggugcgccuggauuucgaucucucggcgaagcuggugcucuacccccuccuucucaaucugagacuugaagaggaucuugagugccacgaugaaacggcucuucuucucccgagccaaguacacguuuccaaauuugccuuugcccaaaggacgcccaaucucaaaguugucaauagugaaaggcugccugauuagaagagcgggaauauggggaagaguuagcuggcuggcucagagucuccagguggcugaucucucacuauccgugcuccccuuauccucccccauuucucccccaucacuguuuaaguuucccuacuuguucugggauccuugcgaggcaguggagcccugacucuuguucucagccaacuucuggccaggggcagcuaaggagagagaauuauguugaguccauccuuugacauucccagcuuccccccccaccucccucuucccaucauccaagguaccuguggacuggcuguugaaccgguucacgagagcaagcgcagaugucguggcgggcuccuuccguaggacucucugggacaacguguucaggccagacugagacugaggagcaaagggugacucugagggcguccuugucccgguaaccuggccagaauaugcuacaaggcgcauuucagcugcuugcuaaaggacccauccacucacaguucacagaacaauacugauacagcacggucugccugccuagccaagaaucuacucauugcuccacgugaaagggguuauuaagaaacaacuggcagccagcagcaguggcacacacuugggaggcagaggcagggagaccucugaguucuaggccagacugaguuccaggauggccagcgcuacucagugaaacugucuugagaaaaacaaaaguaacuugcaaaaauaaaaugaauaaaaagaaugaaacaacuugagagcguccagcacacauccacaaccccagcacuaaggagguggaggcuccugguuaggagaaaggcagccugcagccugagcuaaagaagaccuuguuuuguuuuguuuuuuguuuuuugagacaggguuucucuguggagcccuggcuguccuggaacucacucuguagaccaggcuggccuugaacucagagauccaccugccucugccucccaagugcugggauuaaauuagugcaccaccaccgccgccgcccagcuagaagaccuuguuuuaacaucacccuccacaaaaauaauuaaaaagcaaaguaaaugaacgaaugacaaaacaacccaaggcaagaggcuacuacaccaauuccccugaccccagcccaccgcaggcacaucacugcccagucuggauaguucuaaacacaucacccaggcuuauguaagagccugagcuugugaaguugaaacaaaacuucaucucuuucuaggaacagaacauagggauacugauggcuuuagggguguugcaggauauuugaccacacugugacccucggggaugacaaauuaggccaggagaauaaaagauauguuuacacuugggucacuucacuuucaaaguucucugaguaauagauauuuuccugugauaguaaaucaggguaaaaguaacaggacugcacgcuugucaguuugacucagggcuccacagaggaggaagcugggacaaggaaagagauagacuguccaggaugcucaggucccaccaacagggaacagacuauauacagugaagggcucuucaucuggggguggccacaggaucccaucauguagccaagugcguuacgggugugcuguauuacaggugugcaccaccgugcuuacuaucuccaguguggcgcacacgcacgcacauacacacagcauuucaaaucuacuuggauucuuacuucccaccgcucaguacgauacauuccaaagcuggaguguaguauggaugguacaucaaaacuuggaagcucugggguuucauacccagggccguacauaaauauuuagaucauucggaaccuuuuaaaccguaaccuucuauucuauaaucuauuuccuguguaguuaauuuuuucagacucgagagugagauucacgacccgaaagcacgaugauguuugcucagucccaacuauuauuguacgugacgagcaggcucagcucuacggaagcccucagauucagguuggcaacaucugcuacgguaagacugcaagugaucagacugaguuuugcaagcaaauucuugaggcccacacgucggaaacgcuuagaguccggccauuugcaaggccagccucuaucuucauggacucuucuuccgggggacguggggcggggaauguggccaggaccuuaccgucuuugagccguagggccacggguaggcguucuccuucugagccauucuccagggcgagagcgggaggggagcuggacagagagggaaacaacagcgaaggcaagagaugcagaggcagauccccggggagugcaagccugggcgggcagaaggaagcgagucagcacgcagccaaggucggggguacuccugcaccucuccuuccaggcggauagcgggcacguggauccgcccaacggaacccgaucagccccguggaccacugcagcccccgcaguuccccgcaaagccgcagccuacgccacuaggcgcucgcacacggagaaccgguuuaccccgcgacccggacgcuuucgaaucucccgcucua

SEQ ID NO: 6086 - RNA, 945 nt, Mus musculus
uagagacauuuuaguuuuuuccuuuuauugagcugacuauauaaccuagcaugaccuugaauuucuaaaccucuuucccccaccucccaaaugcugggacuauagguguuucccccuauccagcuuaagacucaauuuuauaugaaaaaguuauaguuucaccauauaggagcuugaguggagcucaguaguaaaguaaucauuuagcgugguccauacccuguguuugauccccagugcagcccacaggcagaagcuucaauaaguaggagcugaauauauaaggacauucaaugcuauagauuauucuuuguguuuuagaaugccauucucugcguugauaauacuauagggucucagaagggaagaugggaggauggcucaguggagggugcuuaccuaccuauauguaagaggccuggagcuuaucuccaauacugaaaaaaaaaaucaggaaauuacaugauuacaaugcuguuguuuaaguuacaaacccuauacaaaacuugccaagcaucucaccucagucuuuuauaauaaaagggggcgaggggggggcaauucuuuugccugguuugggaucucagguucaguuagacaccccccuaccccccguucauuuagaagaccuccagucugucuuucaugaccuuuaacuggcuuaggaaagggaaccccauguauuacuuuagggagacagaaucauuucuucuucuucuucuucuucuucuucuucuucuuccuccuccuccuccuccuccuccuccuccaccuccuuccucucucucucugccaauuccuugaaacaaaaauuuaagaaguaucuauuuucaaagcuucccuuugauauuauucuaguauuaucuuuuaauuuaaaaaaauuauagcacgcauuaccucgcuggguuuuguucuuguuuuggcuguuaucaaucuccccaccua

SEQ ID NO: 6087 - RNA, 945 nt, Mus musculus
uagguggggagauugauaacagccaaaacaagaacaaaacccagcgagguaaugcgugcuauaauuuuuuuaaauuaaaagauaauacuagaauaauaucaaagggaagcuuugaaaauagauacuucuuaaauuuuuguuucaaggaauuggcagagagagagaggaaggagguggaggaggaggaggaggaggaggaggaggaagaagaagaagaagaagaagaagaagaagaagaaaugauucugucucccuaaaguaauacaugggguucccuuuccuaagccaguuaaaggucaugaaagacagacuggaggucuucuaaaugaacgggggguaggggggugucuaacugaaccugagaucccaaaccaggcaaaagaauugccccccccucgcccccuuuuauuauaaaagacugaggugagaugcuuggcaaguuuuguauaggguuuguaacuuaaacaacagcauuguaaucauguaauuuccugauuuuuuuuuucaguauuggagauaagcuccaggccucuuacauauagguagguaagcacccuccacugagccauccucccaucuucccuucugagacccuauaguauuaucaacgcagagaauggcauucuaaaacacaaagaauaaucuauagcauugaauguccuuauauauucagcuccuacuuauugaagcuucugccugugggcugcacuggggaucaaacacaggguauggaccacgcuaaaugauuacuuuacuacugagcuccacucaagcuccuauauggugaaacuauaacuuuuucauauaaaauugagucuuaagcuggauagggggaaacaccuauagucccagcauuugggaggugggggaaagagguuuagaaauucaaggucaugcuagguuauauagucagcucaauaaaaggaaaaaacuaaaaugucucua

SEQ ID NO: 6088 - RNA, 3903 nt, Mus musculus
caguacccggaugcgggugacgugcggccgccaucuuccagucccggguagccagcgccagucggagccagcgcgagccgccgccgccgccgucgccgucacugccucugccaaguccacugcccgcuacccccgccauguaagucagccgccugccacucgccacccgcggauguucugccccuugcgggccgccaccccaaggaguggaccgggaaacacgggggucccgccgcgggccaggcuggugcccaugacugcgggcggaugccgggaaccgggucccuggcggucuggcacgggcgauggcugccggagggagcagacccagcguccacccuccgccccgccccugucacuauggccgucagucauuucgggucgaccccgggcagcaucuacgaggucgcccucauuuaaccagaggggaaauugaggcaugaggagggucucucaaggucacgcagcucaaccuuagagugacugucucccaucggguggccuucucgcgcaagagaggacuggagggacuguggauggacagguggauggguggagccccggccguagggccagaggcuucaggccucgagucuuaauccguuucucuuccuuaggucggcuaccgcugccaccgucccgccugccgccccggccggcgaggguggccccccugcaccuccuccaaaccuuacuaguaacaggagacugcagcagacccaggcccagguggaugaggugagugugugugugugucugugucugugucuaugucuauguaugucaaagaugcaagaugaugggcuggcaaauaggugugggagcccaucuuggguugaagguaaagacaguuuaugcuuguggguuuggucggagaccugccucauccccuuucugucucccuguuagcaugcacuuggaagggcugcaggaugaaucaguugagcuagccuggggugugccagcuggggcaggugugcucuggugauaggcggauccaggcccuauagauagaggguguugcugagacaucugagcgcuaugguagcggcaugacccugaugugugcuccuugcauguccccuaggugugcuaggcauguucuguguauguccuuggcauguuagccuggaaacaucggggugcauguuccacuugugccacgaugggcacauguucaagaagugcccuccuugaggcaugccuuggcacaccccccugccucguggaccccucccucaggugguggacaucaugagggugaauguggacaagguccuggagcgggaccagaaguugucggagcuggaugaccgugcagaugcccuccaggcaggggccucccaguuugaaacaagugcagccaagcucaagcgcaaauacugguggaaaaaccucaagguaaaggggaggagauggggacagguugggaggggcaguggggaaguagggugucacugugucauucaccucccucucacucuuagaugaugaucaucuugggagugaucugcgccaucauccucaucaucaucaucggugaguggggccagaggccagggccccuccccuggggagguagaggcuuucccuggggagccugggcuuugaaggucacuaaccuaguuuuuacucugcaaccaaaacacacuuugcugcuauuggcaguucugacucauuuagagcccaaaacuugaguguuguauagcccugcuuucccugguuaugggucaauccgguuaagauuuugggacuaggaauaccgggugggguccugguguucgucuaggaacccuuugagccuaaaagcuccaucuggggauucuaaaacgggaguaggagacaggaaagggugaggucucgaacaccaaccaccaggauaccacuuacuccacuguuugaaagcuaccgucacauacccagugcauuaaagguuuuaugccccuuuguccagccguggaguuuaagggaccucaauacccacuugccaagucccuuugaagaaacugaggcugagagggaagggaugucagccagugggggaguggggaggcuuggaacagggccaggccugacacacugcuuucuuucucuuucucccccucuccucguccuccuuucucccccucucccucguccuccucuugcccucucuccacaguuuacuucagcacuuaaaucccugaggagucugcccugccuaagaagggccucucccccacccccagccguuccuccaccucucagccauaucuuucagcccccucccuuggauccguguguguguguguguccgugugugugcccccuguaaauagccagcuguuauuuauacauauauaauauuauauauauuuggucuguuuguaguuuuauuacuagaagauuuuuuccgguuguccuuaacaccccuuccugagguucccaucaccucucucucacccucugucccuuuuccucuuuccugaucagccccaagucccuucauuugcaucugcuaugcaauagccccucuccuccuucccuuggauuuaaccgaucuuucccuuaucuucccuguacaaucccaggcccucccaaaacaaaagcaaaccccacagaaacaaacagaacaccccaccugucuaggcuucccuaggcugcaucuuuguaucccuugggaggcucugagacugguuccacuugguccuaagaaucccaagauuuucugggagcuuccaacauguugauuagcauaucauuugcauacgcugucuguuucauuuuguuuuguuuguuaguuuuuuguuuccuuucugauccaucacucuucacucuucuguguuuuuucuuucuuucuuuucggaagagucagucuccauugguccucuuaccacacuuuuauuagcacgacauuaucugcaggugguggggagucuggacuuuuggggaaccaggcugcucuggaccccaagguuuccuccucccaaccccucuagucuaguuugcuucccuuaccccguuucccacaccucuuguacccuccucucccucccccagcugguguguaagugucuuggaguucaguguguuaugauggaccaauaauucugccacucggggucucucccuacauuccugcuccccaguuuucauguggggcacucaacugacauucccagggggucucgcucccucccaucugccugaucugcugccuccucccaucaggagaacugggggccgaccacaaucugguucuuugaggagggguggcuccagugugugggggucaucacugccuuggggaggagugggacaaaacagaaucccccuaauuccugccugaagucucuggccucauccuugcuagagguucgacugaaaacuuuccuccccagucugggggggggguauuacccccaucacugcccagcuccucugacugccccccuguauucaggguggggguacuagucacugccaauauguguugggacuugcuggaggauggggauccucguccuucuccagggcuguugagcccagagagagagagugugagagagaaagcaagcuauuuccuuguugaguacaaugauagaggaaggaucuaaucuuuuuaaauggcacaguuuuagggaucugaggguacagccccuuaaccugccuugggggggguuguuccccaaacucuugccccccacacaccagguuuucuguguggaggggaaccaaggagaucuaaacuguggugugaaaggguaggagagaugcugggggugggggugcuuguguuuuagacccccaauauuaucccaguguccccugccuuccuucuuccccugccccaugcccccaauucuguggcgcauccagauugugaaaauguacaauaaacguguaaugaguaaccauauggug

SEQ ID NO: 6089 - RNA, 2538 nt, Mus musculus
ggcagaagcaugccaacauuuauuucaggguugguggggcuauagugaaccuccaagaaaucuacuagucuaggagacccccaaauuucaugccuaagugauuucuucccaguucacuuagacucucuuccccuaauaaucuccucccuccaguugggucccgccuuauuauacagcuuuaugguccuuaaaccagccuguggccccuuccuccccucacuucccacauuuggggcuaguuccuccccuuccccucccccuucacucccugccuuuccgggagccucgugccgggguccuugagcugggcaucuaggggcugaagggggcggggccgggcccuagcccuccuacccugcagcggcgggauauaaggaucuaggcagcacgcgcugaguccaccgaaggguccggaggagcaauggucacccgggagcgagcugagaauagggacggccccaaggugagaggugggaagggagggaaauagggucccuguucaggccagaggacuuaaagguucuaacucugugggcuaggaaugaggauggagacacaagagugaaaagaccgaaagaaccuguaaaguauaaagagggcagggucagagcccaacuugcgcgggcugcggaagcggaggucuagggguuugcauuauugugggcuaaggcuuguggcuaggaaagugccagaauuugggcaucguggccuauucuagggcucgggaagcuggggcagguggauuaucgcaaguucgaggccacagagugcaccccuaccgaaaaaacaaacaaacaaacaaacaaaaaccaaaccaaaauaaaacaaacaaacaaaaccccacgaagcuauacuauaacaugagauaagcuagaggccauagcugguggaggaggguggaaacaaaaauagaggaaaggcuauggacgcugucuguaagcgccugggaacccacaucugacucaaagagaagaccuuugagucguugguuccggaggugcgaggccaggugagagauauuaggagaacgagugaaggguuugagugagaagaggagguguggucgcacugugugucugccuuucaccuuaggucucuaucgcgcggcucacuagccugggggcaaagaguggcccuaaaguucuucagugauacacugagagggagacgacacaagauagagauauaaagagaaaagaagagugccauagaggggagaagagaggagaaagcugaacacagaaagggcagggagaagugggcgagccacggaaagcgacccaagggacugggaaguagcagggagugagagggaaacgaauggaccagacccaagcagccugggauuaggggaaaggggcgcaugggggguuuucccagcggcaggaucggacgcuugcgcggcggcgcugagucucgguccggucggcccgcucuuccuuucccgcuggucacagaugcugaagccguugguggagaagcggcgccgggaccgcaucaaccgcagccuagaagagcugaggcugcugcuccuggagaggaccagggaccaggucaguuccaccgcuggccccaggccccuaagcauucuguaccugugucccagagcuuucuacugggguggggacauaagcuggaguggugacucuggacccaagccugcuccuugaaaucccaucccagacccccucucgcucucagaacuugcucuucuccaccuugcuggucuguaaguuuccagucuggcucgguaaacugagcuuccagccugcgucaguuucccacuugggguuuucuaaaauuccuuaucuaccucccacgccugaucaaugggcuucaguucugcggugguuuucaccauccggguugcuguuucguacaccucucauauugggaacugguuccacucccucagguuggacaggcucaucucggggugggacgggaacuuuucuuggccaucuccacauucggucgcgagucaugggggcacccgcagcucccguauccgccccucccuucuuccccuagccacuuucccccucucuccccaccccuuucugucucugcgccccuccccccgucuguagaaccuccggaacccgaagcuggagaaagcggagauacuggaguucgccgugggcuacuugagggagcgaagccggguggagcccccggguacagcgcgggggguggggcagcggagggaggcugggagggugggagcccggaaggcuccggccgggggaggggcgggcucugagguggccugggacuugggggagcggccagcugugcaccauggcgagguuaauaacacccgcgcgugucugucucugugucucccucauugcccuccucugcacguccauccggccuccugucucugucugugcgcccgucugaccucgguaucucugcgccccgccccuucccucaaccccguugggccccugcccugcccgccuguccucccgccggccgcaccagggguuccccgguccccaggccaggacgccgaggcgcucgccagcugcu

SEQ ID NO: 6090 - RNA, 3052 nt, Mus musculus
cuacccugcagcggcgggauauaaggaucuaggcagcacgcgcugaguccaccgaaggguccggaggagcaauggucacccgggagcgagcugagaauagggacggccccaaggugagaggugggaagggagggaaauagggucccuguucaggccagaggacuuaaagguucuaacucugugggcuaggaaugaggauggagacacaagagugaaaagaccgaaagaaccuguaaaguauaaagagggcagggucagagcccaacuugcgcgggcugcggaagcggaggucuagggguuugcauuauugugggcuaaggcuuguggcuaggaaagugccagaauuugggcaucguggccuauucuagggcucgggaagcuggggcagguggauuaucgcaaguucgaggccacagagugcaccccuaccgaaaaaacaaacaaacaaacaaacaaaaaccaaaccaaaauaaaacaaacaaacaaaaccccacgaagcuauacuauaacaugagauaagcuagaggccauagcugguggaggaggguggaaacaaaaauagaggaaaggcuauggacgcugucuguaagcgccugggaacccacaucugacucaaagagaagaccuuugagucguugguuccggaggugcgaggccaggugagagauauuaggagaacgagugaaggguuugagugagaagaggagguguggucgcacugugugucugccuuucaccuuaggucucuaucgcgcggcucacuagccugggggcaaagaguggcccuaaaguucuucagugauacacugagagggagacgacacaagauagagauauaaagagaaaagaagagugccauagaggggagaagagaggagaaagcugaacacagaaagggcagggagaagugggcgagccacggaaagcgacccaagggacugggaaguagcagggagugagagggaaacgaauggaccagacccaagcagccugggauuaggggaaaggggcgcaugggggguuuucccagcggcaggaucggacgcuugcgcggcggcgcugagucucgguccggucggcccgcucuuccuuucccgcuggucacagaugcugaagccguugguggagaagcggcgccgggaccgcaucaaccgcagccuagaagagcugaggcugcugcuccuggagaggaccagggaccaggucaguuccaccgcuggccccaggccccuaagcauucuguaccugugucccagagcuuucuacugggguggggacauaagcuggaguggugacucuggacccaagccugcuccuugaaaucccaucccagacccccucucgcucucagaacuugcucuucuccaccuugcuggucuguaaguuuccagucuggcucgguaaacugagcuuccagccugcgucaguuucccacuugggguuuucuaaaauuccuuaucuaccucccacgccugaucaaugggcuucaguucugcggugguuuucaccauccggguugcuguuucguacaccucucauauugggaacugguuccacucccucagguuggacaggcucaucucggggugggacgggaacuuuucuuggccaucuccacauucggucgcgagucaugggggcacccgcagcucccguauccgccccucccuucuuccccuagccacuuucccccucucuccccaccccuuucugucucugcgccccuccccccgucuguagaaccuccggaacccgaagcuggagaaagcggagauacuggaguucgccgugggcuacuugagggagcgaagccggguggagcccccggguacagcgcgggggguggggcagcggagggaggcugggagggugggagcccggaaggcuccggccgggggaggggcgggcucugagguggccugggacuugggggagcggccagcugugcaccauggcgagguuaauaacacccgcgcgugucugucucugugucucccucauugcccuccucugcacguccauccggccuccugucucugucugugcgcccgucugaccucgguaucucugcgccccgccccuucccucaaccccguugggccccugcccugcccgccuguccucccgccggccgcaccagggguuccccgguccccaggccaggacgccgaggcgcucgccagcugcuacuuguccggcuuccgcgagugccugcuucgcuuggcggccuuugcgcacgacgccagcccggccgcacgcucccagcuuuucuccgcgcugcacggcuaccggcgccccaaaccgccccggcccgaggccguagauccagggcucccagcgccgcgcccaccgcuggaccccgcuucaccaauccuuggccccgcgcugcaccagcgccccccagugcaccagggcccuccuaguccccgccucgcuugguccccaucccacugcuccucucgcgccggggauucgggcgcgccggcgccccucaccggacugcugccgccaccgccaccgccuuacagacaagacggggcgcccaaggccccgucacucccaccgcccgcguuuuggagaccuuggcccugagcuuuugggggcuggggcggggauugggggugguguagagacuccagucagagggcaggagagggauccgggcgaggagggcagcggggcgcgcgggcucagcgcgcgggugagauguggucuauauuagaguaucuauauaaauauauauuuucccaucccuuuucccugucccacuucccuguguguagcauuguacucucucuacccuaguccagucccagucccuucccgagucccuagugcauggaauaaaaucguuauuaaaucccgguguguccccuagccaggggccugccuuuauauuggcgccacgccuacuugcccauacccuucucccaccuuuaggccugcucuccacggcccaagcccugggggagacagguaaguaaagagcggagcgacagacugagguuggagcugaacuuuauuugugggucuuuaaauuuuuuaaaagcca

SEQ ID NO: 6091 - RNA, 23449 nt, Mus musculus
augagagccaaauacguuagcuuuuauugaagucacugggcucaaagacagacaauaggaugggaguggguuuaacugggauguggaaagagagcucagaaacucaagcugagcaaccugaugugggagaggauuccacacguuagaagggcauggguucuauugugcauuugacuuuaguuagcggcuuucacccugaacacugcuguacuggucccucacagcucagggcacauugauauaaugucaaggccaucguggucccaugggcagaggagaagguccaaacugagauuaaagaggccuagaaggcccuagggaguuagccuuccccuuaguuguaacuuccuuuccucugggauggcuccaagugggacucaaauggaaacacuguucucaaugaguggaggauccaaguaggcauagggcagugccaggcucugguugcgcucccugauguccuuugagaucugggccaggcaguucuggaaggcugcgaugcucugccguggggccuccucugugaaguguucaucuggguaggugcccagaggucucugggggaaaacagguggagauguuagaaagcuguuccagaugagauagaacauaaugaagguuggcaugucaacaaauacagucaagguguuaucuaaagauacaaucggucaccgccguaaggaacacaagcccuucagaucgcaaugccagcccucuuccccacgaugugacucugaaagaauggcccacacaggcucauguauuuggaggcuucgucuccaguugaugggacaguuugggaaggauuuggggaugugaccuucuuggaggagguaugucacugagguggguuuugagguuacaaaagcccauucuauuccaaauuuuaaaauaccucaaguggcugugcauguuggcacacaccuuuagucccagcacuugggaggcagaggcagguggauuucugaguuugaggccagccuggucuacaaaaugaguuccaggacagccagggcuacacagagaaacccugucucaaaaaaaaaaaaaaaaaaaaaaaaaaaaagaaaaaagaaaaaaaaaagaaaagaaaagaaaagaaaaaagaaaagaaaaaacaaaacaccuugaaccauggaucagcugugaacucucaggagcaugcuccugggccaugcuccccaaugucaagaucacagacucuaaccuucuggaaccaugagcccucagggaaauguuuucuuuuauaagcugccuuguucaccguguuuugucacaauagaaaaauaaccaagacagccuccaaccgcagaagcccaggcaguguagagcacagacugugccuugggcccuagccaaucuagucugagcggcuccucugcugacaaaccgucucaugucacucugacucuggaugccaguuccuggaucucaccaggggagacugaggaaaagcccaaguccagccucucccaacccccagugccggacccacgcuuucaacucagaacacagucacagucgccacucaacagagcuuagcaaacauauuccagaaaacagguccaagacuauaugucaccacacagguuugcuaaacccaaccccuggggacauucagcagccugguucugagauaucuuuacaaucaucugguauaaugaaaccucuguuaucuauauauaaaaccaucaucacgguaacacuaucacacuugggaaccuggacaccacaagcagggaaucucacagagaacgucagccagugccauccguguuuagaacuguccuuccacggucacugucagaguccaaaacgcacggguccaguuccuuaaccuucauacaacaccaauacuacugauguuuuaccauuucuuguuaaauagcagcagucauagcgggaauuauuuuucuugccccugauuuuaaugugaagaccucuauucaucauaaacacaguguuuuuguuguugugguggugguggugguuguuguuguuguuuuaagauauacuuuagggccaggcaugguggcacauggcuucaaucccagcauuugguaggcagaggcaagugggucucugaguuugaggacagucuggucuacaauucaacuucagggcaguuagggaugucguacagaaaaccucugucucaaaaacaaacuaacaaacaaacaaaaaaccaaccaaccaaaaaaauauaugcuuuaauuaaaauucugucagggggguuucgaacagauuuuauuggugauggcucucugcacggaucaaguucaucuucagcugggaugggcuaauuauacaguaugcuuccauauugauggaauaaacaauaucgcuaagcuccauaaggugaaccagccucucggucucagcaucaaccagaccuugccagagcacacuauuguuuacuacacaguacuugccuuuauuggcugcuauguuuuuaagauuguuggagcugaguaguuuauaauuucauuuucuuaauaacaguugacacguaaguacuuuauaugaaccgucacaaccauacaaacaaccccuaggacgggcucuucugugagacccuuuguagauaaggaaauugaggcuuagcauggccaaauuagagacgucauggauaugaaguguaaagccgugacuggggcccucuaaugagauccaccucccuuaaaggucacagccucagcuagcuggagaaccaggcucccgugauucagaaagaucccgccuuuuccugugcuuuccagagguuugaaacaccaaggaacugggcaugguuuccuugccuuagaucccaggccugaaccugggacuccguaggagccgaccugcgccagcacaccuacgccuugugugugguuuccauaucuucuaaagcgcuagcuguuucuguuuucuuacaaggccauuugcuucaucccaaguuuccgugaaacuguaagcaguauaacuuucucucugugaauuccccauuccucauguguacuuuuguucauauauauauauauauauauauauauauauauauauauauauacacauuuaauuagaauugcugggcuggagagaugguacagcuguugaaagccaggcucacaaccaaaagaucagaaaucauuuauaauuucuuuauaucaccagucuuuucuuuuccuuaacaggguuucauucacccgauagcucagguuagccuagacgucacccuauagcccaggcuggcaugugcccacaccaauacacacauuacuaaaauaaaauacauuuuaaaaagauagagcauggugguagguaugcuugcuuaaucccaggacucuggagggagaggcaggaagaucucugugaguucaaagccagccuggucuacauagugcguuccaagauagccagggcacauagagaccuguuucaaaaaacaaacaaacagaaagacaaacaaacaaccggcucuauguuuauccagcaaacugauaccuaauuccugaaucaacaacagaaucaugagaagagcggaacacagaagcauaacagacuaaauccacggccaucacagaguugcuuugugagcuaagcaaacuacuuaauuuccaaaugucaauuuucuccccuacagauggucaccagcacuauacuaggcaucuuaaauauagcuacucacuugcuuuguguuauuuauuuacuuacuuacuuaguuacuuaguuaauuauuuuggcuuuuccaugauagaguuuccuggaacucaauauguacaccaggcuagccucaaacucagagcuccaccugcccucugcuucccaggugcugggauuaaaggugugcugccaccaccgccuggcuacuuguuuuguauuuuaagauacuguccuuuauaucugacucagugacugagacacagaucagauccucauaacuggcaguuacuguuauuguuguuggaaguuucccuggcuuaugaggggggagccuccgaaugaucgucuuguucauucauuccuuggcaacagcaguggguagggucuaaggauaaguuccuguggucccagaguaaagggaauggaccaguagauacagggguuugaugccacccagggugaccugaacuucuccugggcccuugcgguaggagagcagugacugcugagaguugcccucugcccuccacaccugggcccaggaaugugcaucccauuccccaguagauaaaugcagaauuguaauuuaaaaaaacuugcuaggaaggcuggggauguacuucauguuacagugcuugcuuaaaaugcuuaaagcucuggauucaauccauuucucaugcacucgcgcacacacacacacacacacacacacacugaaccaggcacugugguacaugucuauaaccuugguuucucuaaagacugaaacaggcagagggcuugaacccaggaguucaaggccagccugggaaagacugagaaacucauuuuuauuauguuuauuuuauaugguuuuugccuacauguaugaauguauguauguauguauguauguauguauguauaccacaaacaugcuggugcccacaaaggccagaaaggaugcuggauucccugcaacuggaguuacagagcuguuagccucuauauggguacagaagcaaaccugaguccuuuggaggagcagaaagggcucuaacugcugagccaucuuuccagguccucaaaaauaaauaaauaaauacauacauacauacauacaugcauguauacauaaaggguauuguggcacacagcuuuaaucccagcacuugggaggcagagucagaaggaugcccgugaguuagagcccagccuggccuccuuacugagcuccagaacagcuggaacuacauuaaaaaaaaaaaaaaaaaaaaaaaaaaaaacucaaaaaaacaaaaaaaccagacaaagcaaacaauaaaaauuuaaagaaauaaaaaaguggcuagagagaauuuuaaaaagaaaucuagcacuagaaaaagccccaaaaaaugugagaaaugggggugcucacagguaacaugugacccuggcguggggcugagaucaagaagacagagcggggccgaggcgaggugugaauggccaugcugguaacuggugauucaaucgcugcucacuuuaguccaaacuccuucgcugucucauuuccucucucuaaaccugucccucucagccagugacacagucagaggaacacccuugguaggccaaauuaagucaugucaccucuaguuuaaaagcccugaguggccucauuguccucugaauaacuacuucgcaaaguccuaccuugcucugcacccugcccugcugugucacugccaaaucucaaugauccuaugauacucucccuuccacuccugcuugucccucccuuugccuggaaaccaaccuugucccuccucugccugccaaacuccuacuugucccacggguuucagcuuguacgucacguccuccaugaaacuuucuuagauucucccagacccuaagggaggucucaccaggcccuacccgugccucuguuucaguacgauaacaauuccagccgauggugcuuaggaagugauggugaauggaggguugauauaggaguguuucccacaacacucugauguucaccucuauauagcauuaaggugucauguaaguggugguccaggugaugggaucucauucaacuuuaaguagcuaguaucaagcacuaugcagacauguaggaggagccccauguguaaugcuugggugaauuaacgaguaguugauggaugaaugcaugauuggguagcuggauggauggauggauggauggauggauggauggauggauggauaauuuguaaaugacauagauaucauacccagccacuaaaguggcauuugcuauuuccuauguguguccuuggagaucaaguauuguuuccuguuaagacaaaaagacuuucaaggcagcugagcaguggacauaaaucccagcgauuagcauucaaccuuccuucuccagagcaaccucuucacugugcaggcccugcaaugcccagccugugucucgcaucuccacgaacauaccugguccuuuggcucuuggcugaccagccagaagaggagaagguuucuacaggugguguucaccucugggagggugucuagguaacucuucauugucgugucgcccuuggucugaggcggaggcugccucauggaugauggggcguugggcauccaggccccaaagucaugcuguggagacaaccccaacacccugguuggaggugucuaagcauccucucccucauuucugauuccaccaccaucaucccagaucucaaaguuuagaaacgagugacuauggaaagucccagaagcccaugucacccguuugucauucucuacccacuguuucacgagugggcagcgugagucaccauggagggaggagaacccagagaagaggcagcccucaucagagcccuugggcagguaugccucaagaauaccuugaugcucuauguagccaguucuugccaaauucaagcucugaucccaauuuauaucagacucccaagagucgccacuguaacuuuggaugcaaccucacccaagcaucacucaacaauagcccuucaccccacccagucaccacuccaaccucaaagccaacaauaaucccaccccaacccugacccacccauucacucaggcagaaccuugacuugaguucauugccaaggcuaauacaccuuuggaagcuaacacauuggguggcccagugccccuaggcuugcucucccaagccuuaccugcccacuauugaccgcagcgugcugggcggagcaauuaaagaugauugcggugagauacuucacgagcucuccuggggugcacagccggcuugggaagccuggguguggaggggaaaggaagaggguguggguauggaugggaggcgcuggauuccugggggugucucagggcaggggcucacugaaaggggagagggaagaaauacgggcuagacauggacuacaaccauuaaaauuagcucugggauggccaccaccaagaguugugaucuuugaaggggaucaagaucggauugggucgauggacuggaaaaugaugaaaaaccggcucucuacagagccugugacagagcccgcaccaagcuccccaucucugcccuggaaggcacuuccguugcuaguuccucucuagcccauagcaacauucaugacuuaguucugcucuuguugccaauguccaugcaaguccaccagcaaagcauccucugcuuagcagaagcgacaagagaccacagagugcguuccucagacguucucagcggggaaggcagaaggaaagacucaaggaaacguuugaaaccuaagaggagauccacgggacagaaacuagagcuggggcuacaccguccuggaaagagagucuuccuguguugagggauaggugagauuuaaauaugagaggcuagaugcagaggucacaucuauagucuucgaucuuugggagguugaggcaggaccgcuggagcucaggaguucaaagcugauuggaugcuacagugagaucuuaucucaaaacaaaaacaaagccgggcagugguggcccacgccuuuaaucccagcauuugagaggcagaggcaggcagauuuuugaguuugaggccagccuggucuacaaagugaguuccaggacagccagggcuauacagagaaacccugucucaaaaaaaacaaaacaaaacaaaacaaaacaaaacaaaacaaaacaaacaagcaacaacaaaaacaaacaaaccaaaagggcccgaaagacaggugaaggcucuugucaccaagccugacaaccugaguuuaacacacacacacacacacgcgcacgcgcgugccauguugcguacaccagcaucauacacacacacaauaaauaaauguaaugaaaaucaauagaacaauuuuuaaaaaucacuuaaaaagaaaaugcagaagggcuagcgacucggcuucguuguuagcgugcuuuuguuguuguuucuaaauguacacgaagcccucaguuuucuccucagcacagcauaaacccaguguugguggcacaaggcuguaaucccagcauuccauaguggaaacaggaagaucaguucaaggucauccuuggcuagguaaugagccuaaggccagucuaagauauaugugacccugucucaaaauaaauagaucaguagauaauaagagagcccugucaagcuugguccuccaucuuccuagcacacggaccucacccaaguucaugacuuuacucucuggcucugaugaaugaaaucacagacaaguuuaauaaagcaagauagaggaugauaccagugacagcuaagcccaagugugggucuuaaguagaaaucaaccauccuuguggagguaagggauggagcauggcuuuugguacugaaguagggguuaugucuggaacggaucccucucaggugccaaaggacaacuguacuuuuuuuuuuuuuaaggucuuucuauguugcucuggcuguugguucuaugcaggccaggcuggcucuaacucagagaucugccuuccucuaccucagaagugcuaggauuaaagacuacccaccacccuuggcaugacaacuguauucucuuguuuguuuguuuguuuguuuguuuguuuguuuuaagacaggguuucucuguguagcccuaacuguccuguaaauugauuuguagaccaggcgggccucgaacacacacagguucuccugcuucugccuccagagugcugacuuuaaagaaguaugucacccaccucccuccugacaacuguacccuuuauccaggcacucagaucaaauucggugugcucuccccuccucuuaccucacauuacacauaucagcaaacauuuccagaugcccaccuuuccuggucgcuauguuuuccaccacuauccagucaccaccaucucucuugggugaguccugcauuuccuccucuauccuuuguugggcuaaaucagggguugaaggugguauacacacacucacacacacucacacacacacacucacacucacucacucacucauaaaucaaaugaugucaccuuucacuagaaccuucuagagaguuacccuaucacucacuuuacuggcuccuuguuccccucccaacuuuucuucccuuuaccuacucuacucuggcuacacgggaggucuuugugauauuccucaaacacucugguauacccagaccucagggccuuugcacuuaucguaccacugccugaguaucucaucccaguuauccacucaacugcuucccucaaccccuuuagaucuucacucaagccccagcuccucagagagucauccuauggcuaccuauaugaaauauucucccugaggagauucuggguuccuuccuagcacucacagccaucuaacacaguugcugaucaucgccgucucccacaaaccaugcuaaguuccauuaagagcagaaguuuugucuauuuguucgcugcugaaccucagugucuagaacgauacuuaauagauauuaagagcccugcaauugccgguugaaugaagugacaugagaugcuaagaugcaggaaugguggggcaaucccugggaggggauugaagcuaaggcugcgguaggacagcugagcaugcgcuucuucgugguuucugacgacuguccggggagugaugcuacaggcuuaaugagugggcugcaagagucuggaagaggggaggcagagggaaagccaagagucagagucuggaacugcaguccugaugaugggaaaggaugcagagaguagagauuaaccauccaccugggcccaggaagacagaagaguacucagauaguuagagccagacuggggggugggggcaguuaacugagacggaagaucaggcauuggcccagugaucaggcauugauuggcccagcguggguagggagccucugaacuucccauccuagcugauucucuaaacccggaaguaaauaaagaauuaaugcaggagucgggccacaggacuuuucuguaauucauaguguuuauuccccuacccccuugaaaucugaaagccauaguccaauuggcccguuagugaauauauuuuaccuuuaaauuagaaucuaaaguaaguuuguacuggcuggaagaguuguugucagucugaaaaaugcuauagugugcagacucacagacaagcuuaauaaagaggggaacugaaccaacaauaauuaaaucucaauuugagucuuaaacaggaaacauaagccaagagaaagaaacagccaggauccugauuaacagugcguuugcaaaacacaggaaaaggucauccuuuaaacuacuugagagaccuggcugucaucaccuuaaccuagaaaucgcaccuggccguguaaauguugagacaagcugacaucaggcaacuuucaauaugaugcaaacaggacacagcaucaccugagaaguauucugagaaaaaugugcagcccucauacauuccucccaguuuacaaaaucuacaccagacaggaacaagacgggucacauaugagaaaacaacuagguaacacgcuggacagcauaaaccugggcuuuuccauaacuacauguggucuaacuauaaacauuuuuaacaggaggccaugcaugguggugcaugccuuuaguccuaacacuagggagggaagggcaggcagaucucugaaaguuuauggccagucugucuacauagagaguucuaggccaauaagguauauagggagaccuugucaaaaacaaauaaaaaauaaaagucaaaacaaauaacaacaaacuccacaaaacacuuaaguuaaaggagccuuuaaaguuuaaauaagauauggcccuugauuggcuccugucuugguuggaucgauggaagaaaacagcacaauggagaaauguggagauggacuacauaggagggugauaaugaugaguacugacauuuugugguacaacaccugcuuaccauguaugaagaccuggguuugauucucagaauuucaaaagguuauccaaaggguacugugggcugggugucguggcacaugccuuuaauuccaguacucaguagggcacacaggcgagcagagaucuacaaacugaaagccuggucuagccuggucuacauaucaaguuucaggccagcuagggcuacauuagacaugcugucuaaaucaaacaaacuccagcaauaaaagcaaaagauucaucaaaaguaguaggcuggagagauggcccagggguuaagagcucuuccagaagcuuugaguucaauccccagcaccuacaugguggcucacaaccaucuauaaugggaucugaugcccucuucuggcaugcaaguguaaaugcagagaaagcaugcauauauaaaauaagucuuuuuuuuuuuuuaauggcaaaauauugaccauagaaucugguggguaggcuauuuaugaagguguuauuagaaugugcucuaguauucuguaucuuugaauuuuuuugccuaaaagauuaaaaaaauacauaccaagucccuucuggcuaggacugcaauaguuguucuuucuauuugaaggugacuuaaaacucaccucuucuuugagucuccccagauagaaguccccuguguggccaccagaagcagucgguuagcuaaaagccacaucccuacugagagcccagaguaagagaaacugguagguggacauuugagccucuuuaauaagcaaagacagaaggcuccguggguaaaggcacuugacacccuaaccugguauccugaguucaaccccugggagccaugcgguggaggggagagaacugauccugugaguuuuccucugacuuccacacacgugcuguuaugaucccauacacacaaaccaaacaaacaaauaaaauguaauuaaacauuaaaaaaaaaaaaaaccaggccugguggcauacgccuuuaaucccaggacuggggugacagagguaggcggaucucagacuuggaggccagccuggucuacaaaacaaguuccaggaaagucaggguuguuacauagagaaacucugucuggagaaaacuaaaacaaaaacaaaagccaaacaaacaaaaugguaaaauaaacaaauaaaaacaucuggucaugguggugcagcaggccuuuaaacagagagacagagacagagacagagacagacagaccaagaccuuuggaaaagucaauguugaauuucuaaaccuggaaauguaccauagaagacaacagaaguaagguuucuuccauuaagaagacuguguaaaggaaucacagagccaggagagccaagaguuaggaccaccagggagcaagagcugagacuccugggacugaaagaauacuaagggagggagggagggaaggaggaagaaagggagggggaggguacaaggggggagggagggagggaggggugggauaucugcugggcacugcacuugaggaacagagcugaaaggagccaugucaucggcagauugggaagugcuacaguguaggugacugagcaucguaaacuaggagccaagcagggcaugaucaaucauuccauaaagaagcucgugaccacaggaaguggggagaaaauuagcggcuggcaugacuaccuagcaagaugauuacaaaagcauguaagaaaaaguucuagaccccguugaagucagcgguggcccccaccaccuggugcacagcagauaaauauacccgaagguggaggaaccaugaggucaaggcugacaagcaagagcuuccgaaacaguucagacuggcuuagaauucugccuuagcaguuaaauagaauaaugguauauggacuucagagauacagcucgguggggucagugguagagcucuugcuuagcaugagcaaggccccggguucaacccccaacaccauauuaaaugccacuuaguaguaugggcuucaguaauaagaacugguucguggaggagagguagaugguguaaauaaagacagagagggguaccugaacuuucccguccgaggaacgccugagcaaaaaucucacccacccaggccugcaguucacaguccugcugcacagacgcaucgcugggauaauaguaacucacaaucucugagacaaaccugcaaggaaaaaaaugcuggugccccuggaaugggcaagggccuagaccaggccagacauugaggcccaggacacucaagguggggagaagcagacagccagagucuacuacugaguccccaaagacagaaagugacuucaguaggacccacagaucgggcuggaaacauugccuaagcuuuuucuaaguacccccacccucuaaaucaaagaaguuuugggucuccucucuaggagguaauggagaggagagucuauguguucugcucccucccuguucagcaggcaggaggaagaaacccugccugccccaacaagcccgaaucuucugcuccuucccuuuuuuuuuuuuuuuuuuuuuuuggguuuucgagacaggguuucucuguauagcccugguaccccaccccacuuuguagaccaggcuggccucgaacucagaaauccgccugccucugccuccccagugcugggauuaaaggccccgcuccuucccuucuuuaaagcaacucccaguccccugcuaucucucucacagggaaccugucugccaguuccuauuugagggaguuucuuaaacuggauggagucaagacucuggccucaagagcuccaaccgacaugaaaacaggagcccacgaugcacccugggcccggagaccuugguggcuggaaggaccuuaggguccccacaccucucaauagccgcccagaucuucaggccgucgucucgguagugguaguugggaauggucaggacgccacgagcccguaugcuauccgguaggcagaaauccguguaggugaagugggccagcccggugcucaugagguagaugaggcccugccuaccgauggacgugaccuggggacacaggacacagcugggcuucucaaacuggcucacacuccacccuauagugccuggagaccaacugaaacuaauggaucagcucagggaguggagggcauaugcgauuuaucaagcagucaagggucacgcgggccugcuaaugcggacuggacugcucagacugaggaccuacagagugcaggaaggggaccuugagugacaacguagggggagacgagaucucaggaucaucugggagccgugcugggcuaaggcugccuugcccauaaaaccuacuuuugaggggguaggauugaccaacugggucaaggcuuaggggaggggcaagaggcguaguuuaugggaagaggcagaggaggauuacacaagggucuggggagcaagagcauaauuugugggcggggcaagcauacuugggggcggggccuuauggucguggcggggaggcugcaccuuguccacgaggccgucuggguugagcagcguggcucuugcgaugguguucacuugcagcguguagcgaguaugaggaagcaggagcugcgagaggaacgaggucacgugagccgaagguccgggaaggccugcaggcccggcucccuuuagucucaacccagcaucccgcggaccuuguagacuggaugacagagcggcagcugacgcaguguagccauggagaaggccucgcauagcaaaugcgugcacagaaaaugcguguuguucucgugcaccaaaaacucagaguugcgcacccacgucuuggccagcagccaguccaacucgcaaucagugggcagaaagauggggcucucuggcccuggugucuggcugagcugcgugacagaguaguaagagguguggcucaagccuguuagccugaggcuccaccuccuuaaaucucaucccgaggcucaccuggauugccaauggcagcagcacccccuguggguugagccacaacaggcagaggggcgcuguuacguacuguuggagaccguuuaugcaauggacuggggccuccgccaggauccaguaguccgccaggaagaugugcccccucugaagaaggcacaaagagacuuaacaagcccucuccucccugugucccucuuuucucucugcucucugcaacaaggaggagcugagguuccccaguucgagacucagcaguucuugcuaccugccacuaauggucaacgcuagguaccgcacccuucccagaaugcccggaaugaagucuaguugagucugucauuguguaaucccucaccuggccucugggauuggacaaggcaacuuccucugcuccuccccccuaccuugucagcccuacucccucagcucagagggacuccccuccuaagauaugaccucaguguaucuaacaacagcgaaaucaauacauaaugaauuuaccaaccacagccucagcuucggagaaugucugagggcuuggcugucacagaggagaauagguugucaccuacuccacauccucggagcuccuaguccuuuguaaucguuccugcuacaccugccagucuucaguuggccuguccuaaugcaguccucuuuagcuuuaacauggggaaucuccaagacccuaaaacgguccucaaaccaccccaagucccacccggcccuccuccguaucuguuccugaaacauaagcaggccugcgcuguggauagggcccacagaccuggaccauuccaccgucacauacaguccuaguccacaaugguagcccaccugccucccuccuauuaugaccacugcugaggcccucacccaccucuagcucuguuuguaggcaggugccuggucccagcaaaggugccaccaugucauuggugacaggcagcuugcugggcaagcuggagaggcaaugaagcaugacaggguugacaccauucagguacugguacccaaagaagcuguccucacaccaaugcucggugacguacucugguggggggauggagggggugacaagagaaggaaccaguaggucuggaguguacuuuccaaacucugguccugcccagcccuuugcuacucuucauggcuucaguuuuccucccagcaacaggacaagguggauguaacuacauuuucagauacaguagaagucagccaucuccaccuggcucugcacaccugaagugaaggucuuauggcaccagaagauguuccggaugucguccagccucuuccaggagcccuugcgguccaggagaccucgaaucuucaugccaaaggaucugagggacagagaaggugagagccagugcaggcaggggggaggagucaccgugcucguggcuggagagaaucaguggguucaucagagaaggugagagccagugcaggcagggggguaggagucacugugcucauggcuggagagaaucaguggguucauuucccaaguaaaagugccuaacagucgacaugggagaaaagccuagcaguagggugaagcccugcacaguccaggguccuccuucaaaagcagaugucccuggguuucccgugagcaaacgcagugcugcccucgcuggaguugugaccugccaucuucaagcuucuaagaaucucugagcccuucaauggcuccuuucugccuauaaggcaaagccucggcugccaagucuggcugggucacgaugccgcccuccggcaacucucuauaaccuuuguaguguuuucucccaccccucugcaccaaccaaggccugguuuccaaacauaaucaauaaggugcuguguuugcuccugggcuggugaaaaugggguugacaaacugggucaugugcuucugcaucuuguagaugcuuauacugccugguuuuuauuuuucacccaugagcaucagagauuuaaaaaaaaaaaagucuuggaauaagauuggcuuuuccccuauuuccaaggcuccauucaagcugagucucugcuaguagccucuuacuuacuaccuaaagucagucuggcccucuaggugcaacucagacaccaguuccuugccugacucccccaaagucccugccucguagcauucaccauccccuguguuucauuauaacccuguccaucugugacuuccuauucuacuauagcuccuuagggaaaggacucugcucucugaaucccaacacgcccaccuccucgcaaacacucaccaaaugggcugaauuaaagaaaaaggaauggaguucagcacagguaggguuguagcaaggggucgcuaaggcaccuggcuaugugaugaugcugauguucccugaagagugugggcagcugaggaaggcagaggguggggguggacucaugacuuuacagacccaaggucaaggucauccaugcucacaaagugcuugcucaccuacugcgcaaacauuuguggagugauuucuaagcacaacccaggagacaaaaaaacaaaacaacaaaacaaaacaacuaacgacuaggcagagcugagcuuaguaacacaaaccuauguaggcccaguuaacucggcuggcgaaggaaaaucacaugcccaacccugccugccuggguugcagaggaaaacuggaagagcuaagucaugaaggcagaggcugaggaggcaaauaagcaaagaggcucuuuuccuuuccaagggucugccacaaauguccuucacaacacacccuggucaccaagaccaggcuuggcucccucugaccuuacuugggaccccugcuggcgaccccauucuugcuuagaccuuaacauacuucucagacucaccucuggccuucucuaccuuuccagaugcccccauggucccgccuggauuugauaauaaauacauccuuguccugcagccugagccaccuguggcugcuucaugcccuguccaucccagacaauccaggaggcaacucuagugauagcacaauuuaaaaaauccuagcugucgaccuaaguugauaaugucuguccugacaacucuuaacugcacacaggcaucuuuagugacccagggaucccuucuaccaaauggcaucuccuugaagagacugucuaucuagagauuuugugcuuagauuaucucacuggcuuuuccugcaaaccuauaguggggguuggagagauggcucaauguuuaagagagcacuagcuucucucaaggaaccaggguucaauaccauuauccacaaggggcagcucacaacugccuauaaccaagcugaugccaucuucuggccucugugggcaccagcaugcucaugacaugcacucacauagacacacacacacaaacauuuaaaaaaauauaauaauaacaauaauaaaguaagacuaaugaugucugagugagugggucauuuuacccucugggcaauuguccagagacuauguaagaauuaagguuaugcuaggcagggcaugguagcucaggccauuaaucccaggcagaagcaaguaaaucucugugaguucaaguucaaggccagccuggucuacauagugaauuccaagacagccagggcuauguagaaagacccugucucaaaaaaagaaacaacaacaaauuaaaguuacacauccagaaaauaugggcuuuggaguugaaccugagauggccuggccucaccuccucaaggcuuaaggacaaagacuauccuacuucauuggccccugggaccacacccugaauagggaggagaugaaggacaaagcaaagggaggcugggaggaaggaaggaaggaaugugaagaucuguggggaaaugggggcagagagaagggcuggggcuguccugugaggugccccugguauggaugggaaagaaggggccaagagcagaggugcaggggaaaugacaggcucacgcaggaagggcguugaagaucagugaggccgucuugguggcugaguaucgaauguuggguuccaugugcagcagagaugggaugucaaucuucauaggaaagccaggcagguaccgguucccagagcugaggaggggcagguagagaggauagaaccagucauuggcccuggagccugucucccuuaauuccuuuucucagcuuguccccagauuuucuaguuccucucuuacuaagucucaacccugcccuuucugcccaaagcagaaggaaccucuuucuuccucugcuaaccacgugaggaucaucacucgucccucuccugagaggugaagagaacuugacauggacucggauaccucccuccgcucugccagcguccaucucaacacacgguggucuacuuuccuccccuccaccucuuuccccagccuucgcuucucacuugucauccuguucugcacaagguacugucuuggucaaggcaaauuucuuaucugacuccaucuccugaaagcugcugacauccaccauccgagggaagccaggggcgaagaucuuccagcugcccagggggagagacagaagcaaagguuaaucuugggauucacaggguccuuuacuucugaaaauaugacuucaggugagcacugcugcuuucugcuugcuguauucgugacaagaauuggauuuccucccugaaggcacugggcuucaccauguagggaguggaacgugggaucuugugcgugcuaagcacauacugcacugcugaaccacgucccuaagccaucccuaagccucagaggagugcugggggaaugacauagaucccagcaccgauucagagaugggcuuauauuaugauuaaaguaaaacgagcuuggugacacacaccugaaaucccaacaauuugaagggcugacauagaccaaucugggcuacacaguaaguguucccaaccucaaaaaaaaaaaaaaaaaaaaaagucuggaugcguuugaggguucaccaagacugguaaauacaguacuguuuccaauauggggauuugauuuccaucgggacaguagaggcugagaaugguuaauugauggucuugguuaaguguuggcuuugggguuuuaugagaguguucaagggauugaacuuggggccuagagaaugcuaggcgagcucucuacuccugagccacagcuccauucccugcugaaggaacuguugauauugguauucuggguccagacucaggauuacuguuagaguggaguuaaguuuaaaugauaauccuaaucugaauuggguucccaaggguuuuuuuuuggggggggggucguucccaagguuuuaacugaaguuagaauuaggaacaaucugaguaaggcugaagucagaauaacaguggggcaaagaguccaaucaggcugcucucaccgauaacauucuuggcgggcuuggaguucccguuuccugugguccagaaggaggggaagagaauccugacagaugguucuugcuguagggagugaaagccacucuuuauaucaaucucuuuucaaacaguacuuccuguuuccagugucugagcccccuaacucuuuagcacaaucucugcuaucaucuccccaugcaucguguuggggaaugucuauauacgcuuuguucauccaucaugaguuggaagcuuuagcaguguaccaagucauagguguguuccuaaccauucauguuugucuccuacaugacacacuccugaggauaccagucaugucaugcucauugucuguccuuccagaguccagcuuggugccuggcuaugcuaggauacucagcauacacuugauaacuacuggaucaauacauuuuaauaaagccaucauguucucugaugaugaguggagauugauaguaaagucaaugaaaaggucauuguagacuguggaaugauguucacucaccucacucuaacacagacacccaucucucaucucugagacuuaucauaacauacacacacacaacgcgugcauacuuguacacacacaaaaucccaguguuacgucuuuggaacaaagaguucuggaggcaagaaagggcucaaaccaguauccuugaaauccaaaauucaacaaaagagccuaacucacuucccagacccuucauccccaccagaaaagcuagaaaaaaguaagguacaggaucuuugcagguuaauucucuaaauauucauggcuuuucuaccuguugagaucuagcuuguacguuuauuccuuucugaguuccagaagaccauauucuggagaaaugcagagggauaccauuagcugccugcuaugggagugugagucucucugugugugcuuaucuguguccgucugucugugugagccugucuguguguaccuccagaacaauaaacacuacccaggaagcucuugcaugucaggacuuuagcagugcucuuuaucagacacuguugcuuugggaucccggcauuccuaaccccagucacauucccuacgcgccgaguucugugagacuccauuccuaaccucacacgaagccucugcaguacugugcagucucugucccuugcccaccuguuccuggccgcagcuccacaguacaguagccaucgauccacugguagcagggaaaguggacagcagagccaucgggggcagugacacagauucgacugcaguaccaaggguccuugcagaagaaagcaaagcgcuccuuguguaagcgcaacagcaagaucucacccagcucugcuucacagcgcaccuuauacuucugaaccuggagugagggaagcagcaagcaggccuuugagcaaccaggaacugucgaggacaucuuugcacucugaagugugcaucaacaccgcuaccuuucugggauauuggccugagcagucguugauccaugugguuccuuugugugauugagagaaagagcccgucuccauccagagaggagcaggcaccauacucagugccugagugaauuuuuguagggauuccuacccucacugccaguaguucacuuucauguagggucauuagcaaacuaaacuagcgaccgacaaagcagaccccucccaaagaacaggagacccaugaucugaucagaggaaucaauuuggucaaagccuagugucaauuaggggaggagccaggccaggcagugguggcuuuuaauucccccugcacucaggaggcagaggcagucagauugcuaaguucaaggccagccuggucuacacagagaguucuaggacagccagggcuacacagagaaacccugucuggaaaaaccacagaaaauaauaacaauaacaacaaugauaggagaagccaggaaguuaggggaaguccccagaauccauuccaaaugcccuuccccacagcccugucucagaacaauugguaugguuuaucgucucccaaaagucagggaugucaaagaaaaugaucacaggacauagcaggcauccugaguucagcaggacuugacgaauccaacaagaauaauccucacuuccuucagguuccccaucucuccucuguacucaccgauccagaggcgaagucccugccuacgcgauccagcuucugcuuagggcuuucaccacaggugccuaccaauguagcauagauguuauccaaugugccagccuucagguaggaaccaguggucacacacagccgauauacugccaugacuggacccaauaaccccaaaccaguagcuagccuagagaagguacgcuacagguaagagagagucagcuccugggcaggaggcugggggcuggggaagggugggccugaggaaggauccagcucuaggacguuccugggcucgcgcgcgcucucucucuuucucgaucucucacggcagcuccgcugguagcucgggaguacuauccccacccaccgacuugcacccuaauacuuguuugcaugccucugacacagccugucccucuggcuggcucauccagauggauaucagaagccugggcccauuggugagggagggaauaaggaaggagggaccaaguggcaaguggaagacagggaggaggugacgcguguugggacacuacuuugugucugaucaguggcuugacuaauguccugaagcccauguucacccauuccccagauuccaccuagagccuuuuccuccuauuuccaaaccagaaaugggcaccagaacaccagaauuccuacaugugaaucacccacgugaaucacaccgugcaucggaaagcugcaccaauucauaaaugccaggugaccucaucaacaaucaagugaauaacacacaucuuagcacgugacaaggccaucauguucuccuuccugccaccgacccacccaucuccuccuaaagucuagucuucucucugucuccaguuuuuguuauucccgaccucaaucacuccuuug

SEQ ID NO: 6092 - RNA, 1329 nt, Mus musculus
ccauuuugggaaacauuuuggcaguaccugauguggcaaugcacacccuaugaugcagcagagcugucccuggggacaugcccuagaaaaagagcucugcaccagagacaaguccauagaugucacagaaaaauaaaaugcaggcaguugaauguccuuccaccaaggcggucucacaucaggaaauacucgcagcaguucagaugggugaacuguaguuacagacuccugucugucaaucugucugucugggugaagguccgaaacauggugcugagugacagugcaaacugugggaggaaaugggcaacacgugcugcuuacauaacguuaaaaucagugcaggcuagcccaguccggcgugugugauuagaggcagagccgggugagaaggagccccacaaugcaggggcucaccuagcucugggcauuggaggugaggagugugucugucugaaaugccaagggagucagagacagggcagagugagacagagccgcugugugagggagcauaaggugguaacugcugccuucuggggaagggggaauggucagauaguggcuauguuacaaauaaagggagccaaguuuguguugugggagagcagauguacagacauggagaagacaaaaaugagccaguucugcuacugcuuuagguuggguuaucauagaggaaauauauagagauagacauggaagcagacaugaaugcaagcugcgugcuuaucugucugugguguguuuccuagcaauaccucuacuuuucccagacugcuauaaugacugacuguaaacuggguagcuguaaaugacaggcauccauucucuuacuauuauggaggcagaaggucugaaaucaagguuggggcaggacugugcucucugaaggcugcaaggaagaucucugucuucuuggcuuccaucaccggcugccaacagccccugaagucccuuggcaugcagcacaacauuuucccugaaucccuguguccuucuuggccuuuuuauaaggauuuauugguuuuaggauccaucuuaauccauuaugacauuauucuaacuuaauaucuucaaaacaacuucuaaauacagucaccccauuuaugagcaguuuggcuuucuaucauuuggacuguccacagucaacugcagucuggcgauaugaaguggagcaucccagcacuaaacaaugggagcacucugcugucuugguuguuuacaaacaugccucacuguguucccaggcuggccccaaaguccucaaauccuccuccugcuucagcugggaccacaggcucgugcugacgggcuccgcuucaauca

SEQ ID NO: 6093 - RNA, 24407 nt, Mus musculus
acguucccgggccucugaagcccagugaugugcggggagcuuggucucgcgggcgggugacguaauucgguuggaggcgggauugcaagcggugggcgggaggcugccaacgguuuugcaagcuagugucgcgcuagggagguuggccuuuggucuuucucuguggagguuauggggcuugggggacaguccuccucaucuugggaaaccagggccgacaugcucagaguagucggagccaggugguugcgguagagaauaccaggcggcugguugccggguguaugucugugcgcgcgcgcgccccuuuuauugagauuucuuagggugggauagggaggaauucuauggaccucugcuguggcuuuuuuuuuaucaggaaggauuagaggggaaauccgaggaagucgacucugggugggacaggugaagaaagggcgaaacggggguguuguggcauugaagucuugccucuuucuucacuaaaaccaauugggggacauacauugggccagcuuugguuugaggucuguuucaguuugcacauuuugaguguggggaaaaaaaaaagcuaaccaugguuaacccgugccgaaacugauuugcaauuuccaggacccuaguuaggaggaaggaacugcagcgguucugucucccugcaugcaggucuucugaccauuccccugacuuucugccuugcacauccgcuuuuaaccguucccaggaguugggagaaagaauguguuugcccucuccauggucucuggagucaguggacacuccucuaaccagaaagcucauuuguugaggacccaaagugucuuccucccuuccaaaucuuucuucuuugugaacuuauccacaaguuuggaccccucucagaacugaggcaggaguucccaguccccugcugaguccaguugucucuucacuguacauggcgacagcagcccccagucccaguucuccucuccgaccugaggaccuccugagcgauucgucagagccuccuggguugaaccagguguccuccgaggugaccucccaacuguauacuucuuugcaucucagccgccaagcugaggccacggcccgggcccagcuguaucuagcucccaccuccucaccuccuaacgagggcuuagacagcuuggcucaagaacugagucgcagcuuguccguuggauuggaaaacaacuugaagaaaaaggugagagaggugcgucuuggagaucucucggguguuagaaagcauuagguuccugggcuuucagguuagcuuugcuguggcuugcgucuauuaauuagauuuaaacgaucuccuccaagcacacagggcuuucaugcuuuuuucucacagaagauacuuuugagggaauggcauaaaccuauaauuugggaaguuaugacgguuccuaggguuuugcuuuguuuuugcauguuuuuguuuggacagacaccugccccuguagaguagcuugguguccuagaaguggggaguagguuucuugaacccaagugagaacuggagacuuaaggacagcugcagcacacgugaagauccugucagcucgaaauucuugugauuuugugguaugcaagucacugcacaugcauguguaggaagauaguuguaccaaaggaaaggauaccugcugugcggacuggcgagaguccagagugugggauccgguaggcacagcugcaccaggcuuagacaggccaucugcuccucaguugacagcagucccccuccagccuuguuuuaaaccugcuacuucauucacuuacuccccuucuggccucuguaaacauuugggguuugggguucaaggugaagccggguuugagugccuuccuuaguguucuaaggcccauuugaaaauucuauccugguagugcguagaaugcuggugacacugguuaaaaugucacuucugugggcuuucuuuuuucuccccccuaggaugggucuaagcacaucuuugagauggaaaguguucggggucagcuccagaccaugcuccauaccucccgugauacugccuaucguaagucagcucagcuauguagcgcucuagaggaaagcugagguguaggggcaggagaagguaagcaggagcucuuggaagagggcuggagcgauggcucagcgcuuaagagcacugacugcucuuccagagguccugaguucaauucccagcaagcacaugguggcucacagcuaucugcaaugagauccagugcccuuuucuuaugugccugaagacacucacauuaaauaaauaaauaaguaaauaaauaaauaaaucuuuaaaaaaaaaaaagaaaagaaaagacgagaagaaaaagugcccauucucugggaaaagauuuggggaguggagagcugaacuggaagggccucuuuuuuuuuuuuuuuaaauggccgcuguuccuacuugguucuuacuuuggagucucuugggcccucauucuaggaacugguucagagagacgggaagaggacuccuuugacagugauagcacagcuaccuugcucaagugagugcuccuggggugguucuggccccacuugcucuccucccacucccuacuucccauccccuccugugcacuuccuagagaucuagaaucuugucgcuggcuuuucuucuuucucucuuccuucuggaaccugggcaguagcugucuagucguuggcucucucuguccucagcccauuuuuuccuagaagaguaagcuuguaucugcuguuauuaggccucauuguaggggagugguuggaggaagggaccucacagagaauccucuguccuguugguggcuccacuuuuugguucucugcuauauagaauaccacaguaggaucagugggucucaaaguuuugcccagucuugacauucucucucuggcuugcucagcacccggccucugcaagaccugucuccauccagcucugccccggcacuggaagaguuguuuccccgcuacacuagccuucggcccggcccccccaccaaccccccagauuuucaggggcugagggaugcacuggaugcagagcuuacacgcagaaaggugagaggcauaggcuugcuucugaagguggcaagguuagaaaugaggggccuuggguagagaagcaagucugauggauaagccugaggacugggacuagcacugugcucucgggcgucuucagagaggcccucagggacuggccugucuaauguucccccacacacuccugcuuagaguucucagauccccgacuccccucauacaacuugucacugguaacaucuugucuguucuucccucuacaaccuaagcuccuccaaagucagggcuguguccuuuucaaugcuggcugucaccuagcacaggaaaccccuuccauggugucuuuuuaaauggauaagagcuuuguuggcuugcacagagcuuuagagcuauuggugauuuuuuuuuuuuuuuucuucauaagacccuuaaugucugagggcacagagagaugacgaagaauaaagaaaaggcagaucacugguugucagcuuuagaacucuccccguuauuuuaaacugcugggccaugaaugaaagguucuccacuugugugcagugagcuccuuagagcaggaguaacuuugcacacuucacagugaagaaacaguugaucggaaauccagggaagagaagcgccuggaagcucacagccaccuccugaccuaggaagagaaaggauuuggaggccccgggucucaaggcuccagaacucuugauucuuucuuuucaaaccaguucuguuucggggaccuaggcuuucugucuccagcccauuucucccuaaggaugcugaaaugucagcgcuguggucagacucaggaugagcagcacccacgugccucguguuucuuuccagcauugcgagcgccacauccagagccuacagacucgcgugcuugaguugcaacaacagcuagcuguggcuguggcugccgaccacaagaaagaucucaugauugaacaacuagacaaggugacgguagcaaucacugguggacagcucucucuguggagagcacuguugcagugucaccugggggcuggggguggcagggucucaucaucuuccuuugagcuguuaguggccauccugccucagccucccgagugcugggacuacaggaaugaaccaucauacccugucuaaccaguguuugugcaugcuaacagcaucauacccugucuaaccagugugugcgcaugcuaacagcaucauacccugucuaaccagugugugugcaugcuaacagcagggcaagauguuaggguuucugaccugggagagggagguggcucaugacuugucgaaaagagggcaaaaacacugauuuugaaauuucaccuuauuugccuuccuugagacucuggcucgagugguggaaggcuggaaucgccaugaggcugagcggacagaggugcugcggggacuucaagaggagcgccaggcagcagaacucaccagaagcaagcagcaggagguggguggccuggaucaggcggcauuaaagucuagauaggaagaaguagcuuugguauuaggguucccaaaagccuggccuguggcuuuuugguugcugucccugcgcccuuuccucuaccauugcuguaucuugucuuuggugccccaggucauuugguagacacugguuucauguguacauuugguagacacugguuucauguguacauuugguagacacugguuucuuguguacauugcuaauuauuucugaagaagagguguuuuuccucauucucacuguuguguguuuuucucuucugaaagacagugacccgccuggaacaaagccuuucugaggccauggaagcccugagucgggagcaggagggugccagacuacagcagagggagaaagaggcccuggugagagggcccgcugcaggaggugguggucacugauagagaccgugggcugcgaugguuuagaugacuuauaaugugaggguauagggcccugcugcucagaugcacccucagaacaguuuugcuaaucucugaaaacagcccugcucccaggcaaauuggagagacugcaaauuauauucuuuuuaaaacauuaaaccugucuggagaaauggcucaacaguuaagagcaaugacuacucuuccagaguuccugaguucaguccccagcaacuacaugguggcucauaaccaucuauaaugggauccccuacccucuucuggugucugaagauagcuacaguguacucucauacauaaaauaaauaaauaaaucuuaguaaaaaauuaaaacccaucugagguacuaggugugguaucucaggccuuuaaucucagcacucuugaaguaggcagaggcagguggaucucugugagucugagggcagccugcacuacauagaccuuauauccaagugugcacaugccugcacacacacacaccuuuuucuagaaccccacuuuuuuuaagguuuauuuauuauuacacguaaguacacuguagcugucuucagaugcaccagaagagggcguuagaucucauuacagguaguugugagccaccaugugguuucugggauuugaacucaggaccuuuggaagagcagucagugcucuuacccucugagccaucucuccagcccuagaaccccacuucuaaaagccagaggauccucacacaugcuagacagaaguucuguuacugagcuauauacccucagucucucacucccagagauuuugugucaauagauguauaauggguuucagaaauuuccuagguuaucuuacucagucuggagugggagcucugguucagguuauacauccuaaaccgcuacugggugaaaccuacuugggauucuuagagcugaagugggcaugugaagacauaugaaguuaguagccaggccuggaaccuacugcuuucaugacacaugcuugcuguaugcagacuguugcuuguggucuucccaaguacaugugacagagcugacgcuggugcuacuuggccagcuccugacuguagguuggguuuuuguauuuaaugaugauggugauggcuguugcguguuaaguacuugcuaggugccaggcacugcuaaaugauuuauauacacuuuuuccauuaauccucacaaggucaacaguguauuaucuucuuuuuacagaugaugauguaugccuaagaacacaugguacacugggcaugguggcauacaccuauaaucacgacauuugggagguuaauggaucuaauucaagcucagccugggcuacauggccagacugaccgaaaaacagagcacgugauaacagaugugaggaguaggauuuacccugagauuuagaacucuggcacagacuucuuuuauguacuuacuacuuuuauuuuuaaaaauuauuaaccgggcauaaugguauacaccuuuaaucccaguacuugggaggcagaggucgggggaucucugaguucaagccagccugguuuacagagcgaguucuaaaccagaacugcauauugagaucugucuccaaaaaauaaaaauuauccuauugaagauuucauaagagacaggguuuauaucacacauucauagcccacaguguaguaaguaagucuucauuuggcuugcuauuucuuuuuuuuucucucucccuucccuuucuuucucuugcucugggcccuacucgcucuggcccauagguucuuuauuauuuguuucucauuacagaugauuuugagacaccauguaguugcugagauuugaacucaugaccucuggaagagcagucagugcucuuaaccauugagccaucucaccagccccuaauauuucuuuuaaaagcaugaggucuuccugcccccuucugcacacagcaugugugucaguguacucagccucucauaggaaaaaaaccagugacuggaggauguacauaacuuuuuucucaaguucugacagcuacagguacugggaggguuggucucuggcuugcagacagcuaacuucuugccacuccuucacuuggcaaaaaggcgagaugugccagcuuuuaaaauagaauaucuuuuauuuauucuuuaccaaucuuguaaauauaaaaaagugucuugauaaaaugcaccccaagucuccuuuucuuuuggggguaacugcuguagucagcuggcuggcugauccuguugccuugaucacaugccggucucuugccguagccauagcugcuguguugaugagugcauugccuuaucauguucaagagacagcauugcccugcgcuccucccugugcuccucccugcacuccucccugugcuccuuccugugcuccucccuacaucccucccugcgcuccucccugcgcuccucccugugcuccucccugugcuucucccugcacuccucccugaacuccucccugugcuccuuccugugcuuuucccugcacuccucccugcgcuucucccugugcuccucccugugcuccucccugugcuccuuccugugcuccucccugcacuccucccugugcuccacuccucccugugcuccucccugcgcuccucccugugcuccucccugcauuccucccucugcuccuuccugugcuccucccugcacuccucccuccgcuccucccugugcccuuccugugcuccucccugcacuccucccugugcuccuuccugcgcuccucccugcacuccucguggcauuccugagccuuggcagggagucuugguauagauauagaggcccuguuuaguuacuuauuugcaauacugucacccaguucugaguuuccgaguuagcuguugccacagcagagugagccuuuuauugccaagguugaggacagcacaagucuguguuuaaauaaucacacaugaauuuuuaaaaauuuauuucuaguuuauguguaugguuguuuuaccugcauguaugucugcacaccaugugcaugucugguacagaggccaggagaggacuucagauccccuggaauuggaguuaaagacaagugugagccaccauguggguccugguaaucaaacuuggauauucuggaaaagcaacugauccuucuaacccuaacccaucucugcagcccuuaaacguggauauuuagggagcauuuugacaacauguccauuuagcaagacuaauagaguaauagcuccccagaucuauggccuuuaagccuugggcuucugcuaggcucacuguagcaggugugcauucccccuguggagcagugggagggagagcuuaccuccuguauuacaacccagugagcuagucagcgguuagauuucgugaucguaguucucagcacuacauuguguggagguggucugccagguugcugcuuucuugggugcagauuaaaagcugacuuucuccuggggcuuuaggaagaagaaaggcaagcccugacucugagguuggagguggagcagcagcagugccggacccuccaggaagagcgggaugaggcuagggcugggcagcucagugagcaccggaagcuggaggcccuucaaguggcucuacaagaggaaaggcaggccuggaucaagcaggaacaccagcugaaggaacgccuucaggcacugcaggaggaaggccaggcucagcuggaaagagagaagguagaagaggcaaaggggagagcugggaauggagacauguugggaaaaaugacggcagaauaaggugagaugccaggauauggaggucgauagggagcuaggauggagaguaaagaguuauacauggaaggcaagguugaggaccagugugaaggucugggggugggguggggcggcggugggggacaacagauacaugaaaggccaaagaugacauuaagcagagauggagaagcaacaugagugggaagagggaagauggagugugacguggaucaguagccggggcuuaggagaugaggcgugcaucagugcgggauuguccuuuuuaggggaacagccagagggaggcccaggcagccugggagacccagcagcaguuugcacugcuccagacugaggugcggcggcuggaaggggaucuggacacaguccggagagagagagaugcacugcagcuggagaugagcuugguccaggugagccccagaagguccgugggguguucugcaguugagaaagcagguuugagcacacacuuggaaaucauggaagacuugcccaucucagguaguugagacuuauuauugguuaauuugguaauauucugucuuaaaguuucacuauuuccucccugaagacauuuucccacaguguggguugacucacuguuacauuuagacucugcugguucaagucugagauaccguguacuguucuuaaagagacagugccacaccuacugcacgcacucacugacugagaggcugaaagucuuugccugaccugacuccaguugguaauguucugcuuuguauugguuauuauuuuaucucuuaccauuguauaugugguaugauuguauguaugugggugaaucgugccaugacguguguguagaggucagagaacaacucgcgccuugcacaugaggaauugaaccuagguuguuaggguuaugugcuaaacauuuuuaucugcuaaaccaucuacccagcccaguuacuauuacuuuaguaacuucugcuaauaccucugaguuggggaugcaggaggacaauguuuauuuuauuuacuugggaaguuccuguaacagcucauaaccuggcucaaaauaguaccaaaauugucagauacaguuagguugaaacacuuguuucagccaggccuggugacacaaaucuauaauuccaacuacuuggaaggcugaggcaggaggaucucaaguuauagcccagccuagguuucagugugaaugugaagucaaggauagccuagacaacuuagugagagcccguguccaaaaguacaauguagacuaggcuguggaucagugguagaggacacgcucagcaugugugagucccuggguucaaucaacaacaacaacaacaaaacccuuucuagggcuggaaagauggcuuggugguuaagagcacuggcuguuuuuccaagggacccagguucaguuuccagcauccacauggcagcugacagccaucuguaguuccaguucucggggaucugacacccuuuuuuggucccugcauggaccaggccccagcaugucauuuaauucuacuucuuaacuugcucucagaaacucaucgauugcccucaggaaacauuuuacacagucgucagaacgaaacuaaucgccagaacuaaauucacauuuuaccugcaggcaaaauccauacacauuaaaaaaaauagcaguuucaguguaacuaguacauugaaucuuaaacuuacauuaguuagcuucugauuaucuacuaaagaggggguuagcaagcuuucugcaaagaaccagagaguaaauauuuuugacucuguggaugguguguucucaguuguaacuacucuacuguuauaacaaaaguagcuauggggaguauguaaguacauggguauagcuaugucccggucagacuucauaacaaacagcaggcauuggggaaggcagaaauuaaguuguaguuugcugcucccugaaauggcagaccugcucggagagaaccauguuucaguccugggggaaacaugacagugagcccugacucaggaggacuuaguccugaccauugugggccucuguuuuuauguaugaaguguuugccaagggccgaugcgugaguuaguaagagcaagcuaagaaggagaacuaaaugaccagucagaagggaguaagcaguaagacgagccaagaaugaggccucuguuucucagcucagguguuucagcagggaaaggcaccacugaggcagggaucuggagggugugccccugucccgggucuauacaaaacagcugugaaguuuugggguauauggggguuuuguuuauuuauuuguuuuuuguuauuuauuuuuauuuuuaaagauuuauuuauguaugugaauacacuguagcuguucagaugguugcgagccuucuugugauuguugggaacugaauuucuaggaucuuugcucgcuccggucaacccacuugcucaguccaugcuugcuucggcccacagauuuauuuuuuauuauaaguaaguacacuguagcugucugguguguagacacaccagaagagugugucagaucucauuacaggugguugugagccaccaugugguugcugggauuugaacucaugaccuuuggaagagcagucagugcucuuacccacugagccaucucaccagccccuguuauuuauuuuuaaaugauuauucuuauuuuauaugcauugguguuuugccugcauguguauuggugugaaagcguuggcucccgggacuggaguuguagacaguugugagcugccaagugggaacugggaauugagcucggguccuccugaagagcagccggugcucuugacuguugaguucccgcucagcccccuauuuguuuauguuuuggacaaggucuugcuauguggaagcugacugccccuauccuacugccuccgaccaccaagugcugggauucaggcaugggccaccguaccuagcuuggguauaugggcuuaaagcuuggaaaaaagaucagaacaaaaugaaagaauugggaauuaagaaaucuagugaaagcugugccuagaggcaaaagcuuauuauauacacuuuagaauuaucuagcccaaaugucagcagauagcaggaaagagagggaagggcgaggcuaaagcgcaguugcaggcagagcagucagcgaagacucagagcgagaauagagagagguccugcagaggaaaagucacuuagaaaagagguguggccuggggucaggagcugcagugacccggcaaaaggcagagguggagagacagccgcugugggguuggcacucauauuccagagagcaggagagggagcacaaggggagaacggagauggcgcucgggcgcuugaauccuccuggucccaggagaaguaaucagcuuucgccucagacgcaccgcagggugcucugacgcguccccggguuaauacaucgauuucuuuuguccaaagccauuuucacuuguaugugcucauuugauaugucgcauggcuuaauaaaggaagggcaucugagucacuguccaaggcagagucccugucguugguccuucaggcagaugagggguuguuggcacugaucuuguuuacauuucccacacuuagaagacuaaucucagacauaauugagcugacagucaucccaccuuccuuuacucccaggccagauaugagagccagcggauccagauggagucagagcuggcuguacagcuggagcagcgggugacugagcggcuggcagaggcucaggagaacagccugcggcaggccgccucccucagggaccaucacagguacuuggaacuuacuagauaguguuucucuggcagcagcaaguguuauuagcuuccugcccuugugcucagagccucuuagccucucccggccugacucccgguguacuuccaguccugucuguuaaggucucaggcccucucgggaggguugccacgaagugcuuauggacaggcacacagccuagagauuucccucccguggggcagcugcccugagggauagaaagaugaaugcuguuuccagcuccuuuuggaacaaugcagaaguguguuguucacagcugcuccaggaguguucuccuucaaccccagcuuucucucauccuccuucaccaugauuucuggaagugcuucuauuuuguuuguuuguuuguuuguuuguuuguuuuugcgggguguguguguuuucuuuaaagacagggucucacuauguaggccagacuggcuuugaauucacagaaucugucuugucucugccuccugagugcugggacuaaaggcaugugacaccaugccugguggaagugcuuucuauugugucauuuucaaauggauguagauuauacuccuauagucccggcuuggguggcugaggcaggagaauugcaaguuugagaugagccugggcuauguaaugagauucugucucaaccaaaccaacccaaagcgaagagcuggucuguugcuuuccuguaaccccucacaucagucucugcuucuggggccauccuguggccucagcuuuguucucacugucgcugugcugugggguugcagccgucugucuuccugacccgaacccacaggaaugaggcucccuaauggugaggugcugucacuccuggacagggacacagaacuaaugguuccuuuguccuuuuauuaggccucugaaaaagucuuggguugggcuggcuucccacaucuucccuuaccuacacacauucugucuuuuucucacugauaaugucuuuugguuuaaaaauggcuuuguuuguacauacauguauguacauauaucuguguuuagaugugugcauguaaguacagaugccuguggggaccagacaaggagcuggacuccacucaguguggaugcugggaaccgaacuuagguccucugcaggagcaguacacagcacacacuuaaccccugagcuaccucuccugccuccugauggugcuuccgucuguacucuaaaucucuuucucaccugggucuuuuuaggaagcagcuacaggaacugaguggacagcaccaacaggaacuggcugcccagcuggcucaguucaagguagaaauggcugaccgggaggaacgccagcagcagguggcucaggacuaugagcucagguacuggccucggaguucuugcccuggguaaugcccagacuggggauggcagagggaagccuuucagaagaucaggccuccucugauguauccaaauccugaauuacuucaggucugauacugcacccggccucuugccccaagccucuuguuuucuuaaaaucucuuuaauaugugugaauugggggacuauauauacauugcugugggugcuguguagaccugagggccauguccuaugucuccuccaccuuauuuuuugagacgcuaagcuuaaagcucgccaguuugacuggacuggcucaccauggagcucuggggacuucuagggauugcucagcacugggcuuccguaugugcuccgccucacacugcccuuacuggggauccuagcucagccccaggcuucugcagcagacaggucaccaacugagccaccuccccggucccucucuucuucuccucagacuggcaagggagcaagcucgagugcgugaccugaagagcggcaaccaacaacuggaggagcagcgggcggagcugguggagcggcuccaagccaugcugcaggcccacugggaggaggccaaccaacugcucaguaccacgcuucugccucccaauccgcagguagccauugccccagagagcagcugcccugcccaaauagcccuuuuuuccauggucauagcucuccaaauguguccuguuccacugggcauaauuuugugguucugugcaugugaaugaauaugugguacuaguuuggugagauaaugacuaaauaaacuagggcaguaaguuguugcugagggcagggagaugacugucaguaaagugcuugcuuuacaagcaugaagaccugacugcauucccuaaaacccagggggaaacuagcugggcacaacugcuuguggagaggaggaggccaaagucaaaggcucaaacucacccucagcuuuagagugaguugaggguaagccugggcuacaugagguccugucgcaaaggaaaagcaaagcgaaacaaacaaaaauguaugaaaaggagcaacagcaacaacaaaagcaggcacaugcaugcacacacaccacacacacacacacacacacgcaaucaaguuaauccugcccuagauuaaaauagggacccuuacauccggucuugcuaauguugauaccucuuauuuuuaauuuaugauaaugauuauuggcuaaaaugcuuuagaauuaguuuugugcauguggcacaaacaucuaagcuguuaaaauaaaacaaaaagcaaacuuuuuuuacuuuuuaaaaaccuuuuuccuuucuuauaguaaaaaguagccucuacucucuccugggaggccaggccucuguguccagguccuuccccagaggaagucaaggcugccauccugaucaucucuccuccuccccugagauccucacaccagaugccacccucuauccacugcuguauauaacuuugaaugugaccaagugcauauuccuugauacagaaaugguuuucuguauuuuguaucuauaguguugcaauaaauauuaaaacacaugcuauuauuuuaguuaucuacaaaauuuguggaaauagaauuguaauaugaaagaaaaauaaucagauuaaagcuugguggagauuagaugccguccacuucccuuugcagaguucagggaguuuacagccauagucaagugucuguacuaagacuugucucucugaacccaccaggcugugagcuugcuuucuuucucucuccuggccaggcuccucuugcugagcccuccagccccgggccucuggagccagagaagggggagaggaggaccugggccaugccucccauggcuguggcucugaaaccuguguugcagcagagccgagaagugaagggugaugugccuggagcuccgucuguccucugcagcaccuccccagaucugagccuccugcugggacccccuuuccagaaccagaacuccuuucagcccuuggaacccaagccugaugugacuccacccacaggugacuaaggccagaggucaccggccuucuccuuagccaugaauggcuuccuuaccaaguucucucugauaggagcguggguguuugguuucuaggugccuuacaaaucaugaauugcaaggaacagaaacuggcugaguauagggacggguacaugggaguacgugggugugcugggagcuggagcuggggacaggggugcugucagaacggugguggcacuucucucugggcaggaaugcuccucacccuacaccccagcuucuuucuggacaagucuaccacucucucacucuccacacugugguucucacuccuuauaacuguggcuuguguauggaccugaccagucaugacacuugagucuagccuaggcucuucaaugauacuuaucacuggaugggcugacuuuaauggauggccaccccuggauaagugagcuguggcuuggaugaguaggguuuuugcaguucaaacacguugauacaguguaacucaagaacuaagagagguuuguagcuuaguucuaaaugcagugccugcuuaggaugugugaaccgccagcauugcagaaaggaccugguggcacacacagcaggcacugagugaagacaaacaggucagaaguuaaagaucauguucagcuacuuagugaggugguuuuaaaauuauuuuuaugauuuucuauguauggguguuuugccuccaccccucucuagcacccacauagugaguuugagaccagccugggauggauggacgaaccccuaugaaaaaagaaaaaaaaaaaagggauagaacugggguagugcucaugccuugcacugugcacgugugagguggaggcaggaggauagaguucaagguugugacuggagcuguaucagugguggaaugcuugccucucccacaugaggugcuggauucagucccuaguacaccaaaagagggaaguguuggccuggcuggagagaaggcucagggagcaggagcgcuugcugcauaugcagcggggcugagcucagaccuuagcgcccauguaaaagccccagugugugacccucacugaugaccucgaucuguggggccuguggggccugucagagcugugagagcuguucuugguuaucagucugacuacaucuggaaugaacagcaauccagaaauggagggcauaccagugagagauuuucuacuugguugaaguaggugaauccacuucuaguccugaccuuugagguaggaagagagugagacacugggccugguuugagcaucugagaucucaaaaccaaccccuagugacacacuuccuccaacaaagccagacuaauccaacauggccacaccuccuaauagugccacucccuguggaucuaugggggccguuuucauucaaaccaccagaguuggagagacugggaucacugggacaugugggccuggcuccagguucagugaaagauucugucccaaaggaguaagcagacuagcauccuucucuggccacuuagugcgcuugcacucauaaacacucauuuuguuuuuacauuauuuacuuuguauuuguguaagcacaugcauaccauaauauuuauguggagcuaugggaguugauuuacucuuuauauaaauguaggucccaggagucaaacucaagucuuaucaggcuuggcagccaacugcccuuuuuggcugagccaucuuacaggcuccccaaacaaaggaggugggguuugccucagcaacugugaucuugaacucugauuuucaaaugcugggauuccaagaguccacccccauacccagugugcugcggugcugggaccaacccuugugcuugcucuuugcuagguaagcacucucaggggagcugcaccucagcccccaaaaggaaccuuuauccuucccuccagugcuuuucaacucugggaccaucuuuccuggguguggugucccucuuauauuuauuuauuuguuuuaaagguuugcuuuuuaaaauuuauguguacagguguuuugacugcauguauguuuauggaccaaauguaugccugugcaggucagaagagggcauugacugcccuggaacugggauucuaggcaguuugagcugccaugugggugcuaggaauugaacucauguccucuggaagagcagccagugcucuuaaccacugagccgucucuccagcccccacucucccauucagugguaccuuuucuuugggagcacaugguaggucauuucuugagagaccucuuccaugaacaacacacgugcaugccagagcgccuguuucauuuuucagcugggcccuucucugcauuggaggcuuucacugaugaucacagggccgaacgcccguuuccugaggaagacccgggaucugauggcgaugcaaggcugccaccugcuucucagcuugaaggccucaagaacuuuuugcaacagguacuaugccugagugacuuccuugccucugugugugugugugugugugugugugugugugugugugugugugugugugugccugcgcaagugcucaugaauugugugagccagaagccagugucagccguuuucuucuauagcuaaauuauuuguuucaaugccauuuuuaauuuguuucuuuuuuauugguuauuuuauuuacuuacauuucaaauguuauccccuucccaguuaaaccucggauccccuuccuugucccuccuguuucugugaggguauucaccuacccaccuacccccuccugccucagcgcccuagcauuccucuacaggggaccuccacagaaccaaggggcuccccucccacugaugccagauaaggucauccucugcuauaugugcagcuggagucauggucacucccuguguacucuuugguuggugguuuagucccaaauguguagcccaagcuggcgucaaacucgugauccucacgucucagccuccuucagcaaauccuacuggcaugugccaccacagccagccuuggcuuuuuucuuuuccuuucucucucucucucucucucuuucuuuuuuaugagacagugucucugacugaaccuagaguuuacuaguuagcuggaguggccgaccagcaagcacccaggacuauccugucucucucuucccucccuccaaagugcugagguuagaaauggcugcuccacucucugccaugccuggcuuuuuuauuuuuauuuuuguuuuuuuaaagagaaggccucauuauguaacccuggcuggccuguaacucacuauguaaacuaggcuggccucaaacucacagggagcugccauccuucccagugcugggacuaagggcugcaccaucguucacagcuaugccaggcuuuuauguagauguuggggauuaaacucggauccccaugcuugcucagugucccagagccaucuccucagccacuuccuugccuuauuuaggaccaguuauuugucuuagcaaucacucgaucucauucuuaguccguaauuguccuuuggaacuuaggucacugacccuagccucagacaucugugcuccccucagagccuagguuucuuucuaccaguuuucuagaggugccuccugucuucuuuccccagcuacuggagacagcgccucagagcaauggaaaccccucagccgaccuguugcucccuaaggcuggugagucccaacucugaagaagggcaggauggccuaggagagguagggauuggugaucuaggauggaguaggagcuggagguaggacuuggcucugcuccaguaccuaugaagggcuuuggcugucuuagcguauaaaacaaaccugaauuagaaacauggucacaguaguuuucuguagagagauuauauguauuuauuugaauuuggguuccauuucuucuguuguugucugucugucuucugugacaggaucuccuucuguaguccagaauggccucaaacuugcuaaguaaauuggguugaucuugaacucagagcaauuagccugcccuaauacuggguuuauagaagugacacacagugccuggccugaauuuggauuccauuucuaaauuauuuuuaucauuaaaacugguaguguuagaaacaauuacuucugguacuuuucaauguaucauuaacaccuaaaauaacuaaauuuuaaaguucucauuuagccgggcagugguggcucacgucuuuaaucccagcacuugggagagagaggcagguggaucucugaguuugaggccagccuggucuacagagugaguuccaggauggccagggcuacacagaaaaacccugucucgaaaaagcaacaacaacaacaacaacaacaaaaaguugucauuuaaaugaccagucauuguguucauugaaaugucauacuuaccucuucuuuuacuucauaguacguagaaaaauguuauuggggagaggauugucaucuuugcugcugagacauugucucacguagucaaaggugaccuuggacucucaucacccugccuuuguuccccaagaauuguguguacaagcaugcauccugaugcccaguuucauuugugccagccaggguugagcccagggccucugagcagagcccgugcagccuguuuggguuucugcuuacccuguguucaugguugcaccucuuuccuaaugccaggcucucgggcugucucgucuugggaggaggccccucaagugccccgacuuccaccuccuguccacaaaaccaaaguucccuuagccauggcgucaagucucuucaggguccaugggcuucccucaaccaauuugcaaggcaguggucucagcacuggcuccccagagaaagguaaggaggcccgggugugccaggggaagggaaggaacugccugagaccguccuagguuccuagggaaauggacacaggcugggagaggaggccucgggaacacugccaacuuguugcucauuacagaugggcucaaccugguggacgugucugagcuguuacgccucuaccaggcucgggguuggggugcccugccugcugaggaccugcuccuguaccugaagaggcuggaacacaguggguaugagccugggagagagaggaagggcuucaagcguggaauuuggauuaggaguugaucaggcccaguauauccgcugagugcagucuuucguccuuuuuaggggaccaggguggggugagggaugaaauguagagucacaguuuccccaucucuuuguuuccguuucuacuaauuuuucucaaaccccaacccaugagccuguacuucaguuuucuuuccuuucuacccagaagcucaaaacucagaaucccagaauuuuuauuuaccugagaacuuuuuuguuuuaccaaaucaaacauuuacucauaguaaaucauaaggaaauauuuuuugauuuauuaaaaaauuuuuaauugguuuacaaaggagcuacagacuacauugaaacuaaucuucauacaaaaggcagagagauugagauagagauauagagaaagagguacugagauccucaaaacacccagggucaaaauuagggggagagagacgaggaagauacaaaaggaacaggaagacaagagaguaacaucauacauacucaagagugaggagagaacaaggugggugacuguuuagaauuuacucucacagcccuggugauaacuggauuggaacccacaacaaaugucgugagauuaaaagguuuaaaggcaacaguggugcagagacugguuauugccaguauuaagaaagauaaacugguuuuaggcaccagauuggagcacuacgccucuguccagagaugacagacuugggagagggaagcagguuuguuauauguuuuugagacaagguuucacuauguggcccugguuagccugaacucacuguaaggcuagcgucacacucagccccugccgcuugccucugccuuccaagcucaggauuaaggugauuguuuuguuuuguuuuuguguuuguuuuuguuuucauuucuuaaugaaaugaagucagcaacucaacaacuuuucacaucagacauuugacuacaacccauagaaacccugauuugauacgugcuggggaaugacgggguuggagagacagcucgucugguaaacgcuuacaguacaggcacgaggagcugaguuugauccggagcucauauugaaaagccaggcauaguagcauacacguguacuccucuggggcuggugggccuggagccagcuuggcccaauugucgagaccaagacaauaaaaggccguuuuacaaacuaaaauagcuagauauaguaggagaugccuuuaaucccagcaccugggaggcagacacacaaaaauuucuaugaguuugaggcaagacugaucuacacagugggacccuaucucaaaaagacaaaaaaagguuccuguggcuagcucuggaggagcagcacuggaggccccuguccccuggucuccacaugcaugugcaccuagauacgagcacagaagcacagucuguguucuguaauucaaccgugguuugugugagagcaguaaggccauggugauggcucccuagagcugaccgaguguuacaggcagugcucaccgugugcaguguaaaacgugugcugaccgaguguuacaggcagugcucacugacugugcacaguguaaaacgugugcugaccgaguguuacaggcagugcucaccgugugcacaguguaaaacgugugcuggccgaguguuacaggcagugcucacugugugcacaguguaaaacgugugcuggccgggcagugguggcgcacacccuugaucccagcacuuaagaggcagaggcaggcggauuucugaguuugaggccagccuggucuacagagagagaguuccaggacagccaggacuauacagagaaacccugucucgagacccccucccucccaaaaccaaaaccaaaacaaaacauauacuguguguucagaaccaaggcugcagugaagucucagagcaacaccaucuagaauugcaacaucuuggacucauuugggcuugauuuucuauuaauuuuugauuguaccauauucagaaaccuuuucuguauguguguguguguuuucuuuuuuaaaucucuguuuuguggugucaugccacaguuuaagaagcuuggauccaauccagaguaacucaguggcucccacaaaguguccuccacgugggcuccagcuccacuaccucccaguucucuuucucuuuuguuuuugugguacuagaaggcucucccagacucacucugucggucugccuuccuuucucccuuccacccuuccuuccuuuucccucuuccuuccuucccgcccuucuucccucccuccuccuuccuucucuccuuccuuccuucuuuccuucuuuucuguuuuuguuuuuuugagacacgauuucuaaguauagcccuggcuguccuagagcuugcuguguagaccaugcuggcuucaaacugggauuaaaggcaucucacuuuccuaagagaggaaauuggggaauugggggauuacuccccugcccccaccuuguucucauucauacccuugauuuguguggcagaacugauggccaaggggagcuuguccccagaagaaacacagacucccguuugggugagaccacucggaaagaggugagggagcaggggagagcagggcuccccacacgcuagccugcuacucagggucugcacuugcucuggccagccccaccacucaagguccgaacuugcuagcauccccaccucuacaccccacucuccccaucuccacccacugcuugcccacugguuggagccucuccguacaccaugcccuuucucugugggguggggaaagugaggggauaugaugauggcuucuucuucuuuccucuuaauucucagauccccucccaggcugucccucgacgccuugcuucagucccuaagacugaaaagccugcacggaagaaaagugggcaucccggcccuagcaugaggagucggggcggcaucuggagaugaggcccgcccuucuccucuucugccauucauuuuaauuagugcccugcauucugucugucucagaggaaucuggaaaauggagauuuuuguaggaagcuacuuugugaagaaaccuuccagaauuguuuuauuauuuuagaauauauuuguuuucuaugagaaagccuauggagccuuugaggcuggugugugacuagaugucugaguggcccuaggcucagggaugcuugcagugguuagaugccccauaguagaauuaugagugaaucuuuucuuuuuguauaauuuauauuuuguauauuuucugaaauaaguauguauuacuuuaguaauaaaaaaaacucccaaacuuuuaauaaaagaguaaauuauuguaua

SEQ ID NO: 6094 - RNA, 2189 nt, Mus musculus
ucacagauugaaugagcccagauacuuuauucuagagacuauuacauucaaaauaaauucagcaaacauuuuuuuuugaauacauauaacauuaacacugcuaucggcucuggagauagucacuugaaauuuauacucuagaaauacucaaaacauaaaauagcagaaaauaaacauagcauucccuuuggcaacacguauagagaaaacauacacauucccacagaugcaugcuggccuccaaaaggggagauuucagcuggaaccgaaggacaggaaaaagacaaaacauuuuacaaauggagguuuauacccuagaacuacauacauuauuugucauuaaaaacaaaaucuugaagaccucugaaaacugaggccuuguaaauucacauuuguagcucagaaaaauuuuucucaaaagaaugucacuuuggcacuuuaaugcgucacuaguguuuuaaauguuccaccuacagcugaugaugccaucucagagugacuaagagcuaaaccagugauucuuaacuuacauacacauaccugggauucuaaaacuaccggggaauguggacugggguccugaaauucugcauuucuagcaagcugugagaccaaccaacacugcuggucuugauuuuaagucuacaguaagauauuuacaggacuuuagaauagaacuaacuacauacaguaaacaaugucccauuaugggacacaaauuaaaauuaugugagcaucuuuuuuuuucuuuuccccaguauugcuacagagucaguaaagauaacaaaggccuaaauuuugcuuccuuuaucaaauggcucacccaucuuugauaagccuuuaauaaggccucauguaaauaaaugccccuuggauguuuucauaccugcccuauccagcugaagggagguuguauaugcaagauucccaaucauaagcagggagucaacucaguaauugcuggagcacgguaacaagagugggaagauggcaugccagcaaacacaaccagauaagugagauugacaugacauauaaauuagcuuauccccuguccuguccuuuuuuccacaguacacauugucaaccacagaccacugcuaaaauuggauccuuugcuuacaccacagacucugaacaaacgccaaagcuuuguuauuuuuuuuuucuuccuacauuaugguaggcuuuguuucuauuaucccuuggccacuccauccugaaaauauaaugcuggcacagucuaggagccuucgccgcucagaauccacaccaucuaggguccuuucuguugagcuccaucuccaucacgcauguaccaauuccagcaucagccuugauuuccagguagucuugacaucaaccuuuugugucagagcacgccugaggaugcugcucccaccugcuuucugccauagcucugggguuccuugguuacagcguacaacgggucaugugggcaauguccuugaccucuggacaguagagcacuggaggaaagaagaaggguuaguggcaacaggaggaugcaacuugacccagcauucuucggugcaauguacccaguauccucccuaggccgccccucaccauugcuaggcaacggacgccgcaagcggcgugccggcgccaggacccuguccaaaauucggcgaagcgcgcgccaacccgcacuuggaggucccgcccccuucucgcucuccgcuuccccgucgucguccucuccauccucuccgcugucuuuggccgggcuccccaucgggucuccuucacgcucagcccgggcuuuuuccuccagccgugaccacaagacagggucuagcgcgaucuccgugacgccgccgcgcgggagcggggaaggcgcgcggcagaacgggcacgugacagcgcggcgcaggcgcaccacgcgcgcggccgugcggcugccgucgccccgcgcugccagcucgcgcaggcaagcugugcacagcguguggccgcagcgggcgcgcgccgugccaggcaggcggcggggcgcacgggccccgagguuguagggucggaaacagauguugcaguccagcucacccagcucgggaagagagggcacucucaucaagagcugcaucguggucaccguggcccgagggcuucgaucucuaggcggcuaggauacagaacgaaugagcccuccuugggccagggcaggg

SEQ ID NO: 6095 - RNA, 2055 nt, Mus musculus
cgcucuccagcccgggcgcggcggcggcggcggcggcggcgguggcggcggccgcgguagcggcggaggaggggugcggcgggggaggggaggaggccuggccccaaggccgccgccgcccggacugccgggcccgucuagacccgccaggcgcccgggacucuccucggcucggccgaaccguaggugccgggccccgcggcuccgcucgggccccggggagucggacggacgcuuaccugguggcgggggcggcggcagcggcggcggcggcggcgggaagagguggcagcugggggggcuguggcggucgcggcuccggucguggcccggcccgcgcccgaguacucccucuucguccuccuccucaucguccucgucggccgccuccaccuccuccuccuccucgucgcccucuucuuccuccucuucuuccuccuccgacaccaccaucuccuccuccuccuccuccucgucccucagaggggaagccauccuguggcucuggcccccccaccacccccccacccaccgcccgcccgccucccccaccgcuaccaccaccaccuccuccuccuccuccuccuccuccuccuccuccucggcggcggcguccuccuccuccuccuccucaccgccucccccagccccccaaacccccgggccaccccccuccagaacacccacccccggggccggcgucugaggaggggggccgcaccacccccaaaaauguucuuggaaaaauuuaaggacuuuuucccccuucugucuuuccucccaagagaacaagaaagggagaucguuuaaaaaaaaaaaauuauauauauguauauaaaaguuuucgacuucucucuaccccccucgguugcuuuaaauauauuuaaauucugaggggggcgcucagaaauauuucucagagcugaggcacuaagauggccgccuugaaauuauuuuuaaaacaacccccccuccagcacugccaccccccucuauaaagaaagagagagggggguaaaauccccuuuuaaaacaaaauggcuggcuuaauauuucauuuuucauacacccccauucucccuguuacauccaaucuccaagcuucuacucagaaacccacaaauuucucccuuuuuucauaacugauuagugcacagauuaauacauuuuccuuguguauugagagagagagagagagagagagagagagagaguguguguguguguguguguguguguguguguuggggggcaugaaggauuucugcauaaaacaaaaauggcugcugugacuuaacucccccccuuauaaaaauauuuggggggguauuaaucaguacucaugcucagucugacaucagcauaaauuguuaaagguuaacuaguuagauacuaguccaacuagauugaauuuuucuuuucuuuacuagucuucuuccuccccccaccucccuucucuaaagaaaagcuuuuuuuuuuuuuuucugaauacuucagaagggagugguuugaugugaagguuuuuuuuuuuuuuccuucaggcauugaaaaggaaaaagaugaaauauauguuuauauauaacucucuacauaccucauugaagucaaaaugcauuuaauuguguacguagcuuuuaaaugagaaaugguacuggcuuuuuuuuuuuuucuccuuaaaaaaaaagugacagaaauccuagugacuuuggggggagagauaugaauagaugauugaguuuuuuuuccaaggaguccauguuugauucucuccuuugcccagcccucaguguucugugaauguugucaauuuuaucucuacucuuucccuuccucuccuccaguggcuugcuuguaaaaucgucugacuugagaaauuaauuugguggugacuaggucagauuuuuaggagaaagaggagagggucggaucugaagauugugaaauucuuuucuccugugucaucgaacgccucuuccuccaugaccuucgacacugauaaaguagaagaaacugaggcacggggagaggaaagcaacugagaagagaggaacgagg

SEQ ID NO: 6096 - RNA, 2055 nt, Mus musculus
ccucguuccucucuucucaguugcuuuccucuccccgugccucaguuucuucuacuuuaucagugucgaaggucauggaggaagaggcguucgaugacacaggagaaaagaauuucacaaucuucagauccgacccucuccucuuucuccuaaaaaucugaccuagucaccaccaaauuaauuucucaagucagacgauuuuacaagcaagccacuggaggagaggaagggaaagaguagagauaaaauugacaacauucacagaacacugagggcugggcaaaggagagaaucaaacauggacuccuuggaaaaaaaacucaaucaucuauucauaucucuccccccaaagucacuaggauuucugucacuuuuuuuuuaaggagaaaaaaaaaaaaagccaguaccauuucucauuuaaaagcuacguacacaauuaaaugcauuuugacuucaaugagguauguagagaguuauauauaaacauauauuucaucuuuuuccuuuucaaugccugaaggaaaaaaaaaaaaaaccuucacaucaaaccacucccuucugaaguauucagaaaaaaaaaaaaaaagcuuuucuuuagagaagggagguggggggaggaagaagacuaguaaagaaaagaaaaauucaaucuaguuggacuaguaucuaacuaguuaaccuuuaacaauuuaugcugaugucagacugagcaugaguacugauuaauacccccccaaauauuuuuauaagggggggaguuaagucacagcagccauuuuuguuuuaugcagaaauccuucaugccccccaacacacacacacacacacacacacacacacacucucucucucucucucucucucucucucucucaauacacaaggaaaauguauuaaucugugcacuaaucaguuaugaaaaaagggagaaauuuguggguuucugaguagaagcuuggagauuggauguaacagggagaauggggguguaugaaaaaugaaauauuaagccagccauuuuguuuuaaaaggggauuuuaccccccucucucuuucuuuauagagggggguggcagugcuggaggggggguuguuuuaaaaauaauuucaaggcggccaucuuagugccucagcucugagaaauauuucugagcgccccccucagaauuuaaauauauuuaaagcaaccgagggggguagagagaagucgaaaacuuuuauauacauauauauaauuuuuuuuuuuuaaacgaucucccuuucuuguucucuugggaggaaagacagaagggggaaaaaguccuuaaauuuuuccaagaacauuuuuggggguggugcggccccccuccucagacgccggccccggggguggguguucuggagggggguggcccggggguuuggggggcugggggaggcggugaggaggaggaggaggaggacgccgccgccgaggaggaggaggaggaggaggaggaggaggaggaggugguggugguagcggugggggaggcgggcgggcgguggguggggggguggugggggggccagagccacaggauggcuuccccucugagggacgaggaggaggaggaggaggagaugguggugucggaggaggaagaagaggaggaagaagagggcgacgaggaggaggaggagguggaggcggccgacgaggacgaugaggaggaggacgaagagggaguacucgggcgcgggccgggccacgaccggagccgcgaccgccacagcccccccagcugccaccucuucccgccgccgccgccgccgcugccgccgcccccgccaccagguaagcguccguccgacuccccggggcccgagcggagccgcggggcccggcaccuacgguucggccgagccgaggagagucccgggcgccuggcgggucuagacgggcccggcaguccgggcggcggcggccuuggggccaggccuccuccccucccccgccgcaccccuccuccgccgcuaccgcggccgccgccaccgccgccgccgccgccgccgccgcgcccgggcuggagagcg

SEQ ID NO: 6097 - RNA, 1882 nt, Mus musculus
uacgguaucucaugcaaccagugaguggaucuauaugcuugcgaaucuucaaaagcaaggauuuggagagacggaucggagcaaucacuauuucgaguucgaguuauuccccgccaucccuccucugcucuccagugccgcuuccaccgaccccauaccagcagaacuuacgucucuagucuguggaucaaaccagugacuuauguccuggccugcgaccuccaggauggguuucaacaguagguccccuaaaaagaaacagaggccgucaauggccggccacccaagggccagaaccagcucuccagcccuucccuaccgugugucccuuaccuuugaauuccucgacaagcgguguuagauuguaaacaaaucccagguaagacacccauagguccucgagcugguuguguuccgcuacuucugacggcgugaaauaccgacguugaaaauuauccaagucuggcccggcuacuaggccccggcgcggcauggcuccuggucuacaagaggcacaggcucccucagcuaccuucucgcuccuccgcaaucuuaaaacuaucagguccaagaacuaccugaagugcguuugucgcugacauggaaaccauugucccuuuccggccaccggccacaguaguuaguuauacguaaguagggcgggguuugggcugcgcguguccaccggaagcauuccggauuccggcuucgagccuacugugguugaauucauucuuagaggaaaugaagacaguccguuucauaacggaguguaggcuagaugaguuagggguaacagaaaguaucgacgaggagacuagaauagaggguuuuuuaaucaccagauuucaggcguuuaaaagcuguuuaagcaauugcagguaaaguucucgcgauauucuucucguagcccaguaggcauguagggaccuggcaugaaauaaaaucucgcgagaucugcaguggcggaaccggaggcgaggaggaauugugaucucacgaaagcgcuugggagcacucgcgagaucugacgcgccgaucccccaaaacgcucuuaggaaguuuaaggcccaaaagaggucccagggccaauggccggagcugggccgaccaugcuacuacgagaggagaauggcuguugcagucggcgucagagcagcuccagcgccgggguuagcgugggcuugguuucuggacgagcagucggggagcgacaccgggcggggaggggaaaggggguggcgagguuggaaaggagaacuacaauucccagcagcccacgggcuucuggcagcgccgcgagggcagcugggaacugugguuccuugggcgugcugccgauccuaggugucugagugcuuguccugcccuagcaggacucugauggggaacaggaggacucgccggccacgcgugcacggcagcaacuagaggcauugcucaacaagaccaugcguauccguaugacagauggaaggacacuagucggcugcuuccugugcacugaucgcgacuguaaugucauccugggcucugcgcaagaguuccucaagccuucuggucaguguccagggaauacacaccuaccuccucgggaaugcggcggaaauucacugcaaggcauuuccucuugcaggccuuacugcacccccuuauuuucugggggcgagacggauguuugccugcuguucugauacugacuuuuuuuuuuuuuuccagauucauuuucugcgggcgaaccccgugugcugggucuggccaugguaccaggacaccacaucguuucuauugaaguccaaagggagagucugucggggggcccguaucucugaccacaauugcacuucucuuugagaccauuaaacccuaugaccaaaguggc

SEQ ID NO: 6098 - RNA, 1882 nt, Mus musculus
gccacuuuggucauaggguuuaauggucucaaagagaagugcaauuguggucagagauacgggccccccgacagacucucccuuuggacuucaauagaaacgaugugguguccugguaccauggccagacccagcacacgggguucgcccgcagaaaaugaaucuggaaaaaaaaaaaaaagucaguaucagaacagcaggcaaacauccgucucgcccccagaaaauaagggggugcaguaaggccugcaagaggaaaugccuugcagugaauuuccgccgcauucccgaggagguagguguguauucccuggacacugaccagaaggcuugaggaacucuugcgcagagcccaggaugacauuacagucgcgaucagugcacaggaagcagccgacuaguguccuuccaucugucauacggauacgcauggucuuguugagcaaugccucuaguugcugccgugcacgcguggccggcgaguccuccuguuccccaucagaguccugcuagggcaggacaagcacucagacaccuaggaucggcagcacgcccaaggaaccacaguucccagcugcccucgcggcgcugccagaagcccgugggcugcugggaauuguaguucuccuuuccaaccucgccacccccuuuccccuccccgcccggugucgcuccccgacugcucguccagaaaccaagcccacgcuaaccccggcgcuggagcugcucugacgccgacugcaacagccauucuccucucguaguagcauggucggcccagcuccggccauuggcccugggaccucuuuugggccuuaaacuuccuaagagcguuuugggggaucggcgcgucagaucucgcgagugcucccaagcgcuuucgugagaucacaauuccuccucgccuccgguuccgccacugcagaucucgcgagauuuuauuucaugccaggucccuacaugccuacugggcuacgagaagaauaucgcgagaacuuuaccugcaauugcuuaaacagcuuuuaaacgccugaaaucuggugauuaaaaaacccucuauucuagucuccucgucgauacuuucuguuaccccuaacucaucuagccuacacuccguuaugaaacggacugucuucauuuccucuaagaaugaauucaaccacaguaggcucgaagccggaauccggaaugcuuccgguggacacgcgcagcccaaaccccgcccuacuuacguauaacuaacuacuguggccgguggccggaaagggacaaugguuuccaugucagcgacaaacgcacuucagguaguucuuggaccugauaguuuuaagauugcggaggagcgagaagguagcugagggagccugugccucuuguagaccaggagccaugccgcgccggggccuaguagccgggccagacuuggauaauuuucaacgucgguauuucacgccgucagaaguagcggaacacaaccagcucgaggaccuaugggugucuuaccugggauuuguuuacaaucuaacaccgcuugucgaggaauucaaagguaagggacacacgguagggaagggcuggagagcugguucuggcccuuggguggccggccauugacggccucuguuucuuuuuaggggaccuacuguugaaacccauccuggaggucgcaggccaggacauaagucacugguuugauccacagacuagagacguaaguucugcugguauggggucgguggaagcggcacuggagagcagaggagggauggcggggaauaacucgaacucgaaauagugauugcuccgauccgucucuccaaauccuugcuuuugaagauucgcaagcauauagauccacucacugguugcaugagauaccgua

SEQ ID NO: 6099 - RNA, 1721 nt, Mus musculus
uccagauucauuuucugcgggcgaaccccgugugcugggucuggccaugguaccaggacaccacaucguuucuauugaaguccaaagggagagucugucggggggcccguaucucugaccacaauugcacuucucuuugagaccauuaaacccuaugaccaaaguggccugugucuguguguagguccaaugucaggggagggcuagcacaccccacccuuagagguucaucagaguucaggagcuuccucaaccugccccaaugccuagaagaaccaaacccucccucaaguuaggagcuuaaggcagcaggcccuagggugggccccuccaucuucccucccacgcuccugcuucaguuucuagcgggaagcggugucauccugccccggaagauccauuguuucccaccccggccuggcaacacucaguuccuuuaagcuggggucagagaacgggcucggguccccaaggggagcuggguaggcagccgaaacaaggcccucucugcgcuauuaauggggaagugacuuuggggucagggccagacaacucuggggucugaucaggaagaauggacuaaugcgauaaggaaaaggcaggaugcugagagaugcucucugauuugcccauuuguagucuugaggauucguuuccuacuccugagcccagugcaggagcgauuggauaugugccaccccuguauucacagagugcauucauuuuauaauuuuuuuuuauuauuugugauggcuucucucuuauuugugugagcccugucccucaguccuguaaauuuuggaggagcugcaccagcaaaggaaggcacaagguccagcucucuuauuuacaauagggaagggaaagaagaugugcaggguccagcccaaacguucaggaaucaaaugugaaugacguuucugggacaugggaauuuucgccagcucuacguccacauucagcuguuccaucaaagggaugguaggauccggcucaggccgcgguaaggaaccggcuugggcaguacaccccugggcuuguuucaaguccuugagagaccaggagggcaaucgacaggauucuugacucuaagcaccucagacccagaccuuucccggugugggaacagaccgagaaccuggugagacugggauuugcuucggcugugggaugcgccggcgccuguagagggcucggcuguagggcacgaggcagucggccaggcggaggcgcaggcagaggcggcgguagguagccagggcaaggacaagcaacggcacgagcaguaggaauccagugaccaacagggcugugaagccugggucccgcagaugcgaggugcaaaggggugccugagagcgcagaaacugugcggauaagagacaucagaaugggccacucugcccaggaggaaacagcccaaguggggaugcaguggcucagacacccccccacccccgccgcccacacaccacucacgcauaccccuugguaugcuuaccugggaguggcagagaaagccgaagccuaacaugaugacagcagguagcaagaugguccccagcaccagugccagcaagaggagauugaaaacagccaccagcagauucugagccguuacuagcacugcacaggcccagcaaucuaggggaucccgaggcucugggccgccagcgagaacggggcgcugggcuccggggaccuccgccauggccugguug

SEQ ID NO: 6100 - RNA, 17696 nt, Mus musculus
cuuuuuuuuuuuuccugcuuuuauuuuuaauaauauucucacacaaaaaucaccgaaaauaggguaggaaugggaagccccccucugccccuggggcagagagacagugcagugcgagggggcgggacuguaaacccccccaccccuccgcagccccagcgggggggaaaaaaaccgaacuaagaaaaugaaaauaaagccccagagaaaaucaccccagggugucccugccccagagaggcccugcccugggauguuucacgccuuaaaaaagguguguguguguguguguguguguguguccaauguuuuuaaaauggccgaggcuggggaggacaggguuucuuuuccucauaguucuuuaaaacuuuuuauuuuauuuauuuauuuuuuuuacaaaauaccauuucaguucccacuucuuccccuacaguacaggagucgcucacccucagguggggucgggguugggucgggaguggggguacugguccaagaaagugcaggacguaggggaggggagcagguuugagcaccaugagagcccggcuggagccgcgggcgggcggagacagacgggccaagcccggacauacuggggcgcagggaaggcccaggagugggccucccaaagaggcaggagggauggcuuggggauguaagaggucggguuuucccaaaaaaagagaaaaaaaaaaugaauaaauagaggugagugggacuguuauaaauuaaaaaccaaaaaacaaaaagaacaaaaauacgaaucauaaccaagugaauaaacaagagacauauacagggaucacagcuagcauuggaaguaaaaaaaaaaaaaaaaaaaaaaaaaaaaaggagguccagggguagggguaaagcccauagagagaaucucauuaaaaaccucggcugccgaacgucuauguacacaacgagccgcgaacgucugcgccggcgggcggcgggcgggcgcgcggcgggcaggcuugagggaacccguaugugacccccgccgccgccggagccugguccuugugucuguugcuagaaaggccaaagucggugaggggaggcgcuggugggcgagaggcugccagcccccuccccgucucccauuuuuuuuccuuuuuuuuuccucguauuuguuaaaaaaaaaacauuuuuuuuuucuuaauaaauuaagugaggggagcugccaauaggguggaagggcugggcccgacccccuucccggccagaggcgggaccuagguccagcccaggcgugugcugguggccccgccgcgcccagcgugggcgggcgagcggggcguccggccucaucgagacgugcuggcgggagccugcggggagaaagugggcagcuucaguggugggcggauggggaccggccgcucccgcgcccccucuggagcccaggcgcucgcucucaccagugugaaggcaucguaggccugcgccagcuccuccgugcgguacugcucuagcaccaccacgcccuguaggcccgcgcugcgacggcgcgcacagcccucgcagugcaccagguacguguuucggcugccauucucacuuguaacgaacaggauguugaacaccuccaccuggccaggagaaagcggcugucacuaagaagucacuacuacuguuaggucucuuccaggcagggggaagagcuugcacacuuacgucgcauucguugcaguaguaggcaggcucgucuuugacacggccuugguaagcgaucuucuucccugcccgcaccaggcucucccgcuguaccugacagugcuucauugacugcaggaggcagaaccugagcaagacccaaaggguggguguugagacaaggcuccagcggggugccaaggcuggaggauggcagaugggcagggguggagcuccagagacccuagccccacggacuucccugggcaacccucccuuucuuuucguuucugaguugcauuucccgucuugaauaugucacacuugacauuucaagguuuuguguguguguuuggaccacaggaaacaacggcuaugagaugagagcagggcuucugucauguccccagcacagugacacuuaaggucuuaaggacaugcugcagacgcaggggaagaauggggagccaggaagaacaaggguggggaacaagccaggugggacgggcugguaaccaaacaggggucucacuugaucaucuugaacaagucaggaucgcugaucuugaccguucgagcgacguuccaggacacaugaaucaugggcacaauggacuugacguucuucaccucguuccacucauaucgcuccagggccagcugguacugauaggcuguaggccagaggaagucaugcaggggucucaaccagcccccggccccuucuucccucagacucugauucuccagacccaguuuuccccuccaggguucgcuccucauacguaccccaugaugacccgaccccagccucuuaccggugaggggccccacguuccaggcaauguuguugcaccagccgguagccugcacccaauguacagucccugcauuaauccacacaaggucuccagggcgcugcacgaagcgguaaacaggaauauuggacgcauagaggucauccaagauuggccaccaggaaccagucaaguaguccacaccaugccuguggagagggcagucacagggucaggugggaaacccaaggacccgaggugauagggugacuugcaaggggugaugcgcaccggucgcagaaggcgcugauggucucccaauagugcucauguaccgcgaaccacucgcaguccccagggccaauguugauguugacugagcagaaauuguuauucucuugguggccugcagagggagauagaacgucacagaaggucugaugcaggcgagcaaggagcgacaaccacgcccuuugcccucauuggcuaaggccuaagagugcgcgcagccagcacaguacgcaugcgcaguggaaagcacaccuggcguucggcugccagggaccuucauguauagcugcacgguguucaugcccaggaugguguggcccacguggcugagcauguugccuguggauguuacccgcaugaaggcgggcaguuucagcagcuccuguagcuguggcuuccaccuguggacacaggaaugccgacgaaauuaagagggugucccagaccaguaccuagcaggguugcaucccaguuucacuggucuagccucacugaccucuuggcaucagacaggucgauguuagugccaaacuugaugaugugaugguucuugggguccggugcacugcugcuggggcaaaaaucacagacagguugauggcgagccaagggaggagagagagagaagcagggagggacaaacuuguacuucaccugggagagguuccuguagugcugucugguuccucggauuccucauccucacucucccucuccuccugcuuggucacacagguacgugggucagugacuuccugaagcccugacccaguaagcccagcacccuuacucccucuugugccugauccucaccugcagugacuccuggaaggacgaggccugguacugugcguauuuagcgaugguggugugggaacgggagcucucacagggccagauuugucugguaccugucaggucccaguucucgucugagggcugcuguacuuggguacggaccuccaccguauguucaccgcucgccuccaccagagucuugguggagaaaaggccuaagucugaaaggagugccaaacaagaugucagucaggucagaggcucagcucaccccuuuccuuccaggccagggcucugacgacguggacagagauuuggcagaauucagcaccaaggaaugggcacgaaucacaauccuaggaagcugacgaggcugccuccuucucagccccuuucugcaacuacuucaugccucaggucucucgccuagaauucuuaggcauucauaugcccacaugcuagaaaaccaaugaauggcucaagugaaagauuuagucgagcuucgaguaccucccaaaugacucccugggaggagagaauguccagguauaaaggacacggaauugauuuuuauguuucuucauuguuuccucugguuuuauacugcuuaaaauuuugcauuaaaaaaaggaaaaaaaaaaaacuaaccauggaugagaaguagucuauaauucauucuaauucucuuuuguuuguuuuguuguuuuuuacagaccagacaggguuucucuguauaccccuggcuguucuggaacucaccaggcuggccucaaacucacaaagaucuaccugccucugccucacugcugggauuaauggugugugccagcccuaccuggccacucuuuucuuuucuuucuuuuucuuucuuucuuucuuucuuucuucuuuuuaacuuauuuuguuacucuuuuuucccccucuuccccuucucccucuugcuccggcccauagguuccuuauuauuuguuucucauuauggacgguugugagcuaccaugugguuguaggauuugaacucaugaccuccggaagagcagucggugcucuucacugcugagccaucucaccagccccagucuuuucauucuuauucacuaagaaaguuagaagagccgggcggugguggcacaugccuuuaaucccagcacuugggaggcagagacaggcagauuucugaguucaaggccagccuggucuacagagugaguuccaggacagccaagacuauacagagaaacucugucucgaaaaaucaaaaaaaaaaguauguuagaagagugaaucuaaccccuccugaggucuauuucccauguguccacugcugaggacagaaaugacagaugagagaacaccucaaggcugguugacacaccacuuagcaccccucaaacauggccugcgugacagagugagcuccuucacuguggaaauucucuaagcauggaggugguucucgaagggucccgcaaacuacaauccuuacagccuuguacauacuuucuccccaaacucacugagccgaagugaaccagccaggccccugaugacggugaugggguuccgggggucuguacagaacuguagcaggaccggcgagaaggcaucucguuugcucuccaacugagacaaccaggagacaauggggucagagccauuucccaggcucuaagcaccccaauucaacccuucuggaaaggguggcucuguggacagacagcauacguacauagaugcuggggguagggggguugaguuuuucccggggcagcuucuccucaguguugaucuuggguuucacagacugggcaggggacagguaggacucucggaauuucccuuucaccuuggcauuccugugagaagaccauagaaugaggucaggaacaugggguaacgagcacaagccuagccccaggacaagugcggcagccuccgaacucacuugcuggcacgcaugacaucggcggcacaguggcugauggugaggucugccaugcgcagccgccgcucuuccaccucagaggcgauaaaggucuccuuguccccacuuuccaccuugaugagccugaucuucagcuccuugggaggccccucacuaagugaccggagcuucagcauaucugcccggcucacaccuggaggccccggagccuccucacgagucuucuucccagggacaggagcugauggggguguuggcugagcagcgggugcaggagcaggcgggggugcuggagcugugggugucuugacuuuggaaaccccaccgacaucgggccgggccuucucccggcccuggaucuccucacucugcaagucgagguuccccagcacccuucggcuuuuuucuuugggagccuuggccuuggccuuggcccuccccucgcggggucgucgacccacacugucccuacaggcccgccugugccgccgaugcuccuuuugacgacgcuugccacuaccuggaccugcugcugcuaccgccacccccccacucuccuccuuggccugcgcaggcggcggcuguggcucagucccacuguccacugggucugccguguccacuggguugauggcacuccggcccacccgcucuacaagggucucacaagcccgacugauuucuucuagcaccucagacucagaacgagcagggggcagcggcagaggugggggcaacugggcaggggucacggggccuggugcuggcucuucacccgcccugugcucccgggcccaaggcccgccugagguagagaacugagaugacgaggaaaccgagggcuugggggagcccugggcacuaggggccacugaagugggugguggggcgguagcaccugaugcaggacuaggggaauacugaguggcgggcacggacccgggccugguugagacggcugcuccagucccccgguaacaguacuuuugucccucaagaacagaggccaacgauuugagcaggcuggcugggcuggcugguggagguggugggggcuguggcuggggagguggaggaaacuuggcuagaggcggugguggugguagggcuggugguggcuucuucuccucuucuuggguggugguggugguggugguugugguggugguggcgguggugggggcagcaguggugguggcuggggcugugucacugggaaauggaggcuguagagaugcaaagggcucuuugagugggggugggggagccacgccugccuccugcugcugcugcugcuccuccuccuuccgaauggauucauccagcaucuucaugauguuugccagcccaucagguaggaucuugaauucggcuggcucuucaaacugguccuccagcggagugggugggaaaucaaagagccucgggccucgggcaggcagcucuccaaccccagguggcacaggcuggggggcuuuacucacagggccuggggguggccccugccccaccucgggggucuuugggaaggagacccugggccgggggcucuccgagcgccugaagcuuccugagguauuuugguggcaggaggagggaggggcuggaggcagggcaagagucagugguggaagagguggguccugggggcucaagguugggcuggauggccuggggagggggucuauacuucuggccagauaggagggugguggaaagggcaccggcccaguaggacuacugcuguggcuguugcugcugcugcugcugcugguggugguugggggaaugggaggguuaugcgaauccugagugcccacagaaaagcggggguuuggaggccccaagaagccaucacgguggggaaggggugggggaggaggacggggaggucccucagcaccaaagaagagcuccccuaagaucucuccauccucucgggcugcacggcaggcugagcccuucauccaagcagggggcgguggagggcgcaagaggcgaggacauggggguggaggggaugauggggucccaggggguagggauaaguggggcguggcagcaggggccgucaaaaaugguuuccgacugcugugugcggagggacccaggcgggccuggugaggggauaucuccagcgcaggguuuugguaauggucagcgccaggcugcaaguggagaaaggggaggucagugugcuauuguggccccucagacaaugucacccaccuucagcccaaugucauaacauacaaugccugggcuuggcuccacaccccgaagaccaguguuguuacugcuacugcugcugcugcugcugcugcuggugccggggaggccagggggccgggaaggggcguaaggcacgcaggcgguagaugcugcuggugaaacgcuggaguccauccgcgaccucugaacucugcucucucuaaggucacuuccggggggacggguggcaggcaggcagccauggcucucugcuccugggggucggggaccuggaccaagggguguguuggggaccagccgauggcugggcggaugagcggaguaggcgggagcuggguauggauaugaaugaggcaucgagugccgcugcuccuaagggagaugaucgagguuacagugagcaagggaaagacagaauucacaaggggaaaagguaacagguacugacaaggggcucaccuggcgcucuggcggcgcugaacccuugcgcucggggccccaagcaucuccaugcaggguauuccacagcccuggcuuagucagcugaaauggggggcuaauagccaggccaggcagcgguggugguggaggggguggugguggugguggaggcggugggggugggggugguggagggaguggcagaccugggggaaggccagccuagaagagaagagaaagugaaaauccuacuccuugccccagggcauccacucugccugcugacccauguacaaccucccuaccuguucagagcugcagccucuccugcgcuugccuccagggcuaaggcccuccucuccugaggggccugagagggcugcaggaggcauaggcuggaccacgggggguucagcagaucucuucacuggagggcccccucgcuuagccccauaguuccguuugugcuaaaaaaaaaaagagagagccaugguggcaugagcauagccagcugcaugugacccccuucucucagucacuuacucagccucacucaccucaaggugcagcaaauuccagacuugcuccaggggaggcaggaccuuggcucugugcugacaggaaccggcaugaaaguuccagagcugggccugggaggggcaaagggcaaagggcagaggaagauuaauuggggacauugugcuagaaggcacaacuuagccaccuaauguccugccucgucccaccugcugcaagcggccaauccggggucccagcucggcgaagcuuccuccauagcgaagggcccuaugguagcagcauacggcuuccucacugucgugcucugauucauacaacuguccaagcuguucccacaacccuggcugcgcuggcucccggagcaaugccuggacacagccauguagggauuccaacuucccgugaaggggucuugggguggguguccuacagaguggaaggaauuggggaucaucaggcuuggggaaaccuuuaaggccccaauuucccuccaauccuagaacuuuggaaucccccacuuacccaggagcauaauaggguuuguuagggugcccggagcuacugccaugagauggggguaaaggagcugagagugggggcugcccaacgcuggcagagcaucuguaaagagaaaggcucuguuagguacugccagaaucacgcuucccccuagaauggaguagucagagggaagagcagaugagacuggcaucuggacccacaacagaacagaaacucguggaaaaugacagcaauggacagagaagacugggagagaaaugccuggagauaaagccacauucucaccugccuccgggcagccaugagcuucggggaggaggauggggugggcaggagcuccaagccccagcacagcucaagcccccaagggcaaaggcuucccgugcagagcgggccccuggaggguccacugcccgaugcauccagccuaaaucagcgacaagagaucaugcucuaacagggaagcaaaaaccuucagccauguuuucagccaaaccuguuccaaucuuucccuuaccaggucagcaguggccccaggagcccuggagauggggcacggcccccugccccagcucucuggcacgaugguccagcuccaacugcccuuaacaauagugcccacuguuuccaggugacagucucuggccuucugcaaccaauucuacagagagaagaaaagaguguacugaaguugccaacacagcgagggcccaaaggcugaucugaacugucagugcaggaagacugagggcaaggcgccaggacagacaucagcaucaagagccccuagaaucgcgcaaguggguaauaggaauauggcacaaauagcggggagucagcgacgguuaacaacccagccacugcacuguuugacaggcucccaauccugggccacuagggcgaccuaccgcgcgccugcuuacccagccuccgugggagcguccucucacagcuucaagagcuucagaaauuuagccaaucacaagacuucucuauccacagaaagccaaucaucacccuugucuccgccucaguaacagccuagcaggaaccaauaggaguaagguuagccgggcacugagcggccucaggaggaggggcggcagggccggucagacaagcucacccuagggugaccccgaugugaccccaagguucccaccuaggguccacaucucugaucagaaacugguagcccucagggcaguaacagcaagcuaagacugagagugaggaaaccauucacgagccgaccugagggcaagccucacacauccaccgaacuggcaaugguccccgccagacuguucaaguuguccucugccuauccaccccaaggacggacagcagaccaaggcgaaacgcagacaaaggcaucacuagcucuccuuacuucacaucacucagcgauugacucuccacucgaucaccccgguagaaaucucgcaaucagcaaauccagcacccaggcccucccgcgccucuaucagaaugcuccaccuccagcgccugaccccguccuauaucauggucaaguccccagucucauaccaaguuccuccagcuccuccacuuuccccggcucugagucuucaguaucggucgacccccucagccaguucccccagcccucuaacuucugggaagcugcgcaccguggaguggcggccccucucgcguggcuccuguauccucugugcccuuucccugccggggccacgcgguuccccacggcccacguggcccccaccccccccaagggaggggggauuucggggguugcccgugacguggcuacuugcgcagcggaagcgguguguguaaggggggggggguccuucgggagggagaggagggcggggcccaacaggcagugacaucaccccugucccacucucaccgccuacucccuuaaagaacacagaacccguuucacuuccuccuucacgccaccccccuccccuuuacuccuuucccgucgaagcugaacccacaacaggcacaguacuccccuuuccuagucacguucccuuuaauccuagcuuugccuucucaaaucuuagagcccagaagcugcuucccugcgcauaccccaggucccggcagguagggagccuacucugcucccgggaucgguccauugagagucuagaguacaaagaccggcgagaggcuagugucgaguacaaagccgcgggggcggggcuagcgcuccagcuggagaaagcgccgggcaggaagccgggggagagcgagcgcgcggcgagggguugggggcggcuggaaaguucgccuuggccgagaagucugcaccgggaggaaauuuccagccagcccacaaaggcagaaggguuucuggcgaaaacugucuuuccucccgcugggggcaaggucaucuguacgugaaaugugcuuggacccgacagauccugcaggcugcuccgguccgguccccgggaggaccuugcguuccgcggacuacucguucacgcggagcuccggucagaacucucuuuagguugcagucugucaguuaccaaucccugggacgcguacaacgcuaaacuguggucaagugcaacccaaccugagugccccaaucaagcccugcggggguagagaaaccagucauagacaaacggcagcucgggguaccagaugucaaagaagcagaucccggcuaaggaagcggugcccagaacucugcuaguuaccaggaaaugcagcuuccccuucugcgaugaugacacuuccccuuucccacggggaacugacucagcuuucccuaaacuagagaguuccgucccuccagccgucuugaucuucagccuuuauccacaaccucccacgacgacaccauggacuacagagcgcuccagaacaaaacuuccuguacccuaagcacgaucucgccaacuaccacgaaucggugucccccaccagggacacaggcgccugacuucccauccgccccacgaacaaagccuuucucagggucugaaucaggcuugggguggggggggagugagucacaacgaaaaccaucccccguucccacugacucagcccccgccucccucaacucacacagacacacagucagaggcagacacaacuccucaacccacauacugcucaccacgggucccgcggaauuuccccucggucucccucacggccccaccccgcgcugggcagccccgccgccgcacucacaccuguuccucagucgccgccgccgucggcugccucgccguccacucucaccuccacucucgcuuugaggcaggaauggcccuccccgacucccagugcucauacuaaccaaggggaggggacaaccagggacaagcacaaagacagacacccacagacuccucgaagacagacgggaggcagacgcacacguccagggccaggcuggauggccgacacacuucugaggcugacaauccagccuucccaacccgaccuacagcccccaaaagccggccgcccagaaaggguuaauuccacuugagucgaaaccacgcccucuccauccgggcacucccgguaaagccaagcuccgccucccgcauccgggaucuggacucuaggacuuuaaccgacccccccacacacacacaccucccuuagucccaggagagaacuacuccaucaaucacacccacuuaacucucucugggcuugggucagaagagccccuccgcgcagcucacggaacgcgggguauaagagggacgcuuggcacgaggccugcgacccgcaagcagacacuggacgaccaaagacaccagaccccgcagaacgauuuuuccugaacaugcauuuaagccagcacgcaccggcucgaagguggggcggauccaggaccgacccccgcgggucccauuccuucacagucuucuuucugcauggcggaaagcuacuaaguugccggcucgcuucucaccugggagagccggugggagagggagggccgcgggcuggggcuccgcagugacucagccacccgggcaggccgcccgcccgggauucccuucccuagccuucccccgccgccggccccuccccgcccccaucgagaagugacagugcuugccccggcgcgcuggcccgcuaugugucacugcggguguuugugucugccucugacugggcguuguguucaccaaucagucuaacagggucgacugugugugggucuuggugucuguuugcaccugcauaucugcucaucuugucucccucugugccugugucuggcgcguuccugucauuaucccugucuacaugacucugcuaggcugucucuugucugugugucugguuggcuccugucucagucuuuugucugggucugccucugcagcacuguggcgaucacgugugucugucugugcacaugccuuucugugcuuucuuccacguucucaaagccaggggaacgucggagccaggcuugagggauucuccuuaccccccuggauccugacuuacugggucagugguccugcuuagucgauuauuugggacucugucugccuucagucagguucagccccauuccuccacauccucacuugaacccucacagcuuccugcaguuaucaugaugcaaagugcuuaucauuuaccaaaugguaggcacuguguuuaaaaaaacaaaaaacaaacaaacaaaaaaaaaaaaaacaccuuuuacauugaccuuuuaacucuuccccaaaaaccuggcagaggagggccuugauuacccuauuuugggaacgaggaaacaggcuggggaaggcucgacaacucaaccaagaucauucugaaaugagcggacacgugggcuacauuuuccacacuacuucuggccuguucucccucaguuuuacccuugccugcuaccuccuagaccagccuuccucuguuacuaucccaagugucucauccuccaggguagguguggguaggaggcagcagaucucagaagccguagguuucuuggcagugaagcaugacauucccuuaaaacauucauucaacacaaaucuacaaaggcaccucaaugugcgaacugucacgcuaaacaggacagauaggaaaaaauagcccuacucaagaaacccagugagcaauggggaaaagcaaugaggaauccgagaacuuugguuucuggcuuagggaaaauucccuucuacuagggagaugaagcgggccucgggaagagagcugccaguagcagcaggucugaggaaaagcagguguucugaguuaagugcacaaagcaaaucuacggugauacugugcaccacagagagaaugggccgaggagcacucagaggcgauacgcaggaggccguaacaugggcuagcucagggcaguggcuuguaacaucuccucacaucaauuccuaagcacccuuuccacgaauggggggaaaugccuuccccuucacaagaaauuccucugggcuaucucacaacuacauucagcuggcaagcccuggcuagcuuucuucagucugcaaaugaguuaguggcagcacuggggugggggcugagagguuuucaggugguagagaggcaagugaaguacagggauaaaccauucacaggcgauagagggggcuccaucaacguggagggcugaaccauucaagcagcacauguuggggggagguucagaguugggcuggaccauucugaugagugagcaugaaccagaucagagcaaagauuuccaaacaugcggugaagaguuggacgugggggacggaggugacagcagccaagcuuaccagauggaguuggaaguggacugucucauggaacaagcacuccagcaguggguuacagcagaagugggguggguccuaugggcuacagcagaagucgugggguggguccugcuaugaggcugacauggugccugggggaaccuaaaagaaaacaauuucaguuagagaugggaucucccaagauagaggaguucccuuccuuccuggucccccucauugagaaaccaggcucuagaggucagaugagaugggagauucgguuuccauggcaaccuggaaaaaagccaucuuccaaccuuuccuuuaggaagcagccugguucagguaguaaggaagcauaggguggcaccucaguaccaacccacgucgcccuuuucugacuagacugauauucuggcucaggcccagcuacaggggacaucuacugucaagcaaccuuaguuccugcccccagggcauguggacccuaggccuucaguucugcuaccuccaacccuaacaagacaccagauagucaacaccaccuuuuggacucugacccuuccaguucccuuaggcugguguaggcagguucuggcaagcggcacagguggucagacaagaugaacgggcccaacagggaggagccuucuuccuccgcaagagcugugacugggccugagcuaggaaguagccucugcagcaggcucccuccaugucaccuccaaaaccauauccuguuuccccaucaccuccuuccuccauguggcccaaggaggugacaggggcccacucucuucccuccuaauccuuagauacaaagagcuagguauauuacuacaagucuagggccaagacucagguguugauagcaggaguuaggccucagucaacccucaccucagacucacuccuuggggaccaguguuuucuccaggacccagacacacgggcucucuaccuggccucuccauuuccuggccuuccagcccccaucuuucccccugccccagagacuuaggccucuggccuccaugaugcaaugcacugcaagcuuuugugccugcugaugacacugcccccagggaaguguuauuucugaccuaagcaaggcccuuaaggaacaguggucagcagcgagcugagaaaacuggauuggcuaggaccuucuggagaaaagaugcuagaggcuggacccuucuggacagggaagcaaauucaggacuaaggugcuuacccagcaguugauagaauuuguggcuacgggguaggcuagccuauagagggggggaggguugcaggccagaccaagggggucagaaggguaugugaugggugucuggacaccagagugggggagggccaacagccauuuaaagggccaaccucagaacuuuaaucccuuaccagccuuggccccaagcaggaggcuguaauucaucugcccaacagcuggggugggggugggggggcaugugcaugaggaggaggggcuggggccuucuugugcaaagaaccaaacaacaaaaggggaagcugaaggggccagcucuaaaguacccaggucacccuacugaccugcggaucugccaguggcccccaccugguucuggcccacagguucuguaguucagacucacagauucuuggucauggagucaaagggcucacccaugggguucugaagaaagccuagacugagcacccucagggcaggcugucaaccccuucuugcacuuuuccagccacaguaacuggacuggagaccugaggcccagucccagacagccucaaaugcccugcucaccagccaagccucuguagacauagccugccagcucccccuccugccagcacaggguggcaguggccacaccaaggcugucccuuuaaaucauuuccaccccugacgguguggacaaaccaagggcccugccccccaggcaggcagcuugccaccaccccacccccuaacccccagauauguaagggccauuuaaagggacaucagagaggcagccuggucucuaacaaauccccacccccuccucacacacucacugucccugucuccagcaacacacagccccccugccucuccaucaggccccaaauuccgguuuucucucaccccuagagacugcuacgaggagaauggggcaagggagacuggggggagccauuaaagaauaaggacucccuccuuccucagagccccaugagacuggucggaagaagccagccuaagaaacauugagacagaaccccaaaaggugccucgggcagaacaggggagcacacacugugggguggggggaagggagucaggcugcacgagacggaggguggcggagccagcaggcgacaagcccaacucgcagaaauggaacaaggagggcugggggggaaaggcaaggcccgggaaaucggggagacggaaaggggucguccgggaggguguggaagaaaaucagacagggggagggagagccaggccaggguuaccugcugggugucugucccccggcggugcccccagaguccggguagggagggggaagcagcaggggggggagugggggcuggggggcgggggagacggucccuccucugccuccugggccugccccggcgcuugcagccucugccucccucccuccuccuccccgucccugagucccggagucaaac

SEQ ID NO: 6101 - RNA, 1690 nt, Mus musculus
acgcaugacaucggcggcacaguggcugauggugaggucugccaugcgcagccgccgcucuuccaccucagaggcgauaaaggucuccuuguccccacuuuccaccuugaugagccugaucuucagcuccuugggaggccccucacuaagugaccggagcuucagcauaucugcccggcucacaccuggaggccccggagccuccucacgagucuucuucccagggacaggagcugauggggguguuggcugagcagcgggugcaggagcaggcgggggugcuggagcugugggugucuugacuuuggaaaccccaccgacaucgggccgggccuucucccggcccuggaucuccucacucugcaagucgagguuccccagcacccuucggcuuuuuucuuugggagccuuggccuuggccuuggcccuccccucgcggggucgucgacccacacugucccuacaggcccgccugugccgccgaugcuccuuuugacgacgcuugccacuaccuggaccugcugcugcuaccgccacccccccacucuccuccuuggccugcgcaggcggcggcuguggcucagucccacuguccacugggucugccguguccacuggguugauggcacuccggcccacccgcucuacaagggucucacaagcccgacugauuucuucuagcaccucagacucagaacgagcagggggcagcggcagaggugggggcaacugggcaggggucacggggccuggugcuggcucuucacccgcccugugcucccgggcccaaggcccgccugagguagagaacugagaugacgaggaaaccgagggcuugggggagcccugggcacuaggggccacugaagugggugguggggcgguagcaccugaugcaggacuaggggaauacugaguggcgggcacggacccgggccugguugagacggcugcuccagucccccgguaacaguacuuuugucccucaagaacagaggccaacgauuugagcaggcuggcugggcuggcugguggagguggugggggcuguggcuggggagguggaggaaacuuggcuagaggcggugguggugguagggcuggugguggcuucuucuccucuucuuggguggugguggugguggugguugugguggugguggcgguggugggggcagcaguggugguggcuggggcugugucacugggaaauggaggcuguagagaugcaaagggcucuuugagugggggugggggagccacgccugccuccugcugcugcugcugcuccuccuccuuccgaauggauucauccagcaucuucaugauguuugccagcccaucagguaggaucuugaauucggcuggcucuucaaacugguccuccagcggagugggugggaaaucaaagagccucgggccucgggcaggcagcucuccaaccccagguggcacaggcuggggggcuuuacucacagggccuggggguggccccugccccaccucgggggucuuugggaaggagacccugggccgggggcucuccgagcgccugaagcuuccugagguauuuugguggcaggaggagggaggggcuggaggcagggcaagagucagugguggaagagguggguccugggggcucaagguugggcuggauggccuggggagggggucuauacuucuggcc

SEQ ID NO: 6102 - RNA, 1690 nt, Mus musculus
ggccagaaguauagacccccuccccaggccauccagcccaaccuugagcccccaggacccaccucuuccaccacugacucuugcccugccuccagccccucccuccuccugccaccaaaauaccucaggaagcuucaggcgcucggagagcccccggcccagggucuccuucccaaagacccccgagguggggcaggggccacccccaggcccugugaguaaagccccccagccugugccaccugggguuggagagcugccugcccgaggcccgaggcucuuugauuucccacccacuccgcuggaggaccaguuugaagagccagccgaauucaagauccuaccugaugggcuggcaaacaucaugaagaugcuggaugaauccauucggaaggaggaggagcagcagcagcagcaggaggcaggcguggcucccccacccccacucaaagagcccuuugcaucucuacagccuccauuucccagugacacagccccagccaccaccacugcugcccccaccaccgccaccaccaccacaaccaccaccaccaccaccacccaagaagaggagaagaagccaccaccagcccuaccaccaccaccgccucuagccaaguuuccuccaccuccccagccacagcccccaccaccuccaccagccagcccagccagccugcucaaaucguuggccucuguucuugagggacaaaaguacuguuaccgggggacuggagcagccgucucaaccaggcccggguccgugcccgccacucaguauuccccuaguccugcaucaggugcuaccgccccaccacccacuucaguggccccuagugcccagggcucccccaagcccucgguuuccucgucaucucaguucucuaccucaggcgggccuugggcccgggagcacagggcgggugaagagccagcaccaggccccgugaccccugcccaguugcccccaccucugccgcugcccccugcucguucugagucugaggugcuagaagaaaucagucgggcuugugagacccuuguagagcgggugggccggagugccaucaacccaguggacacggcagacccaguggacagugggacugagccacagccgccgccugcgcaggccaaggaggagaguggggggguggcgguagcagcagcagguccagguaguggcaagcgucgucaaaaggagcaucggcggcacaggcgggccuguagggacagugugggucgacgaccccgcgaggggagggccaaggccaaggccaaggcucccaaagaaaaaagccgaagggugcuggggaaccucgacuugcagagugaggagauccagggccgggagaaggcccggcccgaugucggugggguuuccaaagucaagacacccacagcuccagcacccccgccugcuccugcacccgcugcucagccaacacccccaucagcuccugucccugggaagaagacucgugaggaggcuccggggccuccaggugugagccgggcagauaugcugaagcuccggucacuuagugaggggccucccaaggagcugaagaucaggcucaucaagguggaaaguggggacaaggagaccuuuaucgccucugagguggaagagcggcggcugcgcauggcagaccucaccaucagccacugugccgccgaugucaugcgu

SEQ ID NO: 6103 - RNA, 6242 nt, Mus musculus
uguggggggcgugggccgcgggaugcgacgcccgcuccgacugugcuccagcuccgguuuuucccuccaccaugcucucccccuccccgccucuccuuuaacuccccccuccugggcucgggacugguuuccucccuuagcccgcugcccucaaucccggcgaggcuggggcuccagcucggugucuccuucuucgcucccuugcccggcgccucauguugcccccgcccggcccucggcuccccaugucccccacguagcggggcgcacaaaucccgaggugcggcgcgugggccgggggcgcguaaggcgccugcagacggccccugcaaggguucuuguggggcugagcgcucuggagccggggagcaagcaucgcagaaaagaggguccuugugggagcugggggugacuagccacccaccagggugacugggguuccacagcgugguagccaccccugggggugagagacuuugggggaguuggugccccgcccccaggccuugguagggucaugggggccccccauuuugggccagggggugugcaagucggggcccugcugcuguuagguuuugcggggcugguaucuggacucagccuggagccugucuacuggaacucggcgaauaagaggugagugguugggacugaggagauuccagucccauggauaagggauauggaagcuuugagacuaaccgggcuaggauucugagcugagagggggcuggcagaagggugcuugcuguagcgcugaggugaggugacagguuacaagacagagcaaugaucuugagagccagacuccuagucucacagagcugguuguggguggugauaccaugugucaggaguugggagaucuuaaaggggcaaagauaaaguucacgggcagggggagggcaauggaguggcuauuuggcucuggaggagaccugugucaucugcguugaagggagccugguuaaugucagcucucgggagagaggugcugaaugggugcugcugaggcacugaggagaagggcagggacaccuagcucccaggaggcacucgguguugcagaugagggggaaggggguucaguuuggggcuauagaacaacccacccaagguuccuugacucucagucuguguucccaacugguguucacagccagaggacuaguugacccuuugguugaacaguuuggcaacuagaacaugguccugucuuccugguuugguggacucuuucuggaggccccucaaagcccccuccuucucuccugccacugggaguccugagggugccacuggccucuccagucaucuugaccgaccgcaaacucucccaucggggacuccggucccugacaugcuagcuuugcuuggaaagaggccaagggucagucagucacacagggcagacagaaccucugggaggccaucuaagugauuugucuccaugacauuuccuauccccaccagcccaagaguucuguguuucagaaacuuccuccuucgcuggggcgguugugagaggucaugggaggggggaguggaccugagacuuuaucaggcacuuggucuuaacacuagcccugcucuuugcagaaagcuguguggucuuaggcaugucacuuaaccucucugaguuuguaucuucaguccuuacagcuguuaugaggauuggaggcaagguauuuggacauauuauguacucauucaugaaaggagagguaggauugguuuuuuuguuuguuuguuuguuucuguuuuuuugcuuccuggcuuuccugcccuauuccaaucuugguaccuccucucccuccuauaucucagugggaauagucaaucacaaguucucccaccugccagcaacuccuggcugcaguuuugagcacuaaguauaccuugaggauauaaaugggcuauccuguuaggguugagagagacaaggcguuggggcuuucugagguucuuuuggguauugggugggagcuggucaguacgaaucugggaagaugcugggcaacagcuuuguggaaccggguuucaacuguggaugcacaggcaggggcuugcugugguaggcagguuguggcugugcugggcccauccauucccuggcuaacugggcauggagaugcugcuaguaguuugugucagcuguagugacagaagccaacuacuucaauuccucaacuggagaacacuuuccucagaaaguuuaagccccaagguggaacgcaggaagaaugaucagagugauuggcaucuaugcguccauucucaucagccccauuuuggucauugccaaacuagcauuuacuucaugucucauuaacugacuaacuuggaucccagaucccagccccaccaccaccaccccaaccuauaccuugcccccuuugcccugaaauucagugguggccuggaggagggggagguuccauccccaugguugaaugccauggaauagugaaaucaccugggagggguaggcugugugguuccagagaggccagcuccuugguaacuggcauccuguugccauggcaacggcaccggugauggagcgggagauggcagugugcauguggugagggcgggcugaagagugcauuugggcacaccaaggggcaagagaccucugagccuggcuuccugcugcuucugaugugagcuugcagagcccuuaguucccgggcuuacugaacacaggacucaaacaaaggcaaugggcgggagcuaagaauugcuguccgaggugguugggagugagagagggaaagcuuugggcgccacaccccugacaccucuucccugccuaccuugucuucccuguagguuccaggcagagggcgguuacgugcuuuauccucagaucggggaccggcuagaucuacuuuguccccgggcucggccuccuggcccccacuccucuccuaguuaugaguucuacaaacuguaccugguagagggugcccagggucggcguugugaggcacccccugccccaaaccuucuucucacaugugaccggccagaccuggaccuccgcuucaccaucaaguuccaggaauacagcccuaaccucuggggccacgaguuccgaucccaccacgauuacuacauaauugguacugccagacgucgagcaggggcaaauagaguguccgugggauggagggggaggaagguuagagccauuggaauccaccacuggguauucaguaaugcucccuuggcauucagucgugcuucccuccccccccccccccagggaacaggggagggcuggaccuaggagugaugacuucuacuucugcucuuauucucagccacaucagacgggacccgggaaggccuugagagcuugcaaggaggcgugugccuaaccagaggcaugaaggugcuucugcgagugggacaaagugagugggggacaggggacuccugcuaagggcugaguuuaggugguacaugcaaaucuggggcaguucucucagccccucucucacucacgucuuucccaucuucagguccccgaggaggagcuguaccccgaaaaccugugucugaaaugcccauggagagagacagaggggcagcucacagcgcggaaccugggagggacaccauaccagguaggaaccaggagcccaggcacugcugccucugcucccagaccccagcugcccugccuucacccucuccugcccgcccucccucucccgcuuugggggcggcuauacaggaaagaggagaagagaggaugggagggugggagggaaguggaagccaaaugaggaaaagacucaauuagaacuaauuagccaagucacugcuucaaucagugcugucaaagaaggggggggggcacauggcagggagcuggaggccggacaccuggauuuccaucccaguuugggggagggaaugugggguaccuaaggggccuggguacugcuggggaagcccauggggacccccagggcuggguguacccaauauccagaugguuccuucagccccucccccucuuuccuccuucaccccuucccugccaggugaccccagcagcaaugcaaccucccggggugcugaaggcccccugcccccucccagcaugcccgcaguggcuggggcagcaggggggauggcgcugcucuugcugggcguggcaggggcugggggugccauguguuggcggagacggcgggccaagccuucggagagucgccacccugguccuggcuccuuugggaggggagggucucugggccugggugguggaggagggauggggccucgggaagcugagccuggggagcuaggaauagcccugcgggguggugggacugcagacccccccuucugcccucacuacgagaaggugagcggugacuaugggcacccuguguacauugugcaggaugggcccccccagagcccuccgaacaucuauuacaagguaugagggcuccucccaccuggcucuccucaaucuagccguccauggggugcuccuccaguguaauucaugguaugagggacaccugcgccaugacuuuggcccccuuugcccuaccagcucuuuggcuccuccuggcuauagcccucaucuccaauuuuaggaucccuuaagacuugacuacaccuuuuccugaccuccccgacugacccucauuugacugugggcacuccucuguuucugccucuuaggggaggggggucacaggcucagccucccuuaaucacuacccagguguccuuucucccucacccacccagaguggggguggggacagucugucuuuugguuggcaccucuuucugccucucaccauuuuucucuucucucuauuucuuauucucucucucuccugugucuaggucuguucucuuccuccucccuagccuccuccuuacaucuccuuuuacccucucggcuucuuguccuuccugugccucucacgugucuccuggguuggggcaucaaagcaucucuccucuuugcucuuggcccuuuccaaccuuucauaccaacugcuccccucuguccgccaaaaacgggggcuugcggggggugggggggagauucuggaacucuacccccccagcuccaggcaugggcacagggccucuuucccugccuuucuguguacuuacuccagccauuuggggugguuauugggccacaacuacuaccaugagaagaaguguccuguuguggccaguggcugauaggaagacaugaagcaguguggacaugauggacugugucugaugccgaaugggcaucagauaggaagugacucguuccagacaagaagugaccaggccuggacagaaauggccugggaaguguccgcagcaggaacuggaagugccuucauccagaacaggaagucgcacuucugaaauaggaaguggucuggcuggaauuccaaguggcuuagucuggggagguggccugggugggggugggggcaugggaaguggaugguucuuacccuguggagaaaggggcaggaggaacucccugcuuuaggaggaagcuggaacuuaccacugugagaggacagauguggacugagaguuuucuuaguguucaguggcacuucccaaggaccccuucccuugugcucugugcaguuuuuaggacagcuaagaugacugccacuugcuguggcaggcccaauuugucuuguucuccccuuacuguaccccaguauaaucucuguugaucaacagaacuaccccaagaacccacauguucuccccaccuaaccagacggcugucuggcugaugccuuccucccuucaagcccaacacagcgcccuugucagugaagaggugguccauggacuggucuagcugauggcaguuauuagcacugguugcuguuuccauagugacaagccuauaccucuucccgcucuuuagugugcagugggcugcugccucgguguucucccgccucaguuuuauuagaucaaagcugcccuuggccaucauguuggccaccucaaucaccagccaaaaugguugcuuuguccaccagaggucaagccaucucucuggcgcuguaguucccagcuccuucuagggaacaggaaguugauauugccauuggggagguggcgggguauggccgucaccucgauaguuuuauuguaaaagggaaauuugaacaacaacaaaaaaacuggaaaaaaauaaaaaaaaaaacuuuaaaaguugacca

SEQ ID NO: 6104 - RNA, 1708 nt, Mus musculus
caguccauggaccaccucuucacugacaagggcgcuguguugggcuugaagggaggaaggcaucagccagacagccgucugguuagguggggagaacauguggguucuugggguaguucuguugaucaacagagauuauacugggguacaguaaggggagaacaagacaaauugggccugccacagcaaguggcagucaucuuagcuguccuaaaaacugcacagagcacaagggaagggguccuugggaagugccacugaacacuaagaaaacucucaguccacaucuguccucucacagugguaaguuccagcuuccuccuaaagcagggaguuccuccugccccuuucuccacaggguaagaaccauccacuucccaugcccccacccccacccaggccaccuccccagacuaagccacuuggaauuccagccagaccacuuccuauuucagaagugcgacuuccuguucuggaugaaggcacuuccaguuccugcugcggacacuucccaggccauuucuguccaggccuggucacuucuugucuggaacgagucacuuccuaucugaugcccauucggcaucagacacaguccaucauguccacacugcuucaugucuuccuaucagccacuggccacaacaggacacuucuucucaugguaguaguuguggcccaauaaccaccccaaauggcuggaguaaguacacagaaaggcagggaaagaggcccugugcccaugccuggagcuggggggguagaguuccagaaucucccccccaccccccgcaagcccccguuuuuggcggacagaggggagcaguugguaugaaagguuggaaagggccaagagcaaagaggagagaugcuuugaugccccaacccaggagacacgugagaggcacaggaaggacaagaagccgagaggguaaaaggagauguaaggaggaggcuagggaggaggaagagaacagaccuagacacaggagagagagagaauaagaaauagagagaagagaaaaauggugagaggcagaaagaggugccaaccaaaagacagacuguccccacccccacucugggugggugagggagaaaggacaccuggguagugauuaagggaggcugagccugugaccccccuccccuaagaggcagaaacagaggagugcccacagucaaaugagggucagucggggaggucaggaaaagguguagucaagucuuaagggauccuaaaauuggagaugagggcuauagccaggaggagccaaagagcugguagggcaaagggggccaaagucauggcgcaggugucccucauaccaugaauuacacuggaggagcaccccauggacggcuagauugaggagagccaggugggaggagcccucauaccuuguaauagauguucggagggcucugggggggcccauccugcacaauguacacagggugcccauagucaccgcucaccuucucguagugagggcagaagggggggucugcagucccaccaccccgcagggcuauuccuagcuccccaggcucagcuucccgaggccccaucccuccuccaccacccaggcccagagacccuccccucccaaaggagccaggaccaggguggcgacucuccgaaggcuuggcccgccgucuccgccaacacauggcacccccagccccugccacgcccagcaagagc

SEQ ID NO: 6105 - RNA, 6239 nt, Mus musculus
gcucuguguaugauauacauuuauauauauaaucgcucucaguuuauuguacuuuacccucuuuuuacaguagaucugacacaggcauuaaauaacugcagaaggagaccacugggaagaugaaggggcaggaagaccuggauacccaaagggaagagacacagauccagcgggaggaaagagggaaggagccacuugagggugggacgugggggcugcggugaagaggagauuggaaaggauuaaagagaagcagagagacuagaggaauaugcugcucugauggacgaaaacuuggagcagggggcucuuucgcaacauucuagggaugucauaggguuguuuguuuguuuguuuguuuuuuaaaggcaaaagaguuugaaggaggcggagcaaagaaacucagagcugagcuggaggagggugucugacgcuuucaggcuggcaugcagaaagggaagaccuuagugaccaguuagcaacuugcaaggaguagccagagagaggauggggguggguagaucugggcuuagggaguccccccagccagcugacguuuccaagguggcugcuggggauagagccaagacagcggccccucccccacagagcucccugggaaggagaauuugaaagauauucugggaaggccagugggggaagggagccaucaguuaaaaaacaaaguggauauucagagcaggucaagcccgccugaguaggagccguuuggaugacaggagggaccaggaagaaguuaaaagucuaagccuacuagagaauuuucuagaagaauuaaagacuucucuuccagucauccuuuggagucacaguugggggagaagcaggauguaucaggaaggacggaaaaggccacagaaccaacuuguacugagcuacaaauggcagcuuuucagagggagagggaucagggagaggagagggcagaacugcuggaggaaccagaagucaaagccaccaagauacuggcuauggugacagaagugugaagagaugaaaggaaaguggcuagaaccuuguaaaaggaagaaggacaguguucaccccugggaagcaaguggcugaaacggguucgagggaucugugggguagaggcuggguggaugagaccauuuccuguaccucuaaggggaugggaguagaaacugaaacaggagcuguaagggcaucucauucauaaacucaaacuagaaaaccuccaacaaugcugaggcccucgugcuugcuaggcaaguccucugucgcugagugacaacuccgguucccgaacuagaaaacucccgacuccucucugucucuggcuaagcuaagguuggaagauguuggaaauugugugggcaucaggcuagguagagaaguugaggaaagggugugaggcucagacaagucauagcucuauuauaaaaaauaccuuuggggugggugagggagggaucaggcagggucaaggacauuccagaagcauccacaggagagugugggcggguggggguggggagccucagguuuuguugauccggaguuugaaggccacacggccagcgaacuugucccgcucaucgucuguggcaauauuggcagcguugaugcggcauucaacauucaccuccacguugggggucacauucaggaacuuuacagccaccaaaggcugaguauaguuuaccugggccaggagaagaaaaaaacguaagccucugguaccuuggcgucuuucccaagaacaccauuuuuucauucaggagccaccgucaaggaccuuccgaggugggacuuacauggaacuuuuugccauaguagggaaaguacaucagaucaaugcugccauuagcagggaacaugacaaaguggccaagguucucagcaucuucaucucucugugggggugcaggaagguuaaggggagaggauguuaggaacagcaggcaccuggaagcgcucacaagacuuccuucuguaccuccuucaucccaaauuaucccugucaaacuuguuuucuuugagcugugcaucugcucagguagcugugugugcauuugugugugcgcaugcacacauguuccuaucugcaugucugcagauagggguggccuaucucccaucagacuaggucuucuaagggugcugacaacacggugagggccuucuaacuccaccaucaauccccaaguucuuaccccguccuugggaaucagucucuggagcagagccaagaaagaacagauaaacagucaaggcucagugggaaggaggagaguuucuagagaggacagaguuggcugcaggguuccaaggacaacuaguuguagcaaagggugcuaacugagcaguagcuagcagacugagggaacugagaaacaaggcaugaugggagaguggaagaaacccagacaacugagauguaagaaaaaguugacagggaaggaaccagaggucagagcuuuggugcaggaagggauaggucuaucuccaggacagcaggcucucuuuauccuagagagaagcaauagggcuaagagccucuuagagcuaaaacugcauaggcgcccacucuuacccccuugucccuauagugcuguggccucugaaagcacaaaaagauagggagauaugggugaagcacucagaaaccaggaagucuaaccaggugggcagguaaggagggcccccacacucaccuugccaacacaagugacauucaugcucugguuugccccugcauagaaguugaugaccuagagaaaggagggaggguggauuuagaagaaguugccacaucuuggcgucuagccuuucagcucuggggcuuagcuuccaauagccccaccucuuaaaacaaacuaccaaaaaucucuuuaaugcccauuaaccccaaugaaaggacacauuaguaaacagaugguggccccagcucccuccuccauccuccccgggagaccaauaucauggguacccgauucauuuugaugaagacacagggcugcccggugcuguaaccauaguggguaggguccccaaugccagagcaaucgcccaguuggguccgguugaacuggcaggcacguuuuggguaguucagaaccccauuaucagguugcucauaauaucgcccuggacggcagacaucauucuucugugcuuggauggagucguuguaagcuaggaggugggaggcagacagagaaggucagaggccaaaugucucacuuccaggguccuggauuccuucccccaagguccuggacuagccccacacucacguuccaagaacuuguugagcuucugaacaugcugaccccagcuuucagugucacuaauguugacaaugacaucaagguucucagucuugggucgaaucaucaagccuagagccaacaggagagaagacuagagagucacauaagaugaagagaaacacaucaagggaaauggacagauaugaagaacaccagggucaggugggggcaaagaucugaaacugccuuccugggagagcaaucuccuguggcaucugccacgucuccaaaucacaugacucccggcugcagggcaugggaaggaaggccaaguucaagaacuccccacuccaacuccuggaaagaacuauacguuccuugugaggccuuaaggacacaguaguuccagugaccgguaaggggaaaacuacucuucucucaccugguguggccagucgauccugguacuuggggguauggucagagacggucugcagcauuacccacauggugaggcugaacauggccgugaggaaaccauagaagacgagguagaagaggaggaugaaggcuaggauagaggaacuagagucagcagcucccacaucuuccaccaaccccucucuuccuccuuccucucaagcuguguacggggauaggccaaggagcgacaggauaucuuagagccuuccccugggagcuaaaggaaacaagcuggaaacaggcaggguccagcuccagcccugacucccagacuccuccuggggcacagugaagucugaccuuuuggaggccacaagagaccuaaacuguaguuguugugacaacuccaagaauaggccacugucauucugcggcuaaugcauuuccaacuucucaacccugcacgguccugaaaaggcagcaucuguuccugccguaucggaacucgaaguuagagccgucucagagcacaaggaucuggaugcaaccugguaacugcgcagcacucucagccaaauucuuaucaccucagaggacucagguagcaagaucugucugucugucugucugucucucgcccugaggaagcagccccugaaaugaggggcuaauggcccagcagucacccccaccuuuaacucacacaggaucuuggccagagucaaggagaagacagaaucuccuagaagccuucccuggacaucaucucucaggacuccuauccuaagccuccagugaggaggacaugcuguuccaaucucccugaacucucagucuuucuaccuaagaagacaguuccucuguggaggcuucugaguagcccaagcauccaucguugauccuucacaucccacagggucuuggguuccuugaggacaagggcugcauugaucuccuuucaugguccccuaagccucagguggguggucugaugaagacuguguccaaucgauguggauaugucguaaauuaugucacacagaaucccuugugcuucaauucuccagcuuggcacugucuugcaagacugucagucacccuuaccucaccggguacccaucagcagccccugacuaccuaaguccuugcacacccaugagguaaggguagagaguucuuccaaggcaucugagucccauguaaacacccugccugaggauguacccauaucagcacagugaccauuacucccuccaccucugacaucugaaaaccucaagccuggaaaaauaccaucccuccuggcagccccccacccacaaagcagccacagaggacuccaaacgcccaaugguggaauacagacaaacaacuuccgcuguuaagaacccccccucccaagaccccccugccagauccgccuccucaugaauguucccaggguccaagggggugggugagagcuaaaaauaaacgagguuggcuagcuagugagagccagagggagaguuagggcacucuucggggagagggaugaugaccgugugcagccgcagggccugagccggagcgggagcgccguggcacggacacgcgcgcagagcccgcgaccccccgcccgagggggcuccgcggggggcgggcaggcggcagugaccuacuuucuccgccuccgcagcggccagucagagagauuagaccgcugauucggggccccucccgauccaaagcccgacagugggggcuggacgccagggacccggcaggggagcuggggcgacgcccgcgggacccugcgccccaaaggcaucgccgagcggucagcuaccaccuuucccgcgccagccccgcguaccccagcuggucccggugcgccccaugaacuggugcguccgcggguuccacacgaacuccuuccacuccucaaccaccugcccgcagcucuucuucucuuucuggaugaccaucuuggaggcacggggcgagucccggcgcgcugcugggggcugcggagaagccggggcgucgcgcgcugaagcccuccacgcaccaaaugcgcgcgggagcgaggcagggagacuccagucagauauacagcugcugcaaauuccggggugcacagccacgcacuguggucugcuggcagugcggcgaaggugcaccgaggcuaggccccccgacugcgauagaaaggggggcugucaaaacagggaaagauaaccagggaaagggaugccgaggcaccuucaccccacacaccgccuagaagcaaaacaaaaaggggugcaaaaccagacggcuccaaaauucgagcgaaacgcagaaaaagcggggugcaaagaagcagggaaagaugggggagggagccgccccgaaauccgagaugcaaagaggcuguagaacgcggcagguggccgauuaaggcuccuccgacaaacggcgacagccacaccacaguuggcccagccagugggagcuggggcggggacaagcaguugugggggaaagacaaggauaggggccccccaaucggaggcuccgcuccucagcagugcgggg

SEQ ID NO: 6106 - RNA, 6239 nt, Mus musculus
ccccgcacugcugaggagcggagccuccgauuggggggccccuauccuugucuuucccccacaacugcuuguccccgccccagcucccacuggcugggccaacugugguguggcugucgccguuugucggaggagccuuaaucggccaccugccgcguucuacagccucuuugcaucucggauuucggggcggcucccucccccaucuuucccugcuucuuugcaccccgcuuuuucugcguuucgcucgaauuuuggagccgucugguuuugcaccccuuuuuguuuugcuucuaggcgguguguggggugaaggugccucggcaucccuuucccugguuaucuuucccuguuuugacagccccccuuucuaucgcagucggggggccuagccucggugcaccuucgccgcacugccagcagaccacagugcguggcugugcaccccggaauuugcagcagcuguauaucugacuggagucucccugccucgcucccgcgcgcauuuggugcguggagggcuucagcgcgcgacgccccggcuucuccgcagcccccagcagcgcgccgggacucgccccgugccuccaagauggucauccagaaagagaagaagagcugcgggcaggugguugaggaguggaaggaguucguguggaacccgcggacgcaccaguucauggggcgcaccgggaccagcugggguacgcggggcuggcgcgggaaaggugguagcugaccgcucggcgaugccuuuggggcgcagggucccgcgggcgucgccccagcuccccugccgggucccuggcguccagcccccacugucgggcuuuggaucgggaggggccccgaaucagcggucuaaucucucugacuggccgcugcggaggcggagaaaguaggucacugccgccugcccgccccccgcggagcccccucgggcggggggucgcgggcucugcgcgcguguccgugccacggcgcucccgcuccggcucaggcccugcggcugcacacggucaucaucccucuccccgaagagugcccuaacucucccucuggcucucacuagcuagccaaccucguuuauuuuuagcucucacccacccccuuggacccugggaacauucaugaggaggcggaucuggcaggggggucuugggaggggggguucuuaacagcggaaguuguuugucuguauuccaccauugggcguuuggaguccucuguggcugcuuuguggguggggggcugccaggagggaugguauuuuuccaggcuugagguuuucagaugucagagguggagggaguaauggucacugugcugauauggguacauccucaggcaggguguuuacaugggacucagaugccuuggaagaacucucuacccuuaccucaugggugugcaaggacuuagguagucaggggcugcugauggguacccggugagguaagggugacugacagucuugcaagacagugccaagcuggagaauugaagcacaagggauucugugugacauaauuuacgacauauccacaucgauuggacacagucuucaucagaccacccaccugaggcuuaggggaccaugaaaggagaucaaugcagcccuuguccucaaggaacccaagacccugugggaugugaaggaucaacgauggaugcuugggcuacucagaagccuccacagaggaacugucuucuuagguagaaagacugagaguucagggagauuggaacagcauguccuccucacuggaggcuuaggauaggaguccugagagaugauguccagggaaggcuucuaggagauucugucuucuccuugacucuggccaagauccugugugaguuaaaggugggggugacugcugggccauuagccccucauuucaggggcugcuuccucagggcgagagacagacagacagacagacagaucuugcuaccugaguccucugaggugauaagaauuuggcugagagugcugcgcaguuaccagguugcauccagauccuugugcucugagacggcucuaacuucgaguuccgauacggcaggaacagaugcugccuuuucaggaccgugcaggguugagaaguuggaaaugcauuagccgcagaaugacaguggccuauucuuggaguugucacaacaacuacaguuuaggucucuuguggccuccaaaaggucagacuucacugugccccaggaggagucugggagucagggcuggagcuggacccugccuguuuccagcuuguuuccuuuagcucccaggggaaggcucuaagauauccugucgcuccuuggccuauccccguacacagcuugagaggaaggaggaagagagggguugguggaagaugugggagcugcugacucuaguuccucuauccuagccuucauccuccucuucuaccucgucuucuaugguuuccucacggccauguucagccucaccauguggguaaugcugcagaccgucucugaccauacccccaaguaccaggaucgacuggccacaccaggugagagaagaguaguuuuccccuuaccggucacuggaacuacuguguccuuaaggccucacaaggaacguauaguucuuuccaggaguuggaguggggaguucuugaacuuggccuuccuucccaugcccugcagccgggagucaugugauuuggagacguggcagaugccacaggagauugcucucccaggaaggcaguuucagaucuuugcccccaccugacccugguguucuucauaucuguccauuucccuugauguguuucucuucaucuuaugugacucucuagucuucucuccuguuggcucuaggcuugaugauucgacccaagacugagaaccuugaugucauugucaacauuagugacacugaaagcuggggucagcauguucagaagcucaacaaguucuuggaacgugaguguggggcuaguccaggaccuugggggaaggaauccaggacccuggaagugagacauuuggccucugaccuucucugucugccucccaccuccuagcuuacaacgacuccauccaagcacagaagaaugaugucugccguccagggcgauauuaugagcaaccugauaaugggguucugaacuacccaaaacgugccugccaguucaaccggacccaacugggcgauugcucuggcauuggggacccuacccacuaugguuacagcaccgggcagcccugugucuucaucaaaaugaaucggguacccaugauauuggucucccggggaggauggaggagggagcuggggccaccaucuguuuacuaauguguccuuucauugggguuaaugggcauuaaagagauuuuugguaguuuguuuuaagagguggggcuauuggaagcuaagccccagagcugaaaggcuagacgccaagauguggcaacuucuucuaaauccacccucccuccuuucucuaggucaucaacuucuaugcaggggcaaaccagagcaugaaugucacuuguguuggcaaggugagugugggggcccuccuuaccugcccaccugguuagacuuccugguuucugagugcuucacccauaucucccuaucuuuuugugcuuucagaggccacagcacuauagggacaaggggguaagagugggcgccuaugcaguuuuagcucuaagaggcucuuagcccuauugcuucucucuaggauaaagagagccugcuguccuggagauagaccuaucccuuccugcaccaaagcucugaccucugguuccuucccugucaacuuuuucuuacaucucaguugucuggguuucuuccacucucccaucaugccuuguuucucaguucccucagucugcuagcuacugcucaguuagcacccuuugcuacaacuaguuguccuuggaacccugcagccaacucuguccucucuagaaacucuccuccuucccacugagccuugacuguuuaucuguucuuucuuggcucugcuccagagacugauucccaaggacgggguaagaacuuggggauugaugguggaguuagaaggcccucaccguguugucagcacccuuagaagaccuagucugaugggagauaggccaccccuaucugcagacaugcagauaggaacaugugugcaugcgcacacacaaaugcacacacagcuaccugagcagaugcacagcucaaagaaaacaaguuugacagggauaauuugggaugaaggagguacagaaggaagucuugugagcgcuuccaggugccugcuguuccuaacauccucuccccuuaaccuuccugcacccccacagagagaugaagaugcugagaaccuuggccacuuugucauguucccugcuaauggcagcauugaucugauguacuuucccuacuauggcaaaaaguuccauguaagucccaccucggaagguccuugacgguggcuccugaaugaaaaaaugguguucuugggaaagacgccaagguaccagaggcuuacguuuuuuucuucuccuggcccagguaaacuauacucagccuuugguggcuguaaaguuccugaaugugacccccaacguggaggugaauguugaaugccgcaucaacgcugccaauauugccacagacgaugagcgggacaaguucgcuggccguguggccuucaaacuccggaucaacaaaaccugaggcuccccacccccacccgcccacacucuccuguggaugcuucuggaauguccuugacccugccugaucccucccucacccaccccaaagguauuuuuuauaauagagcuaugacuugucugagccucacacccuuuccucaacuucucuaccuagccugaugcccacacaauuuccaacaucuuccaaccuuagcuuagccagagacagagaggagucgggaguuuucuaguucgggaaccggaguugucacucagcgacagaggacuugccuagcaagcacgagggccucagcauuguuggagguuuucuaguuugaguuuaugaaugagaugcccuuacagcuccuguuucaguuucuacucccauccccuuagagguacaggaaauggucucauccacccagccucuaccccacagaucccucgaacccguuucagccacuugcuucccaggggugaacacuguccuucuuccuuuuacaagguucuagccacuuuccuuucaucucuucacacuucugucaccauagccaguaucuugguggcuuugacuucugguuccuccagcaguucugcccucuccucucccugaucccucucccucugaaaagcugccauuuguagcucaguacaaguugguucuguggccuuuuccguccuuccugauacauccugcuucucccccaacugugacuccaaaggaugacuggaagagaagucuuuaauucuucuagaaaauucucuaguaggcuuagacuuuuaacuucuuccuggucccuccugucauccaaacggcuccuacucaggcgggcuugaccugcucugaauauccacuuuguuuuuuaacugauggcucccuucccccacuggccuucccagaauaucuuucaaauucuccuucccagggagcucugugggggaggggccgcugucuuggcucuauccccagcagccaccuuggaaacgucagcuggcuggggggacucccuaagcccagaucuacccacccccauccucucucuggcuacuccuugcaaguugcuaacuggucacuaaggucuucccuuucugcaugccagccugaaagcgucagacacccuccuccagcucagcucugaguuucuuugcuccgccuccuucaaacucuuuugccuuuaaaaaacaaacaaacaaacaaacaacccuaugacaucccuagaauguugcgaaagagcccccugcuccaaguuuucguccaucagagcagcauauuccucuagucucucugcuucucuuuaauccuuuccaaucuccucuucaccgcagcccccacgucccacccucaaguggcuccuucccucuuuccucccgcuggaucugugucucuucccuuuggguauccaggucuuccugccccuucaucuucccaguggucuccuucugcaguuauuuaaugccugugucagaucuacuguaaaaagaggguaaaguacaauaaacugagagcgauuauauauauaaauguauaucauacacagagc

SEQ ID NO: 6107 - RNA, 2264 nt, Mus musculus
uaaugaaacaagucucacuuucccuggugggcccccaaaccccugagcuggagguuuuuauacucccggcuccccaguaccaugcaucauaccuaccuaguagagguugauuagucaaggggaggcaauugcuccuucccagugucccuugaaaugcugacggcagcgcacagucugcggccuuuaucgcauuaguccuaaaauaucuuuggguuccaaagaugaaugacaagcuugauauaccauugcuuauucccucuuguucuuuuuuuuuuuuuuuuuuuuuuucuaacaggcuagaggcaagacuagggugcccagaguccuugaggccuccaugaccccugccucuuuggcugucccagcccucaucagaacaauguucaaauagaagggcuucaaaauggcugcagcaucacauccucuacccaugagggcaaagcaaguauuuuauuugugguuccuaauaaggcuucucccucuuccacucuuucuguacuucaggagucugcacccugggaggccucugggugagcgagcgucugucugggucagugccuaugguuauggucuuaggaaaacuugauauggugaucccaaagaagaggcaggagagagagggcguaagucagcguccugccaacucccucauugccucgccuucaaaucgaaaggagagccagccuuccgauucagucagaucuugagccccuagaaauuuguacaaguucacggccuucuuguuccaauccagaacugccaggcggaacugggagcaacccuuauucagggcaaccuguagaagacauacgcuuacugcacagggcucaaaaacuaauggcuggcacacaccuuuaaucccagcaccuuuaauuccugcagaggcaggcagaccucugaguuggaggccagccuggucuacagagcaaguucuaggacaaucaggacuacacagagaaacccugucuugaacaacaaacaauaaaaagaaaaaucuuucucaucccccucauucaaccucgacacucccacuuacgugacugauugauugauugauugauugaugguuuggcugacuggcuggcuuucguuugggggcgguaacuaguuuguaagccccaccccuuugcucaccucagccaccuuuuugauuauuuugguaccaaucccuugaccuauaguggagaaagggacaggaaggacuauuauuugaguugaaaggguaucaaaggaaacuauaaucugagguugggguaaugggauaggucugaggacuguucauugggucugugggcauucuguccauccuuagccccagccaguaccccgauauugcggcaucacauagaugucuuccagauaaacguuucguccgguccaugugcuauagaugaaguaguacagcccauagcccaccacaagggacccugaaaaugagagagaagagugaggcuuuugggaggaaaaacacggaggauaacugcaggcuuccuuaccuugugacuccccaggugcugggauaaucucugccaccaaacagugaaagaaaggguucucuccaaagccaucugcucgcagagcuauaaagauuggagguaugacaaaaaaggcagagaugggccgggaaaaaccggaacuuggaguaaagcccaguccaguaguuacgaucuuaggacuccauccuuccaccccaucacccgccccccaucucaaucaggacccaggugcacagccucacccaccuucuucacugaucuucaccugaugggacaguuucucgaacucugccaguuccuauaacagggguaccaaaacaacauuaaggcaggaagguccugaucucugagaacaggguccaaaggugcacccucauuucugacuccccaacuccagccaaacugcucccagccccccacccccaccccgcacuguuuuuccaaaccgcagucuuuacccggaucauccucauaaugucuccacaaucgcucucccuggccucucggauucgcguggaagccauuccgagccucacugucaaaaaucaaagaucacagacaacucccacguuugcagaaccgcggaggucuggucucaaagcucaggucucaaagugcugggagcgaggggcagaagaaaugcuagaagcuucuagacaagauucuggcaccaaccggucucagcugggaggauuagccggccugguggucucuucugccagaaaaggccuuaaauucugagcccccuccgggccucccugcagccaa

SEQ ID NO: 6108 - RNA, 20345 nt, Mus musculus
aggccauuuggauuuuuuuauucucuuuuuaaauacuguacagugaaaaauaaauacgccuucucauccaccagacaagguuauuuccucccaacuccccugggagaccuugucaccccccuucauacauaccccugguucuauuccaaaaccuuccccaugccucccacccacgaauacccucacuauccccgucuuccacagugaugaggccccagaaaugggggguacaggaugggaggagggauagcaggggagccccccugaacugucaaaucugggugggucaaggagcacccccaccaacaggcggagaauggggguguucagaggucggggcauuagaggauaaaggcacauccagucugaaagggaaggggaggcucccucacccuggggguaggguggacaagagggagggguaugacccuguuacacaccccuccacuagcuccuggagguugggggggacccaagcugcugugccaccccccucccccguagauaagagcagcuccagcgcaggucaguuggacccaugagggccaugguggugggcagcaagcgagauggagaaaggagggauguggaccggagguuuuaugaaacuccauucaccaaacuacccaacuccaagggggcagagagcuccccauucucugaggggcccuugggaagcuugcugacagagucacccuacagaggaagcaggaggaaaacaaaaaggaagcagcugaugaguacagcagaugcaggcacgccuuccuucucacuacagacacacguggaggccaggucccucaccccccugugcucaaucaccaccagcccugucuucuguuugugccggcucugcucuacccucagcuuagccugaacuccaucacauacagucaauucaacuuucuuugcaaaguuuucugugucccugccccaaacaaacaaacaaacaacaacaacaaagugggguaggcuguaucuugauugccuaccuucuguccugaaagagaauccucugaggguuucgugcguuccaggggccgcuggcggcucugagacucugcccgugagauauagucagccacagucacuaggaaagacacaggaucaagacuuucaggaacuucgggauuucaugguucccaaugaauccaacccugguuucccagccaaugagacauuucaucuuaguuccagaaaggcuccaauucuguaugucagcugaccugguuggcggucuccacugauggacccaucaguccgguuaccacgauuacggcggcggcggcugcgauuucgucucuggggucuugauucaucuucuguggaguaaagaagagucauucacccacccucucauacuucauuuuuuuuuuuuuuuugguuuuuccagacaggguuucucuguauagcccuggcuguccuggaacuugcucuguagaccaggcuggccucgaacucaaaaaucugccugccucugccucccaagugcugggaauaaaggcgugcaacaccacgcccggccauacuucauucuuaaucacaccucuaagaauucuccaggcuagccccucacccaggccauucucugucauguuaggaccaucagacuccaggccuccguccaugacaguccugucuucaucaguacggcggcggcgggaacggcgacgacgggcacuugcuggaggagguucaccaggcuccgaaucaacuggaggcucugguucagauguguccaagaggcuguaaggauugcugucuggauccuuuagcacuagugaaacaaaaggaagaggcuggggagucagguggccacugucuucuccuucaggucaccauccaugaccccagcucugauaccugagcuaauagaugaugaguuauaucuugagguaggccggggaacagguggggguccccuuccccggcccccaaucggccgccuccugcuuucuucuccacggcuugggggaucucugucaccagguccugcucgauuagacuccucucucuuuucugacucugucucugaagcuguggaggggucugagcuggggccuaaagaacacagaaggguuuauucagagacaauagugcuuguccuaggaguucaaccaccacaucuaaauuagaauuccucuuccuaccacucacaggacccaggucagucacugcuuuccuaaguuuccacccaccuccuccacugcccacacagcugucucaccauaggcaggaccaccaguccuccggccccggccccggcccccauagcugcccccauagguucuggucgugugcagggaagaggaggagcuuucgucugugguauagcccgccuugucacugccaccaccacugccaccccguccacucccaggagggcgaaagcccagcccaaucugccgaagcuguucgucaaucugcagucucuccaggcgaagcuguucaaccuccugguuggaaagauggaagaaacacaggagaauuaagagaguagucaguccccuuccuccaagcguccccacccaugucacaugguccuacgcugcugagcucucaagacuuaggcuuaggaagacaaaggcuuaaaaagaacauuucgggauacagucucagagccaaaauauccaccaaugguccuguucuacaaacaaaccaggcacaauagucccaaagauuacguccuagagguccaugcccuccuugccaccccgccugucccugccccaggcuucugauauggguaccugcagguaggagaggugauacucaagcagugccugggcauugcugauguucucucgggugccaacaaauaugaagggaaccauucccuggagaaaagaccaacaggaaaauuacaagucaggcgugauggcacacaugaucuuagcaccaaggagacagaggcaagaacagcacaaagccauccucagcuucucagcaaagcgcuagcaugaccuaagccacagagauucugccucgaaaccgccacccuccccauucccacaaaaaaaagccaggcaccgcugcacacacuuuuagucccaaaacugagaagggcagaggcaggcacaucucugugaauugaguuuaaagcuagccugauucacaaaguaaguuccaggcaagucaggguuauagagugagcuacuguucaaaaaaaagaaaagaaaagaaaaaagaaaaagauugccaggcgugguggcacacgccuuuaaucccagcacucgggaggcagaggcagguggauuucugaguucgaggccagccuggucuacaaaagugagguccaggacagcccgggcuacacagagaaacccugucucaaacaaaacaaaacaaaaagacugaaauguuaagcccaccucucagacugacaggaucauaguauacuagggcaaacaaaagguucuguguucugcccuccacaagucaccagaccccagaaaacaguaccuccucccugggguucuucuugucguuaucuccuuccacacgaacccucaccacaccagacuuauccacaaucuccugaaucacuuucccguucuuuccgaucacuuugccuaaauggauaaagaaggaauuaggcuuuuaauuuuuguuguuaucacuaaggaaauaaaauuaaaacucuugccgggcgugguggcacaccccuuuaaucccagcacucgggaggcagaggcaggcagauuucugaguucaaggacagccuggucuacaaagugaguuccaggacagccagggcuauacagagaaacccugucucgaaaaaccaauaaauaaauaaauaaauaaauaaauaaaacuuuucuauagacuucucuacauauauugcacguaauucauucuccugcuucuaggaaucucaaacuuucuaugggacaaaaaugauacaaucccuacaagguuuauuaucgucuccuuccuuauucccaugucagacuauuuauuccauccauaugugcaggcaucaauccuaguuacauggacaaaacuauuuucaaaacucugccaccugggcccuaacuuuaucccuuuuacacacacacucaaacucaccaaccagguuccugggcacuuguacagaguccucggaaaauucaagguagcuucgagccugucugcaugccucuggugucuauagaaaaaguaaacuaaaacagaauccggaucucccugccauucugacuuuggagaaauaagcugucaccaaagucaggcuggaaggucaccauaacuucagauuugcuuuccaccuuagccucaauccccucugucacccaaaggccccaauaguccaaucucugcugaccuccccauagauucggaaagugcaggucucuucacccaacucaauggcagucacuccgggcacuuuccgagccugcuggauguuggcaccgugcguuccgaucgccagacccaucagguccucucgcacugugaacuccucuuggaaggcugcugccagcugcuuacuugucugaaaggaaaaaggcacugugagacccuggaggugaaaucucagaacacauggcccggaugccucaucguuuaaaugugugaagaaaacuccuaugaaagaaaaccagaaccaccugcaguuugccuagccacugaaacuuccauggaaaccgcaggcaccuuuaaaugccagggcuugugagcagugaggacuguaaugagggcaguuugaacuagaagccaccaaaguucuagauuugguuccaacacuaacugauccuuaccaagacacacacugugccuuugaucuauccucugacaagugcuuacagcugaccugcuuaaucucaaaguaguacaaaugguauuccucuuuugagcccuucccacucucaggaguucucuuuuuauuaauaaauccaugcuuauucugcuuaaaaaaaaaagaagacgagcaggcggguuagacaggcugacagaaagugguuauguacaugcauguuuuccugcaugagugaaugugcaccauguucaagagcuacaugcuccaggcucaacagagggacacuugcuuuguaagcaacagacccugugcuccauccuguguacagaagggggaaagacaacuugugggcugggagaguaguucagcagguagagugcuugcucagcacgcaggaagcucuggguuagaccuucggucauacaaaaaaacagauuuggcggccacaccugcaaucccagcaccagaaagauggagggaggcaaaaggaucaaaaacuaaaugucacuuuuggcuacauaaaaaguuugggggggggccggugagauggcucagugguuaagagcgccgacuacucuuccaaagguccugaguucaaaucccagcaaccacauuguggcucacaacuaucuguaacgaaucugaugcucucuucuggagugucugaagacagguacaguacacuuacauauaauaaacaaauaaauaaauauuuaaaaaaaaaaaguuugaaguuugggcuggagagauggcucagcaguuaagaacacuaacuauucuuccagagguccugaguucaauucccugcaaccacaugauggcuuacaaccaucuauaaugggaucugaugcccucuucugguuugucugaggacaguuacaguguacucauguaaauaaucuuuaaaaaauaaaauaaauaaaagguuugaaguucgaagccagucuaggauaucuuaaaacaaaaccaaaaaaccaggcaguggugguacaugccuuugaauccagcauuugggaggcugaggcaguuggauuggaguuccaggacaaccaggacuacacaaagauacccugucucaaaccaaaccaacccaaaacacccuuacuuaagaaaauaaaaugagggcuagugagauggcucaguggguaagagcacccgacugcucuuccgaaggucugaaguucaaauuccagcaaccacaugguggcucacaaccauccguaacgagaucugacucccucuucuggagggucugaagacagcuacaguguacuuacauguaauaaauaaauaaauaaaucuuaaaaaaaaauaaaauaaaauaaaauaaaaugauuaaaaaccaaacaacaagcagagcacagccaggcaaggugguccacaccugccauccuaguguuugagaugcagaggcaggcaaccccuuugaguuugaggcuauccuggugugaugguguguauaugcuuggccuagggaguggcacuauuagaagguguggcccugguugaggaggugugccacugugagaaugggcuuuacuacccucauccuagcugccuggaagccaggacugugcuagcagccuucagaugaagacguagaacucucagcuccuccuccaccaugccagccuggaugccaccauuuccagccuugauaauggacugaaccucugaacauguaagccagccccaauuaaaugcuguccuuauaagagucgccuuagcgcaugccuuuaaucccugcacuuggcaggcagaggcagguggauuucugagugaguuccaggacagccaggauuacacagagaaacccugucucgaaaaaccaaaaagacagacguaguagguaccagggacugggguauagcgguaauaggccuuguuuaucagaauguggauuuggggacuuuggauuuggaaagcaauacaaggcuuuaaacagggcuuacugggcucucguaguagaaucucguaguagaauaagaagacuuuuauuacggagauugaucugaacugugccgaccuaacucaagagguuucaguggacaauuuccauguguggccuagagagugguuuugugguauuuuguuaaagaaugugcauacuuuuugacguugucugcuugaggcuaaggugcaagacucagauuaauugcauuaacaaaggaggucucagaaacaaacucccaucauagacuuuguucucuaguuaagcuucaugauaaccauuuuaaacaaguguaacaagccgagaaaggaaaaauauaaaauauaugguucaaguauuaaaggggcaccagaaagugaaaugaaacugaauccuguguucucagauauugaguuaagggaguggugaccuuggggcaagaucccacccuucuaaauuuagguucaggcacggugguacaugccuuuaaucccaggagaucugaguccaauguccaucuacagagcaaguuccaggauagccaaacuagacagugaaguuguuagaaaacagaaagccagugaugauguaauagaacaagugggccauguuccagccccagcaaacagcagaacuuaggcagcuucggcuauauauaucuggcuuuauagucaaaaguaauagacuacugugucaauugaugcuggugaucuggcgcugagaaauuagugguggccgggcagugguggcgaacgccuuuaaucccagcacuugggaggcagaggcaggcggauuucugaguucaaggccagccuggucuacagagggaguucaggacagccagggcuacaaccaaaaaaccaaccccccacccccaaaaagaaagaaauugguguugauuaaagaagaggccagcaucacugaggugaggugaaagcuucugguaaguguuuucugagagcacaaagaagcuguguuccagagcuagccaagguuguaccuugugcugcagcuguacuucauaauguguaagagucacccaggugguacugguuuugaaggcaugaagaggucaugacgagcagcugaggcuuggcacugagaaaggccauagaaggccauuggugaaggugcagccuccguugcagcugacagaccagaacugaaggggucauggcaccaugaagagaaccaaugagaggacuagcugcaguggaagacuucagcauauuggggaugccagugccaugggaugaucaccaagagcagcaguagcgggcuggagauggcuuagggguuaagagcacuuucugcucauccagagguccugaguucaauucccagcaaccacaugguggcucauaaccaucuauagugugaucugaugcccuauucuggcaugagguguguacaugcaaauagaacacuuauacauaaauuaaaaaaaaaaaaaaaaaaaagccaggcgugguggcacacaccuuuaaucccagcacuggggaggcagaggcaggcagauuucugaguucaaggccagccuggucuacaaagugaguuccaagaaagccagggcuauacagaaaaacccugucucgaaaaacccauaaauaaaugaaugaaugaaugaaugaaugaauggaguuggagaucugaagaccacacugacaucaaacauggagauccaauguggaguuugccuagcuuauuuucugccuugcuuuggaaauuacaguuaagugacugaaugaauuuuagaagaaacuuugaacacuguugagacuaaauguauguuuuuuuaugcuauguguagguauguuccccuaaagacucauguguuuauggggccagggagugaaaugugauggucuguauauacuuggcccagggaguggcacuauuaggaaguauauccuugguuggaauaggucuuucaaacucucuuucuagcugucuagaaaaagccagucuucugaugaaaauguagaacucucagcuccuccugcaccacacuugccuggaugccaccauguuccagccuugaugauaauggacuaaccagugccagccccaguuaaauguccuuauaagaguugccuuggucauggugucugcucacagcaguaaaacccuaagaauuccaggccagaagaccagugaggcccuguucaaaacaacacugcugggcagugguggugcaugccaucaaucccagcacuccagggucagcgaucuguggauuucuuguugaguucuaggacagacaaggguauacagagaacccugucucaaaaaacuaaaacaaacaaaacaaaaccaaaccuuuuuuuuuuuuauuuuucaagacaggguuucucuguauagcccuggcuguccugguacucacucugcagaccaggcuggccucgaacucagaaauccgccugccucugccucccaagugcugagauuaaaggcgugugccaccacgcccggcgaaaccaagccuuuuaaauccauaccaaaccacaauagaauacuguccucugaggaugauaaaauaaauuagccacacaggacuaaugaccuaguagccuuuucuauguguuucagacacaaaagaaaacuagaaaggaaaggccguuguuauucagggugagaaacagcagucagaacuuaccucuaggugcuuaguagcuucuucauugcgggacaugagcagcaauuuggugcgaaggcuucggaaaugcauaucacccaacaaagaugcccucuucacaggggcuucugugguugacuggggaaugaugaacaagaaguauaaaagcaaaauauaugggcagagacaaguggcucagagguuaagagaacugacugcucugacagaggagcuagguucaauucccagaaccuacauggcaguucacacuugucuguaauuccaguuccaggagaucugacacccucacauagaugcacaugcaggcaaaccagcaauacacauaaaguaaaaauaacuuuuuaaagcaaaauacacaccauggaagcauuagagacuuggcauuagaaugccaguuccugaaaaagggcaggaauaaugaaaggaaguuggcuuuuuguuuguuuuucaagacaggguuucucuguguagcuguggcuguccuggaacucacucuguagaccaggcuggccuugaacucacagagauccgccugccucugccugcuuccugaguguugggauuaaaggcgugcaccaucaccaccuggcaagaaaugaaguuuaaaauaaggugguagcaugggcuggagagacggcucagcaguuaagagcacugacugcucuuccagagguccugaguucaauucccagcaaccacaugguggcucacaaccaucuguaaugagaucuaguaaccucuuuggaccugugggguacacgcaggcagaaugcuguauacauuuuuaaaaggaaaaaaaagaaaggaaggaaggaagguagguggcagcacaugccuaucucaaaacuagggacuguaaagcaggaaacugucacagagucagggcagcuucugcuaagugaauaccaggccagccaagaggaaacagaaaagaaauaagguaggcuacaugaaaacuacugucagucacauagcagcugaauagcuaaauacugauaggagucauaugacaauaaggagcaagaagagagauauacauuuguuucauuuucaaauauuuauagcagguagagagguaguggcacaagccuuuaaucccagaacucaggaggcagaggcagguggauuucugaguucgaggccagccuggucuacagcagacagucucaaaaaaaaaaaaaaaaaaaaaaaaaaaaaaacccacguauuuauuuauguacaucucucugugugugaacauguuauaugaacauaggugcauagaccaaaagagggugucaggugcccuggaacuggaguuauuggugguugugagauacacggagaagggagagacaggaacccccagagcuggcuggcuagccaaaguuggcuagcucuggguuaggugaagauaagccgccuuguaaaguguaucaugauuaagagauaucggauaccaacacuuaaggguuuccaacccagacgugcaccuauauacaugcaaauauauacacacacagauccaaauauauccaagggcugggguacaacagcuaaauggcaaggcacuugucuagagcacauaggugugugaaaaucaugguuuaauuucuagcauaggaaaaaaagaagagaaggaauaaauuaaagucauacauaaggacaauuaaggaaaggaaaggcuaccugguccagaaguaucagaaggaauaaaguaagcaugaacauagucgagcaugagcaaaagccauauauccacuuuucuaaaaguuuaagcaguaaaaaaggaaaaacuguugaguaggcuuguuaaauucaagcaugaaacucaccagaauaaagagcucacuguuugugauguugagaaagaugcaguuggcucccagugcuuucuugaacuccuuauggacauuuucauuggagcagcugcagaaaaaaguaacaugcucaggaaagggggcacaagaagcccgggaacaagcggggaggagaaaaccagagagguagaaccccugcuaaaaaaacagggcuuaagaaaaucauuuuguaaaauaauuacagcaaggcacaguggcacacgguuuuagucccagcacuuggaggcacaggcaggaggagcucugugacugcaaagcaagucugguuuacaguuuuaggucaaccauagcuguguagugaggccaucucaaaaccaacaaaacacagacagacaggaaaagagagagugaacgaugaaaaaugggaggguuaugggcauagcauguaaaaagguccucacaggccagaggaugaacagggcagagugaagaguggaagaccuggagaaacgaggacagagcuggcacuguggaagucucuaauccccaaccucuccaacacuuacgccucccugagguccucaggcacagccaugguaaccuugaagaagcugccuuugguugcaaggggacugggauugacuggccgaagucguuccagagugacaaucucauuguagguagcaucacaggcagcguacucaaugacauagaacuggcagaaaagagaaagaauguauauuaccuuuucaggaacaaaagaacagucucaggaauuccccaaagggcuucagucacucacaucucccuucaucauccgcacccgggccagccaccagccacaagguuccuguucauuggcucucgaauagaccugaaagaggagaaauaaagagaaauggcauugaagacuauccaaaaauaucaagaauuggagaaagcauccaaauacccaagcauucguaaacccacaagaggaaacaaggagauaccaacucaaaguauggggucccugaguuuuauuuauuucacuuuuuuuuugcucagugggcaagaguucuccaagcccaacgaccugaguucaagucccagagcucacaggucaugaccaccacuccuaagcuguggaacacucaugccccucaaacacacacacacacacacacacacuacuucacacuaaggaaaaaagauaaagagauggaggucuugagcuggagagauggcucagagguuaagagcacugacugcucuuccaaagguccugaguucaguucccagcaaccacauggugguucacaaccaucuguaaugggaucugaugcccuuuucuggugugucugaagacagugacacuguacucacauacauaaauaaaucuuaaaagagagaaagagagagauggaagucucacuauauugaccagaacaaucaaaaacucuugggcuuaagugagucuccucccucagccuccaaguacugaaacugggguugcagauacauuucagugguagaaugcgugccuuacaugcccaaggccuggguuucaauccccaggaaccaaaccccccaccccuuguacacacacguacauauauauuggaacuguaggaguuaggcuuuaagugcauuugugacaaaugaagaagcagauccuuuaaagcuggugcccccaggucacagccacgauagaaaggcacugcuacauuacucacugacuacauggcuagacacgguggcucagaaaaggaaagaacacaaucaguaaguaaaaaaccaagguuccuaauaaagcaaacauuggaaagguggaccucacaguccuuaccucuacuucaucuccuucugugauuuccuuauuguagucagcuggaggcgguagucggacauccccaaagggaaucugucucucacucugccagcuauaggacaaacagugacaugaaagcuauucagauugauguuauuguccaccucuucacaaggggguuacucccuuagaccacuuuuuuuuuuuuccauuuuuuuccuguuuuuuuucuuuuuuuuugguuuucugagacaggguuucucuguguagcucuggcuguccuggaacucacucuguagaccaggcuggccucaaacucagaaauccgccugacucugccucccaauugcugggauuaaaggcaugcgccaccacugcucugcuucuuucuguuuuuuaauuagauguuuucuuucuuuauuugauguuaucuccuuuccuaguuuccccuccaaaaauccucuauccccaccccacccccagccagaccacuuuuauucuuccugguaaagagucaaaacaccaagccgggcaugguggcgcacgccuuuaaucccaguacucgggaggcagaggcaggcagauuucugaguucgaggccagccuggucuacagagugaguuccaggacagccaggauuacacagagaaacccugucucgagaaaaaaaaaaaaaaaaagucaaaacaccagauccuguuccauaguggucuuuuauccuugcuaccaacuaucaagugaccaaaacuugcaccaagcuaucugcucuucuuuucuuagaauuuccaucuaaacccucagcucucugccaucuauuacaggccucacagaccucagcagucucuccucucacccuccuuuagggccuagugauauugagcuugucuauucccaaggucuuacuuguucucaaagaagauagugacagagucuucauggacauccuuuacaaagcccuagggagaaaauguaaaaaacauaaaugaaaauacauuuuaccaccaccuuagccaucagguaagaaauaucagaaaccuuuaaaauuaagaguuuuagcuggagaugugagcagaguaaacaucgccagaaagacugugaugggaaagaauauaaagaaugagaaaagaaaugauacugagagaaucuagaaaacguggacgaggcacaaaguaaaaccugcccaggaacagcccagaagcugcucaucuacucagggccuguuaccucccuaccugccugcucccagagagcuaagcagcuugcccgaguucaauuaaaucacuagcaacuuucagcaaggccaauaauaucccauaagacagugaacgacugcacuagaacaucuagaagauaucagagcugccaagagggagaagggucugauccccagagacugaguacuuaaagaauagaacacacuggagaaguucaaaagaaacagcaguuuauaaaaggaaaaaaaaaaacaacuacaauuuaaaagaugucauaguucugaauggacagaaauaacuacugaaucuaaaaauaaaauaugcaaagccaccaaucuugagaucaugacaauaggaaucauuaaauaaucuauuuuauuuucucuuuccuaagaaggucuaaacuguacauucaaccuacagucucaauuguucuuucuuguuuuguuuuguuuucccuucaguuuuuugaaacaggguuucucuguguagcccuagcuguccuggaacucaguccguagaccaggcuggccucgaacucagaaaucugccugccucugccuccugagugcugggauuaaaggugugcgccaccaugcccggcuguucuuucuuguuuugauaaagucuaauucauuacuauuauuacuacuauuacuauuauuuuacaaaguaugaucucauuucaugguuaagaaacuucuggaauucaaagccacaaguuuucuccuaugucuucuagaaauuuuguuagucguuuuuuaguauuuauuuauucauucacauucauuugugcagugauguuuugcccacauguaugugguugaggguguuagaccuuggaguuacagacaauugugagcuaucauguggguacuggaaacugaaccuggguccucuggaaaggcagucgaugcuaagccaucucuucagccucauucucuguuuuaaacuacacauuaugggggcuggugagauggcucagcaguuaagagcacugacugcucuuccaaagauacugaguucaaaucccagcaaccacaugguggcucacaaccaucccuaacgagaucugaugcccucuucuguagcugucugaagacaguuacaguguaccuaaauauaauaaauaaaucuuaaaaaaaaaaaaaaaacaacuacacauuguauacguguuaugugugugugaacacaugcauguuuuccccacaacguguguggaugucagaggacaaccuaucgaaguaggcucucuuccaccaugugggucuugggaucaaacucaggucuacaggauuggcagcagauaccuuuuacccauugagccaucucccugucccaagauuuuuauuuuacauuuagguauguuacagauuuucuuuuagagacagaaacucacaugaagcagagccuuucugauuuuccuguuucuaucgugcgagcauuguugugaucaccacuacacccuguuuaucuggugcugacgguguuuuaugcaucuuuaccaacuguacuacacucuuagucccacaguugcuuuugauuaguaaacauuaguuuguauuugcguuuuuugauagaaguggagacaguuuagagagcuguuagucccaggagcugagaaguaggagcaagugaaucuuuuuaaauucacgaccagccuggucuauaucacaaguucaggcuacccagaaauauauagacagugucucauagauagguggauggauagaaagaaauaauaaguugccagauagacagagauagagaaggaaggaagauagauaagaaggaaggaagaaaggaaaaauaauagcugccagguggugguuuuuuuaaucccaacacgcagaggcaggcagaucucuaaccaagccagcauggucuacagagugaguuccaggacagccagggcuacagagaaacccuauucuggaagaaaaaaaaaaaaaaaaaaaaaaaaacacuagauagauuagauaagggggguuuggcuagaauauaguuccgugugaugugugccuagcaaguauaaagcccugauuucaauccucaacaucaaaagcaguaagaaagccagaugcuucaaaaaaaaggcuaacaauauucaaggaccagcccuaaguacaguaacuaggauaguggcagagcuuaggagaaaauguaccaauaauauucuagagaauacagaguucccaccucacagaccuggccagucaccacuuacaaaacuauucuuuccuuauaaugagaacaucuaacccugaauauugcuucagauacgaccugcuuuggcuguuuggggggagccugaggcaggagggucuaagaauuggaggucagcuuaggcuacgugcuaaguuucagaguaaccugagcuaucaaaguauaaaaauccugucucuauauggggagaaauguuuuuaaaaaugaaagaagggaggaagggaaagggaaaggaagaaagaaggaagagaucggaggagggcuaccuggcugaggauguacuucaguggaaggcuaagaugagaccucaaguucaagguuagccuuaucaacaaagcaaggcuauacaauaagaccccaucuuaacagguuggugguggccuaaaccuuccaaggccagccuagccuacagagugaguuccagggcaacacaggauauccugccccccaccccaaaaaaaaacaacaaaagacagaggcaggcggguuucugaguuugaggcuagccuggucuacagaaugaguuacaggacagccagggcuacacagaaaaaccuuguuucaaaaaacaaacaaaaacaaaacaaaacacauuaugaagcugggguugauggugugcaccuguaaucccaggucuuaggaaaggccacaguaaaccaggaguccaaggucaucccggguuaaaagcccaagccaccugaaaccaccuuaacaaaacacaucacauccugacagaaaagccaaguuugauaggauaauucuaaaauaacuuagaccucagaucugauauuuacuggcucuagaaaaaucacaguaaaacaguuuugugagaggagaaaagaaucuccccaaacguaaaagaucuaaaaaguuaguaucccuuacucacaccaaaguuugcugagucauaaauauuaaucagcaagguuugaauagguaaguaucuacauuacacuuaggcaaugucuuuaacucagucauggagcagaaagugcugaaguggccagaauacaaaaucuacacucaauauuuggcuuuuauuaacucuauacuaucaaagaauccugucccugcuucccucaaaucuaucacugcucuggcccacagaauaaaaggauaaaagagagacuuucuguuggauacccauauguguaacagaauucaugucccagcccaaccaugucauacaguuaauuggaacugagcacucaucugucccagcugugcauggcuccugagcuuccuuaaaccaaaugcaaauaucuuaucuugaucucauacucaauuuaagaaccacuuuucaaacuaagaguaguuguggaugcuuuuaaucccagcacucaacaaaggcagaccuaucccacagaguuugaguucagggcagccacggcuacauagagaaauccuguacccagaaaucgaacggggguggguguguguguagguguguguguguguauguauguauauacacacacacaccuacacacagcuuuuuuggaauuuuuaacauuuugauguuagaaggauacagaugaagacuaacauaucgaggaaaagagagcauaauaaagaguacuuuuuggguuuguuuggguuguuuuagacuggauuccauuccccaugcugguuuugaacuucaacaauccuacuuuagccuucuaaguacuaggguuagaguauguaccaccauacccagccugaggagacuguuuuaacaaagguaauacaaaugugggugaaauagauauuaaaacauuaauguguccucucagaagccaaaagaauuaaagacuuuugcuacagaaaacagaaauguuagagacacuguucuggucugaagaaaaaguaccaagaguuaggaaagugacagaaucagcuaggagccuucuucagcuauacacagacuagacagguagacaucaucaaggauacacaggaauacagaaauaccaagcuaaaaagaccgagacuuaguugagaagcugcauuaaagcuaauagguaugugcacccauaggcacuggguaaagaacuugaucagaaaagggaaaaaaauggccuggccuuuauaauggauaacuagcauaucaguugaagugaggguaggaaccaucuacagggguagggcaaaccuaagucuuuuuucagcuacaaaaaagauacaauuucauaguagagucagagaaaguuauuuccaagggcauaagaaaguagaaguucuacuaggguagggggacagacaaccugaggaaaccugaagaaaaaggggcucuucucacccaucucaugcuauggaaauuccucuuucucuccaggaugaagaguaagagagggaccaaacguguccgggacaauuccacucauaaaagucaaaagauguucagaaccccacugaucagaagaagaaaauaucuggggcgugggauccagaauagacucaggacagauacagaagauggggugggugguggauagaaagaaggaaaaaacaaaagucuggucuggcaugguggcucaaccaguaacgccagagcuguaauccuaggcugaggaagaguucaagugcagccagggaggggaucuugucccaaccacaccccuuaaaaaaguucacaggaaucaaaucuuaggcaaagaaaaagcugauuaaagaagcaauucugaaagauacuuuuuuucuuuccagaaggauugucaacaagcagaaaucuguuagaauaagaacuuguugagauggccuuugagagacagugaagcuuaaacuuaccaagaagauagaggaaugaccuaaauauaucuagagucaaagagauaagcgugaauccaucccucauaggugauuuuggaauauagguguggugggugacaaacuuguccaacaaauccacuuuauggcuggcugauaaaaaccugaggccaaagaugcuaaugcuaaauaacacagauggguuuugaccauuucuugucagccugggaacaggaauuuaagaccaaaaguugagcaaauggucuagagccaguaggcagaaggcucccugaagaccuaaugugggacaguggaccuucccaagggggucauguaggaaaagaaugcgaauccuccaugugcuugggcugcaggggugaugugauuaaaagcugaaguaucgccuacacuaaaaaaaaaaaaaaaaaaaaaaaaaaaaaaaaaaaaaaaaaacaagaaaagucgauuagaagcuaggaaaagggcuuucuccaaagggacccggggcucccauccccgcacaggaaugaccugauggccauguuuucagcugauaaaagcagguguaacagcgagcucaaaauaaaagcacgaggguuaacucccacgaucgccacgggaggguuucgagugggaacgugggucgaagguucuaagggucaagaccaagcuccagaaacucgaucccgcuccacucuucccugccucggcugggggagggggcuaaggaggguggcccgggucgacgcgccgucucaccuuguagaaggccccguuggagccccgcaccucgacgggcagucccggcuccacaucccccccagaggccaggccgcccauggcgccgccaccaccuccgacuggcccggcagcagcugaaacagagcccugagugcgggccgggccggguccccggcgucucccuggaggaggagccggagggggagccgcggggggcgggagccgggccggccccacggcggcccugcuacagccgacgagcagggggccggggccgggccgcuccccguccgccgccgccgccgcugccuuggucuccgccaccgugagggaaacggccgccgccgccgccgccgccuucgucaccucagcuuccgcccgccggcgcccccgcugcugccucggucccgggacccgccgcugccgcuccacggccuccaccucccccugcugccgccgccu

SEQ ID NO: 6109 - RNA, 1694 nt, Mus musculus
agacuccgaaacaugguuuuaauuguacaaaauuguguuuagugugcauucugguuccuuggagaucuguaggggucugugggguuggcccugggcgucccugccaguuaaagguggguuacuggcaugggggcuccagcaagggaaguauuauauggaguggaagagucuggggauagguaaggggagaaagagggucuuagcucccccuggagccugggaucacucugagggaaggugcaugguaagggggccuccggucugcagugggaagagcuguaaaaagaaacauggggucuggagguuagucuucuugaaucgauugggcaguguccucaacucuucgugggggacuggucugaccaguuugcagcagacaggguuagagcuugccauucagccagccuugcuggguacagcaggcauggaaugggacccuagggugacuuaaagaacaagguaguucuguuggggcaugcucagcaggcggcuugcgugcugcacggcuguuugccuccuggggcagcaggccaggaaggagcaacaggaugggcuuggucucuccuugcccccagggcugggagaggaagaugggucacacaagggccagccacaaggagaaacugccauccaaaaggcagagguaggacacauuaguugagauggaacagccacuauccugaacucugggcccucagccugguguagcuucugcuuggguggauuuggguuuaacuuggcacucuggccucuguucccacccagcucucaaggaagggggucgugugggaagcauggaacagacagauggacacaauuaggcacucacguguaacugccaggcagguaggcugucgaauaguuggggggcugguacccaaagccucugcucccuuggguaguuguguacccuggcccccagugugagccaccacaugccaggccaccuccuucuuggcuaaaggggacagacccggugcucgaguuuuugcucuuacgccggggucgguacuuguagucgggauagucgcggagguggcgggcacgaagacgcuuagccuccuccacgaagggucgcuucucuucaucgcccagcagcuuccacugagcgcccaagcgcuuggagaucucagaguugugcaucuugggguucugcugcgccaucuggcggcgcugaacagagcuccacaccaugaaggcguucaugggccgcuucaccuucuccagcggaagucccccagacgcuccagggcucccgccggccuccugcuccugggguccuaaaggcaaagaggccguggaagcccgaggaugcaggcuccaagucucugcuugugaggagcuggucagcgccauggguuggaggugaagccucuuugagagggcgucuugaaugcccuucucccagagcgaagacuggacuaggaauauuuggguacuuaaguaucuuccagagcgcuugaauccaaacuuugcucccagcgaucgauugucaccucugggaagcugaauuuagaauccuugucuggagcccuuuaccggagagguaguguucucucaggucuaccagucgcucuuucuacccucugcuucagcgagacaggguucuucuguugaaacugcaguuucaagcgugcagcucuuggucuccacaaagucccaacagcugccaggagugcacccaggugcuacag

SEQ ID NO: 6110 - RNA, 6199 nt, Mus musculus
cggggugugcgcggcgcgcaugcgcggcgcggauaaauggcggggguugucccgccuggcggaagcuuagcuuuccaacauggcgggggaggccgacgggccguucaaagggcugcuggugccaauucuuuuaccugagaaauguuacgaccagcucuucgugcaaugggacuugcuucauggugaguuuuauuucagccuucaaggucuagcuggagcagccuugaaccguaaguuggcgugacaguggcgauuaaugucaccgcgaagcugggcagaaggcgguucugacgagggcggaaguguuuggggcccugcauaggaaaagugccauauuugggcaugaaggggugucucccgaaaaaaaguuaaauuuguguuuuacaaucucggaagucuguacccaacccucaucccuuucugggcugggagucgaacucagggcggcaugugcuacucugcuaaccaggcucuagccccaggcuggaaaacucggagcuuuuuugucguacccccccccccccccccgacaggguauagcucuggcugaccuggaacucgcucuguagaccaggcuggccucgaacucagaaauccaccugacucugucucccaaaugcugggauuaaaggugugugccaccaauccucggcggaaaacucguauuuuauaaaacaaaauuaaaaccccagccaggcauguaggccuccuuucgccccaagcacucaacugacagaggcucacaaauuuuuuuuuuuauccccucucuccagcaccagcuucuggaauuuacuauguggcacagacugcccuugaacuggcaacaguccuccugccucagucacuagaguguugggaguauagcacuuuuccuuuccuuuuucuuuacaaaggccuuugauaagccuucuccaucucucuauucuaagugacuuuuggcuuacaauagucaagacgccuuccugggccaaaugcccaccaggucaaagauucagugguagagagauugccaggaucaggguuuuguaggcagcagcucagcucacucgcugcaaucuauugaaaaucagcccuggacacaggguuugaaagaaaaauguuuuuuaaaaaaaauuagagaaauugccaggaacuguggcccacaccuuuaaucccagcccuugggagggacccagaggcgggaguucaaggacagccuaggcaacuggaugaguuccaauacaaccagggcuggcuacacagagcagccuugucuggaaaaaccaagauaagaaguaaaugauaggggcuggagagauggcucagugguuaagagcacugacugcucucccagagguucugaguuuaauucccagcaaccacaugguggccuacaaccaucuguaaugggauccaaugcccucuucuggugugucugaagauagauagcuacaauguacucacacacauaaaguaaauaaauaaauaaaucuuuaaaaaaaagaaguaaaugauagagauaguggaagaacaaggauaaauguccuggaagaguggggacaaccugaagguucaggaauguaugaaugugggaaugggguggggggggagagaaaagagucagggaacgccugugggacuggagggguggcuugcaaggcuggcaaccuggguacaauucccggaacccacagaaaggcaaaaagggagaacuggcuccucaaagucucugaccugaacacaugcaccuaugugcucacacacaaaauaggguuguuuuauuuuuuauuuauuuuuuaauauuuauuuauuauuauacauaaguacaccguagcugacuucagacacaccaaaagagggcgucagaucucauuaugggugguugugagccaccaugugguugcugggauuugaacucaggaccuucagaagagcagucagcucucuuacccacuaagccaucucgccagccaggguuguuuugaaauguagauuuuuuuuuuuuaugugugucuuuucacuuguauauguguguguauauguauacuauacaugacugcaagggccugaagaugccacuggagcuggagcuacgggcauuugugagucacuggagaaggaugcuaaaaauugaauucagaucuucucugcaagagcagagaugugcucuuaaccacuaagucaucuuuccagucccaaauguuuaaaauguauuucuguugugguauucccuuauauacacucaggucaacagaguuggcagcagagccaucuuguuggccuaaugauuucuuuaaagauuuauuuuuguuuuauguacacugguguuuugccugaauguauguaugaaugagggugucagaucuccucgaaauagaguuaagaguugugaacuccaugugggugucaggaauuaaacccagguccucuggaagaacagucaguacucguaaacacugagccauaucuccagccuuuuuaauaguuucucuauaucacccuggcuggccugaacucacuauguagaccaggcuggcuuugaacucacauagcuguccuucgaucccaagugcuaagauuaaauguuuuugccaccacaccugacaauaguuuuuaaguauuugagauagggucucacuguguaauucuggcuggcuuugaacucagagaugauuaaauaagacuaaaagccugaacuacaacacacaucccuuaugacuuuuuaaauuuuuuuucagccaggcgugguggcacacgccuuuaaucccagcacucgggaggcagaggcaggcggauuucugaguucgaggccagccuggucuacaaagugaguuccaggacagccagggcuagagaaacccugucucgaaaaacaaaaaaaaaaaacagaaacaaaaacaaaaaaagauuucauuuuuaauuaauuuauuauguguaaauacauuguagcagucuucagacaucccagaagaggacaucagaucucauuaaagaugguugugagccaucaugugguugcuaggauuugaacucaugaccuuuggaagagcaguuggugcucuuaaccucugagccaucucuccauuuuuaaaagacauacuuucuuagugcuuuuuuuuuuuuuuugacaggguuucuguguagcccuggcuguccuggaacucacucuguagaaccaggcugaccucgagaacucagagaacucagaaauccgccugccucugccucccgagugcgucaccacgcccggccuuagugcauuuuuguuaguacaguuuauuaggggggccaugcauggaaguucuggaguuguuucuguccgucuaccacguggcuccuggguuaaugagggauaaaaguuagcuuuuuaguuacacaggcauugcuuaagaauucccugacccuacucuccucaggaacuggauggccuacuucaaaugcuccuccuuccaaagacaagugcccacaccauacauuucagaaccuucugguuauccugguccuucugaaggggacaacccuacucuuugcagcccucaaaacuauuuuagacguguauuuauagggaauggaagggggacaggaaggaagaagcuguugugacagcacacccagucugaauagaagaugucuguagcaaggauguuugcccugucaucccuaccacccccagagacuuacuggugugguaggugugguggucacgggugagggagagggcaacagcuccuaggagcacuucaaacccucaccugggcgccagaggccucucugcugacugcucucucuucucaguucccugccucaagauucuccucagcaaaggccucgggcugggcaucguggcugggucacuucucgguacguacagcuccuuccugcuguuggaguaaagggaagggaggugagaggcugaggaugccaaggcuggggauagagugcccuuuccucagcccugcugcuuuguccacagucaagcugccccagguauuuaaacucuugggagccaagagugcagaaggacugagucuccagucaguaaugcuggagcuaguggcacugaccggaaccguggucuacagcaucaccaacaacuuccccuucaggugagugaggguccacucuucacgcccaaagccaaauccccaagauucucuuuggguuuuucaagacaggguuucucuguguggcccuggccguccuggaacucacucuguagaccaggcuggccucaaacucagaaauccgccugccucugccucccaacugcugggauuaaaggcaugugccaccaccgcccagccccacaauucuuuucuuuucaguuuguuuauuugaggugggaggggucacggaacaacuuguaggaguugguucucuccuugcaguguguggauccuggggcuggaacguaggcaaucagacucagaggcaaacauccuuacuugcugagcuauucuggccccagcaccugcaguucuaauaaguaaauauggggauggagcgagccuucccugcgugagccaggcauggugggaguggcagacugaaaagcacaggcucaucccagagcugagccggacggggcauggaggcuuccccugccuuuuuccaggccugccuuuuuccucccaccccuugacucugcagcucuuggggugaagcgcuguuccugacacuccagaccguugccaucugcuuccuggucaugcacuacagaggagagaccgugaaaggugccggggacuggcuggagagcaggcauuguguaugggaacuuugguggggacucaggcucaagaggacuccuugucucccugacccccaggagucgcuuuccuugccugcuaugccaugguccugcuggcgcugcucuccccgcucacgccucuggcuguagucacucugcuccaggccuccaauguaccugccguggugguggggaagguggguacucuggggaaguaggaagcaaagggacgugagaguguguguguguguguguguguacgcgcgcgagcuaguguaaggcagaggaggaccuccaacuauggagugcuagugugcagggcgugaggaauagugacgggucacggagaagggucagaugagagaaccaaaaguaucaaugucuccucuaguugcuucaggcagccacuaacuaccgcaacggacacacaggccagcuuucagccauuacaguguuuaugcuguuugggggcuccuuggcccgaaucuucacuucuguucaggugagugcaccuucugcccacuagagggcacuaaaaccucauucucugcugagucuuggaacuuuucuagaucugugcucucucauaacaggaaacuggagacccccucauggcuggagucuuuguggucucuucucucugcaauggccucauugcugcccagguccucuucuacuggaacgcaaaggcuccccacaaacagaaaaaggagcaauagagcugagcucgcuucuagaacaauuccauuuccacucauccucagaguccuccccacaugacuugaucugcgggugcaguguaagcacccuccauuccucuaacugcagccuccugagccaggguugugggagcaguaaagcuuguguaggcccugccuucacucacucacuuccccagaucccuccuugugagcagcugguuuacuggagcagaugcucuggcccuguccacuuaccuuccuuuuggaccaaggacagagccuagaaaacugugguuggaagcuaguggcugcuucccugugcugcccgggugggauggucuauuggagcccaguucugggggugagggagagugacucagauaagggcccugggguuggguggggagguuccugccgaggcagguccuggcggaagggugugugaaggcgcugguugcugcuguagggagagaauacaaaugggacaauaaaagacuccgaaacaugguuuuaauuguacaaaauuguguuuagugugcauucugguuccuuggagaucuguaggggucugugggguuggcccugggcgucccugccaguuaaagguggguuacuggcaugggggcuccagcaagggaaguauuauauggaguggaagagucuggggauagguaaggggagaaagagggucuuagcucccccuggagccugggaucacucugagggaaggugcaugguaagggggccuccggucugcagugggaagagc

SEQ ID NO: 6111 - RNA, 1960 nt, Mus musculus
auuuuaguuaagggaagugaggcuuuucauuuccucuuccaagagaaggcaaaggggauuggauugaggaaggaacugguguagccuagcuggucugagcaucucugccaugcggcucccugugugucugaucuugcuaggaccgcuuauagguaaggagaaaugggaggugggggagggagggcucaugggcaggagccugcaccuggguggccaaccaaucucuuacugaaagcccaaggaacagaggaagacuguccucacaaaaaggccguuacucuccugccauccuucacgaugacaccuacagccacagaaagcacagccagcccuacgaccagccacaggcccaccaccaccagucacggaaaugucacaguucacaccagcuccggacccacaacugucacucauaacccugccaccaccaccagucaugggaaugccacaauuucucaugccacaguuucucccaccacaaauggcacugcuacuaguccaagauccuccacuguuggcccucacccuggaccaccuccacccucgccuaguccaagguccaagggggcucuugggaacuacacgugggccaacggcucccagccuuguguucagcuccaagcccaaauucaaauccgaauccuauacccaauucaggguggaagaaagguaaagcuaaaguggggcuuaaagagggcaagaggcaaguccugggcucguucagcagggaagaggaagagaagaggaggggauaaacuggauggagcauucuugugauuucagacccaccauugcacuucuacaggcuuggggcauaucuguuuugaaucccaacaaaaccaagguccagggagguugugacgguacccauccccaccugucucucucauuuccuuauggacagcuuaccuuuggauucaaacagguauacagcuugaguuugucucuauccucuauucuuccauaucccauaccuguacccccggagccucuguucuugcucuguggacauggaugccucugucccugaugccuugagucuuucuguucaccuuaaggaccuacaucagagcccgaguacagucuaccuggacuacauggcgguggaauacaauguguccuucccacaggcagcacgugaguaaucucuucuccuuaccacacuaaaagucuaggcugggcgugcugggcugguggggaggacucaggagucaggacuggauuugacucuuaauuacuaauuacugcagaguggacauucauggcgcagaauucaucucuucgagagcuccaagcucccuugggccaaagcuucugcuguggaaaugcaagcauaguucuuucuccagcuguucaccuugaccugcucucucuaaggcuacaggcugcucagcugccugacaagggacacuucgggccauguaagcccuaccuacuucuucuuuccuagagcucucccauugcucuggaaaccuuccccagaacucuuuuucuagaccuccgccuccucuacaagacugccuuauuuccccuuugcugacugcucucaccuauggguuggcuccucagccuuucuucauccccuuuccucuuccguccucccccaccucccaccuuuagcccguccaccacugcagcaauucucagggaucccauuauucugccagguuucucuugcaaccgugaccagucccucuugcugccucucaucauuggccugguccuccucggccuccucacccuggugcucaucgccuucugcaucacccgcagacgacaaucaaccuaccagccccucugagcaucugccccaguccacuguguaagccaccaaggagcgccucaucucuucaccaugccacugacucaacaguuaccuuccuucucugucuuuaggaacacaaugaagagauuuuauaauagggguggggaaucaauaaacaugaaugguaccuacuac

SEQ ID NO: 6112 - RNA, 2994 nt, Mus musculus
caaaauggacccgcccgccaggcgccggguggguuccccgugccucacgcggccgcuccuccggguuaggcucuuuccuggccgucaagaaggccagcgcccugaucggccgguuucuucuuccccgacccacauuccaagcgcgacggagggacucgcugaagaccggggcaccccugcuugucgcgagugguaccgccagaacucuccggaacccucgcucgcacgcccugcccgacacagggaggcagccagaccagccggcuccgggccgcgcagccgccucuuucccacguuaugucgcgaccucaucuugccuuucaguauccgagcuucgcguacggcguucccacaggccgaggccucgugacgaagcucgcgcccuccgcccuagccaggucguccuuccccguaaccacacuggggucagcggcggccaugggaaucucccccacccccccaaccccggacgguuccucccggcucgguucucccgcaaccugguagguucggugcgaugggccucucaacuuccccacggcgggcccuuuggagggaacuacgggguaaguagccauaaccuuuugcaaaagccuuucuuaccgagaauccugacucgcagacaugauccuuagaaucuagggcggagugcccgccuaucgacaacuuauagagcguccgaccccgccccagccaucgcauuggcuuggccaccucugccccgccugccggcgcucugcaacucgacgugacguuacuuuguaggcgcuuuaguucggacgcccuauuggguaguuugaaagcccaucauggccuagccccgcccuauggccucauuggcugaaggguccgccuuucucgcuggugcggaagugacauacuuaagucgggccucgcggcggggcagccaucuuggaacccagcaccuuuacacgugcggaggcgaucgugccuuagucauguggcucagcagguccuaucaagcgacgggggugaggccuuagccuccaggaacuuccgggcagucuggacugccacuuuccuuuaccuggguuuucuuuacaggacaaguuuuauuuauucuuccguucaggaaaauauuguagcgauaucucauuggauaguaaguuuccccgacuggagacaaaaaggauggaacccacuuuuggguuaaagggcauagggggauaagcugucaaggauugucccacucaaucacugguucauuuaguauguuuccaguuucuccugggcuuccuuacaugaauaagcgagucuuaauucauauuuacugccaucugcuccccggggauggcaucuaucgaaagcuggacucucaagcccugaaauggggaucgcuaacaguguuagcuggaagaagaccugagauaaagcacagccacuauuuugaggccccuuaaggaagaccaccacuugcauaucuucaaaggauccuuuauugaccagagcaggaccguggcauuuuuauauauauuuauauauauaaaaaaaaguuugaagaucgggcaggcaguaaucccuuugcgcguccaccacccccacacuguuuuccugcccucugaacauggaaggaggaauggcugcuccaccuaggccacaaggcaacauucuccuauagagggagaaagaggcuugcuuuuauguggccauucccuucccaucagaaaucaauauacucgcagcaaaaaaaaacaaaauacagaaaccaaacauuuaaauaugaaaauccaaagggaauuggguagagaaacaaaaaggaacuagaguuucuugggaagggucucccuuuccccugcccacugaugggcuaagggucugggguaugaggcucacacagugaguuugcagugacacaguuccuuguagaucugacgacggaguuugggcauguccugcugggugaagcugaauggcugagacagggccaggugcuugcaguacuggguguuaacaaaguagaccaugagaacaguuuacugagcacccucccaagucaggaccugugcuacacauuucacacaaaauacaucuuaauuucucagaaaauaucuguuucucauacacacugccauuauagacuaagccuggggcuucaacaagccuacauaauauaucugguguuuaaacuggaaaauauauuuaguuggauguugggaagccucuauaucaggaccaaagccagagauacagucccaacugaggauggagaaaaccaaugaaaccaggguuucugugcuaacacauaaaaguacacccugcugugcaaucugacugaaccaaaugaggcaagagcuaccaacaaccccuaagcuacugacugagagcuaagaagaccuuaucauuugcuuaccuguaauacaaaggcaccacagucacugucauuauucugccuggccacauucuagggaauagaaagcaagaaucuguucacuuggagacuccuagagguuacgaauucaauugcugccuccuaucaaacuauuccauuuuucucuggaaacucaccauuuugaaguaaccuuuccagcccugauggaaguccagucggucuuuuuugacugccucugccuguagauacuuggcaauaugcuaugugggcaagaaaaaagaaagugacaccuuaaucaccugccaguguaacacagagugugcuggugggaaacaucacacccacucacuccucggacuccaagcccacgcuucuuccugaaauggcuugcugccacaucucccuacaauuuuacuacuuguuuccccacaaccuccucaaaccuuagggcagcggcgauuuagaguucgcugggagucaaaauaggugaugguacgucgccuuacaucaacugagauaagggaccagugcaccuccagauggauggggauuagcaguaauuccuuauugaagauguccaccuggaaagagagugcuggaagucagcuacaacauaaaacccuauugauugccaugaggauucu

SEQ ID NO: 6113 - RNA, 862 nt, Mus musculus
accaccacccuacacacacacacacacacacacacacacacacacacacacacacauaugugcgcgccuaauguaaggacagccagaguuuauuaaaaaaaaaaaaaaaaagaagaagaagaagaaaaaguaguaggucaucuucaaaaaagaggaagaaugcaaaagccuaggauuuggagaccagaaaucucugcugccaauaucugcuuaccaccuaacagugcacagugagugaggaaggcucaguaguaguaagguugguaaguuuuuagcuugaguucucaaagaggaaauauucuaaauaaaaauguuaaaaucuacaaaugauauauuccauaagaaccaugaguguccuauggagauccacaugucuaggccuuuuuccggcaggaagaaagccuuagaauggacaacaugauuuccuagagcauagauagcucuuugucaucugcacugaagaccauaggacaucuacuuauguagauguucccaacacugugucccagguaucaguccugcuaaaaaucagaguccccagcucccacaagauaggaucuuucuuugcagcccagguggggccuugauuaauuguuccaucuuagccuccaaaaucauaggauuagugugugccuagacgggccuuuaaaauuaaggcuuaaaucgggugguggcggcgcacgccuuuagucccagcacuugggaggcagaggcaggcggauuucugaguucgaggccagccuggucuacagaaugaguuccaggacagccaggacuacacagagaaacccugucucaaaaaaaaaacuaaauuaauuaauuaauuaauuaauaaaaauuaaggcuuaagaucauuucacgg

SEQ ID NO: 6114 - RNA, 862 nt, Mus musculus
ccgugaaaugaucuuaagccuuaauuuuuauuaauuaauuaauuaauuaauuuaguuuuuuuuuugagacaggguuucucuguguaguccuggcuguccuggaacucauucuguagaccaggcuggccucgaacucagaaauccgccugccucugccucccaagugcugggacuaaaggcgugcgccgccaccacccgauuuaagccuuaauuuuaaaggcccgucuaggcacacacuaauccuaugauuuuggaggcuaagauggaacaauuaaucaaggccccaccugggcugcaaagaaagauccuaucuugugggagcuggggacucugauuuuuagcaggacugauaccugggacacaguguugggaacaucuacauaaguagauguccuauggucuucagugcagaugacaaagagcuaucuaugcucuaggaaaucauguuguccauucuaaggcuuucuuccugccggaaaaaggccuagacauguggaucuccauaggacacucaugguucuuauggaauauaucauuuguagauuuuaacauuuuuauuuagaauauuuccucuuugagaacucaagcuaaaaacuuaccaaccuuacuacuacugagccuuccucacucacugugcacuguuaggugguaagcagauauuggcagcagagauuucuggucuccaaauccuaggcuuuugcauucuuccucuuuuuugaagaugaccuacuacuuuuucuucuucuucuucuuuuuuuuuuuuuuuuuaauaaacucuggcuguccuuacauuaggcgcgcacauauguguguguguguguguguguguguguguguguguguguguguguagggugguggu

SEQ ID NO: 6115 - RNA, 15185 nt, Mus musculus
ucguggagagccuuucguuuauuuguuuguuaguuuguuugagacagggucucaccauuguaaccccuggguggccuggaacucacuauuuagaccaaguuggccucgaacucaucgagaucugccucccgaguacugugauuuaaggcguaaagcucagugcccagcucggaaguguauaggagaauggggaggaugaauggcaugcauaucgaggcaccuaacauauaucuuuuucuagauaguaacaagaauuuggacgcaauaggugaaauacugaaagccgggcuucuuguuaauugaagcagaggguacuugaagaguuggauaagguuuucccuagcagagaccauagucuuuccucaaccugccgcuagauggugcugcuguucuggaugcauuccaguggacaaggcuuggcacagugcgcaaaacccccuucgcacacacaacaaaagaauuuggggcugugugggagauaaacacaaaauauucuacuuuuuuaauauccauggagucaaagcccagauagugggagcgggaaaggcaaagggaggaacaacagucaaggcaaagccauggagagcuguucuugaccguuccuuguccuuugucuagccaguuuuuggaaugggaaauccccacccccuuuauaacaaucauaguuucacaaaccccaggaauguuccaugcggagaaaggcuaaguuuugcguuugcccguggaauuuugacagugauaauauccccuugauguaaaugaaagacaccugagggugggggaaaaaaacauuucagacgcuucguucugccugcuccagccccuccuccauuuugauuuuauguuuucaguuuuuuguuggggaacaugugcauguguggagaucagaagacagcuugagaguugguuccuuccuuuugcucuguggguucucggaaucaaacccaggaggugagauguaagggauggagcaaguuacuuuccuaagugagcggucucacuggcuuuguugaauuuugaaggcagucucacucuguagccuaggcugaccuugaacuuuaggcuaaccuaucacaugggcuucauaugugggauuauaggcacgaaccuaguuguucauaggcgggugccuuuucucccugcaaggacuuuggcaucuuguucuugagucuucagauuugccucuccacccccguucccaacucucuggucuaacuccccacuccaagucagcucugcuaccucauaucaacacuccacggagcccacaguucucaccugcacuguagcagcuauuguaggcacggucaggaucagaaggcauacuucugauacaucggaauagaguuucucuucucccuuguccuucccgagauaccaccugacccauugugaaagucacaucaugaaacaggaccugucagagaagggagacgcugaagaaaaccgggauggcaccauucagucccuggaggccucaggagcacuggcaguggagccaggcaauaaggaggggguuuucuaaguuuaguaugagcagagggaucaggaaaacccuccuuacagacaggguacauagaaagaagagugacaagccagucuccauguccacacggcaggcucagggcuuaucugggauuaccugacuauagagcagauaaauuccagugucccagacucguacaaugucucccugggccuccaggccucucccacgccuaaguacugguugccacaucaccucugucacgucagagucugcuagaggugaggagugugcaggucagcauuuccuuacccucaguacaugagcucucucccuuuucaguucuaggguucucuuggccccagccccacaguuccugguuggugccccucccacagugccguuauuuaaaauagugcuuacccuuggagguaauguuaacuggaacaagaugcaggacugagugcuucucuaaggaaagaaggaggaaacagcaguguugaccugcccuggaguccacccucaccucagcccugcuccgcaucccucgugcuccugggucaccgccaaccgcaccgaaaccccagggcucacucacucuugugcuucugggugaguacugcucuccuucuccgagauuucgccccauccuuccaggcuuccaggacaucaggacucugcucaugaaagagggccagaguuugacuaagauguuaagggucucagacaaccuucuucccagcccuccucaacaccaggaauaacugaaauguauguaucugucauaggccccugaucugggcacugacugccuuucaggguguuuauuuuccuuaaauggcuguucccuugacuuccaaaucuagauccaccuccagcacuuacuugcaauuuugcagauugagaggcucugagaccccucugccauucauccuucagcccuagauucccaucuccccugacucaccugcucccagaggcucugccaugggcgcucucccugcuucugggaaggcccuccacuccgcugcagccggcucaccucccgccuuaggcuuugcagcucugucuguuggaucaguagugcgacagcacaagucacagcccccagaacugccccccaacucaaccaaagagcaaccgaaagggcuggcucucugacugagccccccauguggccuggagaugaggcuggcaugagcuagggacccugccaacagcuguggucucagaagugagguggccaagagguagcagggagggugggaauacaggcaaaggcacagaagggaagagcggguuacgcaagggagaaauaaaaaggaacuugagaauaggaagaaaucaagcuaggguacuauuagucccccuuguccccagggucgagcuagugacacucugacacuccuuccccccuagccucaggagaauuuggugccauuaucuaggaaggacagggcagccgugacacccagaaggagcggccagccuucaggagcccaggggcggccccuaaguuggaggagggcaggucgguugguuauggggcauggugccaggagcagggaauggguauaagcugggcagcgugggguuuagaaggugagugugguagacucugacucaggcaugaaugagaucuuugaggagguuuguuaggggugacuggagaugaaaaaaagggguuuaggggccagcagggaggagaaccagggacaagaaacuggcagggugcugggguuaaggcugggccggguguguuggaaccaggccugcacuacucccugugcugaacuuggcaagcuggacuuccuguuucccaagaagaguucuuacauaagguucucuggacaaagagaaaagacaaaagcggcaagccccucagucggugcagcucuccuccccacgcccauguagcuggcccaccggaauccuuccuacggcugguucuaagccccuucccaagcuagaucccaucccauguccuagccagaccucugccagcaccugcucaacugcuugaggcugccaagaggaagggcccugcuccuccuagccagggauuccccugcaggaggaaguccuuugcuaggaaaaugaggcugcuucugcagcaccuugagcagaggaccagguggguuuuguuguuguuuguuuguuuguuugcauuuuuuuucugguaccuuugugauuucuauucagaacugcagcuuggaggcaugcaggucccuguuccccaaagccuaaauccccuucccacaaucuucaguuacucugaaccccaaagaagagaaaucaugauuuauucucuuuaauauccauuuaacauuuugucacaauaauaauaaaaauaguaucuuuucaaaauccacagggauccagggaggagcuuguccccagcucuucccccucacaguugggaacuucuggccuagucccagguucucuggcuuccugccaccagguccagcccaucucagugccuggugcacaaagucaauaaacacguggucgggugagugggugggggagucagggauaaguaggggcuuugggagcuagugagguggauaguuguggugggaugggauguuaaagaagagcaaggauacgucuguggaauggaaaacaugugaacaagcucuggcugccuuugaggagaggacaggacuggaccaaggagcagcgaggggguggaggagugggggugggguagggagguguggugaugcuccuggagccagggaaaguuuaaggaaucugggagagcaaggccccucagugaacuugaaagaguccaaaguagguuaggaagggggcagccuuaagaugagcccaggggagggugcggauccgaagggaagacccuggccgcagcggcaacagcccagacaccuggcacaaacggagcuggggcccaggagagcuugcugcuguggcugagaauucuuccaggcagcgcagggccagcacaccguucaccagcaaguccagcuucagguagacagccuuucccucaucaaagugcaccuggaacagagagaggcaagcaaauccagaccucugccucccucaucgaaagccaggcaucuuccuucaugagucgcagagucucccucucccacccauuccuugccagucccuccuccccuuagccuuugcucugccccugaagccaggcagggcuuaccugacaguacagguaguagagcccagcccugaugacuguaaauuccccaaucuggcggucguagcgcagagggcuggagcuguugauuuuggucucuucccagccacucacugucccauccacaccugaaugggggauguuuagggauaaguagaagccccuuuacaagaccccacacacauuccccaggaauccauuaagaguguguguguguguguguguguguguguguguuuguguguguguguauacacacacauacaugguacagcuugcccagaguauagguggagccaugcccuuaugguacacgaagugauaauaaaguauugugugaugaaaccuaacauacaugaccaggaaguugucacuggugauugcuucuggggagaauaaagaguagugcuacagcagaagaguugggguuuuuacauuuuacuucacgguuuauguccugaacaucuauacuauacuauacuauacuauacuauacuauacuauauacacacgugcccgcaucauuugagucaacugaaaacaggugacaggccacagacucauggguuaugaauugaaaacuuccuauacaaaugagaagaauaugcccagcauugcuggugcacaccuuuaguguucaccuuuaaucccagcacuugggagacagaggcaagaguaucuaugugagucugaggccagccuggucuauagagcaaguuccagaacagccugggauacauagagaucccugucacaaaacaaaacuaagaaaaaaauaaaauaacucuuaauguccaucagcaaaugaacagaugaguaaauaugacaucccugucucuugguccauuacucugcuguagaaaggaauaaagaguugcuugcuagcaugugagugaaccuugaaaacauugugcucagugaaagaaccacauauugucugcucccaagcauaggaaauaccugcaauaaguagucuauagagacugcgagggggcaggugauuacuugagguuagccaugaugggacuauaaugugauggcuaaaggaugcgcggcugcuucuuccucuuuuuauuacuacuauuauuuuuugacacuggaucucauguagcuuaggcugccucagacuuucaaugcaguugaagaugaacuugaauuccucaugcugccuuccaagugcugagauuaugguaugugccacuuuaccagacuuggccucauguuugugacaggcucucuaugcaguccuagcuauccuguuguccacuauauuacccaugcuggucucuaacccagaaacuggccugcaccagccucugccuccuaaugcugggauugcaggugugagccaugguuuuuggugauuaacgguuuacaccucagggugcacuuuagucacaguagagcacaggauuauacaugugggcggacugcaugggaugugagagcuaucuuuuuuuuuuuuuuuuuuuugguuuuucgaggcagaguuucuguguagcccuggcuguccuggaacucacucuguagaccaggcuggccucaaacucagaaaucugccugucucugccucccuagugcugggauuaaaggcgugcaucaccacugcccggcugugagaucuaucuuaauagagcugcuaccaaaagccaugccaugcaaagggcuggggauguagcucagggguaaagugcucagcuagcgugccuaggacucuaaauuaugucaccacaaaacaaagagaaaucucuagaacuaguguagucgaaaacuguaaagaaagccaggcauggugacacacgccuuuaaucccagcacuugaggcagaagcagguggaucuuugaguucaaggccagccuggucuacaaagugaguuccaggacagccagggcuacacagagaaacucugucucgaaaaaaaacaaacaaacaacaaggaaguaguagucagcuuggaccucagagucuaugacuucccagauucugcuccaaggcuaucacccccaccccacucccacccccaccacuacuaccacgucccauccuggccuucuuccugucucccaccaugcuccaagcuccuucucucuauggggcuuuauaaugguauuccucccccaacugcacccccgccagcucuucucuuccugacaaugacuucuaguuucuccugugggaguggugugugugugugugugugugugugugugugugugugugugugugugugauauguggggcggggagugggggggaguggugugugugugugugugugugugugugugugugugugugugugugugagagagagagagagagagagagagagagagagagagagauggaacaggucuauaaucugauccuuugggauucugagaaagaaagcuccugaauucaaagccgugucucaaaacaaagcaaaauaagacaagcaaacagacccggccaugcccaucucugacuucccuucuuguuccccagcagucagcaaaacaugaacucuguauucauccccccuugcaagggcaaggacagcuguccuauucaccccgacuaucuucccagcacuuagaacugggccucaccuaagguaggccuaagaugcacgggugaggaguuaccugacaguucucauccuuuggguccacaggcucccugggccucaggccccacagucagucagucauccaccccccucagcccucccucucugccauccccagcucuguuccugucucuuauuuuuuguugcuugguugaagucagagucucacuguguagcccuggcugccugguaguuacaguacacugccuugaccuuccugccucugccuucaaggugcuggaaucacacugcgcuccacccugccuggcuuucucaucccuuucucaaguaaacaguaacucuuuggcuuaggguguggcucugugguacagcacuggucuagcuagccuauggcccuccuucaguuugucucccugucccuucuccacauuacccaccccaugcucacugugggguugggggggggcagugauucuuucugggcauuuccaucugaguuguuagcacagccaccuguccuuuaccagccucccuuuacccaaacugaccugaccccuuaacccagaagggugaaugaagacucacuccaguauccacaccccaugcguggcucacagaaccaccagucucuccuauaccaauaccaaauuugcucaauaauaacaguuuccuacuguucccgcuccugaacagcccuguccucuccuccccucccuccccagucuggccuccucgggacuccucacuguuuccaauuuugacuuuuccaguuuauuccccaaaguauuggaguugcuauguccaaaaccugacucucccugcauuaccuuugauggauaggucacugaagaacaaucccuucucucuuugugaccugccugccaucugucuuccguagucuucuacccuacccuauuuucuuuuacaggcaugugcaaccugcagccaucagagggccccaugcaucucagggugcuauggacauggcccaauguaucugcagaggacaucaugucacaguaucagaagaucagguaccccacauguauagagcgcuuuuccacccccaccucacugaaacucuuuaacaaccuuccgccucaucagacucuugggaaagccuggccuugcauggguccugagccugccucuaccacccaauuaagcuuugaggccuacuaaggccuaaaugcuacuaccaggggcaaggagucccugacuccacuguaaaaucgucuuccuguguggugccauguaucuugggcuaccuuaccaucauucuugucaucuaccacuguaauuacacauuuacagacugccugcuguuccucuguggugaauccuuaagcaaagaugugugagugugacucaccguggccuggccccugguacugagcagguuccugauugcauguaugccgagccggugggcugaggcuuggggaaucaucagcugcccaauaaugccgaaauaaugaugcccaaacaaaccaucucucccaaggugaagagagcuagccuggcccuaccgaacagugaggaaggaaaaaggagaaggaauacuggguguagacuggcuuagggcaaggcuaguuguggucugaggacaggguauacuugggaaugugaauggcuccuaggucacgcagcaccauaaaccuucaagggugucccaugcuacuuggcagcucccauaagggcuauacuuguuaguguagcaucucuccucagaucuucugcugccaugucccuaguuccccuggggucccccauaaaaccuacaagcaccacuucucauguuccuuuggcaucuucaggauggaagugugucaucucuuccuucuagaaucaucccuucuaccuucucuagccuguggguaaccuuaucccugccccaagugagucucucaugaagacucuguucagcaccuaagcauguccuagcuggcuuugaaucccaccuccaccacuuaggccugccaugaccuugggcaagcugaauaucccucucauuagacguagguuaucgguguccuccugcuauggcgguuguggggaucugaucaguucuaaugccuaccggcuacucccagugccuaccccaaaggcaccgcaccaggaggaaugcagcuuugcuaaggaccaagguuuucucugacuuacaucccucuuuaccgaccagccacuucucuccuucuugccgcugucuucucauucccuuuuucaugcuugcugcgcucgcucuaucuacacuucuuuuuguuguuguuuuuuuucuuuguuuguuuuguuuuuuuguuuuuuucuacucaggguuucucuguauagcccuggcuguccugggcuauacacuuuguagaccaggcuggccucuuaacucagaaauccgccugccucugccucccaagugcugggauuaaaggcaugcaaccaccacgccuggcucuccgucuucacuucuaaccacaacccugaaacugcccauuaaggucaucaguugguguuaugucacuuaacccuguagucacaucucuguccaugucauguggccucucagcugccucugcacagacagccacauccuccugccuggaacugucuucugagaucucagggcaccgcccugccucagagucuuccuuucccaucucuucagcuggcuuccccuucugcccagcuucauucacggggagucucucuccccuggugucucaucucauccuguagcuuuaaauaacaaccccaugaccauuucucaccuagccugggccagccuucccacacacccacgggugaaauucacuuuacuaaccgcccucccauuuguugguaauuagacaucuccaaguuaaucagucaacuuacacuccuuuccuccccggcaauccagucuuaggaaauggcauuaucuuucucagacauucuagccagauaugaaggcaccagccugguguuucagccgcuaaggaggcugaggcaggaggaucacuuaagcccagaaguauuagaacagccuggguagaguggcaaggccccaccucaaaaacagaaaaggagguagauucuacuuauugauccuccauuucucuuacuguuuacaucuaacccguuagcaagcccugcaucucuaagccacauguagaaucuccaguucucccuuuaucuacuacuaaugccccaguccgagccacccucgaauccugccuccgggccuucacaguggauggauguuccaggugacaaaacagcaaguacaaaguccagaagaggcacacuagggcacaggagagucagccucacagugccaggaagugaggcugaggccauagcauggagagacugaagcuaagcagagaagcaaugggauaggagagcuaagcugggggguggugcgggggggcggggggggaggaggugauccaggauggggaaggggcagaguugagucugagguccuaaggucauggugucaaggugggggacagagauaggcagagacuagaaacauuuggagaaauaaugaucacacaguaggagaacccaugguacacagagaacacagggccacaggugcuuccuggaaaagccugagcauuagaggaggaagcugggggccacugguuuggggaggggucuggguucugccgaugcgugcagggaaagcugagguugggugggacucaccugcuugugcuccauccuguccuggccgaggaugaacuguaagacacaggaaaggguuggugaggcuuccccugcccaucucccaccaucccucccuccacagugggcuaccuacccucauaaugggcugcaauagcucggcgaggccgcgccuuccggccuuuaggagcuaaaaauaaagcaaggauuuauuaggagauuagcagagacaccucucaggggauccaagagcuaguccccagccuuucacccugcucaggacacuggcaguuauccagacugcuggauaauccuccuccuccaucaacagugacaacauaauuuaucauccaaacugcgauacuucugagagcaagaaguggcuauuaauuaauaaucacacuggaagccggacuugguggcacacaccuuuaaucccagcacuugaggcagaagcagguggauaucugaguucgaggccagccuggucuacaaagugaguuccaggacagccagggcuauacagagaaacccugucucauaaaaacaaaaaagaaaaaaaaaaucacacugggcuagggugcagcuuagugguagagcguuugccuagcaugcacgaggcucuggaaucuagcuccaccaccacacagauacacgacacaaacacacagacagacacagauacacagauacagacacacacagagcagggaaacuuucauccaaccaaaccaguaauauaucuaguaaugaaccacugauucaugggagccuuuauuuagggaagccugggccucuuuaggagaacuccuggagucuguuuaacgccuggucauuugugguaggguccacagcuagcagcuccauguggcaaaugagcuuuagaagguagagcugaagcugggcggugguggcacacgccuuuaaucccagcacuugggaggcagaggcagacggauuucuggguuuaaggccagccuggucuacagagugaguuccgggacagccagggcuacacagagaaacccugucucgaaagaccaaaaaacaaaaaagcuagagcugaacuucuuagauuccauucucagcugcuuagcugcuugacucugggucuccuucaggcucccugccucaguuucucuacaaaaauaguaguuuuuuccccccucugcucacuucauaauacugcugugaauucagagcaaagcaguauaugaaccaaagaaucuuguuacugagacugggacauagggacagaugcucaccacuucuucgaggccggacuaguuguuccaagaaagguaccacauccuggcuuuccucugucuggggauucaguuccuagaggaauuaagggcaggguucaaacaggaccucccagagacaaacaagcaaagagccugucagaagaaccaucagccaguaacagacacaaaaccugggagguuagggguuggccaaacuggagagugaggcucagccccaaucaacaaccugcagucuacucacacacacacacacgcacacgcacacgcacacgcacacgcacacgcacacacacacaccugcacaggaucucaggaagguggggcagagacagacagcauguaugcauaggugauacauuaucauucucugguaucugguucagacgucacagccaaucagcacuuuccacucgggcagcacaacucucaccuugguaaaguugcccccuuauauccagaucacccucuuguacacaccgacauacccacgugggcugguucacuccgcacacucagucuuaaacuagugccagcuggagucucccugcacacaccucacacaacugucacagcaagccaacgcucaguuuagacacauuuuccaugcuggcaucccgaacgcagcauccacaccuacucacagggggcucccggcgguccucugcugucagcuccuccugagaaggcuccugcugggaaggaggcagcgucacccuguccuucugacaucucauccuccaccccuucuccgauccccuggcccucugcccacccggcccccaucugcuucucugcacuuucugcuccuaagauacccagaaagggguaugcugagggccucaccugggcagacagcguugcccagcuccccaggcugaccacgaccagcaggaggccaaggcaggccagcgccaggcccaggcucagcaccagcggggccagcagggcggugcccggcuccccccggcgcccccuccgccucuggcuccgacgggcggccaugggggcggggggcugugccugccucaccgcccccccaucccgggacccgagggauggggagggggagcuggugggcggaucgggccaggggagagggagggaccagggaagcgggccggagggggggcggaugaggacaggaagccggacacuguuugugugauuaaacuccaaccuccccggagugcugugcaagaaguaagagacguccugcgcccgggcgcgugcaggcaggcgaccgcaguggcacuccagaccaagaacucugagggccagugaaagcagaaguggacaggcacccacccaggccagugugccagggaugggacgcgggcccuggccccaggaacucagcaccgccccaguauguugagcccucccacggcaaucauuaaucaugaaaaugcccccaaagggcuugccuauaggccaaucugauggacucaguuucugaguugagauucccucuuccagaauuccccccaacuuguuucaagucugcuaauuaccuccuucccagcauagguuauuuuuucagcucauccugguuuggguuuuguuguuguuguucuuuuuguuugguuuuggguguuuuuuuguuuuuuugguuuuuuugguuuuugaagacaggguuucucuguguagcccuggcuguccuggaacucacucuguagaccaggcuggccucgaacucagaaagaucccccugccucugccuccugagugcugggauuaaugcacccuggaggcauggaucaccaccucugcaauaaagaauauguuuuuaaaagauaguuugugggcuggugagauggcucaguggguaagagcaccugacugcucuucugaaggucaggaguucaaaucccagcaaccacaugguggcucacaaccauccauaacgaccauaacgagaucucuucuggagugucugaagacagcuacaguguacuuacauauaaauaaauaaaucuuuaaaaaaaaaaaagauaguuuguaaaguuguuuauguguacagugugcagcuaucugagcaggaggccagagacagcugccucacuagcucugccccuuguuuuaggggagaugguguggugacaauucugaaauuuuguuuuuguuguuguuugguuguuugguuuugugguuuuuguuuguuuuuuguuuuucucaagacaggguuucucuauguagcccuggcuauccuggaauucacuuuguagaccaggcugcccuugaacucagaaauccaccugucuuugccuccugagugcuaggauuaaaggugugugccacuacugcccagcccugaggagaguuuuuuguuuuguuuuguuuugcuuuuuguucuuucaagacuggguuucucuguauagcccuggcuguccuggaacucacucuguagaccaggccucaacucagaaauccaccugccucugccuccccagugcugggauuaaaggugugugccaccaggcccggcuguccuuuuucuucuaucuaaugauaggaggugagacacagggugugggguaauaaaaggugggaaagcacuugggaaacagaggcaggcgaauuucugaguuugaggccagccuguucuauacaguguguucuaggacagccagggcuacacagagaaacccugucucgaagaagaagaaaaaauaaaaguggggaaaagaaccuauaaagcagcaaagaccaacuacaagcagagaagaaacaagaagaaagacauuagauucaaggaucaucaacucucucucuccccucccccacccucaccuccgcucugucucuggucuaccccucuauccuucuuauccuuacuuugacucaugguccugguccaagguugaagggccacacucagugauggccguucuguugccaaaguccuaaguagcacaggacaucacauggugacagauagggaacaugagagugaccaaacuggcuuuauagccaauaccuucugaagauaacccacuaauucauucauu

SEQ ID NO: 6116 - RNA, 8328 nt, Mus musculus
agauaguaacaagaauuuggacgcaauaggugaaauacugaaagccgggcuucuuguuaauugaagcagaggguacuugaagaguuggauaagguuuucccuagcagagaccauagucuuuccucaaccugccgcuagauggugcugcuguucuggaugcauuccaguggacaaggcuuggcacagugcgcaaaacccccuucgcacacacaacaaaagaauuuggggcugugugggagauaaacacaaaauauucuacuuuuuuaauauccauggagucaaagcccagauagugggagcgggaaaggcaaagggaggaacaacagucaaggcaaagccauggagagcuguucuugaccguuccuuguccuuugucuagccaguuuuuggaaugggaaauccccacccccuuuauaacaaucauaguuucacaaaccccaggaauguuccaugcggagaaaggcuaaguuuugcguuugcccguggaauuuugacagugauaauauccccuugauguaaaugaaagacaccugagggugggggaaaaaaacauuucagacgcuucguucugccugcuccagccccuccuccauuuugauuuuauguuuucaguuuuuuguuggggaacaugugcauguguggagaucagaagacagcuugagaguugguuccuuccuuuugcucuguggguucucggaaucaaacccaggaggugagauguaagggauggagcaaguuacuuuccuaagugagcggucucacuggcuuuguugaauuuugaaggcagucucacucuguagccuaggcugaccuugaacuuuaggcuaaccuaucacaugggcuucauaugugggauuauaggcacgaaccuaguuguucauaggcgggugccuuuucucccugcaaggacuuuggcaucuuguucuugagucuucagauuugccucuccacccccguucccaacucucuggucuaacuccccacuccaagucagcucugcuaccucauaucaacacuccacggagcccacaguucucaccugcacuguagcagcuauuguaggcacggucaggaucagaaggcauacuucugauacaucggaauagaguuucucuucucccuuguccuucccgagauaccaccugacccauugugaaagucacaucaugaaacaggaccugucagagaagggagacgcugaagaaaaccgggauggcaccauucagucccuggaggccucaggagcacuggcaguggagccaggcaauaaggaggggguuuucuaaguuuaguaugagcagagggaucaggaaaacccuccuuacagacaggguacauagaaagaagagugacaagccagucuccauguccacacggcaggcucagggcuuaucugggauuaccugacuauagagcagauaaauuccagugucccagacucguacaaugucucccugggccuccaggccucucccacgccuaaguacugguugccacaucaccucugucacgucagagucugcuagaggugaggagugugcaggucagcauuuccuuacccucaguacaugagcucucucccuuuucaguucuaggguucucuuggccccagccccacaguuccugguuggugccccucccacagugccguuauuuaaaauagugcuuacccuuggagguaauguuaacuggaacaagaugcaggacugagugcuucucuaaggaaagaaggaggaaacagcaguguugaccugcccuggaguccacccucaccucagcccugcuccgcaucccucgugcuccugggucaccgccaaccgcaccgaaaccccagggcucacucacucuugugcuucugggugaguacugcucuccuucuccgagauuucgccccauccuuccaggcuuccaggacaucaggacucugcucaugaaagagggccagaguuugacuaagauguuaagggucucagacaaccuucuucccagcccuccucaacaccaggaauaacugaaauguauguaucugucauaggccccugaucugggcacugacugccuuucaggguguuuauuuuccuuaaauggcuguucccuugacuuccaaaucuagauccaccuccagcacuuacuugcaauuuugcagauugagaggcucugagaccccucugccauucauccuucagcccuagauucccaucuccccugacucaccugcucccagaggcucugccaugggcgcucucccugcuucugggaaggcccuccacuccgcugcagccggcucaccucccgccuuaggcuuugcagcucugucuguuggaucaguagugcgacagcacaagucacagcccccagaacugccccccaacucaaccaaagagcaaccgaaagggcuggcucucugacugagccccccauguggccuggagaugaggcuggcaugagcuagggacccugccaacagcuguggucucagaagugagguggccaagagguagcagggagggugggaauacaggcaaaggcacagaagggaagagcggguuacgcaagggagaaauaaaaaggaacuugagaauaggaagaaaucaagcuaggguacuauuagucccccuuguccccagggucgagcuagugacacucugacacuccuuccccccuagccucaggagaauuuggugccauuaucuaggaaggacagggcagccgugacacccagaaggagcggccagccuucaggagcccaggggcggccccuaaguuggaggagggcaggucgguugguuauggggcauggugccaggagcagggaauggguauaagcugggcagcgugggguuuagaaggugagugugguagacucugacucaggcaugaaugagaucuuugaggagguuuguuaggggugacuggagaugaaaaaaagggguuuaggggccagcagggaggagaaccagggacaagaaacuggcagggugcugggguuaaggcugggccggguguguuggaaccaggccugcacuacucccugugcugaacuuggcaagcuggacuuccuguuucccaagaagaguucuuacauaagguucucuggacaaagagaaaagacaaaagcggcaagccccucagucggugcagcucuccuccccacgcccauguagcuggcccaccggaauccuuccuacggcugguucuaagccccuucccaagcuagaucccaucccauguccuagccagaccucugccagcaccugcucaacugcuugaggcugccaagaggaagggcccugcuccuccuagccagggauuccccugcaggaggaaguccuuugcuaggaaaaugaggcugcuucugcagcaccuugagcagaggaccagguggguuuuguuguuguuuguuuguuuguuugcauuuuuuuucugguaccuuugugauuucuauucagaacugcagcuuggaggcaugcaggucccuguuccccaaagccuaaauccccuucccacaaucuucaguuacucugaaccccaaagaagagaaaucaugauuuauucucuuuaauauccauuuaacauuuugucacaauaauaauaaaaauaguaucuuuucaaaauccacagggauccagggaggagcuuguccccagcucuucccccucacaguugggaacuucuggccuagucccagguucucuggcuuccugccaccagguccagcccaucucagugccuggugcacaaagucaauaaacacguggucgggugagugggugggggagucagggauaaguaggggcuuugggagcuagugagguggauaguuguggugggaugggauguuaaagaagagcaaggauacgucuguggaauggaaaacaugugaacaagcucuggcugccuuugaggagaggacaggacuggaccaaggagcagcgaggggguggaggagugggggugggguagggagguguggugaugcuccuggagccagggaaaguuuaaggaaucugggagagcaaggccccucagugaacuugaaagaguccaaaguagguuaggaagggggcagccuuaagaugagcccaggggagggugcggauccgaagggaagacccuggccgcagcggcaacagcccagacaccuggcacaaacggagcuggggcccaggagagcuugcugcuguggcugagaauucuuccaggcagcgcagggccagcacaccguucaccagcaaguccagcuucagguagacagccuuucccucaucaaagugcaccuggaacagagagaggcaagcaaauccagaccucugccucccucaucgaaagccaggcaucuuccuucaugagucgcagagucucccucucccacccauuccuugccagucccuccuccccuuagccuuugcucugccccugaagccaggcagggcuuaccugacaguacagguaguagagcccagcccugaugacuguaaauuccccaaucuggcggucguagcgcagagggcuggagcuguugauuuuggucucuucccagccacucacugucccauccacaccugaaugggggauguuuagggauaaguagaagccccuuuacaagaccccacacacauuccccaggaauccauuaagaguguguguguguguguguguguguguguguguuuguguguguguguauacacacacauacaugguacagcuugcccagaguauagguggagccaugcccuuaugguacacgaagugauaauaaaguauugugugaugaaaccuaacauacaugaccaggaaguugucacuggugauugcuucuggggagaauaaagaguagugcuacagcagaagaguugggguuuuuacauuuuacuucacgguuuauguccugaacaucuauacuauacuauacuauacuauacuauacuauacuauauacacacgugcccgcaucauuugagucaacugaaaacaggugacaggccacagacucauggguuaugaauugaaaacuuccuauacaaaugagaagaauaugcccagcauugcuggugcacaccuuuaguguucaccuuuaaucccagcacuugggagacagaggcaagaguaucuaugugagucugaggccagccuggucuauagagcaaguuccagaacagccugggauacauagagaucccugucacaaaacaaaacuaagaaaaaaauaaaauaacucuuaauguccaucagcaaaugaacagaugaguaaauaugacaucccugucucuugguccauuacucugcuguagaaaggaauaaagaguugcuugcuagcaugugagugaaccuugaaaacauugugcucagugaaagaaccacauauugucugcucccaagcauaggaaauaccugcaauaaguagucuauagagacugcgagggggcaggugauuacuugagguuagccaugaugggacuauaaugugauggcuaaaggaugcgcggcugcuucuuccucuuuuuauuacuacuauuauuuuuugacacuggaucucauguagcuuaggcugccucagacuuucaaugcaguugaagaugaacuugaauuccucaugcugccuuccaagugcugagauuaugguaugugccacuuuaccagacuuggccucauguuugugacaggcucucuaugcaguccuagcuauccuguuguccacuauauuacccaugcuggucucuaacccagaaacuggccugcaccagccucugccuccuaaugcugggauugcaggugugagccaugguuuuuggugauuaacgguuuacaccucagggugcacuuuagucacaguagagcacaggauuauacaugugggcggacugcaugggaugugagagcuaucuuuuuuuuuuuuuuuuuuuugguuuuucgaggcagaguuucuguguagcccuggcuguccuggaacucacucuguagaccaggcuggccucaaacucagaaaucugccugucucugccucccuagugcugggauuaaaggcgugcaucaccacugcccggcugugagaucuaucuuaauagagcugcuaccaaaagccaugccaugcaaagggcuggggauguagcucagggguaaagugcucagcuagcgugccuaggacucuaaauuaugucaccacaaaacaaagagaaaucucuagaacuaguguagucgaaaacuguaaagaaagccaggcauggugacacacgccuuuaaucccagcacuugaggcagaagcagguggaucuuugaguucaaggccagccuggucuacaaagugaguuccaggacagccagggcuacacagagaaacucugucucgaaaaaaaacaaacaaacaacaaggaaguaguagucagcuuggaccucagagucuaugacuucccagauucugcuccaaggcuaucacccccaccccacucccacccccaccacuacuaccacgucccauccuggccuucuuccugucucccaccaugcuccaagcuccuucucucuauggggcuuuauaaugguauuccucccccaacugcacccccgccagcucuucucuuccugacaaugacuucuaguuucuccugugggaguggugugugugugugugugugugugugugugugugugugugugugugugugauauguggggcggggagugggggggaguggugugugugugugugugugugugugugugugugugugugugugugugagagagagagagagagagagagagagagagagagagagauggaacaggucuauaaucugauccuuugggauucugagaaagaaagcuccugaauucaaagccgugucucaaaacaaagcaaaauaagacaagcaaacagacccggccaugcccaucucugacuucccuucuuguuccccagcagucagcaaaacaugaacucuguauucauccccccuugcaagggcaaggacagcuguccuauucaccccgacuaucuucccagcacuuagaacugggccucaccuaagguaggccuaagaugcacgggugaggaguuaccugacaguucucauccuuuggguccacaggcucccugggccucaggccccacagucagucagucauccaccccccucagcccucccucucugccauccccagcucuguuccugucucuuauuuuuuguugcuugguugaagucagagucucacuguguagcccuggcugccugguaguuacaguacacugccuugaccuuccugccucugccuucaaggugcuggaaucacacugcgcuccacccugccuggcuuucucaucccuuucucaaguaaacaguaacucuuuggcuuaggguguggcucugugguacagcacuggucuagcuagccuauggcccuccuucaguuugucucccugucccuucuccacauuacccaccccaugcucacugugggguugggggggggcagugauucuuucugggcauuuccaucugaguuguuagcacagccaccuguccuuuaccagccucccuuuacccaaacugaccugaccccuuaacccagaagggugaaugaagacucacuccaguauccacaccccaugcguggcucacagaaccaccagucucuccuauaccaauaccaaauuugcucaauaauaacaguuuccuacuguucccgcuccugaacagcccuguccucuccuccccucccuccccagucuggccuccucgggacuccucacuguuuccaauuuugacuuuuccaguuuauuccccaaaguauuggaguugcuauguccaaaaccugacucucccugcauuaccuuugauggauaggucacugaagaacaaucccuucucucuuugugaccugccugccaucugucuuccguagucuucuacccuacccuauuuucuuuuacaggcaugugcaaccugcagccaucagagggccccaugcaucucagggugcuauggacauggcccaauguaucugcagaggacaucaugucacaguaucagaagaucagguaccccacauguauagagcgcuuuuccacccccaccucacugaaacucuuuaacaaccuuccgccucaucagacucuugggaaagccuggccuugcauggguccugagccugccucuaccacccaauuaagcuuugaggccuacuaaggccuaaaugcuacuaccaggggcaaggagucccugacuccacuguaaaaucgucuuccuguguggugccauguaucuugggcuaccuuaccaucauucuugucaucuaccacuguaauuacacauuuacagacugccu

SEQ ID NO: 6117 - RNA, 24642 nt, Mus musculus
ccucagaagcgccgagagcgcgaccgggacgguuggagaagaagguggcucccggaagggggagagacaaacugccguaaccucugccguucaggaucccgguuacuuauuuauucguuaccccuuuucuucuuccucccucccaaaaccuccuccucuccucccuucuuuuguuuccuuuuugggagccgacgaaucuccggaaagggagaaaaggcuuucuuucagcccuuuucguuccucugccuucccccccccuuccccccucccccaccuuucccuccuccagccuuucccucccuaucccgggaggucuuuccugguggccgcccggacggguucugagcacuuaggcggcgguggcgcaggcuuuuuguagcgagguuugcgccugcgcagcgcgccugccucgccaugcacggggguggcccccccuccggggacagcgcaugcccgcugcgcaccaucaagagagugcaguucggaguccugaguccggaugaauugguaagauaguccgcccgucucucugcuaugccuuuggcugaugauccucugggaagaugggucagugaugcugauguugugcggggguccagccuucaaaaguuaaauuaugccaggacuuaaacaagcgaaaugcuaugccugagaugagugcuugacuggacagagaagaaagauguuuccauacuugagcauugcugcgguucaacgagacaggguugaaaguuguacaggaaguggauccccaguuuuaguucuuucaccaauauugagcauccugcuaugugacaguaaucagacacuaggaacacagcugcacaauaaauauaacagaaacucuaccuucuaaaacacuaugggaaaaacagagaagagagcuuaagaacaaaaagaaaugagcaaaaauaaguaccuagauuaaagcaaaaugaggaaaugcuguaagaagucacugaaauugaauggugucaggguuuggaagacauacuugccagggauggugacauucccaaguaauaucagucaucagagcuauuuuuuuagguggaggaaacaagugucaugggacugagagggaaauaaacuuguauucuagagacugaaaagccaguguuggggcaggcaggguuagugggugcggagagugcacugaagaagcacgggauauuguaaauuacgcucuagagaguccaaauuucuguuuucaguaggaaaccacuggguaauuauaaaggugacaguaguaacuuauacacacacgcauguacagaagcuccguaaagagcugaugugaagugggugaggauagacaagggauagcuuuuggagacuuggacuucuuccuccugagaggaauagagaguggaauuaaacagcugauucuagacugaggcaguccuguugggguaagggcucaacuauagcagaacucaaaagaaaaaacagaaaaaccuacaucagggcugguaagauggcucagcagguaagagaacugacugcucuuccgaaagucaugaguucaaaucccagcaaccauaugguggcucacaaccaucuguaaugagaucugaugcccuuuucuggagugucugaagucagcuacaguguacuuacauauaauaaauaaaucuuaaaaaaaaaaaaacaaagcccuacaucagguuucuggacauccaagaccucacagaccgacacaaaauaaauuccagauaauuaaaguaauaaaacauuaagaaagaacaggauuuuaggggagcugauaccagaggacaaaccuuacauuaauaaauaaagguaaauuuucugaugauccuacaguaagcuaagcauuguacuaaaagaguaaggcagacaugggccacuuuuaucagaggcucuagaacagaacuaaaauaaguauauugggaaacaaauuuguacugugauggacaggguuugauuuuucaggguuuuguucuguuuugcuuuugaagcagggucucuguauguagcacuggcuauccuggagcucauagcccaggcugaauuuugcugggacugaaagucagccuugugcaugcuaggcaagugcucuugaccacuuggcuacauguauuugaagcucuugguauuuugaagcagaaucuugcuguucaguucaggcugcccugcaaauggugauucuucugccuuaccuuucugagugcugagagcauaagcccaucucaccuggcgugguuagacuuuuuuuuccuuuaacaaauuaaaaauaaaagggggugggguggggcuggagagauggcucagugguuaagagcacuaacugcucuuccagagguccugaguacacacacaugguagcucacaaccaucuguaauagaaauugaugccccuuucuggugugucugaagacaacagcaguguacucauaaaauaaaucuuuuauuuuuuuaaagguuuccuaauaacaaguuaaaaagaguuucuuaaucugguagcaaaaauaaugagaagaugagugaccucaugcauuauugauagaagaauaaguugguuagcuuuuuggagaucauucagucuuuaauauauguaucucuugacccagcaucaaaccaagaauuuauuuaauuuuuaaauugagacaggguuucuuuguauaguucuggaacuugcucuguagaccaggcuagccucaaccucacagagaccugcaucccaagugcugccaccaccaccuggccaggccagccuuuaccuuuacgaugguaccuacccacugaccucuguucugaguagcccugccucagucuuccaguaguuguagagauguuuucaucaugguccuucccuucauggcauccucucaggaggauccagacuccuugaaauucugccccugcuugccucuccaucuuauuaccagucuccugguaaauuaaaaaaauauuuuuagauuaauuuauuuuaugaguauuauuaauguuuugccagcaugcauguauguacaccacaugugucccuggugccugagagucagaagagggcauuggguccccuuaaacuggaauucuugaagguagugagccaccaugugggugaugggaauaaaaccuagguccucugcaagagcaacaagugcuuuuaaccacucugccauuucucuagcccuucuugguuuccuuuugcaacucugaccugcuuagcuuuuaacacugcaaguuuauucuugcuucaggggcuauuuaaucagucucugcugcuuagaauaacacugcccagaccuuauugccugcucuucaugucaguguguucuguauuuagaugucuacucugaccauuuaaauagcauccuucguucuguaacccccuacccuuuguuuuacuucaauagccugccacuguuggaggauuaauuuucuuaacuuucuguuagcauuccaaguagauccuggugcugauuugcauguaauuaaaaugauuuggguaaauacguuuuaagauuguuugaaaaugacaauugaaagucaccuaaauauuuacuaauaggaacccuuuuugaauaccguagguccuaucuuuagaauagaacaaaacugcccuauagucuagauccaauguucccaaacugcugucacauuugaaagcacuguagcaaaaucacaggggcacaggguauucuguacucuagaaguauaggugcucuguacucuacuaguugcacaugguucaguuccaacauuagauggcgcuggaucccauugaaugacaucauauguuugagaagcugaauuguuuuuuguuugguuuggcuugcuuuuuuuuguaggguuuuuguuuuguuuuuguuuuuugauauguguggaaaaggguggaggugcucuuagagaucaggggauuuuuuguuuuguuuugguuuugguuuugguuuuuuucgagacagaguuucucuguguagcccuggcuguccuggaacucacuuuauagaccaggcuggccucgaacucagaaauccaccugccucugccucccaagugcugggauuaaaggcgugcgccaccccgcccgacuguuuuuugucuuuuugagaucaggggaucuuauccccuggagcuguauucagguuguuuacaaaaaauuaaaaaauaaaaaaaauuugauguguguuuuugugugcauaugugcauggcauauguaugugggggagucugaagagguguuggagaccugacacaguugcugaaaacuccccuccaauuaucugcaagaacaauauguggguguuuuguccuuguuugguuggggggggugguaguuugguuuuuuuguuguuuuguuuuguugagauaaggguucucuguauggcccuggcuacuguggaacuugcuuuguagagcaggcuggccuuucacgaagagauucagagauguaccugcugagcuuaaaggaguuugccaucacacccagcucugugauauguucuuuuuuuuuuuuuuaauauuuauuuauuauuauacauaaguacacuauagcugucuucagacacaccagaagagggugucagauuucauuauagguaguugugagccaccaugugguuucugggauuugaacucaggaccucuggaagagcagucagugcucuuacccgcugagccaucucaccagccccugugauauguucuuaagcacugagucagcucucuagcuuuuuugucuuuugagacaguguuuagaucugaguucugggguuauaggcaaaugcuacugugccuggaucacaaagcugcaauuuuagcaauugcuaaggacuaguagauuuggagcaugaaauggggugcuguuagcuaaggauugagaggucagacagcauuuaacaguuuuaaguaagaaauuuuauuauuucauuguuuauuuaaacaagauguccauuguaggcucaggcuggccucgcacccuaaaaccuccuccugggugacagguacaugucaccauaccuggcuuuauuuuaacaaauuaaaauauucuucagcucauguguuuguuuuugcuuuuuguuguuguuuuuuuguuuuuuuuuucaaauggcuacugguugcuaagacauaaauauuuuuaaguuuggguuuucuugcuuaaugaaucuuuuuugaagguauugugaacagauaagagaaaaaguuacuuaacaauaugcaaaaugagguggauuuuuuugagacuuggucucacuauauaguucuggcuaaucuagaacacguuacauaacccaggcuugccucaaacuugagcucuuucugccuggugcuaggauaacaagcaugggcccuuaugccugccuuuuaccccuuuuuaaaagauacagcacuuagggcuggggagcugugcaagcauaagaccugaguuucaguuccuaauagccauguaagaaaucagguguagaggugugcucccauaaucccagcagugaggaaaggaggagcucuggggcuugcuggcuuguuaggauagccacauuggugggcuccgaguucagugugagagccuguuuuuaagggaauuacaugguuuuaguuuggguaggaagauggguaauaaggggcuuucugugagguauucuuaaaguuuugggguagaaauugaauuacagagggcucuuugaauugguaaaaugucugcugcuaggacuagagagauggcucagugguuaauuuacuggccuuggagagggccugagcuuauucucagaacccacaugagugacucacacucacaugaaggggaucugaugccucugacuccaagggcaccugcacucauagacacacaggacaugcauacucauaauauaaaauuaaauuuaaaaaagaauauauguugccauggggcuaaagagauggcucagugguuaagagcacuggcuauuggacuuuggcuuaacuccuagcaccuacauggcaguuuacaacacccuaacucugguuccagggaguccagugcccuuuucuggccuucuuugguaccaggcacacaugcaguauacaugcaaguagaacacucaaacacaugaaaauacauuuaaaaaaaaaaaaaaaaaagucugucagacugguugacagugcuuguaaguucaaggcuguucugaucuauauacugcuaguuccuaaacauugagggcuacacaaugagacucuuuaaaaagaaaaagaaaaaaaaaaucgccgggcagugguggcacacgccuuuaaucucagcacuugggaggcagaaguaggcagauuucugaguuugagggcagccuggucuacagagugaguuccaggacagccagggcuauaaagagaaaccauguuucaaaaaaaaaaccaaagaaaaaaaugcuguuauaggaaaugauuugaguugggguggggagcuaggaaaguuaguauuguggugugugucugucuggggccaggggaaaccuggcauuaaacccucacacaugcuaaauacacacuguacuaccaaacuguauccucagucauucauguacucuuugaaguggguaguuacacuaaugaaugagauuuucuuugucuuaaaauuaauuacaaucuaauaagggucugguuuccuacagucugccaguauauuuaaccauuugcugguguguagacuagccacugaguguguguguguguguguguguguguacguguacacgugucauguucugugccucaaggauuauagucaagugggaguaacauauauaagcaaaguuaaaguugugcuuagcagaaccuuccuaguauggguaagacuagagacuagagauaaggcuaauagagugagauaagacuucugcaucuggcacuucuuccugacugcagacacugagugaccagcuacuuucacacucuugccacugugccuuugcuuccgugguggacaguauucccucaaagcuaaaaagaaauaaaaauaaaaagagaaauuggaaaggacaucugagcugacucuuacaaaggaaugaguuuacucaguccguguauaacagggugguaagacuagaggaauugugagguaacuugcuguaguagaaguauauaagguaagagaauguagcaaauaaagcuguaaagugaguuguugaaggucaaggauauaaggaccucaugugguuugauauaggcagaugaaagagagugaagaauuagugagcuuuguagagcaggcuguuuaguuuuuuuauuguuauuuguguauuuuccugugaccugggguaacacaaaagaacagccagcuucacacauacacacacacacacacacacacacacacacacaccaagaauguccuguaggggggcuagagagguggcucagcaguuaagagcacugauugcucucccagagguccugaauugaauucccagcaaccacaugguggcuugcaaccaucuauaaugggauaugaugaacucuucugguguguguguguuugaagauagcuauaguguauucauauaaauaaaaauaaauaauauuuuaaaaaaagaauguccuguauucaguaagaaccaguguuugguuaaaguagugaauaaucccaaacuaacauuuguuaaaucuuuaguagagugguccuuccauuuaugcauuuaugccugcuacaaggagagccucuggacuagucucaggaugcuuggaaauagaauuaaucaauuagaugaggcucagugaguauugacugagcagagagagguggaauuuuuuaguguacuuuuuuuuuuuuaaagauuuauuuauuuauuauauguaaguacacuauagcugucuucagacgcaccagaagagggcaucagaucucuguuacaggugguugugagccaccaugugguugcugggauuugaacuucggaccuuuggaagagcagucgggugcucuuacccccugagccaucucaccagcccuuuaguguacuucuuaggcuccuauguacuguguacaccaguggccagauucaugucugcuucuguguuuuugcauuucauaguaagcaaaauccucuucauguagcuugggacuuagagaagcuggugaggguccagccuaauaauuuagucccaucccaggccugucuccugagucauaucaccuugauugaauuuauuuaucuauuugcgugguguugaggccgguauuguuuaaguuugacacaacuagccaugaagcucuaacugacacagaacucaaaaaauucugccugccucugccuccugagugcuggaacuaauggugugugccaccacaugcaaucaguuuuggguuuuuaaaaccuuuuucaacuuguuugagauuauagguuacauagggaguccaaggccagccuaggcuacgugucuuaaagaaugagggcuggagagguggcuuagagguuaauuaagagcacugacuguucuuccagagguccugaguucaauucccagcaaccaaaugguggcucacaaccauaugugauaggaucugaugcccucuucuagugugucugcagauaauauacccauauaauaaaauaaaguuuuaaaauaaauaaaugaaugaaugagcuggucaugguggugcaugccuuuaauuaucauaguacucuagaggcagagcauggcagaucucugaguuugggggugggggcaggauuacuuagugaggugcugucucaaaaaaauauauauauauauaaucauuguuucugcuauaguauagguaguauaggagaguaggaugagccuguguauaguacuagagaguguugggucucaucucuguugacuacuugagacugaagguuuggguaaauaacuucaugagacaucuaagagguaaggaggucagugguuagaauuagaggaacaaauuuugucuauaucucaauuaacacucagugagcuguauaccucuagaagcugguggagcaaagccugacuaauuugaaagucuaccuuucguuauaugagaagauacucaggauugccuugaccagcuuagugugcuugaggcccuggguuagaccccaggucuacauccuccuccccuauauauucaaaugaacagaaaaaaagaccuuaucuucugagcuccucuaguucucaucacugaaucgacccuuugaguccuggcuccaucuuucuugggacuccagcuauucacuuuugcucugccagccuguguccuuacuuacaauaaaguuucaccuggauaugaaagugcuccggcaguuuaggcccuaagaaggaggaguaaauggcaaagauagggguuaagagaggagacaaaguuuccaagugccuguucuuuucaggagcugaaguuaagaguugguagauaagucuugacagcacacguuggcucucaggcacauugcagguacagagagauucuccagggacuccgauagucauuggccugauuucagcuugggagaagaaaaaaauaguauuuugguuuugacuccgcgcucaaccucuuuccaucucuuuucauguuaaaucuuacugauguaauagugacguagauuuuuuaaaaaauuuuuuaagauuuauuuauuuauuaaauguaaguacacuguagcugucuucagauaccagaagaggguauuagaucucauuagggaugguugugagccaccaugugguugcugggaauugaacucaggaccucuggaagagcagucagugcucugagccauugcuccaaacugugacauagaauuuaacucaguagccaggugugguggcacaugccuuugaucccagcacuuaggaggcagaggcagguggauuucugaguuugaagccagccuggucuacaaagugaguuccaggacagccagggcuacacagagaaacccugucucgaaaagcaaacaaaaaaaccaaaaacaaaaaaaaagaauuuaacucagagagauauuacuuggaauuccaguccuggcuagaggcaagguggugcuuguguaacccuagcuuuugaaagaaagaagcgggagaauuuugaguuugaggccagcaugaaccacauagcaagacgucucaaaauacuaaaaguagguauagaaccaaggcucauauucuguuugaauacaugccaacucacccucuaccccucaugcagacacaguggcugacugaaacauacuugggauguguuacuuaaguuuaguauucuaaaguuuuaacuaugcuaacauucccauuucauaccuuaaacaaaugguuuggaauuuucuuucuuuucuuucuuuuaagauuuacuuauaugaguacacuauagcugucuucagacacacagagggcaucggaucccauuagagaugguuguaagcuaccaugugguugcugggauuugaacucagauccucuggaagagcagucagugcucuuaaccacugagccauuucuccagccuuguuuggaauuuucuuaggccuuauuacagaacucuucaguucugcacacuaggaauccuacuuaguugguacuggcuuuucuuuccugcagaagcggaugucugugacagagggugguaucaaauacccagaaacaacggagggaggucgccccaaacuugggggacuaauggauccacggcagggggugauugagcggacuggccgcugccaaacaugugcagguaagugcugggguuagaggauuccuaaggauggauaccuaaacuagucucuuagccuagcgguggugguuuaugccuuugauccuagcacuuggaagcaaagggagacgaauaucugaguucuaagccagccuauuuccagaguucuaagacaccagaacuaacuacauagaaacccugucucagaaacaaagaaccuuuagagucaguggcaacuuuaaagaaagugucuggugggggcuggugagauggcucaguggguaagagcacccgacuauucuucagaagguccagaguucaaaucccagcaaccacaugguggcucacaaccaucuguaacaagaucugaugcccucuucuggagugucugaagacagcuacaguguacuuacauauaauaaauaaauaaaucuuuaaaaaagaaaaaagaaaaaaaagaaagaaagugucuggugugucuuuccauaggaaacaugaccgaguguccuggccacuuuggccacaucgaauuggccaaaccuguguuucaugugggcuuccuggugaagacaaugaagguuuugcgcugugucugcuucuucugcuccaaacugcuuguagauucugugaguaggucuuuggucccuagucugggagggugguugcuagcuggggcagggcaagggaacagcuccaauugacccugcucuguuuuucccccagaauaacccgaagauuaaggacauccuggccaaaucuaaggggcagccaaagaaacggcuuacgcaugucuaugaccugugcaagggcaaaaacaucugugaagguggagaggagauggacaacaaguuugguguggagcagccggagggugaugaggaucugaccaaagagaaggugacagggacuugcgggaaagugacucuagaaaauuuggugaaaucacauacagcuguggaauauauuucauaguguggcagaaauggcccugugcuagguucuaaugguucucuucuugaaagggccauggcggcugugggcgguaccaaccccgaauccggcgcucuggccuagaguuguaugcugaauggaagcauguuaaugaggacucucaggagaaaaagaucuugcugaguccagaacgagugcaugaaaucuucaaacgcaucucagaugaggaguguuuuguguugggcauggagccucgcuaugcccggccugaguggaugauugucacaguguugccugugccuccucucucagugagaccugcuguggugaugcaggguucugcucgaaaccagguaagcugcucuaagaaucuucccugggcaucuggggaaggaucaugugauuagaggcugcuuucuuuuaaauacacuuagguguagcguguguaaagggccagguggacugacaggaguuugaacauguuuugcuccuugauaguuguguaaccuuuaaagauacccuaaacaugguuucccaggguaggcugaaaggaguuugaccguguccuuggcauguuugucagugcuggccugacugugacacugcugacucuuuaccucaggaugaucugacucacaaacuggcugacauugugaagaucaacaaucagcugcggcggaacgagcagaauggugcagcugcccaugucauagcagaagauguaaaacuucuccaguuccauguggccaccaugguggacaaugaacugcccggcuuaccccguguacgucugcacacuccugcccuuauggauuggagccagagugggggccagcaugaggcagcagaacucuggaggagagaccagugcugacuaccugagugccccuuccuguguuuucuuauaggccaugcagaagucuggccguccccucaagucccugaagcaacgguugaagggcaaagaaggacggguucgagggaaucuaaugggcaagcgaguggacuucucagcccgcacugucaucaccccugacccuaaccuauccauugaccaagugggugugccccgcuccauugcugccaacaugaccuuugcagagauugucacacccuucaauauugacaggugugcuuuaguccauaaaccuuguccauagugaccaagguaggggguggagcacuuguucucagauguguaccuuccucaucuggaagagacagcuuggaaugaagcaggaagacccugaaguuuauaaguuuggcauccacuugggguuugggaugaaggugggaauucaugguuuuuggagaguauuuugcucauuucauacuucauuccuuccuagacuucaggaauuaguacgcaggggaaacagccaguauccaggagccaaguacaucauccgcgauaauggcgaucgaauugacuugcguuuccauccuaagcccagugaccuucaucugcagacuggcuauaaggcauguaaauaggccaugaccauucuuagucaccagagcugggagccuccuguagaauggggcugguuauuuuaggaguguggcagucagaguguuguggggguuuuuucugagacagguuuucaucauauaccccaggcuaaccuagaaaugguggacuucaaguauguguuccucuugccuuaguucccuagugcuaguguauaccacuaugacagugggugccuuuuguucugcuuaaccaguugugcugccagucucugaggucaaagugaggcuacaucagcccgugucagcauguguguggcaggggagagagcuucauggauguuugugauuccuacauuuuauuauucuuaguaaccugauguuggacugggaccgugcaaaggggauguuugaaggugaaauaacagugaaaaagcaucgcaguaucaucuccaggcuacgagagacuggguccacugucauuucauucuuagugugccuucuucacugaacccuucucugccucaccucucuagguggaacggcacaugugugauggggacauuguuaucuucaaucgucagccaacuuugcacaaaauguccaugauggggcaucggguccgaauccuccccuggucuacuuuucgguugaaucuuagguuaguucucuaccugagggaaucagacugagaugggaacaggccaggcaauuccauuaugucacugaagaaguagucccaacucuugacuucuuucucuguuuggcuacagugugacaacuccauacaaugcagacuuugauggagaugagaugaauuugcaucugccacagucucuggaaacacgggcagagauccaagaguuggcuauggugccucgaaugauugucaccccccagagcaaucgaccugucauggguauugugcaagacacacucacggcaguacgcaaauucacuaagagagaugucuuccuggagcgggugugugacccaaauggaaacuggucuugggugggcaaaagggucugaguaugaaagagccagggaaggagagcuacaguguuuuuuucuuuaauuucauguauuaucuaucacuucuauauuuuuuuauuuucuaauuauuaaaagaaaaauaagaucuuacuauuauaauauucuguauuuaaguaaaaauuugaaagucaauucuaacauauuuuugcuuccaaaaucugacuuacuguguuaggcagggccauguuccagauauuccuaagacagugagcucaguuagaucuuccucccuuuuacuuucuuuucuugcuguuuaccucucagggugaagucaugaaccucuuaauguuucuguccacgugggauggcaaggucccacaaccagcuauccucaagccccggccccuguggacaggcaagcagaucuucucccucaucauaccuggacacaucaauuguauccguacccacagcacccauccugaugaugaagauaguggcccuuacaagcacaucucuccuggggacaccaaaguaaggcuuugcuucugaguguauacaagauuugaacaugggaaugagaacaaaaaucuaagugaguguuuguccacagguuguaguggagaauggggagcuuaucaugggcauccuuuguaagaagucccugggcaccucagcaggcucgcugguccauaucuccuaccuggagauggggcaugacaucacccgccucuucuacuccaacauucagacugucauuaacaacuggcuucucaucgagggucaguauagccagcuuccaaauccucucugacucuucuucaccucacuuacaauuuauccuuuacuuguucacacuguccuccuagauugcuaauguaguuuuuguuucucccuaggucauaccauuggcauuggggacuccauugcagauucaaagacuuaccaggacauucagaacacuauuaagaaagcuaaacaagauguaauagaggugagggaaggcugggcagagaagagcuucuuagggauuugaacuuaaaacucugcaagagcaaaauagauauaaggguuuagagagagagggaauagugacucaaauguguuaaugaaaacucugucuccaggucauugagaaggcucauaacaaugagcuagaacccacuccaggaaacacauugcgucagacauuugagaaucaagugaaucguauucucaaugaugcucgagacaaaacuggcuccucugcacagaaaucccucucugaauauaacaacuucaagucuaugguggugucuggagccaaggguuccaagaucaacaucucccaggcaagaugcuucauuuuccagauauguggccuauaccagaguuuguaaagaggaugguauguacauguuuuggugugaggaaagauggaaaaaauaguagggaauugucaccaccaccaccacugcugcagugucauggcuugaaacaagauucacucacguguaaaagaccuuuuuuaaaacaaaacaaaacaugguuuugcuguguagcccagguugagugugaacuuuguaucuuucugccuccucuuuccaacuuuagguuucaggcaugcacuauuucugccauaaauucauacuuuuaaugcuaggggaaaucauaugcagccuuuccccccccuuaggucauugcuguugucgggcagcagaauguagagggcaagcggaucccauuuggauucaagcaucggacucuuccucacuuuaucaaggaugauuaugguccugagagccgaggcuuuguagaaaauucauacuuggcuggucucacacccacugaguucuucuuccaugccaugggaggacgagaaggucucauugacacggcuguuaagacugcugagacuggugaggccuuuucugagcucuuguggagaugggaauggggauucuccaucuaaaggugaauuuuggucucugcauuuugagcuuugucaugcuuuuaccucaggucuuucaauuaauucccuuucccaggguauauucagcgaaggcugauaaaguccauggagucggugauggugaaauaugaugcaacugugaggaacuccaucaaccaggugguacagcugcgcuauggagaggacggccuggcaggggagaguguugaguuccagaaucuggcuacacuuaaaccuucuaauaaagcuuuugagaagaaguaagaaagcgggaaaacagaugauucacaccccugggucuuagugccuucccugaguuacaggauucccuuuagaaggugaccucauacaguuugcagcagacguacuugacuuuuagcaccaucguuucuccacccauuugaaauagaugcugcaugggaaaagaguggauauagaggcagauuugaagucucccuaugguaguaaaaaagagcagagaggaacagauagguacaagccuagguuccauuagccguccuguuccuaguggucuguucccauuuggaaaccucacaguaugccuuaguggagugaaaacacagagcccauuuguccugauuccacccccuugucaccuagguuccguuuugauuauaccaaugagagggcccugcggcgcacccuucaggaggaccugguaaaggaugugcugagcaaugcccauauacagaaugagcuggaacgggaauuugaacggaugcgugaagaucgggaagugcucagggucaucuucccaacuggugacagcaaggugcauagaagugugaaaugcuggacucuagucugaggguccugcuguugaacugucauccuaauggauaauccucccauuaaucccuccucccucaggugguccucccuuguaaccuucugcggaugaucuggaaugcucagaaaaucuuccacaucaacccucgccuucccucugaccugcaucccaucaaagugguagaggguaagcaaauggaaaagaaaaaaaaaaggacaugaccaccuagguauaauggaggagaaagguuauuguagauuaagggggaguauagccaaaggcagauacaucugggugaguccgguggucaugacccugagccauguaagaagugagagaggggagccaaguucagcagccacgaggccaacagaaccaaaggaguaguacccaaaaugucaggauuacauaggaaagagccagccagccagccauaccuuguaacagguauggacugagggaugcugggagaacccacugaccagguuugcugauagguuaaguaggcagcucagcuuuuguaaguagugccugcuuugcugucucaggacuugacuggaggauuagacucugcuauggcuugguauaaccaucucuuugccucuccauggaccccaggagucaaagaauugagcaagaaguugguaauugugaauggagaugacccacuaagucggcaggcacaggagaaugccacauugcucuucaacauccaccuaagauccacacucugcucucgccgcauggcugaggaguuucggcugaguggagaggccuuugacuggcugcuuggggagauagaguccaaguucaaccaagccauugugaguguugcacuucuccuuagccuugauuuuuauucuuuuguuuauuggcgucuuugguuacuaagaauagcccauuucacuggagagauggcucagcgguuaagagcacugacugcucuuccaaaggcccugaguucaauuccucgaaccuacauggugguucagacuuauaaacuccagucacaggaucugacacccucuucugaccucuguggccagcauauacaugcugcacagcauauauucaggcagaacauccauacacauaaauaaaguauucuucagaaacaaaaaauggauuuagcauguuauagaaucuuuucuggguguucagcauauuccaaagugaugcauagugauagguuaaaaacugaagcccuuguaaaggaaauaguguucuuuccuuugcuacacucaucuuccccaagucccuuuauaauuaacagauaggcucacccuaacugcaucccaugacuugcaagauagacauugucugaugccaguuuuccuauaggcccauccuggagaaauggugggagcucuggcugcucagucucuuggagaaccugccacucagaugacccugaacacuuuccacuaugcugguguaucugccaagaaugugacgcugggugugccucgacuuaaggagcuuaucaacauuuccaagaagccaaagacuccuucacucacugucuuccuguuaggucaaucugcacgagaugcugaaagagccaagguaagaaucaggauaauggacugccuagcaagaacagguuggaucaggaaaugaugauaccucugaagaguucacuaggccaaaagcccagugaccccaguaccaugucaugagucacugucucuuccuaggacauucuuugccgcuuggaacauacaacauugaggaaggugacugccaauacagccaucuacuaugacccuaacccccagagcacagugguggcagaagaucaggagugggugaauguguacuaugagaugcccgacuuugacguggcccggauaucucccuggcugcugcguguggagcucgaccgaaagcacaugacugaccggaagcuuaccauggaacagauugcugagaaaaucaaugcagguaaggcugaguagacagcccacauggaugucccaccuagguuucuacuacuuucauggucacuuuauuggaguccuuagagucaccuguaaacaccucugcucuccaacagguccuuuucaggaucauuaaacccuucaaguccucucuguacuuccuuccuucccuucccaagguguuuuggguuugguuuggcuguuggaacccacuguguugucugagcuggaugaccagugaaucucuaggcuccauccauccaccugucucugucuccucgugcccucaugucacugagguuacagacagucuauuaaauguacucuuucucaugggcauuacuauuccuaccagguuuuggcgaugauuugaauuguaucuucaacgaugauaaugcagagaagcugguccuucgaauccgcaucaugaacagugaugaaaacaagaugcaagagguaaauggucugagacccgggggaaauaaaauagaaugggauguaaugcugugauuaccaguguguggcaucugcaguuaggugauucugaucuuagcuacuucaagucaagauggugggagaauggaguuacuuuagagagaguugcagcuggguaguuaaagaaggaaaaguccaaauuaaugaguaaaaagucuuugaaacaauaaacaggcaugccuguaccucagcauuagggagagucaguuacuauaaguccacuuaauuagaacaaacaaguuuuaauacugaccuaauauuuauuuguauaaguacagcaagaauuuuaaguuugguuuuguuuggcaguacucagagauagaggcaguugggucuguugaguuccgggccaaccagaauugauccauugugcccgugggggacugaagaggcuguuuaucaccuagcacugcaguuacagaugauugugagccacuauguaggugcugguaaccaaacccaaaugucuuuagucacugagccaucucuccagccgcuucuuggcuccucaguguuaacucauauuucuggucuuaaauaaaucuuuuuuuaaaaaaaaguuuauuaucuguaaguacacuauaucugucuucagacacaccagaagaggguaucagaucucauuacagaugguuauaagccaucaugugcuugcugggauuugaacucaggaccucuagaagagcagccauuguucuuaacugcugagccaucccuccagcccuggucuuaaacucuugaucuucugccaucaucuccccguuauuaggauuauaggugugcuuuacaauaccuggcauagagaaaaugauuaugaaaguaauaaaucuugauaaauuauacuauauuuccacuaugcacaaguacauacugcacagugugugggacacugcacaaggacugugcaggcaaaagcucuugcugccaauccugauggacuaaguuugagucccaggaaccuauaugguugagagagagauaacucuuauugcgaguucugugacuuccauauuugugugugugugcauguaggggcuucagagaugacucacugguuaagaacuccggcugcuuucccagaggacucaaguucauuaauucccaguucccugguacugguuuacagagagacucugauacccucuucuagccacucuugggcacugcauacacguggugacacaugcagacgacauucccauacacaaauaaaacucuucuuuaaaaaaaaaagucaacuuuuaaucccagcacaauuaguuuaauuuaaaauacuuuuuaaaaguggaaaaugcauuuugguuguaggguguagugccucuucuguuguaugaacaccuuucauuccuaugcaggaugggguucaggaaccaguuuauccucagcuaaaaagaggaggcuagggacuaaagagguggcucaacagcuaagaauacucuuuuuuggguuuuguuuguuuugagacaggguuucucuguguagccuuggcugucucacucuuuagaccaggcuggccucgaacucagaaauccgccugccucugccucccaagugcugggauuaaaggcgggugccaccacgcccaguucaguaauuaaguaauuaauaauucuuagucuuuacagaggacccagguuucauucccaacuccagacacauaauugaacacagacauacacacaaacaaacacucacaaacaaaaaguaaaaauauauuaaugucauaaaagcuaagggcuuuagugaagacaaggaagcaauucuuucuuggccaauuguaguuuggggagggaacagaggaaaucacaggcuuacugaccucacucuuguugcaggaggaagaggugguggauaaaauggaugaugaugucuuccugcgaugcauugaguccaacaugcugacagauaugacccugcaggguaucgagcagaucagcaaggucagcauccguucuacucuggccaccugcccgccugcucuugccccuacucagccugacuagagcuugccucgucucuccagguguacaugcacuuaccucagacagacaacaagaagaagaucaucaucacagaggauggggaguucaaggcccugcaggaauggaucuuagagacggauggugugagccugaugcgggugcugagugagaaggauguagacccugugcgcaccacguccaaugauauuguggagaucuucacggugagagcccacagagcaugaugccuaagucucucuaggaacuccccgcucaugguuuccaugcuuaggcuuucugucuggauccauugguuuuuuaguuugggauggacugcccccgauauccucccugccagucuggguagugaccggaucagggagaugaacugagcuaacuuggugugacuuccuuucaacucuggcagguacugggcauugaggcugugcggaaggcucuggagcgagaacuguaccaugucaucuccuuugaugguucuuaugucaauuaucggcauuuggcgcuccugugugacacuaugacaugccguggccacuugauggccaucacucgucauggggucaaccgccaggacacuggaccgcucaugaaaugcuccuuugaggaaacgguacugacaaccuuuucccggccugguuuuuagagauagauaggacuucacugggccuuuccuagccuuagacucuuaguaauccccaggaacccuguccugucacuaaagcucucugaaggguaagcaugagucaucaugcccagcacuaaggacaggcuuauuuuaucaucauuuguguaggggagaggcagggucuuacuauguagcccuaacuggaacucacuguggagaccagguuggcuuugaacucacaaaguuccuucuguuugugucucccaagugcugggauuaaccaugccugaguagauugaaagaagggagcuugucucaguagugagcgugcaggccuuuggcacugcuuuccacuguugauuguugggcaggaugggugcugugggugaugggugcugugggcagggagauuaaugucucuucugguuguucagguggauguccuuauggaagcagcagcacauggggagagugacccgaugaagggagucucugagaauauuaugcugggccagcucgcuccagcugguacuggcuguuuugaccuccugcuugaugcugagaagugcaaauacggcauggaaauccccaccaauaucccuggccugggggcugcuggacgugagugugugggcuuucagcugugucaagcuggcugggucaugcuuaaggguagacauacaagggagugcgugccuuuagccccgagugcugcuccucauaaaccacucugggcucuuugcagcuaccggcauguucuuuggcucugcacccaguccgaugggaggaauaucuccugcaaugacacccuggaaccagggugcaacucccgccuauggugccugguccccgaguguuggugaguagccucguccaggaagagaagcgucggacuucguggguuuggggcuggggaagggggugcuagagcuccugcugacgcaccuguucuuccuucagggagcgggaugaccccaggagcggccggcuucucucccagugcugcaucugaugccaguggcuucagcccagguuacuccccugcauggucucccacaccaggcucuccgggcuccccuggacccucaagcccauacauccccucaccaggugagcugcuacaccauuuccuccuuccuccauguuuguaugccgggcucuucaccacuauuucccuuugucuuuuccuauagguggugcuaugucucccagcuacucaccgacaucaccagccuaugagccacgcuccccugggggcuauacaccccagagccccuccuacuccccuacuucaccuuccuacuccccaaccucuccaucuuacucuccaaccagucccaacuacagcccuaccucuccuagcuacucgcccaccuccccuagcuacucgccaaccucuccuuccuacucccccaccucuccaagcuauuccccaaccucuccuagcuacuccccaaccucuccaagcuauucuccaacaucaccuagcuauucuccaacuucucccagcuacucaccgacaucuccuagcuacuccccaacuucucccagcuacucaccaacuucaccaagcuauucucccaccucccccagcuacucaccgacaucucccagcuacucaccaacuucuccaagcuacucaccaacuucuccaagcuacucacccaccagcccuaacuauucuccaacuagucccaacuauaccccgacaucacccagcuacagcccaaccucacccaguuacucaccuacaagucccaacuauacacccaccagcccuaauuacagcccaaccucuccaagcuauuccccaaccucacccaguuauucccccaccucaccaagcuacucccccuccagcccacgauauacaccacagucuccaaccuacacaccaagcucaccaagcuacagucccagcucaccaagcuacagccccacuucacccaaguacaccccaacuaguccuuccuacagucccagcucaccagaguacaccccagcuucucccaaauacucaccuacaagcccuaaauauucacccacuucucccaaguauucuccuaccagccccacuuacucaccuaccaccccaaaauauucuccaaccuccccgacauacucaccaaccucuccagucuauaccccgaccucucccaaguacuccccaaccagcccuaccuacucgcccacuucucccaaguacucgcccaccagucccaccuacucacccaccucucccaagggcuccaccuacucucccacuucuccuggcuacucacccacuagccccaccuacagccucaccagcccagccaucagcccagaugacagcgaugaggagaacugagcgaacagggcgaagagcugguuagggucagacaaccucgguggccugugugucacuucccucaccucacaggcugugacccuacccugggucccuuguacauaacuccuugugacaaaacccucuggaaguucuggaccccauuuuugauaggcuuuuuugucuuguccucuacucaugcugucuuggacucacugacccagcugcaggguuuuguuacccugccaguccccugccucacuccaccaugaaggucucugcuuuccugugacuugauugggauacaggcauuuaacuuuggaaggcuaguuuggugccugcucugggucauacaccugaucuggaagaacaaagcuuaagcugccuuuguuauuuuuugaaauugaaauaaaguuuacuaauuuugaccaaaag

SEQ ID NO: 6118 - RNA, 9334 nt, Mus musculus
gcacagaaaucccucucugaauauaacaacuucaagucuaugguggugucuggagccaaggguuccaagaucaacaucucccaggcaagaugcuucauuuuccagauauguggccuauaccagaguuuguaaagaggaugguauguacauguuuuggugugaggaaagauggaaaaaauaguagggaauugucaccaccaccaccacugcugcagugucauggcuugaaacaagauucacucacguguaaaagaccuuuuuuaaaacaaaacaaaacaugguuuugcuguguagcccagguugagugugaacuuuguaucuuucugccuccucuuuccaacuuuagguuucaggcaugcacuauuucugccauaaauucauacuuuuaaugcuaggggaaaucauaugcagccuuuccccccccuuaggucauugcuguugucgggcagcagaauguagagggcaagcggaucccauuuggauucaagcaucggacucuuccucacuuuaucaaggaugauuaugguccugagagccgaggcuuuguagaaaauucauacuuggcuggucucacacccacugaguucuucuuccaugccaugggaggacgagaaggucucauugacacggcuguuaagacugcugagacuggugaggccuuuucugagcucuuguggagaugggaauggggauucuccaucuaaaggugaauuuuggucucugcauuuugagcuuugucaugcuuuuaccucaggucuuucaauuaauucccuuucccaggguauauucagcgaaggcugauaaaguccauggagucggugauggugaaauaugaugcaacugugaggaacuccaucaaccaggugguacagcugcgcuauggagaggacggccuggcaggggagaguguugaguuccagaaucuggcuacacuuaaaccuucuaauaaagcuuuugagaagaaguaagaaagcgggaaaacagaugauucacaccccugggucuuagugccuucccugaguuacaggauucccuuuagaaggugaccucauacaguuugcagcagacguacuugacuuuuagcaccaucguuucuccacccauuugaaauagaugcugcaugggaaaagaguggauauagaggcagauuugaagucucccuaugguaguaaaaaagagcagagaggaacagauagguacaagccuagguuccauuagccguccuguuccuaguggucuguucccauuuggaaaccucacaguaugccuuaguggagugaaaacacagagcccauuuguccugauuccacccccuugucaccuagguuccguuuugauuauaccaaugagagggcccugcggcgcacccuucaggaggaccugguaaaggaugugcugagcaaugcccauauacagaaugagcuggaacgggaauuugaacggaugcgugaagaucgggaagugcucagggucaucuucccaacuggugacagcaaggugcauagaagugugaaaugcuggacucuagucugaggguccugcuguugaacugucauccuaauggauaauccucccauuaaucccuccucccucaggugguccucccuuguaaccuucugcggaugaucuggaaugcucagaaaaucuuccacaucaacccucgccuucccucugaccugcaucccaucaaagugguagaggguaagcaaauggaaaagaaaaaaaaaaggacaugaccaccuagguauaauggaggagaaagguuauuguagauuaagggggaguauagccaaaggcagauacaucugggugaguccgguggucaugacccugagccauguaagaagugagagaggggagccaaguucagcagccacgaggccaacagaaccaaaggaguaguacccaaaaugucaggauuacauaggaaagagccagccagccagccauaccuuguaacagguauggacugagggaugcugggagaacccacugaccagguuugcugauagguuaaguaggcagcucagcuuuuguaaguagugccugcuuugcugucucaggacuugacuggaggauuagacucugcuauggcuugguauaaccaucucuuugccucuccauggaccccaggagucaaagaauugagcaagaaguugguaauugugaauggagaugacccacuaagucggcaggcacaggagaaugccacauugcucuucaacauccaccuaagauccacacucugcucucgccgcauggcugaggaguuucggcugaguggagaggccuuugacuggcugcuuggggagauagaguccaaguucaaccaagccauugugaguguugcacuucuccuuagccuugauuuuuauucuuuuguuuauuggcgucuuugguuacuaagaauagcccauuucacuggagagauggcucagcgguuaagagcacugacugcucuuccaaaggcccugaguucaauuccucgaaccuacauggugguucagacuuauaaacuccagucacaggaucugacacccucuucugaccucuguggccagcauauacaugcugcacagcauauauucaggcagaacauccauacacauaaauaaaguauucuucagaaacaaaaaauggauuuagcauguuauagaaucuuuucuggguguucagcauauuccaaagugaugcauagugauagguuaaaaacugaagcccuuguaaaggaaauaguguucuuuccuuugcuacacucaucuuccccaagucccuuuauaauuaacagauaggcucacccuaacugcaucccaugacuugcaagauagacauugucugaugccaguuuuccuauaggcccauccuggagaaauggugggagcucuggcugcucagucucuuggagaaccugccacucagaugacccugaacacuuuccacuaugcugguguaucugccaagaaugugacgcugggugugccucgacuuaaggagcuuaucaacauuuccaagaagccaaagacuccuucacucacugucuuccuguuaggucaaucugcacgagaugcugaaagagccaagguaagaaucaggauaauggacugccuagcaagaacagguuggaucaggaaaugaugauaccucugaagaguucacuaggccaaaagcccagugaccccaguaccaugucaugagucacugucucuuccuaggacauucuuugccgcuuggaacauacaacauugaggaaggugacugccaauacagccaucuacuaugacccuaacccccagagcacagugguggcagaagaucaggagugggugaauguguacuaugagaugcccgacuuugacguggcccggauaucucccuggcugcugcguguggagcucgaccgaaagcacaugacugaccggaagcuuaccauggaacagauugcugagaaaaucaaugcagguaaggcugaguagacagcccacauggaugucccaccuagguuucuacuacuuucauggucacuuuauuggaguccuuagagucaccuguaaacaccucugcucuccaacagguccuuuucaggaucauuaaacccuucaaguccucucuguacuuccuuccuucccuucccaagguguuuuggguuugguuuggcuguuggaacccacuguguugucugagcuggaugaccagugaaucucuaggcuccauccauccaccugucucugucuccucgugcccucaugucacugagguuacagacagucuauuaaauguacucuuucucaugggcauuacuauuccuaccagguuuuggcgaugauuugaauuguaucuucaacgaugauaaugcagagaagcugguccuucgaauccgcaucaugaacagugaugaaaacaagaugcaagagguaaauggucugagacccgggggaaauaaaauagaaugggauguaaugcugugauuaccaguguguggcaucugcaguuaggugauucugaucuuagcuacuucaagucaagauggugggagaauggaguuacuuuagagagaguugcagcuggguaguuaaagaaggaaaaguccaaauuaaugaguaaaaagucuuugaaacaauaaacaggcaugccuguaccucagcauuagggagagucaguuacuauaaguccacuuaauuagaacaaacaaguuuuaauacugaccuaauauuuauuuguauaaguacagcaagaauuuuaaguuugguuuuguuuggcaguacucagagauagaggcaguugggucuguugaguuccgggccaaccagaauugauccauugugcccgugggggacugaagaggcuguuuaucaccuagcacugcaguuacagaugauugugagccacuauguaggugcugguaaccaaacccaaaugucuuuagucacugagccaucucuccagccgcuucuuggcuccucaguguuaacucauauuucuggucuuaaauaaaucuuuuuuuaaaaaaaaguuuauuaucuguaaguacacuauaucugucuucagacacaccagaagaggguaucagaucucauuacagaugguuauaagccaucaugugcuugcugggauuugaacucaggaccucuagaagagcagccauuguucuuaacugcugagccaucccuccagcccuggucuuaaacucuugaucuucugccaucaucuccccguuauuaggauuauaggugugcuuuacaauaccuggcauagagaaaaugauuaugaaaguaauaaaucuugauaaauuauacuauauuuccacuaugcacaaguacauacugcacagugugugggacacugcacaaggacugugcaggcaaaagcucuugcugccaauccugauggacuaaguuugagucccaggaaccuauaugguugagagagagauaacucuuauugcgaguucugugacuuccauauuugugugugugugcauguaggggcuucagagaugacucacugguuaagaacuccggcugcuuucccagaggacucaaguucauuaauucccaguucccugguacugguuuacagagagacucugauacccucuucuagccacucuugggcacugcauacacguggugacacaugcagacgacauucccauacacaaauaaaacucuucuuuaaaaaaaaaagucaacuuuuaaucccagcacaauuaguuuaauuuaaaauacuuuuuaaaaguggaaaaugcauuuugguuguaggguguagugccucuucuguuguaugaacaccuuucauuccuaugcaggaugggguucaggaaccaguuuauccucagcuaaaaagaggaggcuagggacuaaagagguggcucaacagcuaagaauacucuuuuuuggguuuuguuuguuuugagacaggguuucucuguguagccuuggcugucucacucuuuagaccaggcuggccucgaacucagaaauccgccugccucugccucccaagugcugggauuaaaggcgggugccaccacgcccaguucaguaauuaaguaauuaauaauucuuagucuuuacagaggacccagguuucauucccaacuccagacacauaauugaacacagacauacacacaaacaaacacucacaaacaaaaaguaaaaauauauuaaugucauaaaagcuaagggcuuuagugaagacaaggaagcaauucuuucuuggccaauuguaguuuggggagggaacagaggaaaucacaggcuuacugaccucacucuuguugcaggaggaagaggugguggauaaaauggaugaugaugucuuccugcgaugcauugaguccaacaugcugacagauaugacccugcaggguaucgagcagaucagcaaggucagcauccguucuacucuggccaccugcccgccugcucuugccccuacucagccugacuagagcuugccucgucucuccagguguacaugcacuuaccucagacagacaacaagaagaagaucaucaucacagaggauggggaguucaaggcccugcaggaauggaucuuagagacggauggugugagccugaugcgggugcugagugagaaggauguagacccugugcgcaccacguccaaugauauuguggagaucuucacggugagagcccacagagcaugaugccuaagucucucuaggaacuccccgcucaugguuuccaugcuuaggcuuucugucuggauccauugguuuuuuaguuugggauggacugcccccgauauccucccugccagucuggguagugaccggaucagggagaugaacugagcuaacuuggugugacuuccuuucaacucuggcagguacugggcauugaggcugugcggaaggcucuggagcgagaacuguaccaugucaucuccuuugaugguucuuaugucaauuaucggcauuuggcgcuccugugugacacuaugacaugccguggccacuugauggccaucacucgucauggggucaaccgccaggacacuggaccgcucaugaaaugcuccuuugaggaaacgguacugacaaccuuuucccggccugguuuuuagagauagauaggacuucacugggccuuuccuagccuuagacucuuaguaauccccaggaacccuguccugucacuaaagcucucugaaggguaagcaugagucaucaugcccagcacuaaggacaggcuuauuuuaucaucauuuguguaggggagaggcagggucuuacuauguagcccuaacuggaacucacuguggagaccagguuggcuuugaacucacaaaguuccuucuguuugugucucccaagugcugggauuaaccaugccugaguagauugaaagaagggagcuugucucaguagugagcgugcaggccuuuggcacugcuuuccacuguugauuguugggcaggaugggugcugugggugaugggugcugugggcagggagauuaaugucucuucugguuguucagguggauguccuuauggaagcagcagcacauggggagagugacccgaugaagggagucucugagaauauuaugcugggccagcucgcuccagcugguacuggcuguuuugaccuccugcuugaugcugagaagugcaaauacggcauggaaauccccaccaauaucccuggccugggggcugcuggacgugagugugugggcuuucagcugugucaagcuggcugggucaugcuuaaggguagacauacaagggagugcgugccuuuagccccgagugcugcuccucauaaaccacucugggcucuuugcagcuaccggcauguucuuuggcucugcacccaguccgaugggaggaauaucuccugcaaugacacccuggaaccagggugcaacucccgccuauggugccugguccccgaguguuggugaguagccucguccaggaagagaagcgucggacuucguggguuuggggcuggggaagggggugcuagagcuccugcugacgcaccuguucuuccuucagggagcgggaugaccccaggagcggccggcuucucucccagugcugcaucugaugccaguggcuucagcccagguuacuccccugcauggucucccacaccaggcucuccgggcuccccuggacccucaagcccauacauccccucaccaggugagcugcuacaccauuuccuccuuccuccauguuuguaugccgggcucuucaccacuauuucccuuugucuuuuccuauagguggugcuaugucucccagcuacucaccgacaucaccagccuaugagccacgcuccccugggggcuauacaccccagagccccuccuacuccccuacuucaccuuccuacuccccaaccucuccaucuuacucuccaaccagucccaacuacagcccuaccucuccuagcuacucgcccaccuccccuagcuacucgccaaccucuccuuccuacucccccaccucuccaagcuauuccccaaccucuccuagcuacuccccaaccucuccaagcuauucuccaacaucaccuagcuauucuccaacuucucccagcuacucaccgacaucuccuagcuacuccccaacuucucccagcuacucaccaacuucaccaagcuauucucccaccucccccagcuacucaccgacaucucccagcuacucaccaacuucuccaagcuacucaccaacuucuccaagcuacucacccaccagcccuaacuauucuccaacuagucccaacuauaccccgacaucacccagcuacagcccaaccucacccaguuacucaccuacaagucccaacuauacacccaccagcccuaauuacagcccaaccucuccaagcuauuccccaaccucacccaguuauucccccaccucaccaagcuacucccccuccagcccacgauauacaccacagucuccaaccuacacaccaagcucaccaagcuacagucccagcucaccaagcuacagccccacuucacccaaguacaccccaacuaguccuuccuacagucccagcucaccagaguacaccccagcuucucccaaauacucaccuacaagcccuaaauauucacccacuucucccaaguauucuccuaccagccccacuuacucaccuaccaccccaaaauauucuccaaccuccccgacauacucaccaaccucuccagucuauaccccgaccucucccaaguacuccccaaccagcccuaccuacucgcccacuucucccaaguacucgcccaccagucccaccuacucacccaccucucccaagggcuccaccuacucucccacuucuccuggcuacucacccacuagccccaccuacagccucaccagcccagccaucagcccagaugacagcgaugaggagaacugagcgaacagggcgaagagcugguuagggucagacaaccucgguggccugugugucacuucccucaccucacaggcugugacccuacccugggucccuuguacauaacuccuugugacaaaacccucuggaaguucuggaccccauuuuugauaggcuuuuuugucuuguccucuacucaugcugucuuggacucacugacccagcugcaggguuuuguuacccugccaguccccugccucacuccaccaugaaggucucugcuuuccugugacuugauugggauacaggcauuuaacuuuggaaggcuaguuuggugccugcucugggucauacaccugaucuggaagaacaaagcuuaagcugccuuuguuauuuuuugaaauugaaauaaaguuuacuaauuuug

SEQ ID NO: 6119 - RNA, 2087 nt, Mus musculus
guuuuuugcuuuaauauauauuuuuuauuuuguguguaagcacgccacagcgaauguauagagagaauaaucuguaggagucgguucucuccaucuaccauauagaucaggcuugguagcauuagccucuaucugcugagcuaucucacugguccuccacaccaguucuuugccaggcauuuguucucccaugguuuuuauucccaucucuccuauuuaccccuguccccccucccccccucaaguuugauuucauuccuccguuugcccuuccuuaucacaacugagguucugggcaguaaugauggcaaugcugcccaacacaaccccugcucccaugaugucagaaggugccacggucucauagagcacguaauacugcagcaugagggcuaccacgaccucagagugcaggacagcacauaccagggcagggugggccuuggugacugcauagcucacacauacaaaggaaaccaaugcaaggagccccacugccaccacacagcuccagcuuagagugucuugggguagcacaggggucugcagcacaaagaggccugguacagagaccauuagccccaccaggccaaaaaggaaggccacaguugguagacaggaagggaaguguagagagcgguaaaucugcagccccagugacagugccaguccucccaggaaagccaguacauagcccagggcuguguagaggccaguagucccuucuugcagugucccuaguccaggucccacgaugaugauuagcccaagggugcugccaaacaggccacaccaggcauagccacugagacccuggcucucgaggcagagugccaggagggcagagcacacgguggaagaaccuuugcggacagugacugcguugccggcaggcaccaccugaacagcacuguaggcgcaaccaaugcugaggacauuaagaauggcauggaggaaggcccgaacccgaacaucaggaggucccagcaguggaucaccacggaacuuaaguaacaaggcaauggggagguggaagaggcaucggaagaugagcagcuccaacgagggcaacugggaggucugguaagccauacgggagaaugggcccacgaagccagcagacaggccuccacccagcagggccacaaacaggccuuugguggcauuggagggcccacagcgauggugauguuuggaggggaggcuggcuggaguggagggcggcgauggcugggugaagucagguagguugaaauagggaugacuggcagccuguuagggagaaaggagcuuggacaggagagcaaccacagcccugggguagggugaguggcaggcugaaaccuuggacccuucaggauaguagaggaacucauaggagcuagaaagggccugaagauggaugaaaugauacagugugggccuugaggaucuaaagcaggaggcagguagugaauaguccuggagccucauguuucucuggguaguuaguuguuccuggguggaaaaaagaggacccagggauacucuguuuguuugaggaaugggaguuagcuucagaugcuguguguauccauaucaugucacaggcuccaggaacuuuuggguccaccauuaugaauuucauuuguuaguaucuccaggaccacugggaacuuuagaggaagaagggaagaggagcaccucgaaacugagugucgcccccacuuuuccccuuugccccaaauacucaccaucucuucuuggacuuccuccucuccuccugggucagguugccugguccccugcagagcuucagccauugugacuggcuuggaguggggcugagguuccuucccuggaaccuucucgagggacuauuuucucauugauuccaacucgguuuucuuguuguugucauuuauuugggggaucgguuuguuucuuuuugguuuggagugagaucugagggugagaggguaaagaggcucuuucugcaggccaggcuauucuggaguucgcuaaguuguccaggcugauuuuagguguguaccaccacugcaggcuuguuuccugucuuuguugcuauggcuccaaguucauucuca

SEQ ID NO: 6120 - RNA, 5651 nt, Mus musculus
cuccgguuguauaaaucaucuuuaauuacagaaagcaugaaguggagaccccguccccugagagcagugccaggagaugggcggagccugagcgggguuuguaugagggaggggggcaucucuugcaacaagccagaaguaaaagggccugaggaaaagugaccugucuuugagcacuagccccucccuuaggaccucaauagacguuuccaccuacaucugcuagacucagaaucuaccuccuauuuuacuagagguuccccauggcuuucuccguuuuucagguccuuuuuggguacuuagaacccaccugagguuuaaaagcuguaaaguaaaguaaauucuauuuaguuagaagcucuggggauacauaugaggucugggagcccaagaggcuccucguuuccuaagccugaccuguagagggcucggagaaguugaacuuauugcugaguugggggucucucugcugugagggggagucaaggcugugucccuauuuguccuuuuuaauucuagaguuauucucauuguagaccuuagcuuccuguuguuugagacagggucucacauagccuaggcuggcccugaccucacuagguagcccaggcuagccuuuuauuuccugauucuccuccucuccuuuaccucacagaugcagcauaccauaucagaacgaaaguccucagcuuuaaaagggaucuggaaggaauuccugcugagguagcuaaguguucagacacagguucaaucauaccauggcauuuucucccucucagcuucccuucuaggagccagguauauucuuccagaauuccuguaucuuuccccagacucuugucucccuggcagaacccuaguuggaaugcugaaacuagaaaccauguaaaaguaagguuaguauucuggagggacuauuuuuagaaaauuauuuaggaaaagcaagaagugguucuugauccguucaguacugauuaguucucucucucucucucucucucucucucuuucucucucucucucucuguguguguguguguguguguguguguauguguguguguguauuggcuuuugagacaggguuuugcuauuguagcccaggauggccuccaacucaggaucugucugauucagccucccgggugcugaauuacaggugugugccaccaagcacagcucagagccaaucaguuuuuaauuaaucauagcugaguucuacccauagcucauccuuuaauugcuagagaaaguggaaggguaggucuagaacuuacucuaguacaauaauauggcuauacaggcccuagcuccauccgggaagaaagggcugagagucaugggcuauguccuagaacugagauucaggaggaaguauggcuccagaaaggucuagaauaccacguucuagaauugggugucucugggauaagaagguuuaaucaguggugaccugagacuggucccaauucagaccaaggccaauugcuacaguagggggccucuuuuuuaaagccaggggugggagguguccaucuaggacaaggauagacguggaaaggauacauacuuggguuccaacacagaacauagggauggcccugccuggcuggggugaccagcucuaucagaaccuguccagaccaagucagaagguagagcagagagagaaggagaugcauucugagugccaguggaccgaccuagaaagcuauggcuucgagacgaugcaaagaaggacauggcuucagagacuggcucagccagggugaagaguauuaccuuccugccuugaguguuggaaccccggugccuuuuaggaaaaaaaauggguguucucuuaagggguaggaauuaguguggaaaaaagagaagugaucaggcagggucaucucaggcacccccaucuugggaccucuccugggccccaggaucuaagagcucagcaacuccggaggucccugacagccccgaagcucccacagggugcagcaccugcugagaccugacugcucagggcauguguguggcaacaggggugagagcggcaaggcccggcgcagggcuaggacacaggauguggcgguggcugacucacuggaagagcagggagccuccaguccagggacuauaucucagugggcagggggacuggaaggggaggucucaggaacacuguggagagaaggcucccgguacauggccacuguggaggggagagagagagaggagcaaggaaggagaauuaggcacauagggagccaggaagaagcagagcucugagaggccucccuucucuuacacucacccuuagagaaccccaacccaaaagaagagagcuuccuaaccccccaaaggccaaagccuuccugccuccaucugccauaacaacaucuuguugaacauuuauggccugcccgagcuaugugucauuaaguguucaugucaaggucaaugcccucccacgugacccaccuuuucuggagcccauacccacccuccaggagcuugggcacaaagugggcagcugccuuggucuucuugacucgguuucccuucaugacccggccuuccuuguccaggccuagguaccaggcccggccagaacgacgcugacgguagagagcagaggcauacaggacauaguaauucucaaagacgcacuccuuaaagcgacacucugcugugaaauguggcugaggagacagauucagaaagagguguggacacacaacacacacacacacacacacacacacacacacacacacauacacacacacacagagagagagagagagagagagagagagagagagagagagagagaucacugguagaauggagcccuugggaagaaacagccaagauauaauccauacaucauuuggaaaggaggacggcagcuacucaguccaugcagcagccagaacacagagagaauaggaagaacccagugaaccacccaggggcaggaucuaaauuuacaggggcacuagaaauaagauuucuucucuucguucccaaccucguauuuauccggaggaaagaugagguuugaaggcugagaggugccacuguaauagcuggaagagucaggcauccaaagagccugggccccuugagggagagugaacucuagagggggaguucuggacuaggcccuagacaagccaaaacaggaaggacagaguccuggguguaagccauguguguagcaaaggaugauuaugugcugaggguguccccagucguccaggccacucagccucauuguccucuuaccgagcuguacaauagccccucagcguucauggccauguagugacccagcuuggcacucuggauggugaccacacggagucccacaggaaucagauugaagugggcuggggugggggugggggaguggaaagcaagcagucaauacccaaguaccucauuuccaucugagccccgccccccaacuccagccucacugccucccuuggggcccaagaagacaaauggaaggcagccaagccugaagaggugauaggcuugucaucuccuguccccaucuccccacugcccacccugcagcuggugucccuucucacugaaggagcugguguccucuggggugcccuggauacucccaucgggauucgccuggagguagaaacccuggcggcagaacaguuuggugacgaugccuuugagcugaggcucuggagagagagacauuuaucuuugaaaaugacaucucuguucccagaaacauuccuacacuuggcgggaucacaggaaagaagaaaggggaaaugaagagaagaggguuccagggccccagcuccuuuacccuucaagcaagcuucccuccaccucgcuuugauuccugaggaagcuggggugugggucccuuccgcuuucucuaaucaugagcgucagcuuaauuuauugaaauuuauuuaaaugguuuaauuccuuuucccuaccagaguugggggcggggaggagguagaagagagagagagagagagagagagagagagagagagagagagagagagagagagagagaaacggacagugccagaaacgcagggcaauguguuugcaaaugucggggugagcagcaaggugaccacagggaaggggcucccccucagaaguaggggugggacugggcuugacugacgcugacucagcaccugcugcugcagcugccgcucgcuuggcgcgggccuugcucuggcacagcgccggccugucugacacugacccaucugucugucugucugucagucagucggcuggcucacgaggguccaguuuucccugagacugagcuucuacccuucagccagguaacuggccugggaugggggacauuuaaaccacaucaaggaaaaggaagaggggacagagauggagaggcaggcugcaucacgugggggcugggucccacucagagggugggcugcggacuguaccacuaccuaccguugguggugggggaggagggcacaaggggcuaccccuaagggaaccggcagcggccuggagcgaggccagagggacucccuaacugucguaccuggacgggaaucacauaccagcccuuacaucucuccucuccugguggggcuugcucucugccgauuucccuguucccccuuguaagugguacgaccccccgcuuaagucccugugcaggucuucagcuugaacuaugugugaguuccuacuggcugaggguccccggagccugugggacuggauuuccgagucacacaggaguaaugggagggggugcccagcacccuucucgaagcgcaggucacagaaggagggcguacggagggggcugacugacgagguagccugcaaggacacccgggggagagcuggagagauuggcuccuggccaggcgagcucgaccaggaagaacagagccaaagcguggaggggcgggagagccggagcgggggcggggcagccagggcugcagaaacccucggggugacccaagcguccagaaccccucaagccccgccacuucggauggaaagaaucgcgagaacccgcacguaggcgaagaaccgugggggguggggaguccugugcugaaggggggcugacaggagcagagaagcuuggggcgccagacuucgccccucaaaccuucccccugcccucgaaagcaaggagacucggcauuacaggcaaagaggaagaaccugaaggauagucccguaaauucugucguucuggcccaccucuuccacuucugggacaccccccuccucaucgggcuucaaucgucagggucccuggccucaggcaggacuucugugggagaccccgcccuagccacacucaccugggccgcgguccugucgcgugggacgccccccgcacagucgcaccuuggacagcaggaugaggagcuguuucuggcaaagugacuugguaccgcggggacacacgcgccgcugcgccgacacgggccggcugcccccgggcucgcggaccucccgcuucugucggaucaggcuacuggccaacgccgccaucgcgccccgggaggagacacccccaaaccagcaggcucccggagcgcccugggcuccccaagaggagcccucucaccagggcaugcucagga

SEQ ID NO: 6121 - RNA, 808 nt, Mus musculus
agccucugucgccgccgccgccucagcuucccacagccgcugccgcugccuccgccgcucugccugguccaaccuccaggcccagugcucugacuuugccgaaccgaggcgcucugcagagacauccuuacuccuuccuggggguccgggacgcuuaggccgacguuggggggaaaccuccgcuugcgggugacagggagggaggagccuggagcuggagcucgcggcacccgucgcccggaucaacaggacaggacagguugaggggcgucggggaaaggaagggguguuauagcagucccagggaggacgagaaagcccuggcgcaggaagcucugaugcgcugugacuuauuaagggccuguucacguuugaggaguguugacaacgugggugcacuccucucuugggggccuuguuagauuggagggugugggaucuaagcagugccaguuguuccucgggaaauuuaaggggcaacuagaaaacagacagaaacggcggaugcuccuuuuuucggggcgacagaggguccugcagacaaccaccuggugucugcacuaagaaggguugauuuggaggugacuucaaaaggaguggaggguagcaaggugagggaaugguguuagcagcugggacucugugguacuagaaaugggggugacaaugagaaaaagcauuauccagccagggggccugggaaccccuuuucacugaaccuaaacagccugaauuuugagucauauuugcuggcagaggggggauuugaagaaagugggagacccacuccauuuagaguauagaaaag

SEQ ID NO: 6122 - RNA, 3007 nt, Mus musculus
uaaaagguaccauaugucuuuaaucucagaacucaggaggcagaggcaggaugaacuguuugagaugcagucagucaggucuacauagcaaguuccaagccauccagaggugcacagugagacccagucucaaauagcuaaauaaauugaagggauaaaaaggaaaacaaacaaacaaacuacagcuuccaguaggcacuacuuugaaacaacggaaaggguguguaggcaccgcugcaccuguaucguggaacacaaacuacaacucccaggguaacaacaucucagcagggugagaggcgugacugaacgaacucucacaggaggcggaaccaguccggagccacccagacagcuuccagaaagggcguggacaugugaccaccaggaaguuaccuguagaaucuuuuauguugcuuucuguccaccaccuuugaagcuaccccuucaucggaaagccgcggaccaauaagcccuucucaaaaagagguaaagggaggugggcaaaggcucgugguaaagauuggcuauuguauucccaggagggaccaaauagccuuuuuuuuuuuuuuuaaccugcugagucaggugaaccgauuuaccguggggcaaccugcuuagaaaaaaccgaaggcaauagucauuuguucaucaggaagacuaaauacagaucacaucaucuccaagacccacuuguggccugucuguaacccuugaucugccucagagggaggggaaaacuggacaaguuuggggccgcaaaagaaaggccugccaaagcuaacugcaccaaacgcuagcgaagcauggcuuccaccgucugggggggugcccccugguggggaccaccgcccccagccccagcccggccucucacagacauagauuucugcucgggcgcccagcugcaggagcucacucaguuaauucaggagcuccguguucaggagaguuggagugaagggcccaagccuggagcugaucuucuccgagccaaggauuuugucuucgcucuacucgguaagugugggaauuugcaaaccccagccucgccauuuccugccccgacuuugaaccaggauaccuucacgacccuuucucuucuuuaggucugguucaccgccaagacccucguuuuccaccccaggcagaacucuugcugcuucguggugggauucgcgaagguucccuagauuuagggcacgcccccuuaggucccuacucccggggaccucauuaugaugccggcuuuacacuccuugugccuguguuuucucuggauggcacugggcccgagcugcuacuggaucuggaauccuguucugcauggcuccgccuuccagaacugaugcguggaauuuugguccgggaggccuggcaggauugcuuaggaccuccugucccagaagaaagugauaugacucaccaaacccauagcaaagagagucccaccgaccgggaaaacucuguagauccgucacaugauuaugucccugaaccugagccacacaugucuuugcaaaaaucaucuagugaccuuucagagucccaaucgucuuauaaggacauuaccaauccugaaacuccugagccauuggaaacacugagcagcgacgccuuggacgccgacgaaagccaagucccaaagccgucggaggcuccaaaggcauggcccacauuaugcccgacccaaguaacuuccugguucuucguuaaguuggcugagguugcugagucccugaucccggucccaggcgccccacggcuaguucaugcagcucgucacgcaggugucaccacgguccuccuggcaacuccagagcccccacgccaccuccugcucuucgacuugaucccgguggugaccgugacaggcuggccugacacggcucggagccacucgugggcggguccacuggucucugaaucggccucuuucuaccuagugccgggcagccucccagagcagccgagcaccucuggauggcagcugugcuucgcucgccaggagcuggcgcucaaagagcgcauccccacgccgcugcuucaggcacacgcggcggcccaggcgcugcugcgcccgcugguggcggggacccgagccgcugcgcccuaccuccugcggaccuugcucuacugggcgugcgagcggcucccggcgcucuacuuggcgcggccggaaaaugccggcgcuuguugccuugggcuacuggaugagcugagccgagugcuagaggccggggcgcugccucauuauuuuuugagcggccgaaagcuccgugugggagacggcuccgcugcucugcgcggggcauuggcccagcuccgcggggacccugcacaggccuugcgugaggcuguagaggaagccaagguugcccgcaaagggggcgguuuagcgggcguagggggcgggacccauuaaagauuuuacuccuaagggaauggaaaguguuuccuuuggugagagggucaugcaggggacugcugcucccuccauacagacaguguaugcuuggguccaaagucccuuuucuaaaagguuuccccaguauucuacccugccugaggcccaaguucucuaaaucuggcuggcgccccuucugucccgguacugccucccggaaccucucuccccuauucuuucagagucugacagggauaguaggaauguauuuacugacaaaaugcgggaaggaacugguuuuuggaaaccuaguucugaucaauuggcucauaccaaaccagagauauuaaggccggaucacagcccagacuggauggcacagcuaccgguuucuccacuuuccccccaacucuccucguccauuucuguccucacuuccaucccaggcaguagaaucccuuuucauuuucucucugucggcuauuccaucgacccccugcccccagccccgccauaucaggcuccgugucuccucuccucugaaccccgagauuugcaggccuugccucuacuccgccugccucugugacaguucccacu

SEQ ID NO: 6123 - RNA, 3244 nt, Mus musculus
acuauuccauuuuauuuuauuuuguuuuauuuuauuuuacuuuauuuuauuuugacaaggucucacuauucaguccucacuaccuagaacucugugcagaccaagccagccuugagcucacagagaucagccugcuucuguaccccaagcacuaagauuaaaggccacgcucagcuuuucccuucuuuuaaaagagucaaagggcuggagagacggcucagcgguuaagaguacuggcugcuuuuccagaggaccugaguucaauucccagcaacuacacgauggcucacaaccauccauaagggaucugaugcccucuucuggcacacaaguguacaugcagacagagcacucauuuaccuaaaauaaaucuuuaaaaaaaaaguguccaguuguuccaucuccugacauuuccaagccauagcuucucucaaaugaucagagaccuuugauuccugggaggcagaggcagguggaucucugaguucaaaacuagccccccugauagacauagugaguuucaggccagccuuagcuagacagugaggcccuagcucaaguuagauaaaaacagaaugaagucagaauuuccuuuaaagagccuugucuaagaggccauggagccucaaaacuggaccgaaggaaauguucauuauuuacuguucggauccaaccgauuauucuucaauuccaaggaguguuuguguaggacugauuagacagaauaauauacugucuccagcuggguguaguggcaggaaccuguaacuucucucaucaaggaagcugaaauaggaagccugcugugaguucagggucagccugggcuacauggugacuccaggccaucuugggcuacauaagacuuuguauaaaagguaccauaugucuuuaaucucagaacucaggaggcagaggcaggaugaacuguuugagaugcagucagucaggucuacauagcaaguuccaagccauccagaggugcacagugagacccagucucaaauagcuaaauaaauugaagggauaaaaaggaaaacaaacaaacaaacuacagcuuccaguaggcacuacuuugaaacaacggaaaggguguguaggcaccgcugcaccuguaucguggaacacaaacuacaacucccaggguaacaacaucucagcagggugagaggcgugacugaacgaacucucacaggaggcggaaccaguccggagccacccagacagcuuccagaaagggcguggacaugugaccaccaggaaguuaccuguagaaucuuuuauguugcuuucuguccaccaccuuugaagcuaccccuucaucggaaagccgcggaccaauaagcccuucucaaaaagagguaaagggaggugggcaaaggcucgugguaaagauuggcuauuguauucccaggagggaccaaauagccuuuuuuuuuuuuuuuaaccugcugagucaggugaaccgauuuaccguggggcaaccugcuuagaaaaaaccgaaggcaauagucauuuguucaucaggaagacuaaauacagaucacaucaucuccaagacccacuuguggccugucuguaacccuugaucugccucagagggaggggaaaacuggacaaguuuggggccgcaaaagaaaggccugccaaagcuaacugcaccaaacgcuagcgaagcauggcuuccaccgucugggggggugcccccugguggggaccaccgcccccagccccagcccggccucucacagacauagauuucugcucgggcgcccagcugcaggagcucacucaguuaauucaggagcuccguguucaggagaguuggagugaagggcccaagccuggagcugaucuucuccgagccaaggauuuugucuucgcucuacucgguaagugugggaauuugcaaaccccagccucgccauuuccugccccgacuuugaaccaggauaccuucacgacccuuucucuucuuuaggucugguucaccgccaagacccucguuuuccaccccaggcagaacucuugcugcuucguggugggauucgcgaagguucccuagauuuagggcacgcccccuuaggucccuacucccggggaccucauuaugaugccggcuuuacacuccuugugccuguguuuucucuggauggcacugggcccgagcugcuacuggaucuggaauccuguucugcauggcuccgccuuccagaacugaugcguggaauuuugguccgggaggccuggcaggauugcuuaggaccuccugucccagaagaaagugauaugacucaccaaacccauagcaaagagagucccaccgaccgggaaaacucuguagauccgucacaugauuaugucccugaaccugagccacacaugucuuugcaaaaaucaucuagugaccuuucagagucccaaucgucuuauaaggacauuaccaauccugaaacuccugagccauuggaaacacugagcagcgacgccuuggacgccgacgaaagccaagucccaaagccgucggaggcuccaaaggcauggcccacauuaugcccgacccaaguaacuuccugguucuucguuaaguuggcugagguugcugagucccugaucccggucccaggcgccccacggcuaguucaugcagcucgucacgcaggugucaccacgguccuccuggcaacuccagagcccccacgccaccuccugcucuucgacuugaucccgguggugaccgugacaggcuggccugacacggcucggagccacucgugggcggguccacuggucucugaaucggccucuuucuaccuagugccgggcagccucccagagcagccgagcaccucuggauggcagcugugcuucgcucgccaggagcuggcgcucaaagagcgcauccccacgccgcugcuucaggcacacgcggcggcccaggcgcugcugcgcccgcugguggcggggacccgagccgcugcgcccuaccuccugcggaccuugcucuacugggcgugcgagcggcucccggcgcucuacuuggcgcggccggaaaaugccggcgcuuguugccuugggcuacuggaugagcugagccgagugcuagaggccggggcgcugccucauuauuuuuugagcggccgaaagcuccgugugggagacggcuccgcugcucugcgcggggcauuggcccagcuccgcggggacccugcacaggccuugcgugaggcuguagaggaagcca

SEQ ID NO: 6124 - RNA, 1908 nt, Mus musculus
guuuucuggacucuuucucuuuauuccuuucuccacgccuugcgccuuguacacgaucaccuguugcucaguuaaguuucccuguccggcuucuaugcagagagggccuugaagcugagguggaaggcggugguagcgagcuggcccgcccucuguucuccugcaccugccucuucagcuccaggcugucauacaccugguagguggcauugccaccuggauuccgacugaguggaacaaaggugguuggaggugggguuggaucagaaaucuggacuuccgccaagcgcugggaggagugugggaucaucaggcccgagcuggcugguggggcccuuugguaugaagccucacccaaggccguaagggagguagagguggucagaggaugacgagaggggaaaaccucaauccagucaggggcccgccugcggacuucgugagauucccgggagcuguaacccacgugucccauggauuguggugggcugugguuggguuggcugugaguaugacuagagaaguucugccggugggccugggaguuguggucccgguagccuuggaccucucugggguuccuggguacaaaggcaggugguggcucacagccuucugucccgcgccuccacugaucccuggcaucauaagguauguggcccccugaagggaaagagcuauaacccacagugacccaggaaggguuaggaagcagccggcggggaggagguggugaugaggcccacugcucagcuuccacgguaccccaaauccgggacugugaauaaugaggaccgaagcccuguagccucaguucugauuuggccucuacucgcuuaggcaagcggcgcagcucuggugacagguagagggaggguaaugggaggcuggcaaggauuccacccuggcgaccccacagucccacauuggaggccagacggacuggcuuacacaaacuaccccagccccgacgggguugcuuggcaugcgggcaggaaugacccuccggaagggaaucccggucuuccaugucaaaaaagggcauuggccucaucugugacaucuuguggccuugagguuguuuacgaaaggguggguagccacgggagaguggccuguugcgaagucucugcugguggcugaggcagcccuguugcuggcugcuuugguggaucugaagguugcccuguugguagccguagcgccugcggcugcgccugucauuagagcgcuugcaaaaauagugggaagaggaagaggaacacuguguggguugggccaucuucacuuguacaggguccaggauacaguggauguggacguccuggacguuggcugguuggggcucuuuggggggacauucgguaaccuggacuacuucugcuaaaaggcaagaagagccaaaaagaguucaggguuaggaacacuuagugcagauuuuucaggaugagggugugggugugaggcacuguugucuagcauacuuacuuuucugguucauccaaaagaucaucuugucuauggcauucuggagccccugccacaucuggagguggugggaagauaagagugaagaccagcuugcuaauaucauccccguucccaacaaccccacccaugucucuaagggaagccagcuuguagcuggcuuuucuauaaagccuucuucauccccauggaugcuucacaguaaucacugaccgcgguugccacauugaugcugauguugaccagaaugaugaggcccagcagcaggaacaagauguucucagcauccugagggcuuucuugguauugcucgcagcaccucaggguguucugccacagcugguuuuccaugguggggggggguccuaaggccaccugggccaccacccccccacccagcccaacccaacccacacuguu

SEQ ID NO: 6125 - RNA, 852 nt, Mus musculus
ucugauauugaccuaggcccaagggccuaugaccgcuuccccggugacucgagggacuacuccacggagcuaagcgugacuguggcagugggugccucccuccucuuccucaacauccuugccuuugccgcccucuauuacaagcgggaccggcgccaggagcugcggugccggaggcuuagcccaccaggaggcucaggcucaggugugccuggugggggcccccugcuucccacugcuggccgugagcuacccccggaggaggagcuaguaucgcugcagcugaagcgggguggugguguuggggcggacccugcugaggcccugcgcccugccuguccacccgacuauacccuggccuugcgccgggcaccggacgaugugccucucuuggcccccggggcccuaacccugcugccuaguggccuggggcccccgcccccgcccccacccccuucucuccaucccuuugggcccuucccacccccacccccuacugcuaccagccacaacaacacgcuaccccauccccacuccaccacucggguauagggggcggcuuugggaggucugccucccuagcccucccagcccaggccacuugaaggcagggaggaggacuuggcaccgggcuuugcccccguggauuugucagacuucguggagcaguguuaagguggacaugggauuccucacugggaagagaguuuuucccaugcagagagccccauuaucuccucuggaccugggccuucgaacaccugggggguauuuuuugcccuccguugggacaccagucuucgguguguggaaauguggaaguccuuuugcccaugugaagacaugcuuucc

SEQ ID NO: 6126 - RNA, 7772 nt, Mus musculus
ccgcccuuuuuaggauuuaaugcccgccacuugggcggcccccguagcugccucuuccgccuucgccaggugagaguccacaccuagcaggggcgcccgggccugggaccagcgggcucccuuuggggugcgucgcuggaucccuuuucccggauccuucccuucccucucaggauuucuucuuggcugcuuucuccccgcuccucccuuccuaucuguggugcaacacagggccuuuuuggauuugaacuuucuucugcucucaguucucaggccgccuggggugaccaacuccccacgcuccccaccuccaccucccaccucagaccuccgaucuaggacuuccucgugguauaacuacagagagacagguguguaaaagagagucuuugggcaggcagcccggacccagaggccuagagccuuauuuaauaauggcuggugggacuguuugguagcugacuuaggcugaaugacgcaggagaacaccugggcacuguaccuggaacugagcucaaguggguguggaaggaccacacaccuagcagucuaggcggcuuugcgaacaguaucuuaaguuuggcucucggcuuagccuucgauuaacagcccagcccugauaucuguuuaauuuucaguguugcugccucggguguuuaagaagccaugaccaugggcauuacuggggugacgugguaguguguccucauuauguguguuuguuuaugugauccuuggaguuucagauggguggugauauaucuagguaucuuugacuuguggaggcagagaagcguugugucucaaguacaccugugugagggcguguugcaguaugccugcuuuuuguggcagaguaugggaauaucuuggacuugaggcgacauguucugauugucuuaggcauguuuuguaguauaucuguaggucucagugugugugugugugugugugugagagagagagagagagagaggugguagugggugggaggcacugcaccuaguauaccuauguuccugagguaugguguguuagcauaacagggcaucucuaguuuguauaugguaggcaaaaugucucauauaugaagaggggauauguuucaguuguauacgagucaaugugugcugggaacuaaaugggcacaguauuugagggucuggaguucaagggcaguaagccauagggucaaagcaaugguuuucaaccuuugggucacaacucuccugacaaaucccugucuccaaaaauauuuucauuaugauuuuuaaaacuuuuuugguuuuuuuguuuguuuguuuguuuguuuguuuguuuucgagacagaguuucucuggauagcccuggcuguccuggaacucacuuuguagaccaggcuggccucgaacucagaaauccaccugccucugccucccgaguuaaaggcgugcaccaccacgcccggcucucauuaugauucuuaaccaacagaauugcagcuaugaaguagcaaugaaacuaauuuuaugguugagggucaucacaacaugaagaacuauauuaaagugucacagcauuaggaagguuggauaucuugcaucccugggcauuucugcuguguuaggguggcaguugagauucugucucugucuuuggugcuugcccuaggccauccauuuaaagcagucggccauccuccugagacaucugaccccagacaugcucccugaagccaguucccuguggcuccuucggcuacuccgggauguucaacuggcccaguuuuaccggcccauccuugaggaacucaacgucacucggccagaacauuuugacuuuguaaggccugaggaccuggacaacauaggcaugggcaggccuggugaggaaccucugccuuacggcccuguagcuuccccagccuaccagaugcuggcccugcucccccacacuucaggcuugacuguugguucucuguccuccacagcacccccacucuacccucacccucuaauucuggucuuccccagcccagcgcagacuuaaugaagcccugaagagguaccggucaggggucaaguccaagaauuggguguacaagguaugugcuaugguggucguugagggcuuguugaggguggucuuugagggaugauaggccgggccgagugccugggaggguuaaucagggcucccuacucccaaauuccuacuccuauuucagauacuugggggcuuugcucccgaacagaaggagaucccuccacgcucagacaguccucugugcuuccaugagccagaggggggacucaagugucugauuccagagggugcugugcgcagaggggagcugcuggguucaggcugcuuugguguuguacaucgaggguuauggacacuacccagugggcagagugugagugucuaaggggcuuccuuccuuuuuuccuuucuccuuuucuuccucuuucuuucuuucuuucuuucuuucuuucuuucuuucuuucuuucucucucucucucucucucucucucucucucucucucuuucuuucuuucuuucuuucuuucucucuucgccccccgacccccacccccguucccaguuuucuacccacaagggguuugcuuaaucuaagguaccugugcucucuuuauccuuuaugcccucuguucuggcuaugggcaguuacucugggugcuuccuucccccacccccaccuccagaucccaguggcggucaagucccuccgugugggucccgaggguccgaugggcacagaacugggcgacuuccugcgggaaguaucugucaugaugaagcuagagcacccacacgugcugcgccugcauggccucguacugggccagccucuacagauggugagucuauaaggacucugcuuuccucauagccccaggcuugcugugcagcaagaaauaccaguggggccagauuuuggcuuacaugacuuucucuguuccugcaggugauggaacuugcgccacugggcucccugcaugcgcgccugacugccccagcaccgacacccccacugccuguggcccugcugugccuuuuucugcgucaguuggcaggagccauggcguacuugggguccuguggguuagugcaccgggaucucgccacccgcaaccugcugcuggccucaccucgaaugaucaagguggcggauuuuggacugguucggccacugggaggcgcccggggacgcuacgucaugggcgggccccguccuauccccuaugccuggugagggggcguacucugauggucugguuugaggcaggucuggguugaacagggcuagagggccacagccagcauggaacuagagggggcagggcgguugggguguuggggggagggagugguuguuacucuucuacaggaggcaggagagaggugucaucaggucaagaggcacagaaaggauuuuugaggcuaauggaggggggcgggauggagagaguggguacacaguggaaggaaggugagcugggcauagaccuagccacuuuuaacuuccauuuuccucaggugugccccagagagccuacgccagggagccuucucgucugccucugauguguggauguuuggcgugacacucugggaaauguuuucuggaggugaggaacccugggcaggugucccaccauaucucauccuacagcgacuggagaaggaccgagccaggcugccaaagccuccccuguguuccagggcccucuacucccucgccuugcgcugcugggccccacacccugcagaccggccuagcuuuuccaaccuggaagggcugcuucaagaggugagaauuccuaacucuccauauacacauauagccuuucuuccuuguauucucucacccagcguuccaugcagaagacaaacacggcuuggugccugggcuggaaucuggaacucggcucagaaccagguucagucgcuuccugcaggaagugcagaacccugaggcggcagccaagggcugcaaagauguagcuggaagaggugguguuugcuucugggccacaaaaaaggcacagaaacgacaguaguggguuuucacgggugccugacaagaaaagugaaauagauaaauaaaagaaagaaaagagccgggcguggucacgcacaccuuuaaucccagcacuugggaggcagaggcaggcgaauuucugaguucgaggaggcuagccuggucuacagagugaguuccaggacagccagggcuacacagagaaacccugucucaaaaaaaaaucacaccaaaaaaaaaaaaaaaaaaagaaagaaagaaaagagguucagugugggaggggaaagggaagcaacagagcugcagaugugaacaggacuucgucagggagaguuuagaacacuugaccagugugauagacugugaagagccuuacagguauccccggucacucauuuuauccuuguuuaacagcuccaggagguaauuacucuuaaucucuauuuaacagauggggcacuucagccgcugauaggucagugacuuaucgaagucacccaguaaguggaggugcagagaguagcaccacccacgugacuucaccacccacgugacuucagagccgggcccugaaucagcccaucuacccuuagagcacuuuggucuucacucccagggcucuugggagcugcagaaggcuauggcucagaguaguuguuuucaucuagcuaggcuugagaacaguaaggcaaaugauacagacaguggcugggaggcaggagcgagagaaagagcucccgaucggagccgugggccugccccugaggugugcgggaggcagaccuggugggcuugcuguggaacagagugaacagguugcuacucacuggguccccuugaacagagacaagagucuccuuugugguuucuugcaucccauguucagcaugacauggggcccaggucagcaaccccccccccgcaccccccccacuuuggguugcagugggaagggagggaauacguggaguguauuuguuugcuacagaggaagguccuuucucauuacccuuaugacuuagcccagccacccuuuccucugucuccacaggcuuggcuuucugagggacgcugugugagggaggucacagagccaggugcuuugcggauggaacccggugaccccaucacuaucauugagggcaggugacaaccuuaugucccccuaagcaucccccagggagguguucucccagccuucuugacucccggaccccuuuguuuuucuccaacuccuugaauguuggucuugugggucuuuucguuuucccacugcgcccugcaccccggugcagccccacccucccugcuggagcccugccuggcccacagugcccuuuuuguguuggagagaaaaaggcuucccuuccuccgggcagauguggcccgagagcagcugccauucucccugaccccauuuccuucaccagcuccucuucccacagccuggacacugcaaccuggaaaggccagaauggccggacccucaaagugggcaacuuuccggcuuccgcagugacacuagcagacuugggggguucaccagucacccauccagcccacagagguuccccugcccauggagagaaaugcagagggggcacagauggguaaggccaugaaaggguggggggacagaguuggguugggggggacugcuggucaaauagcacaacuucccugggaggaaacuugggaaacaagauggaggagugagaacggaccggcccccaucuggagcuucccuugugggucaugugugggacacauuuuuuuggaaggaggccaugauguggaugaauaguguagaaugaacgagaucacucucucucagggacagagagaaggcaacguuacaagaccuacccccagcacggagccacagaacgaagaugccccugcagaggaugcgagguggguguggugguacccagggucucaggaacaacuuuccaauuccccuucccaacucugaauccguaccuuuguguauaugauuuccuuccuccaaagaugguaaucuuuggacagauuauuuguuuuggcuuuuugagacauaguuuuucuguguagcccuggcuguccuaaacucauucuuguaguccaggguggacuugaacucagagaucugccugucucugccugcccaagugaugggauuaaaggcgugcgcuaucuccuccuggcgcacuuugagauuuaagauuagaggugcuccugauucuccacugggcagcagcuccuggcuuuggcucucacacugcucuuugagccucuagcugucuugauucuguuugcauaccaucuaacacacagacagcugaggacaaggccaaccagcuuaccuaaauauccuugcaaaaucacacagcucagugcagauagucaagagagcagggaggugggccuccuccuauagcauuucuuucucaacucugaaggcauuuccaagagucuggaaucaguucugucccugggcccuagacccacaggaggugguucaaguccuccagaacuucggcguacaagagcuaugccgcaaagacucccagaccuaccuccacgcccaccagaccugccuccacgcccaccuauuaucugcaacucuucucagcccacccagccccacaaagcccggcccaaaagagaauccucacauaaucaccgcacuggagcaccuggagccagcaaagccacuguccccucuggaggucccuugucagaccccgaguggcagaggaagguuguagaggugagggcucacugaaaugacuuuauguucaaagggccuguagguugacacaagggcuaaacaaagauuuguccuccgcagguagagcugagugugcauggugucaccuaccaggagugccaaguggcacucagaaccacugggggagauguggcuucugcuauccggaaccucaagguaacgcuaaccccuucugcagguuccccagucgccuguuuggcccacuaguggucagcuguccuaccuccugcucacacagguagaccagcucuuccaccuuaguaaccggucccgagcagacugucgucgcauccuggagcaucaccagugggaccugucagcagccagucgcuacauccuagcccgguccugaacucuguauccucagggauggacaccagcauggguuaccugguccacuuagggcuuggccuuacggacuaaucagaacaugaggucuugacggaggcacgcugagggagauuuaccugcugugaggagugacaggaaguguauagggcacucagguacuggcuaaugcuuccuccgagcccugcuccuuggccucugaagggaccaagaccaaguccacucugccuacuauauucccaauugaacaggacuugaaagaaaaagcuuuggaggaggccucuacucacuacagacaaggaucaaguagcaauaccggaucacugaccaaccgucggaacugucauuagcuacuucccuaaacucuauggggcacccaacuuagauauugacuugggagcugcucugguuugguccagaaucacuaugggugaugaaaacuaacuuuuuggacucaaggacuuuuuuccuuuaauccaaauaguguagauuauacaggcuggcugacgccgcucccuuuguguuauccgguaucuacccucucccaucacauccggcuucuacuguuuaaaaaguuucaaaguuuauaugaguacaacaua

SEQ ID NO: 6127 - RNA, 18879 nt, Mus musculus
ggccccaccccuaccccucccagagcugccuagaaguggugggguuagagcuccuccuggguuaccccguucccuuuggggaaagaauuccagacccaggcucuuccuaccagaggauucuucuccauuaauaccccucuugggggguggggagugcaucugccuacauccccaccuaccugaccuccagggccccccaggcccccaaagcaagucaucugagaugacggucaagcuagauuuugaagaaugucucaaggacucaccccgcuuccgguaagugugugcagguccaugagacuaaggaggggaaggaaggcccaauaggucccaacacccacccacccacccccagcauuccccaggcaggaccaaccuuagagccuaggccacagggaccagagggaacuggugggaccuagugccucuaccacucaagccaggcucucaaaucaggcauggaaccccagcacuugggaggcugaggcaggaagguuguuaaguguuccaggcuaaccugggcuacagaguaaaaaaaaaaaaaaaaaaaaaaaaaaaaaacccuuuaauaacagaaccuccaugcucuccgaagcucacuuuacucugccuuucugccccuucuggucuuuauaauuggcauuccuccuuccuucucacggcauccccucccccagcaccugccccggggcgguuagcaacuuccugcccuggccacauccacccuccuacucuuccugcucuggucuggguuauugaagcuuagaaugugcacagcagcacaagagcagaaacugucuggacucugcuuggucugugcauacccaucaccccaugacgccaacccugccccugaugcuaagcagaggcccaguggaccuaagugcuguccauucuuucccagagccucgauugaacugguggaaacugaagugucagaauuggagacccgccuggaaaaggugaccacgucauggagaaaagaugcagagucagauuaaaauaaaagauuagaauaaaauuaaaauaaaaggucagggagauggcgggagacugggaaugcguuagagucauugaaaguuaacugugccuggcacacacacacacacacaauuauauuuaaaaucuggauguugcugggcgugguggcgcacgccuuuaaucccagcacuugggaggcagaggcaggcagauuuuugaguuggaggccagccuggucuacaaagugaguuccaggauagccagggcuacacagagaaacccugucuugacccccccaccccaaaaucuggauguacuggcucaugccuuuaauccuaacacuggugaagcugaaacaggcagaucucugugaguucuaggccagcuagggcuaaaaaaaaagcugggaauggggcugcguacccagaucccagcacuugggaggcagaggcagaugaaucucuugugaguucuaagauagcuuggucuguuuacauaguaaguucuaggacagaagagaaacccugccugaaauacauacauauauguguguguguguguguguguguguguguguguguguauguaaauuauuaacauauuaauauauacuuuuugagacagggucacauguaguucaggcuagcuuugaauuuaccuguaguugagccuggucuugaauucccaauccucugaccucuauuuccccccuggagauggaauucaucuuugugcauguuagacaggccggguucccccaccagcuacauccccagagcaaacacuucuuaaaacauuauugauauuauuucaguauauauauuuggcuguuuuaucuggguaaaugucugugaaccauguccacaccuaguggcugcuacagaggcuagcagagggcauuggauccucuggaauuggaguugcaguugugagccacaauguggaugcugggaauugaaccugaguccuuugcaugagcagccagugcacguagucacugagccaucucuccaaccccucaaaugguucuaauugaacuuuuuuaaaaaauuuauuuauuuuauguauaugaguacacuguagcugucuucagacacaccaggagagggcaucagaucccauuacagaugguugugagccaccaugugguugcugggaauugaacucaggaccccugaaagagcagucagugcucuuaaccacugaagcaucucucuagcccucuaauugaacuuuuaaaauucagguuaauccuacacuuguaguaauugcuuagagaggccacgucccugccagcuucccugagugaugauauuuaaugcaguuuuuacucauuaucacaaccaaaaauuagcauuggugcagucuaguuaacaauaaagucuacagggaccaggagagauggcuggucaacaaagugcaccccuugccagcaugaaaccuaaguuugauuucccccccccaccauguaaaaaugacaagguauauguaugguauacauuuauaacccuaguauugaaguagagacaagagaauuaauuauugggguuuucugaccaugcagccuaaccuaauugguguguucagaggcuaaugagaaauccuaugguagauacuggauacuguucuuuuuuuuuuuuuuuuuuucaaggucauauuaucuacccuggcuggccuggaacuugcuauguagacuaggcuaggccucaaacucacagagaccugccagcuuuuaccucaggagugcuggucugucagucugucuaucaucuauauaaucgugugugugugugugugugugugugugugugugugugugugugugugugugugugagugcguaugcuguaaugcaugggaggaggucaguggacaauucaggucaguucucucccuccaccccaggcuccagaauugcacuuagguugccuggcuuaccugucagguaaacuaucucacuggccugaaguuggcuuuucuaaaaaacuagaaguccagugugguggugcacaccuuuaaucccagcacucaggaggcagaggcagguggaucucuugaguuugagggcagccugaaagagagagagagagagagagagagagagagagagagagagagagagagagagagagacagagagaaagagagagagagagacagagauccaggacacccagggcuauacagaaagacucugucuugaaaauaacgaaguguuugaagucuauucaaguugucuuguacauugacaguuccucucuauugcugacuucaauucuauuuuauagauguuguaauuuuuguuuuuuguuuuuuuccaagacaggguuucucuguguagcccuggcuguccuggagcucacucuguagaccaggcuugccucaaacucagaaauucaccugccucugccucccaaaugcugggauuaaaggcgugcaccaccacugcccggcuuuuuuuuuuuuaagacaggguccuucuauguagccuuggcuggccuagaacuuguuguguugaccagucuggccucaaucucacagagauccacuugucucugccuucugaguacugagauuaaagguuugugccaccaccccagcuaguuauugguucaguuuuauggaaggucuuuugucauauuggagaaaaagguuuguagacauaugagaacuaggcaaucugcugauccacacugaguuagagccguuuugucuccuuaucucaagcuacuaagacuugaucucggucaguugccugaccacagcugacccacugucaacccaagcuacaguucucagacaccuccacaagccuccagaaaaaaaugugcugggaagacauggagcccaggcuccuggcacccugccaccucuucacaaagccucucuguagccucucaucacccugaaccacucggaaaggcuccaccaacacuuggucuauucaagauaugguggcuccuggccaaagucuggcauggcacccuuagggugaagcagccacaaccauguaucggguucuagcucagacaccuaccuuucccuucccagaucagucaguuacaguuugaccauuauaggggcacugaaaaauggacaacugagcaccccaacaucuuacuuggcccugauccugaggccuugaagacgaguuaacauuugaaagggaguguuuagagaguauagaaugagacacacuccccaccccaacacacaacaaaagacaaagacuugaacgaggccaggcagggacuggguacuaguaaccagacagugcaggaggaugggguccuagggggagccauuauuuaaacaggacacagaagggccggcaggaucagacagggaaagcuauuuggggaguagagaugacagugacuuugggagcaaacuuggaggaaugggcaggaacuuugacacaggcacaggaaaaggaaguggggguuaaugacccugcagccgugaguuugacuugggggugguggcugcagugggcugggugggacagcagaugagguuagggaaggacuauacagccuugggcaagaagggacguggugcagagggaacaucacuuggugugcuucauuuccccagcugcuaaagcuggguuccugccuccuggagagcggacagcauuaccuugcugccggucgugccuucguuguuggcaucugugaccuggcucgccuggguccaccagagcccaugauggcgguaugugauacuucugaaccagggcugugguugcuagggguaggggacugggauagaggggacuucgguagaggaggacugauuuggggucugcagagcccagaacaaagcaaagcuggggcaaccauccaggcuagguccgucuggugggaccuaccuagaguuggacagaccuuggcgucucuguguuuuuuguuuguuuguuuguuuuucguacccaggagugucuggaaaaauucaccgugagucugaaccacaaacuggacagccaugcugugagugugggggguggggguggcugcgggugagggaauggauggggguaggguugauggggauccugacugucacuugucaacuucuuccaacaggagcuucuugaugcuacucaacauacacugcagcagcaaauccagacucuggucaaggagugagacgggagggaaagaggggccuuaucccccagaaacuagcccuccaccucucuucccacagggccucccccacaggaggagcuaugagggugggaaguggccuggcuucugucuuccuauccugggauugccuggcguuuccucucuacacaggcugacaggagauaggugggccuuauccugagauuuuucuuuccuaaagcagaaggguaaaucugugguuuuguuuugucuccccuaacucuagaggucuccggggcuuccgagaggcucgcagggauuucuggcgaggggcugagaaccuggaggcugcucuuacccacaaugcagagguccccaggcgccguguccaagaagcagaggaggcuggaacugcuuugaggaccgcucgagcuggguaccggagucgggcauuagauuaugcccugcagguaggugccuaccccaacccauccuccaggauaccugcauaccuugaagguguucgggagaaggggaguuccuaggguguaaugggggggugcugugguuucuagacugaccugaggucuuuuggggccuucaggucaaugugauugaggauaagaggaaguuugacaucauggaauucgugaguuucaggggcagccaagauggagaggaacgggcugacagugggagggaagagggagagagaggaguguccuuccucaguucugccucccgcccaccaucagguacugcguuugguugaggcccaggccacuuauuuccagcagggccaugaagagcuaaacaggcuggcucaguaucggaaggaauuggguacccagguaaggacucuagaaaguuggagcagagagguuaggauacacuaagaugacucuucuggacugguugggacaaacucagacaucugagaggacccuccuaugcccaguugcacaaccuggucuugaacucagcucgacagaagagagacauggaacagaggcauguguuacugaagcagaagguaagggcugguauggaggccagaggaaaaccagcuauggcuuuggucucugccuaucccaguugucuuugauccucucaugcuucuaggagcuagguggcgaggagccagagccaagccuaaaggaggggccuaguggcuugguaauggaaggacaucuuuucaaacgugccagcaaugcauuuaagaccuggagcagguaagaagacaacugucucagcuaaacccaaccaguugaauauucucggaucaauaaugauuguguauuguauaugaaguacaucaagauacaacccuuagucagcaaagacagacaaacagaucaguaacuaaauaacugcauacuauguuagaagguaauaauaaaacaucuggcacaauggcacgcuccuuuaaucccagcucaggggaggcagaaauaggcauaucucuaugaguucaaggccagccugaucuacaacauagcaaguuccaggacugccagggauacauagaggaacccuaucaaaauaauaauaauaauaauaauaauaauaauaauaauaauaauaauaauaauaauaagcugagcaugguggcgcacaccuuuaaucccagcacuugggaggcagaggcaggcagauuucugaguucgaggccagccuggucuacaaagugaguuccaggacagccagggcuacacagagaaacccugucugaaaaaacaacaacaacaaaaaaaaccaauaaccacaacaacaagggaucuacagcugagcuacacccacaauguagguucccaauucuaaauaaacuaucaggggcuggguuugguggaucaggccugcaagccuagcacuggcaaggaacagagagguuuggaacucucucucucucucucucucucucucucucucucucucucucucucucucucuuuuuugguucuuugagacaggguuucucuguguagcccuggcuguccuggaacucacucuguggaccaggcuggccucggaacucagaaauccacuugccucugccucccaagugcugggaucaaaagcuugcaccaccacugccuggcuaggauuggaauucugucugcaaacaaguaaggaacaaaacuguuacuuuauuucuugacacacucuaugggaaaaucucuuggcugauguagccaaggaugaccuugaacuccggaucuuugggccuccaccucccaagagcugggauuacaaguguucaccaucaugccgggcuaagaaaguaacuucuaagucaagauaucugagugaaggaugcuguaggcagaaggacaaguuaaugggaaggaaggcccugaguucccaguauuugcaaaaugaguugugggccgggacagagugagggaggaaggaagaggagcuaaaggggcuacggaauccuucuagaacuuugcagauguugguaggacucugagacuacucugaggaagauggggacacccuacagggcuugaaacagaaugcuacgugucuugaugugacugguucaucuuucagaaccacccccagcccauaagggaccuugguacaaauuagaaaauggagccccuucccuaacauaguuucauuugcccaacacuguagcaauaagcuugguguaaaugccagcagucaggcgacuaaggggagaggauugcagauuuguggucagccuggacuacagagcgacuuuuaggcuuacccggguuacauggcacgauccuaucucaaacaaauacucguagaagugauuccaauacccucaggagccacccgaaacagugucuaucacuguuacccauuuuuauaaccuuuaaggcugucucccccugcuagcuccuucaacauuggccaagcuugacaaaaagguacaauaauaaacuuagaagaaagauaugugguggcauauccuugugagccuggcuuuugagguggagguaggaagaucaggaguugaaggccagccuuacugccaucugcuggaagguauguccaaucucgguuguccaaggugugcagaacagcccuuaaggagcuguaaggguguacccauucugcguguaaguucccaccauugucuggaaugucccaugggacugucaguccacaccucucuccucagugagcuacuuagggggcaaagagcacaguuucucuucuguccacuccugagccuguccccauguugggcaugcauguaaccacuucuucugucuccuccagacgcugguucaccauucagaacaaccagcugguuuaccagaagaaauauaagguggguuggucuggggugccuggacucuagauaaacucagccuuuguucacaaugacuggcucauggaccuuaucacucucugccaggacccuguaaccguggugguagacgaccuucgucucuguacagugaagcucuguccagacucagaaaggcguuucuguuucgaaguaguguccaccagcaagugaguagagucccuggguugauauucuaaaaugucugaauguuuacaaacccaaaaggcagggccaccaaaacaguaucccugaauagguccaggacuuaacccuuuggugacuggguugaagcagaaagcccagacugagaggacaagccgguaggagauauuucggaggacgcugccauucacuagaggaguaccagugcuccgcuuacaguaaauucauugucauuugaaaagauacuggaaaaccuacuuuacacauagcuuagccuagccuuagcuuaccugcuagaaaccguuagcauacaauuccaagguucuuuuacaugaaaguguuauugaacaugcuacugaaaacccaagaggguuguauaaauacaccuuuguguguuaaucuugaaaaauauugucaaacuaccauaaguuagggaucaccuggauuucaguagagcagauaaccagguacggagcacaccuguaacgccagcacuugggaggagaaccuuaaguuugaggaacauggccuguuucugacucaaggagaaagaggcuacugagauggcucaguacuugugccaagcucgucgaccugaguucauccccaggacgcacaugguggaaagagagacucaacuccacgacauacuggguguguguuugcacagacacacagacacacagacacacacaugugaauauaaugugucucucuccaccccaagaaggggguucucuguguagcccugacugucuuggaacucauucuguagaucaggcuggccuccaacucagagauccaccugccucugcuucccaagugguaggaucaaaggugugcaccaccaccaccggguuaauguugucuuucugaaaaauucaaggcccgaauggcuugcuagcaaguuugaagucagucuggaaaguuuaucagauccuaucucuaacuaaaguaaaaaaugucuuggauauaacuccgaggcagcgugcuuaccuaagcaugcgcaaagccuugggcccaaucucauuagaaauagaucaauaaguaaacaucuuucaaaaucuuucaaaaucagcugggcauccacagacugucagcuugcccucccugccucacggcucucuggucuugucacucucaauaucaccugcagguccuguuuccuccaggcugacucugagcgucuccugcagcugugggucagugcuguccagagcagcauugccucagccuucagccaggcucaccuggagaacagcccucgggggccaggccagguaccuucauaugggccacacugcccugggagguggagcuuuccucacccuuaggccccuugcucauccuuucuccugucucccucaggucucaggauaccaugccccgggcucugcugcaacucuggccuguggcggggcagccagaggaagggagucuggaggaguuggucagguggcggcccagguacaaagcguggauggaaaugcgcaaugcugcgacugcagggagccagccccagagugggccagcaucaaccuuggcgucacucucugcauucaguguucuggcauccacaggucauucccuaagacccgaggcacaagccccgcuuccaacugcugcguggccccucucaugcacccuacccuugcucuuccuucucugucaccagucuccaagguuguagcgcaagugcacauuugaguuggauguggacaggccugggggccuccuagaugaacucauugucuugauaggaagaagcauggguuacgguugcugagggugggacagccaacaagagcccaagagggaaaggguugugagauccuagaaagccccuaaggcuucaccaccagucugaaguguauggagggaaaagagguggcagacaaaacauguuccagaccgaagcaucacgagcaaaguggggaggcuagaguguucagcagcaauggugagcaggccagagcuagagggccucugcugcucugcuuccuggcccggcuccucugugucugcacacaggccuggucuuuucaggagcaacagcuuuccuaggcuacugcccacacagggcaugacucucccucuggcccuccaggagccucggaguucauuucuccaaaguccgcucucugacccuugacuccugggaaccagaacuggugaagguaacuaggguuacucgggauauugugaagacagaggacugaggagucuuugagggcucugauacucacccagugacucucccucuuucucuugcccucuucugggccuucgaagcuuaugugcgagcuggggaaugucaucaucaaccagaucuaugaggcccggguggaggccauggcggugaagaagccagggcccagcugcucccggugagguugcgguggaggcaccuagggcuucccugucguggagaggaauggcaaagaggccgagggaccaaaggcugucuccucuaaccuccaggcaggaaaaggaagccuggauucaugccaaguauguggagaaaaaguuccugaccaaacuuccugaaauccguggacgaagagguggcaggggacccccaagaggacauccuccugugcccccaaagccucccaucaggccacacucgggcauugucagauccaaaucagguagagaguccaacucauugcuguacacucaguacuggccaggcccuagagggaggcagaaugugagguccaggcugucccuuggaggagguugggaggagcagaguacagucaggaggucacaguggggugugacauugacaugaggaaaaguaugggcuggaguauggucaggaagagccacagagaggggcaucuccagagagagguugaacuuggcaucuccaaagguuugaaaagaaggaaggguuaugagccuugucugggcgggggaagguaagcacugaaucugucagggagucagcucaccucuggcauccagccagucuggggagaugagcaaugcuaucucuuccacacccagggcccugcacacacacaacacacauaccaacacguauacacauccacagcgcucccguuucucaccacagcucugagucacaagggacuccccacaauuuggacgugacuuaucccacugcagcaccuggggacuuugcugaagauuuucuuucuagacccggcacugauacuccuuaacagaauuaaauccacuugacagagugcccgucugaugacaugggaagccugcacccuggggcccugcuguuucaagcugcuggacaucccccaucucuuccuaccauggcugaugcccuggcccauggagcugaugucaacugggucaaugugggccaggggaaugccacaccucugauccgggccacagcugcugugaggaccaugcugaccuccccaacucuacccuagagcucucccuggggucuccuucccauagggcaagauaaauaauauagacuaaguguuugaagugugauuuggagguggugaauuagauuuuucgucugcuacuuacaugagcuuuuaaacaaguugucaauaucccugugacuuagucuccucaauguaaaauaaggaagcagaccggagagauggcucagagguuaggagcucaugcugcguuugcucaggaucaguucccagcaucuacaaggcagcacauaacuguaacuccagugccaggagauccagcgcccucuacuggcccccucauucacugcaugugacacacagacauacauguagguaaaacaccuauacacauaaaauaaaaauaaaacaaucuuuaauuaaaaaaaaaaagagggacagcaugacucaucagggugcaggauaugcuuuggggagggacagauuuucucuguguagcccuggcuguccuggaacucacucuguagaccaggcuggccuuaaacucagagauuugcuggccucugccuccugaguggugggcuuuagauuaagacaugugcuaccacugccuggcuuuuuuuuuaaugugcauugguguuuugcuugcauguauauauaugggaggggguucccuggaacuggaguuacaggcauugugggugcuuaggacugaaucugacuccuuuggacgaguagcuggugcuuuuaaccacugagacaucucuccagucccgggauagauuuaauauaugagcaucuaaaggucgaggaccaagccugacaccucacugagcccugaaacauccaaaaauccaccucuaaaaaugccaucuucuugaucucuaugcagaacucucuucuggccugcgaguuucuccuccaaaauggggcgaaugugaaccaagcagacagugccggccgggguccucuccaccaugccaccauucuuggucacacaggguagggagccauggaaauggcaccauggggaggaagcuuucugggagugaaauugggggaugccuguugcugaauuuagcucucuucucuaggcucgcuugccuguuccugaaacggggugcugaucugggggcucgagacacagaaggcagggacccucugacuaucgcaauggaaaccacuaaugcugacaucguaacccugugaguaugccgaaggggcagacugaugcuuggacaguccucguuggggugagacuaacgucaaaaccugacuuggagggugaggucugggguguguguguguguguguguguguguggagagggguguggagcaggagcauggaccaguugggugagauacugagaguucaccuggggagccauuauuaggacaccaacauugcaaaaauguucgugaguguaagcuuuuaucuuuaagcacuaguuauggacagacauuuuuaaggagugacacaacucaagaauuggacagaggauggggauuuggcgaaguuccaggucuuuuacuccuuaauccccacccuucaggcuacgauuggcaaagaugagggaggcugaagcggcccagggccaggcagguaaaguaaccacguauuucaccccgaccccgaccccagguccauaccgaaaugccugaccccuuaguacccaacugcauuaauaccauuguuuauucaacaaacauguuuugggcacagcgaacgugccugaccuguggaacaaagguacuguacuuaggaugcacccacacuuuaaagugcuuacccugccaggaccaccccuacuguguagcccggcuguccagccucccagucuuuccucugauuuccuuaggagacgagacguaucucgacauauuccgagacuucucccucauggcgucggacgacccagagaaacugagccgucgcagucacgaccuccauacucugugauuccaggcuccuccccacccugccccauugaagucuccauuaaagucucucagcuuggcuucuuucuuaguucauuuacugugcgccaccugggggcccggcagaguguuuggcacacuggccacccaggugcggguagccgugguuacucaagaggcuaggguuucucuaaaggaggaaguugacuagcacccgguggcuuggcgggaggggcuuucgagcccaggggaccagggaagccaccgcgugggaaccugggcucgcugggauggcccgaaggcaucccgggaaugcgauggcucagcauccgcccccucgggaguucccgaccgggauccaacccggagacguggauucucucagacuagaaggauggacuggagacuccauccucgacuaaguuguacuagugaggucaugcacaucugcagggaacgcggggccgucgcggccacauccgcaacgaagccugugaaucauuccacccccgcuccagucggccgguccagccuguucgccccaucucucgcacuggcaaggccggcucccacccauagcagagcccggccagcccacgggggcguagggcggggcgcuaaggggcgggacugucgcuuaaagggccacugaccgcugcccuuaggccacuuccuggggguggagaggaccucagugccugcugcgacaacccaggaaggcgguaacgcccgagcccugagacacuguucccaacagagucccgggacacucucagcucugacugcaagagcaucgccucucccaagccauacagaacugcuggcuaccggcuccuaucaguugcgccuccaucuuuugggacacacgccccuaacccuggcugggccucugaacagguccucggaacccgacguggacucuacaacuacaaaagcucagaaacucaaacugauccuuucagcguccgaccggugcucaccaccgucaccugcugguugaauuucggaaacccacugucugaagaguacaggagggaaucgcugaccacgcacaaucagaagcgucuggaccaaaagcucccugauccugucuggcugccgucuguuccuuucaucgguucuuucauccucucggggauuuuuguguccugaagcccccaaccaccaccaaaguagcuugggugagcuacaaacuuuacugucuuguucuccaaccucugccuccaacuuagcaagucugaacguuaccacccaauucuuuccaaacccccaaauaucugcuuuuuccuucuccuugccugucucuuauauuacccaaaauuucccccccuccuguguccucuuuacccccuuccuuugggggucccgugacccuaaauguggggggaacacuauauuccacuacacuggagacccugacucgcuucccagauuccaugcugggggccauguuuagggcugacacccuaaugccagccaaccuuaacccgcaaggagauggccauuacuucaucgacagggauggcaaggcuuuccggcacauccucaauuuuuugcggcuaggccgucuggaccugccccguggguacggagaaacugcccuucuuaaggcagaggcugacuucuaccagauccggccccuccuggaugcccugcgggaauuggaagccucucgggguacaccugcauccacagccgcccuacuccaugcagauguagaugucagcccccgccaggugcacuucuccgcucgaaggggcccccaccacuaugagcugagcucuguccagguggacaccuuccgagccaaccucuucugcacugacccugagugucuggcugccaugcgcaacagauuugguguggccauuggggacagggcagaaggagguccacauuuucggcuagagugggccucccgcccccaggaacucccugaaguagaguaucaaagacuggggcugcagccacuguggacuggggggccagaagaucgucgggagguagcgaacacgccuacauuccuggaggaggugcuacggguggcucuggaacauggcuuccgccuggacucugucuucccagacccugaagaccuucugaacucuagauccuugcgcuuugugcgccacugagggugcugcccuccacuugacugcagaggagggggaugagucagccaaggggccuguggcucuucuaaaaccucuuucuaguacuggugugguagcuaugaaagucagggauuccaccauaccuggccagagccuagagcugggguucccagaucgagcugcccccuuccaccccacaagacucacgaaugguccagaaggucuacgcgggggcuuauccugggaaagcaucguggauucucuagccuguuuuugcuugaggauggguccucuguauucagaaguguggcaaaguaagauagcaccucuuugcccaggcuaaaccuagcagagcucuggcggguugagcacuaggugggaggacuuugacuuaucaaauguaaccugcucccuagacugugguuuccuuuacuggagcugacaucuuauccuacaguaaccauuaagaggccaggacucucugggagguuucuuuacuauguuccaagccaccuauugugggacacuccauccuagggugacauagggagcaaggagaaccuccaucaacacgggggcuagagcucccuucuggaauuccagaggauccuguauggaaguggggcuggaccaugguguccagaggccucuuucaugugugugcgccugccagucaauagaucugaugcugccuggcucccugcugucuugguucccaucaguguugcugacuccugugcuuguguauugguccuucugugaucuuggccuguccaggccuguuugggguugcuuagaaacucuccaggcucagguacuucugugguauguguaaaagcagauucagauuuaguuuaaucauaggguguguguguauguguguguguguguguguguguguuugcauguguguuuaugccugcgcugccacguaggcaggagggccuuguuugaguuugagucacacuaggcccuuccuaugagagguaaaagccucugggcuuagcugggccucugagaccucugggagcucuugguugcugagacaaccaugagccuguugcuaggaaauagcuggguaaggaaggccuaaggcuguccugggcagccaggagcuagaguugggagagucggggagggugugggaaggauagcauuucuggguuccugggcggaugggauacacacauaaacauggucaucauuggguggagucauucaucuaucacugugacuuacaagaagaaaaauaaauugcuuucagaaccaugacguguaaaggccacuauccccuugcaacagaaacccugauuuauccguccuagagauacguuuuagccuccaguucuugggggcccagggguggcucuaccggagccgagggguaagacaauggcauuguucuggaucagucuagaaccuccgacaugaagggucagaaucuggaucucagagaauucugacucuucccuggucugaggggguccaacuccuuccauaccccagcaggcuucaugugggugcuggcucuggguggggcuuucuuggccguggccaaggcuuguaucuucugucgucuccaagaucaugccuuggcaaaccgccuggcucagcucaauaaccagacgaagccgaaguggaaauggaaggaaugggcuuccccagauuucucggccuuugccuuagguaauaucagauaugcaagguuagcucagcaauagucaccacuggauccuaagggggcuggcgcccgagcuccuagcugugcaucucagccauugcuucaguccauagcccuuucuggacacacuagccucucucucucuuuggaagaacucugugcccuaggaaauaggaaaacaaaaaaacaaaagacaacacaaaaccccccaaaacucuagagccuacucuagcuccuucuuguccaucuccacagaugaggucucaaugaagcaagucacagagaaaacucaccgaguccugagagucauaggugaggucuggagaaaacggacacuuugagacuuaggaagacccaagacgagacgggauauggggggaggggaggugaagagagggaccgaucugggagggggccuggaaggcagcuccgaugaggucuagggcaauauagcugugcugugccucuccagagaaaaaaggauccaccuccuugauuccauuauacuggcaauggcuucagaagaccaggaucccccaguacaccagggaagguauugauggggaggguaccaaggagacgccuaggauuuguagccccguggggcaugacugaacaagucagccacugcuccuugcuuuucauugcagcucuuugugcuccugucugccgugaguaaaagaaaaggccguggagcccccuggggagcgaagagaguagggcgacggccugaggagcuugggcggcugggaggaagggguuggaggcgguggcuucgcuugccagcgcugcuccuauugucuccugcagggggcagcaccauccuguacaacugcuccaccugcgagggcaaggaggagucuuguuggccccaaaagcacugcuacccagguucuuuaauccucacccuccuaaggcccccuagguucccuggugugauccacaggaucauccacggucuccuggguuccuugcagacagucacgaucugugggacgcuaggauucugcuccuauguaucuucggaauuguccugcuuucggguguugugagccuccaaguggagugaguuguggggaucuucccaacccccuucccugauucucuucaggccucccauccucugucuccuuucagguaccugaaccugcaagcaaaagacuugugaa

SEQ ID NO: 6128 - RNA, 3638 nt, Mus musculus
aaagaaagucuugggguguaacaauaagggaagggugugcggaggaacucccaggcugaagucugauagucgaccuuucaccugccucagcgccagggagaagaggcagaggagguccggucugacccggagcccccagcgcccaccgcccgccgcgaugggggcagggccaacgggcagggcuaugugcagcuagaaggguaggcaguggaauugaagugguuaccaaguugagcuauggagaagccggagucucucgcaccuguuaguggccucagugcagaauccccuggggggguuucuagggcaguaccuggcagugccagagguaugcaaacagacaccggauuaccccccggaguagccuugcuucgcgguccuggcucccucuugcauuccgggaacccuguaguccgcaguccugguccaauucagcccucugaaggggcagugacccucaauucaggacccgcuccgcaacuucaggagguugcaagccuuggguccagcacauccccuggcacuggaacuggugcaacuaaggcguccacccccgggccggaggaggcuaaaguguacagcucggagaguaguacacacuccgggacaucuuucacggagcggccucggagcauccuaaaaaacagcagcuccauuuugauaaagaaaccccccgguucggagaaguaagcaacucagcugguuuuuuuuuuuuuuuuguuuuuuuguuuuuuuuuuuuuuaaugguuuuagagcuuuauuguagaaaggcagggggaaagagcgagggaaggagggcuagagaguaagaaaggugagagcuuaaauagcagcaacucagcuuuuagccagcagcccugagacgggagggagggaggaguucaggacaccuugagcugaagccaagaaaaaaacagagucccaaggcccugguuagggagagguggugaggucaaauagguuggaaaucugaaguuccaugacuuggagagggcagcaggugucacaggaauccuggccacacagcacugauuaucacuggguaucuggcucccauccuagccucuacgagggaauauaagaagaauuuuuugaaugccgggaagaaugaaggagaccucucuguuaggagagggucgccagaagagcuuccuccuuugcuccuucccucaccuuaggaagucucagcgcugggaugaaaugaacaucuuggcuaccuaccacccugcugacaaagacuauggcuuuaugaaggcggaugagcccagaacccccuaccacaggugcuaagcccuagcuuuugagccuaaacuguauucuaacauguggcuaugaggaagaggcagagaagccucggggcacaaacacugccuccuccuccuccuccuccuccucugcaggcugcaggacaccgaugaggacccaucugcagaaucuucucucaaggugacuccucagucaguggcagagaggugagagcccucucagagauuaguugagcugugcccucugcccucauaccuuugaaggcagucucagauagcuuuguuccucaaacccuaaaaugguagguacuaccuaccuccucaggccuaaccaaagcugaucuaggcaaucagcagcuugguccccacccaacaccuacccccaccaucauuuuuuuucccuucuguacccccaacuagucucccuccccuucagguuugccacaauggacaauuuccuccccaagguccuccaguacggagacaacaaaaacucaaaggacacagacaacuuugccaagacauguaugugagacguggggugggucucgauggacaggggagcuuggguggggggcagcccuucugugaagaccuugggggaaagcuaagcuuucacgcuggcccacagacuccagugauuuugacaagcaccgaaagauacacuacagugaagggaaguuccuaaaguccccaaaaaaccugcccacugaggaagagagcauuggggcuagugccagcaucagcagcaguaaucaagcuguggcgacagaccugaagccuaggccuguggagaaaggcugggcaggaagacuggccacaggagucaaaaaugacacuguccugaugacugauagccaugucuuaagcaccaacgguuagugacaggggccuccuggggcugcagaguggagacaagagacucuuccagagcccagaucuccuugaaauuuacauguuuucaaaucuguucucuuuggcucucugcuccucacaucucugcuguauucugauuuauucagagagcauuggccuacagucuugcucgucugacagagaggcagugacuggaggggacgcuagggaaggaaugggaacaacuggagcugagucuccacugggggggggggggccuccagagacaaacugaacagagagauuaagagaacccuugggggauggggguucacugaaggcuuuuuaacaugggggagggguguuagaugagaacuuaaacucuaauccgguaguggccugacucaaaggcagagcagguggccacaggcucaagauugucugggguacuuuuucagauucugcuaccuauagaaaccaguucccaucagccucagacucuuccauggggcagcuggcuaaucuacagcgcaaggaauacuacagcaaaggaagguaucugagguccggcucccgcccagagcucggagaggauauagaagaugaagaacaggauagugagagacuggggaggauggccuggggaggauggcccggggaggacagccugggggguggggugggaggacggaacaaacuguccuccuguuacuuccagguccuucagguuugaccuggguuacugagaauccgaaaggcacuccagguacuguuggaagcgucuuuggguaugacaaaaccauuuagcgcuuucugagcauaacccuaacucuagugcaaccuggcaagggcaccaucucucuaggccuggcucuuaacaagcucccaucucccacccucccaaucccuuuuaagucagugcaucagccacaggcaguaaaagaggucuuaaacauccuggcguugauugacuacauuauagagaccagguccgagugaugcucagagggguugagauccccuccagccuagcaucagccaagggcuccaugccuccuccuugacuccccucugccaccccaccccucucuaguuaguacuauguccuucacagucaaugggucacaggugacgcccaacuguugggcuaaggggccaaggugccgaaguccagggagcucagaaaaggaacauggaaguaaccagaacccuccaagcuggaaugggcgcagacgugagccugggccaaggcaaggggguaacuugcacugcccagggaggcagagggguuaaguggguagguucuagagauuugugggucacauggacaagagcguaccccugcugcaagaaagccuaaccuuuucuuucucuagaugaaagcuugcggcuccaguggacucagaaaaaagaacguagaccuuggaaaauguagucaacgaggaguggggugaggguugccuucccugucuccacucuaauggacaauaaagagaacaucaggaaucugagugcugg

SEQ ID NO: 6129 - RNA, 2581 nt, Mus musculus
augaugguggguacauuuuguacauuuuauugguuuggggcacauaagaccccagccugagggauggagggugggcuggagcucucuggugguuacuugugauagaaucuuggguucuggcuguguuggaugaaagggagucgggggccagguuggcuggugguggcaaagccugacugguaaugauaagaguuuuaucaguggguagguauuccagcacucagcacaagggggaggggacaguuacaguaagagguuagucuuucccugguaguauauguagguuugauugccagccuuaccuucccugcugcuuguaucuguacgggaagcuggggggaagccaggaguccaggggcuggaugcagagcuugggggugcaugggccgcagagaagacuaggagacaaagcugaccuuaaagggaggcauccuggggcuccccucaucuuagcaccuuggccucccaggacuccauacucacugaguccgagaagcuggucugcugguuggcaugcuccaucuguuucugcaaagagaggguacugccgggcuggaggaacccugaggggaggagaguuugaaaugagcagguggcaguaggacuccugaagguagggcuccugcccagggggaucucaccugucugagugggcugaaaguggccaugcacugcauaggguuguggcuguggcugagauagguacugcacugcaggaaaugcugauggggcugaggaaggugggagaugaucuguuaggguuugaugcucuugcucuucuugccccuagucugaggagaacaacacucaccucugagcugcuggcuaggacuauaggcugguuguguuggcccauaaugaggugggggcugagcagucccauaagcacccccuggacugccuuggaauuguccauguucugggguuccugcaaaagcagcugcugaucccacguagugccgggucuaaggggaaaugaaagcucacugcuuaggaaaaaccccauauguauauauauaugccuuuacgcucagcuccuacauacacaugcuugguauauuuguucuugaaugauugggauuaacaguacugauccacagaaggaggagacauggaguuaggaucagauuucaagacuagucuuggcuaguaacuuaaaaagccagccugaagaguuaaaaaaaaucaaaaaaccuuucccucaccguaagcacuugugguccaaacaucugcuuggcucugucagcugccaucagaguaccugggcgauuguguccuccagggcucccuagaaagggggagagguuucacgaugcuaaaauaggcagcgaccuccuggagaacuccccuguuaggcgguuuccucaguccucucacccugcaugcugaggagguggguuccuguaugaaccgucaggcucugcugguaugcagcugaugucagagugguuaagucacuggaguggaaggaagacaggucaguuagccucuugcuauuagauugucaccugugccacugcacaauuuuacuuuuagccaucucaucacaccucuguuccuuucgccuccguuuuucuuccucaugcaaaacuuucuugagcugcaagaaaagcuggugcuucuccuccuguagagcagaaagcuucuccugcagcuucaggaucuggaagagggacgagcagcuaaagcagggaaaagaaggcaucgagaaacaaguguggagaggcuacuuaccuguuccuuggucuccucuagugacauucucucuuccauuuccuuuuucuuucuucucuccugcucuucuuucaucuucuguuccaucaucuuguccaccucuuccuccucugaagaaucagaacggggaaguggcaaggcggugugaauaagcugagcguuagacugaagaccagcaaaaaccaguuacuccaucacagccacagggagaacuuggcuucauuaggugcucuccaagguccuucccagcccaggguucuggucuggaacuuagacugggccucuucacucacaccccgaaggcgccgcugccucccucuuagccucgccagcaggcgcacagcugggcccguggaugggggcaaguucguggguagcagggccacccugagccgagugucuguccucccgcucuggcccaggcucacccugccguuugcgcucccgcuccaucaugaugugccggugcagagcccuggccauagcguuggaaagcuuggggcgcuccaggagugcgggcaugaugcuguuggugacgcuugggcagugggcacccgacucucacugacugccagaccucaggcggggccugcagggaagugggagcuuagagagacugcgacgcgccgaagcggaagcccguccgccgcccgcucgccacuucgaucacgugucccgggcaccagcgucccuccggggucucugccucagcgccggggcgcgugcgagggucuuaggcuccgcgcccccgccccucccucguagcccuggcgccaacccccgcaacccgccuugucggcgcuuucuccgaggccuucggcgcgccuuggccucuacgucauauccg

SEQ ID NO: 6130 - RNA, 5866 nt, Mus musculus
gaccagcuucucggacucagugaguauggaguccugggaggccaaggugcuaagaugaggggagccccaggaugccucccuuuaaggucagcuuugucuccuagucuucucugcggcccaugcacccccaagcucugcauccagccccuggacuccuggcuuccccccagcuucccguacagauacaagcagcagggaagguaaggcuggcaaucaaaccuacauauacuaccagggaaagacuaaccucuuacuguaacuguccccucccccuugugcugagugcuggaauaccuacccacugauaaaacucuuaucauuaccagucaggcuuugccaccaccagccaaccuggcccccgacucccuuucauccaacacagccagaacccaagauucuaucacaaguaaccaccagagagcuccagcccacccuccaucccucaggcuggggucuuaugugccccaaaccaauaaaauguacaaaauguacccaccaucaugccugagugcuguuuauuugcuuccuauccaacugccuaaaccacaaaggcuacuaugaagucucagcauuucuagauucuaaaaguaccuuucaaucaacaaauaaacaacugaguugggggcuucauauuaaacuuguaguuuuauucagguuugauuuuuaacaaaugugucagggagagagcccacaggaaaggguaaagcccgugggggcaaggccuucccagaugccugaggagggaucguguccccucccccccuccucuucucaccaccccuacagggguuugggaagagacacaggcagggaaggggcugguccccagucuguacaguggugcuugggggugaaggacuauggagaacaggggaccagaucggggaugaguaggauaaagggcacaagaccauuuaccagaauccagcuuucugauuccaaauugaauuaaaaagaaaaaaaggagaggggaaccuaaaccacaagcaguacccaacucccuuucccccaucagggcugcgagagaagaggcagggaguuucaccaaggccauggcucccucauuccuggccaagggagcuaggugaagggcagggucuccccgacaguuugagggggugaggaaaaccaaaauaaaacgucaaauaaauuugaauaggaguccagccaagggcccagccagagcagaaccuggcugggggaggggccucuguaggcucauggaucacugcugccaccaccgccacccugggcaagagaaagaaaucauguuuaagauauaggauguaacuucaacaguaaguguggggacaguggggggugcguucucucaccuggaagccgguuauuuugccauggccuugauugcaacagcugccuccucugucauggcagacagcacugugaucuggaaaagcaaaaugacaguccagagaugccuuaacugaaagacuucgaauuaaggaucaaagcagcauacaaagcaaggagggggcaucguaccaggaucucuucuccacagucauacuucugcucaaucuccuugccaaggucuccuucaggcagacgaagguccucucguaccuccccacuguccuggagcagggauagguacccauccuggaugccaaucagcugggagaaguuaaaagcagguacaaguagguuaaguauaagagaauggacagaccaacuacagugacagcaacuuccuucacuccacagccuuuaccagcucccucuuuccccacaaggugcagucaacaccgcccccacauacacacucuucuaagccaccaaucaucuucauccuaauaacauaccuggaagucauuccguuugauguuggggacauccauauuaugaguugacgggcagauaucuucauauuucuucccaguaaaaaugucaaugccaaccagauggaccuguguacauauaucauaaagagaaacccaacaaaucaauuuuugaaguaugagacaaaugucugugucacuuacugccugagaggugagcgugccauguuauggguaaagauuaaggaauuauaaaugaaccaagugagaaagauauacuaaagucuucaaggucuuaaaagaucacaucugaagguuagcaagugagggaagucagucucagggaacucauuuacaucaagucucaaaaacugacuggcaagaccugaggauaucacccaacugcucacaacacuugcccagcagcacagggcguuggguccgaugccuaacacauaagccaaucauggugacacaugccuguaaucccagcacuagagagguagagguggaaggaaguucaaguuugacgguacccuggaguacaugagaccguuuuauuuuauuggggaaguaucuggggaaaaguuucuuggacaaacguggacaaguggaauaggcugagaaaaugaagcaaaggaauguaaaagaucugaagacgauaacccaggagaagagcagagggacugugcagucaguaugcaaggaaaacagaagaggagcacgccuuauauuuaaugucaacaaaggauaggaaauauaacacaaaaauuucaacuagucagaaagucuaagcuaagagaaagaaugccgucuuaaguaaaccaaagaacaguggacagucagcagaagguagaggacauugagauuuaucacaaccccaaaggggaagccagaauuugaaggagcagcagcagugauuagagaaugcagacuggagcaccccaagaaugcugccuugggaggagggguccuugacuggagaaauccuggacaaggagcccaaggucaagaauaagaaacugaauauacaaaccaaaagaaaacuagcacaaagagggaggaaaaaaacauagcaugacagguacccuacagaagaaacugggaacaguuuaguuuuaaauuggagcaaaaaacugggugcugaacaaaaggaaaacagcaaaaggggucaagacuagagccaacaguucacugcccagaguccuaggggugugggagcugcagggaaggcaagauguugagaggugauucuaaccuuggcauggccaugcuugccagucuucgaaguagacaucucgacgaucuuacauggccggccuuugagcaccacaaaaccauucuuacguaaugcugagcacugcauugggaagguggcugaggccccugcaucuccugucucgaaguccaaaucaucugccauuuuaagaggcuucgauuccaacuaaagccaagaagagaacuagggucaguaacgauggagguuaaaugagaucgcugaucuaucccauuccucccuaaaacacugauccacuuccccuucauucauuacccaccuaaauaaaguugcauuuccugcuuugaaacuggagucaaacauauugaagagcuugaguauuggggguaaaacagcuggggauccccugggcccccacaaugacaucuaaaguuguggcuagggaaaggaagccuccugggaguugggaugccaaaucccagagaugaggaaagggcuacuucccgggagcgaguaggacucagguguuacucgccacugaaaccaaccacccccucuuccccacacucugccaggacuauaauuaggugagcagcaaugagccagcugaagggcggggcuaauggagggguggagacggaggacaaggccccacccaguuguuacaccacccccccacccuguccacacacaagccagucauugguacaggaaaccacaaggccucuuugggggauucccgccuccaacgugcacuugcagaugcagucaagggagagaaaguaguuuccuaaaggaucccacugccaaacauuucgaucucaguucccgaagggaacucagccuuuugucgauggcccucccacuuuucccaggaugcaccaguccugucggcuuuucaggcccagccuguacagucaguagaaagugagggguggugaaugacaauaaaaugaaagcaaaagauucguaguaguaauagaaaucguacuaggcuggcagaguaaaggacuuuaaaacacaguaacucccaaacaaaacacgacagggaaggcacuggcauggugaagaucgaagaucaccgcaggggaacuagaagcucacuacuuucaggcgcugucggcaugggccgagaaagaguugggcaucaguccaaucgcccucaguuuccccacuuuucccgguuuccccagcaaagcaguaccacuuacaucuggcuggacgucucacuucauaugaagacugagggaugagcuccagaggcccaugaggcuggggaacacuaacauaugccugcaacgggcccugcgggaugagugagacccaaggguagggucucucccgcacgccaaaauccaaggcuccggagaaacccaaaaaagaccagagcuccuugcgcugaggguugccggcucgcgcccaccauguggucgcccggggcuuccgguggcccgggccaggggggagggguccccgugcagccaugcggccccggucaacguucggccgcauggccucggaccccgagggcagccuccaauggggaacacuuccggugcuacggcugccccugccccaaagcugcgccaggccaggaccaugccgccuccccuccccccgccggccgccaacccccuccacaugcccucaccuaacagcccccucccccaccucacguggccgcgcagcgccgguccucaaccgcacaggagccuuugcccugucugggccgaucuggccccgggcccucgccccggcguggccgccuggcggccucucccgcguggcggccucgcggcucgccgucccccgcccugcgucgcuccaacgucacccggccggccccaaccgucaccccucgcgccaaccgggcccugcacccgccucuccgcaccucgcgccgcucccucaccgaacccgugcggcgacagccgccgcucccuucugccccccuccccgacccccgcguaguuccgucucucguucguagcucaaaccgagguuacgcgcaggcgcgcccugcccgcucucaccucgcgcgaacgcacugacuugaccugguccgcucgccgcgagcccaacugcugccuccgaacccgcuacugugcugccgccgccgccgccgccgccucuagcgccgccgccgcugcugcacacgggucuuaguacgcaggcgccgacuccccacugaccaaccaagcagcccuaugacagccgcgcaagcgugcuagguagcuccaccaccuuccacccccgcacugcgcaagcgcauggacccuccccgaucuccacccucucucccaccuacccaucggaugacgcacacacgugaccccgccccuuuccaguccguagugcuuccaaccagucggcaaugcgcaggcgcaccggguuuuuuuuuuuuuuuuuuaaaucccuucaaccucuucuucccuccccuugagcgacagcucgcucuaccgggcaacccuugcggcugcgcaauacagaacccugcacuccacacccuccgaaggaaacgccugggucucaacgcaugcguguuaggaauccuaaacgccccuuccaccucagacgucgucccuacgcgggguguugaaaagaccacgccacugugcugcuugcggcgucaagaacgcaugcgucugagcaggcgccacaccucggcuuuaacuggaauugaacaacucacaaacacguuucugagaaccuuucuaguuagguguguggcucuucuccgaaucgcugucccagcucugcacgugcucaagagacugcuuuccgugggagacucugcucucacgcuaguguggucggauuacaaccaucc

SEQ ID NO: 6131 - RNA, 5918 nt, Mus musculus
cagcucuccgcaucuuucccccucaagcgggucucacuagaucccggagagccuuggugcucuccgguuccguggguuguggcagugagucccaccagacccgcccuuugcacacggcuuccgaacgccggggucucgugccggccaggcccggacccuauacccuauucauuuuuuucuuauugcagcgccugagucuuuucuucuuuuaaaacaagaugccgucggguuuccagcagaucggcucugacguaagguucagcauaccggggcgaauugggaaaucugguccaguuuuucuugggcugaguuugggguuggggucagcuaggaggcgguucuugcgcaggcgcagggguuggagauggggggcuggcuauuuauauucagccuagacaacccgugacugucaaauuccaaucccgccaagagacagaguggguccgagagacucuuuacgcgcccaggcugagagacuggauucucgggaauccagaacuugucuccuagccuacugugcacugcauggggugacacucugcccacgacucuauuuggaaugguagauccagagucucgccuucccuucccggagcuguucagauuuacgguguuucuaggacccgagcacuucgggggccccacccccacugcuggcugucuuccaggaggcugaacuuucucucggccuugcgguggguggaggggcagaggggagugucagcccccccccccagcucagguuuccucuuggagacagacugugccgccagcaguagccaccacugccaccgccccucacaccacucacuaccaucccuccucuuccccugggcauggcucucucucccugcuaaaauccccccucacauccccgaguacuuggucccaguuuaggagcugaggguuggcuaggccuagaccuaaaaggcuaccccaaagcaaugacccagacgcccuuucuggacuagccauucuugggccuguuuacggccuacuggagcaagcugagagaacuuccagaaggaagagacaagggcuagaggugauguuaaaacauuauuuauauuaguuuauaaaacaggcacugucugggauacuguuauaguugauuuugauuuuucaaguguuuucacagacugacagguagccgagggaggcaauaucaccugacagaagaggaaauccagguucaguuuagaguggggaagugacuuacccaaggucacacaagucuugagucugucucaaggucacaggggaauuuugagguccagauccucaaacuuuugccugugguguggacacagagaucgguuuuuuccuacaugcccagguuccuguggcguucuguuuacagugagaucuuuguacaauuccuaauauggcccacuuucucucauccaguauguuggauggagcccagaaucuucaugcugcagcuaggccugggccccugaaggaagucaaacaugacucuacaugacauaccuuccuuuguuucugucuguccaggauggggaacccccucggcagcgagugacuggaacacugguccuagcuguauucucagcugugcuuggcucccuucaguuuggcuauaacauugggguuaucaaugccccacagaaggugagugaccuaccagcuguugggguguggugggcgggguauaucaggcaguggaaagagaaaggucucuagaguuacucccauauuccccccccucccucgcaaccaggugauugaacagagcuacaaugcaacguggcuggguaggcaagguccugggggaccggauuccaucccacaaggcacccucacuacgcucugggcucucuccguggccaucuucucuguggguggcaugaucucuuccuuucucauuggcaucauuucucaaugguugggaagguauggagcuggagggcagaggaggggaggaguaggacggagggccacagcaugggugucgugaccagcccuccucucugugugccugccaggaaaagggcuaugcuggccaacaaugucuuggccguguuggggggcgcccucaugggccuagccaaugccgcggccuccuaugagauacucauucuuggacgguuccucauuggcgccuacucagguacccacaggugcuauggcucuacucugugccucugcucuccuuaauguauguguaugagcuucuauauggaauaugcagcuauccucggcucucucuucuuccuucugcccagggcuaacaucagggcuggugcccauguaugugggagaaaucgcccccacucaucuucggggugccuugggaacacucaaccaacuggccaucgucauuggcauucugguugcccagguaaaaagaccuggcuuuguggggagcuggaguaggaguuggagaggacgccugcauuugggcuggaaggaagagcaaagucacuuuuccucuuuccugucuuuuccuacaggugcugggcuuggagucuaugcugggcacagcuacccuguggccacugcuucuggcucucacaguacucccugcucuccugcagcugauucugcugcccuucuguccugagagccccagauaccucuacaucauccggaaccuggaggggccugcccgaaagagugagcccucaccuuguaucuagcccaggcucauaccuccaccccaucuugcuaguaaccgggccuccucucggguucccuaaagccugacauuccccucccccaggucuaaagcgccugaccggcugggcugaugugucugacgcacuagcugagcugaaggaugagaaacggaaguuggagagagagcguccaauguccuugcuccagcuccugggcagccgcacccaccggcagccucugaucaucgcaguggugcugcagcugagccaacagcucucaggcaucaaugcuguacguagagaggcccaggcagagcaugggucagguaccaguuugggaaaagggagcaagucaccgccuccauuagcauucaggcucagucugguuuggugugguuagaauaaaggagcagacaucccuagcucugccucuccuguccccccucacuucuagguuuucuacuauucaaccagcaucuucgagucggcuggggugggacagccagccuacgccaccauaggagcugguguggucaauacggucuucacguuggucucgguaacugcuugccuguggaauggccacaccacuggugucauagcccugggugcccugggguuacucuuugucaccaacugaccgcugcacacacaacccccucucccccacaggugcucuuaguagaacgagcuggacgacggacacuccaucuguugggccuggccggcauguguggcugugccaucuugaugaccguggcucugcugcugcuggugaggccucaggacuuugagaauacagcaaucuuacccauggggauaaccccaagaggcucuguggcuggcugugccaggaccgugggugggugcuguagucuacggucuauguuucugagguacccuggccacgcuggggccuagcauaauguaauaguuccuaugaaaccucaggagcaaugauucccaaaagcacaacuucggagccaagggagcaagaaaccagaacauucuaccuugaaacuuccagagguagccaacaaaaugacagcagcucucagaaacgcucuggggcagugcagcacuugguaggcugagguggaggccuugaaaguucaaggccaaacugggcaacaugugacacugucuaaaagggcaguggacgggggaugcuuuaggccugcuuuagccuagaaugguagcuucuacccgauuaagcccuggaagauuucaguucucugggccaaaggcaaggggaaaggccagaaccaaauuuucugcuauuccuuccuggucucuaggaacggguuccagccaugagcuaugucuccaucguggccauauuuggcuuuguggccuucuuugagauuggcccuggccccauucccugguucauuguggcagagcucuucagccagggcccccgcccagccgccauggcugucgcugguuucuccaacuggaccuguaacuucauugucggcauggguuuccaguauguugcgguagguucccuacccuuugcccaguuucccacauccguggccagagggaaggcaaauccucccggccccccccccccaguucccucacugucuggucagggacucccagccauguagguggucucuggaagauaggucugguggaacuacuucaccacaaucaagggggaggcaggcggaaauagauggguggaaauagguggaaauccagcagcuuagauuuagaagucuucuaaaaaauaaaccagugguauaauuuaaacuuucuauuaaugcuauaagugguuuagaaaucuacuccaauuguacacuuaggagagcaaaggguaaaaaagcuaaaugagauuuucagugaaagcuuucauuucuggucauugccacugccucuuaagggagcaaaccugcuccucacauagccccaguuuccuuagucuuugguuccuggcuucccaucucugucaacauuucuuucuccaacugucccaggaugcuauggguccuuacgucuuccuucuauuugccguccuccugcuuggcuucuucaucuucaccuuccuaaaagugccugaaaccagaggccggacguuugaccagaucucagcugccuuccgacggacaccuucccuuuuagagcaggaggugaaacccaguacagaacuugaauacuuagggccagaugagaaugacugaggggcaaaacagggugggagagccacccucuccacccagacucccuccuuuccucuacagcacuuuagcccucucuucccuguuaccuccagguugaaggaacagcagccuggggaacugggaagcugaagggaggggugguccauguaccccucauucccccugugugauucuuuuggauuauuuauguguguggcuaggcuguggccaccuagaugggcuuucuccguccugccuuccuccugccccuacccagacucagcucuagacuacuuuccuccccuuucgagaaggggucugcaggagggugggguggcccugaauucaucaggauaaacagcaggggugggugugugagcgagugcuuuccucccacaaacuggcacuuccacugaacucuugccacacaggcucugggugaaggggguugucuugaccccuccagggcaaaggauacacccucccaaaaucuagcccugccuccccacaggcuccacccucccgggcaaaggaacacaauaguacauaccugacagggcaaggacgguuagagcgcaucagucuccauuuggggcccuagguuguucccagggcugcaaagcguagguaccaacacuuucuuguuccccuccaggaagggugcuaaacccgaaagcuucugaccaacuaagggcgggaggggauuugaaaggcugccuauaaacacugguugggagggagccuuugguauuuuuguauguuuugaagaacggauagggagcagaaacccaagggcugcuguauuaaauguguauauagagauucguccauaaagucacuguuugaagaugaguguccugugcuggaggaacuggagggugugcaaaaagaaaaugccucacucacccuuugcacuucauccuuccugggcucagggcaccgaggccucuagauucugucaccuuuuuuuuaggggggggcggguuucgagacaggguuucucuguccuggaacucacuuuguagaccaggcuggccuugaacucaagaaauccgccugccucugccucccgauugcugggauuaaaggugugcgugugccaccaugc

SEQ ID NO: 6132 - RNA, 4248 nt, Mus musculus
ggcuguaaaacacaagagcccacucugcuuuauuuacaacacgcaggccgucugucugagcagccggccaacaguauuaaaaacgaggcgagugcuaauugacaccuuuuucuuuccuuccucacuccacaggcuuugguacuccaccucugagcaaccucgcucaaaugggggagccccaaauuaaaaauacauccgguguaaaagaaaguaaacgggagagagaagaaacaugaggggagugcuguauuuacacuacaguuuuauagacaacuaucccauuacaucccaguuugagcccuggaccugcaagugaaaaggguacaggguugacuggacagagauucugucuacagauccagccuccccgacccaacuguaauggggucaacuucaaguccauggagcaggaaggacagaguagaagacacucauuuccaaauacgucucccuugggaauuguggcccucaaguggggacagccuccucacuccaagggaaggcuggggacccugaggcucaguucccaaguaaugucacaaguuccagccuuagugaugucaggguucuccagauuuggggagacccccuaaccgccgggccucuggccgaaguuccuugcauuucuggcaauaaaagaagucgggaacguuggucuucuuaaucuuagcacaggagagguggauccacgucccacagaggcugcacucaaucaugggccgccccgcaaagggcuuucugcaguaacacgugaucagaucccaggagucgucaccuggaaaagacaaaucucuuuaguguucugcuucaaggcgucaacuccuaagagcccccaaagcuaucaccucugcuccccaccccgggcagcccaacuucucaccugauucuaccaugauguccucauccaugacccgcaucucgccuucacuggagcuagcaucuccaucuuggcuuguuucugugcugcccacaucuuugccuucacugucaguagggggagcaccuucagagugcacuguaacagggggccugggggccucaggggguguugggagcacaggggcugggacuccaccccccacugucaucucuuccucaucaucuuccucuucuuccucuuccuccuccucuucagagucuguaucacugggaggagcccuaggagggccaggaggugggagucuaucuccccgaucugccuuuuucaacuuccgcuucuugcucuucuugauucgagaccgcuuuuccccauccccaggagcuggucgaggucuccgaagcaccccaaagccagccccaccuccuggucccaacuuucuauucuuucgguccuucuuucgaggcugggagaggucccccugggacagcggcacuggggcgagagcagcggggggccgggaaguaugcgucaaugaugugggagagaguggagaugccacuuugggcccauccagaucaaaaagagaguccuugagcuucaucuucucaagcagaguagcacugucaggagccugcagacgagaaaaaguggaccuuggggguccuggcuggguaggaccugauugaacugcccuucucuuugaugacuuugcuuucuuaacaaaagucuggauaguucgaagguccgacggggccgagucccagccaucacugucugcugcacucucaccucgcaauggagagcuagagccagaggcuggccaaucgcuuuccuuaaaaggaggaagagacuagggucagccggagucuagugacagcucagcccugccacauguccagcauaaaaaccaggaacuagacguaucccuaccccaaaucugauguguacucuauaaccuaccuuccucacaguccucaggggaccuuuagaacacagaagccacagcuguuacuuccagcacuguuuucaguaucucguuugcuaggacacucaucucccuacagcuuaccuggaaacacuuuucuguuaacagccacucaaaaccauuaaaaagucuugagcaacacuccaaauuuuuguuucugccguucauugccguuauuccaucccuccaaaccagcucucccaccauagcccuaagggcuuccgguuuucuuagucuugcauauuacaguaggcucuuccuauaaaguaauucacucugccucaccucagcuacuuuucuguuccuuaccucuuugcuaggggggauguaaccagcauaggccaagacaaaacugcagaauuuguuaaaauccucaaugguucuccgccuuuucuccgguggcuaaauggaaagacaaaacacgaucguauggaagccaggcacgaauguuaaaggagcccuuccccaaaacacagcccccuaaauugucacucaguguucugguaugggacagcucaccugagucucugguuuaagagucggaggcggaucugugaaaucaauaaaagcugagucaaggcacuagaaaagaguccguguaaaauccuaccucuaaaccucggaguucccgaccuaaucccauccaccgugaggucgccuagcccagccagccacagcccccagcugugccggacccgccccugcucccccuuccgccccaaggggcggagccugggcgcggcgcccuccccggccucgcuauagcgcuccccuucccccaccccgaggcccggcgccccgcccccucccagccucuccagucaacucggcucucuuggcgccccaccccgccauaccgcucccggggcgagaccaggccaccgcccgcccccguccuucacacgcgcccggagcccagaguucccagccggccgcgcuccacugcccugggcccuccgagaccgcacaagccgccugcccgcccccaggguccaggaugaccacgcugaacugcuccccgcccuccgggccccuucgacucgaacacgaggccgggcgcgccccucacccccaccccaaacacacacaggcucacacuccccaacgcuacuucgcguccgggacgggcgaagagcugcagcccggagccagacccccaccccaccccgcggccgcgcuccccacaauuucgcugucccuccgcccccauccggggcuuuagccccucccuccccgucucgagcucuucgggcuccccgccgggcccccgggcccaguuccgagcuucuccggccgccccccucccgcccccggacucagcgagucccuuaggcuacggacccauaaacucuagcccccggucacccuccagccgcuccacagaaggcccccugacgacgccgcuacccccaauacacacuccacaacucggaagcucuugccccggccgaccaaccccccacccgcgcaaguugccggucuuaacccccacacacacacaccucgccccgccgccccuacaaguaccgggcucgccucgcuucccaguucuccggccccacagcugccccucgguaucgggcucucuaccggagacaauacccagacccucuccccacuccacaacuaccugcccaccccucuaacaaucaccaagcuagcucuggcggcaacuacgaggugcucaagcgccaccgccaccaacucccccaccucggccaacuaccgggccccucacucaauccucuucgugcucccucaacucuacggagggcaagcagcuucccccagccucucugucucagagcuccaagcaguccgaggccuuuucagcccuuaguucccgaagcugggucucgggcgcucagaccccgcaccgccacucuccacgcuguaccugaugucuaacuaucccgacccagucucccgcuccucuuucuccaagcuaucucaacucaucgcccuuccaccucaagagccagggccccgacccccuuucccgcacuccuccguugggugccggggcucgaccuccaacuuugcccauugaauccucaccccgcucccuguccucugugccuauggagugcuuaccuucgggacugggcuccgccauggcuuccagcaucgcccccuccccuccacccgguccggcgacccccuccucgaagccgggauucccggugcugccuugagugcuccguguuucuaccgccucgcuccaccgaaguguccgcuuggcgcgguugagacuccacuccgcuaccgccaccucccuccaccacugccucccgcacucccggaccgggcccccuccccccgcaccgccggccgccugcucccuccuccuccuccuccucucuccucccucccuucugccccu

SEQ ID NO: 6133 - RNA, 12477 nt, Mus musculus
cgggcuugggucacguggcauggggagaggugggcggggaccucggugcugcucgcgacguccguggagcuaguggcccucgacugugcggucuagguuuugagucucgccacacagcucuucccgaucagcccgcugguccccgccauccuccuugggcacgucuuccgcacuggcccugcgcuguuggcgcuagcgcgucaguuugcgggugugcgcaggcgcggcgggggcgcuuaguccuguugggugggcggcugagcccgggagcgcgcgagcgagaccauggcgggcagcagcgcggggggcggugguguaggcgagacgaaggugauuuaccaucuggaugaagaagagacuccuuaccuggugaagaucccugucccggcggagcgcaucacgcucggcgauuucaagagcguuuugcagcggcccgcgggcgccaaguacuuuuucaaguccauggaucaggauuuuggguaagcgcgaggccuagacugggaaggacgguggguaugcuagaguggauugggcgauauugagggagaccggucuaccuuggacuguuucuggccuguaguggagcauagcauauuguacugugcuaagguagaaagcccaucccaagacggacaagguuauauuuggacacauagaagaaagggcuggauggcgagaaaauuagguuggaggaauggggaacacugguuuguuuggccauucucucuccaugauuuuagccaaaaggcaaagaagugaugcuugagguuaugcuaggcugugcggagauuagagccaucuaucuuuuggugagcugggaugcucgcucucagacgucugcacgcgaguuagauagagauagucuguaauuuuguuugccuguuuugauuuguucuuuuguuuggagguagggcuuuauuccuuguauccuaggcuggcuucgaacccauggaguuccugccuuagcccccagagcugaaauaaacaggugugagccaauaugcugggcaugcaguguuuuuauguagaccgggcuauagugagacaauuaggcuauucuggcuuauuaaucagguuccauaguauuauuuugggaugguagagucuguaauauugcagcgagaucuauugggauauauuaggcuguuuugaaguagacuuuccuggcaaagcauguaccauucugaacuuuucugaguucuuauuuccucuuagggccagaaccuccucuccccgcuaccccgauacccccugggggcugaagagaguuggaggauuuuuuugcuuuuuuuuuuuuuuuaaagauauuuuauguguugggcagugguggugcacaucuuuaaucugagcacuugggagacagaggcaggcaguuuucugaguucaaggcuagccuggucuacagagccagugccaggacagcuagggcugcacagagaaaccuugucauaaaacaaacaaaagcuacuuuauguguuuggguguucugcaugcauaguguguaccacaagcaugcagugcccaaugaauccaguagauggcaugggaucuccuagaacuggaguuagcaucugccagccacuaugugugugcugggacuugaacuccagucuucuccagagccagucagucugcugcugagccaagaacuuccuucuguuacugaagcuaccuagaacacaauauagaacaggcuugccuugaacuuguagcagcccugccucuacaccugcauccauagugcuggaacuagauaacguguggcagucaggaugccuggcccagaccugggcuuuuuacaaguuacaagacagggacaagugggaacaaaugggguagugguacugcuacaucauagcagaaugggguacuguaaucaguauggugcaaagggcugcuuguguggggacgcugggggcuauggaguucuggggugauuugugacaugcugggugacccugugcuggacugagacuauaauuuaaggcaguuucuuguuguuguagagauugggacugagccuucuguguccccaagcucagacuguguuaggcuaugauguccugaguugacaagcagggauagcaggguccuggggacaggaaggugaccuaccaccuggguuggggagagacuucuuaccugugaaagucccuguggugggagcacaucccccucggcucccugaacaggcuggacccuuguuaacaguuguucgauguggagaaggugaugcugccuagggaguuggucuuggguuuauaucaagguuguucuuuuugcauuauaauuuugggcaauuuauuuagcuuuugugcuuugauuucuucaucuguggcauggugauaaucauaguguaaaaugcuuaauuucggugcauggcacaugguacauucuuggugacugguaauuuucauuuaguauggaagcuaacuaguucauagacuacauuacacgauacagaacugcuugcuuuggaggagacugggccauguccggugggguucuguugggaagaguugguuaauguugaguagcucgugugccgucuugauagcaaauguauucgugaggccuauccccaagcccccagaguacguuaggcuagaacuaaucacacagacaaaucugugcacacagugugccugcuuggugccuggaaagcuuggcugagacaagucagaucccuugggacucgaacuauggauaguugugagccacuagguggauucugggaacuaaaccugggucuucugcgagaacgaguguucugaaccacugagccaauucuuuagcccccauccccaccccgaagaagcucugauuugagggugaggguguuaugugugggaaagaauggcucauggcucauaguuugucuacauggauuugcuuacaaaggugagggcuugugccacacacccaggacauguguugaaucuaauagguacuaaugauuucuuguggguaugagaaggaaggaacaggucuaguccacuacaggaaccugugggaggcugggcuuugggauuuuucagaccgagcagauugcuuagugaggugagguggcccggaauugggaagcccagcuuccucgcuccaugggagcguuccacacguggacuguuauuguugcauguaagggugauuuuuuacccagaaaagccacacauuuggguggcucugcuugugaauuagagagaacucaaaggcagcagguuccgugaggaccagaggcuuuuaugggacagauguguaggacagagaugguuaggcggccagccaggcucuuaaauuagauauuuggagcaguugugggaacugucccaaagggacuuuggagugguacuuugagguuuggaucaaaugggaagaagucuuuggaguggcauugugccucuaaggaugaguugggguagugguaaaugagagagucuagaauuuuuauuuauuuauuuguguauaaaagcaaguuacuucacugugaaagcagaggagcugggcauggugaugcaugcuggcugaguggcauagccaaguuuggugacauaugccuuuaauaccaggauggagaggcagaguuaggcagcucucugugaguuugaagccagccuggucgucgcuaccgcugcugaaaaaaaaaagggcagaagucuauagacaguuggcuuagaggaugccgcuguguucuguucuuagcacuagcacccacugguggcuccugacucccuguaacuagcuccaggggagauaauauucuccuguccucugcaaauacccucaugugacagccaugcacacagacauguacauauacauuaggggaaaagcagacgacgugucagucagggcagcaagucaccaugcuugggcaggauggagauggggagagacuuggaaugagauuuggaaugggagugacuaguuuagcuuuacuaaucucccccauccccguguuugucccacccccacccccagaugggguuucucuguggagcccuggcuguccugguucucucuguaaacuaggcuggccucaaacucagaucaccugccucugcuuuccagagugcuggcauuaaaggcaugcaccaccaccgcccaucuaggguguguguguguguguggugugugugugugugcgcgcaagagaaacccuugcucacugagugccucuugccucggccucccaaguguuaguugaagguguaccccaucacaccuggcaccuuacuaaucacucugcucucuccgcaggguggugaaggaagagaucuccgaugacaaugcccgccuaccuugcuucaauggaaggguugucuccuggguaaggggacucauuacugagcugcuuccaaccucagucugucucugcagccuccccccugcucagucgcggguggccuggcuucccucuucucuaauguggauacagugagcacuccucggccuccucuuccuauagccucccguacuggauuguuuuuucuggccucuucacccaggucuccaggacccuguguccuucuuuucugguccuuuuccuuaguuucuucucguacaccgcuccccagcagaaccauguuuucuuacgugcucucuucuagcuugugucgucagauaccccacagccugagguggcucccccagcccaugagucucggacagaacugguuccuccgccuccacccuuacccccuuugccaccagaaaggaccaguggaauuggggacucaaggccuccauccuuccagugaguccuuuauauucuugaguccaggggaugggagcgaagagggaauucagucuagaccucuugagagagggggacugagguuccggugcucuguccgacugacuuugguuggaaacucucucuaccuguguagcccuaauguauccagcagccaugaaaaucuagagccugagacagagaccgaaucugucguaucacugaggcgagaccgaccuaggaggagagacagcagugaacauggcggugaggggauggacccuggaggcaggguagacugagcugggcagacaggcaagccuuagcaugcuggguaugaagaaggggaggccuggcuccugagucucuuguuuauacacagcugguggccacaggccugguggccccucgaggcuggagcgccaccuggcuggcuacgagagcucuuccacccucaugaccagugagcuggagaguaccagccuaggagacucggaugaggaugacaccaugaguagguauggcugcacacuucccucccuguucccucccuccuccccccuccuccccucccccucccccccagccagucuucuuguuucauguggcucccugaccacuuccaccuccaaaugcuaugcuucucaauugcuaucagguucagcagcuccacugagcagagcagugccucccgccuccucaagcgccaccgaaggcgaaggaagcagcggccgccacgcauggagagggugaggguucuuuugggaugaagugggcucugguugaaacacaagcuuguggcuucucucucuguugacggggagcaguucacaccuuucaugucuccccgcuguagaccucauccuucagcagugucaccgauuccacaaugucucucaacaucaucacggucacgcucaacauggguauggaggguccugacggggagaagggaaggagagagaggggcuugggguuucuggggcucagucauauggccccccuccacagagaaguacaacuuccugggcaucuccauugugggccaaaguaacgagcguggugaugggggcaucuacaucggcuccaucaugaaagggggcgcgguggcugcggacgggcggaucgagccuggagacaugcuuuugcaggugcgcugacggccuggcugcuggcuggggcggaugcucugccccucccacacugcccaugacccaccaccccuucccuucagguaaaugauaugaacuuugagaacaugagcaacgacgaugcuguacgagugcugagagacaucgugcacaagccagggugagugcggcuggccccaggccucuugggcuuaagccuguuuaccuuuguuuugcaauuuuuauaaagacgugaggccaggcaugguggugcaugccuuuaaacauguuauuugaggcacaguugggcugagugugaggcagccuggucugcagagugaguuucaguccauccgggucuacauagcgagaaaacaaaaaccaaacaaaacaagggcuguagagauggcucagcaguuaagaacacuguuugcucuuccagagauccugaguucaauucccagcagccacaugguggcucacaaccauuuguaaugagaucugaugcccucuucuggugugucugaagagacugacaguguacucacguacauaaaaaaaaacaaauacgucuuucaaaagagaacaaaacccacaaauugcaaaucucccuggcaugucacuccacacuagagcaugaagcagaugugggugagcaccugagaagaggccacccacugugugcuccuugccacucccucuccucacugaugauaauuaccguuuggcuucuuuggucaagaaaaccuuuaaugguuuuucaugcaugaguccuggaacaagaugguuugguguuaccugggugaggcuugcugugagugaagggaacauucacucugcucuccauuguuccccgcagcaguguuuugaacuuagccauguugugagucacacgcacuguggaggccuucacccucacucucucuagcccagcaacgugagcucuuuucuuucccaccucucuguccucagucuccucccaccaggccucgggcuuccugaggccucgucccuccccugagcugcucugcucuuccccacagccccaucgugcugaccguggccaaguguugggacccgucuccccaggccuacuucacccucccucgaagugagugaugcuggggcuggggucuggaguuaggagaucuggggagcgugggcacuugggagguuaaggcgggaggaucucuagauggaugaggccagccugggcuacagggugaaacccugccucaaccaaacaagcccaaaaagagaugagaaaagcuggaaguuguagggaauguguucaggagggccaagggauggggguagacagaacuccuaauucuggaacacacaggccuaguuuuccaggcuugagcagcaaucaucuugguguuucacguuacucuuguccuagaugagcccauccagcccaucgacccagccgccugggugucgcacucggcugcgcugacuggcgccuucccugcuuacccuggcuccucaucuaugagcacuaucacaucuggcuccucucugccugauggugagucucucuccuuucccgccucccugggugugugagggaccuuucguaaguucuccguggucucuccuaucaggcugcgaaggccggggucucucuguccacauggacauggccucugucaccaaggccauggcagccccagagucugggcucgaaguccgggaccgcauguggcucaagaucaccaucccaaacgccuuucuagguauucccaggcccugagcaagguggcaugggaagguggggaggaggccaaagcugggcacaacacaagguggaggggaggggaggagcugggaggagagucugaccuguuugcugugcuggaucccaggcuccgaugugguggacuggcuguaccaucacguggaagguuuuccugagcgccgggaggcccgcaaguaugccagugggcuguugaaggcgggacucauccggcacaccgucaacaagauuacuuucucugagcagugcuauuaugucuucggggaccucagugguggcugugagaguuguaagucagcaggucuggcuguaggagcucaggcugaugugugccccgguacugcugaguaguacugcugaguaagcgagguaccugagcugcauccccaagggaaagagugcugcacggggcucacaaaagcauuuuggggcuauuggugagaguccuggcuguuucucugccagagcagcagaguuuccuguuguaagccaucauggucucuggcuuuugucucguggggagcucuggggaaauggcucagguuucucuguucucaggaauccuggccuccuaaagcagggaccucucuuccauuuuuuuccagaccuaguuaaccucucucugaaugacaaugacgguuccaguggggcuucagaccaggauacccuggcaccucugccuggagcuacucccuggccccugcugcccaccuucuccuaccaguauccagcgccacaccccuacagcccccagccuccacccuaccacgagcuuucuucguacaccuaugguggaggcagugccagcagccagcacagugaggguaagugacccacucccacguaccaguacagccagagaaagugggcacaaguagagcggauucggggaggagaggcaagagcagggacugggauccugaggacucugggcugagcuucauuuuccucgucaccucugcccuccaacagggagccggagcagcgggucgacaagaagcgaugggggggcugggcgcacaggcaggccugaggaacgggccccugaguccaaguccggcaguggcagugagucagaacucuccagccggggaggcagccuucggcgggguggggagccuggugggacuggugauggcggcccuccuccauccaggggcucgacaggcgcuccuccuaaucuccgagcucuucccgggcuccaucccuauggagccccaucuggcauggcucuccccuauaaccccaugaugguaguuaugaugccuccacccccacccccugucuccacagcagugcagcccccuggugccccuccagucagagaccugggcuccgugcccccagaacugacagcuagccgucagagcuuccacauggccaugggcaaccccagugaguuuuuuguggauguuauguagggacccaucuugaggccacauugggucugugcccuuggccuggcaaguuucagccuggugcccuucauagugccugggcucagccuggcggcuggugccuaccaaaacguuuuugccacugugacucucaccagcagugccugguccuucccccucuuccucggggguagauggggaccuuugguuauuuuuagcuuuauuuuuuauaagcuuuuugggggguuaaaauagacuuucuuauauuugggggaguauuuuuuuaaauagacaguuccucuuuuauauggagaaucccuucuaaccccagaauaugaccgccaccuccaggugccuagucagcucucauguugagggugggugguggucagugguacccugggaagaagaaggugugggcuggguaccccagacagcaguccaaggaggcuggugguguguuggggacuguguagcugccuuuguuacucuauuuauuuuagucacuuguacaaaacaccaaauaaagcaaauagaggccaacuccccaagccucuggcuccuuucuuugcgaggcaggcaguggagaggagggagcagugacauucacggcagacagugacuugguagaaaauuuauuguuaaggcaauaaguacuccaucacccccauaaaggguuuuggcaucagagaaggcacaugaccuugccagggccugauugggagucucagauucccaggggguuaccggugaccaggccaccauucuccaccauggccuuggagaugcuucugaaguuccggaagagcuccugaugcugagggcuggacugcagacuggccauguuuucucggauccgaguugcagccuggggagagggaaggggagggacggucaggccguccuguacuggggagcuccaaggcccaccuguacuggggagcuccaaggcucaccucaaugcaccagcuaucacagagcauuuucucaugcugugccgucggguagcccucacucagggaccuugaggcucugugaggaaacagagguuaaaaugauccugagugcugguguuggcccagcuccucuguggcucuagccugccaagcgucccucgcugccgccuuaccuggacagaaccaccaccauggcauagaggucaauggcgccguccgccagucgcugcagcaggaacugcucgucugucagguagaugaggguggggcuguuagucggagggagggaaucagggagggaaggggguugcagagcucacucacugacaaucccuuucuuguguuucaccagcuuggccuccaccacgguggcaaauugauccagagccugcacugccugaagagacaagagucacagacagagcucaggagaggaaggcagcgcacagccaccgcaggcucugcuuuaaggcucacucaccaguucaccacugcgacuuaacucuggguggacaaucccugacagacucaaaccacugccgauuccuguccuccugagaggagauggaagagugacuggucaguugcggccucccaucuuguuugacccugacucugacccuggccccggcccaugagguaccgucucagcuguuugccugcuucucccaucaggaggccaacguuuccaaaaggauucuucagggcauugcccagcccagugaguuccuuuccuuuguccuguggagagaagggggacggcgacagugaggacucaguguccuccccagcugcucucucucauccuccuuccucuuaccauacagccuugcagagccacaaacagucgaagaaugucauuugccccuucaaagauccggaagauucgaauaucucggagcacacgcuccaccccugguuccuggcacgcaggaagacacagaaaccucuguugagaugugccuguccacucugaacagaugccccccccugccgaggaauacucuguaccuucaugaagcccaugccccccauuauuuggaugcacucaucugccacuuuccaggccgccuccugaggacagagaaccagaugaguuggauuuuugagcugagguccuaaucuggacuccgcccucccaucacaccuggguccucaccgagcaaaagauuuugcugauggcggcuucuaucuggaagucuuugaaucccugguccauguuggcacucagcauguaagccauggacuaagggagcauggucgggacauggggaagacaacagggaagggcugcaucagacagaauggcuaaugcucagaccuucaagaccagugcugaucuacuccuccaacccuugaauucacuuuagccuccuggucaggucaaauauguccaauaugugacccucugguauaucaggggcuucgaggcuuccgacuuuguaaagggguggguuaaaagucguguuuggugcaucugggcagcauuuagcagagcagcaccacccuccagaagagaacugacuaugccuccucgcauccccuagggcauugguguaaagcuggagacccacugccccaggugcugcuggggguuguagucugacccaacugugaagaaagccauagggcuccagggaaggggcccaggaggcccuuaccucagucacauacugcagaauagccauccgagccagcuuuuccuggaucaccccaaaguugugaauuuuguccccaaacuggguacgauuaguagcaugaucaaccugcaagagggcgcauguuaccccacugugguucuucaguuuccaccuggacgggcuggaggccuaacugugccgauggucgagugugcaugugugugugucggcgcucugaggcagucagggacaugugcuagcuagggacugggcugggacucaccgccuuggcaaugagggauuucauggugccugcgaggguugcagccaucccgaaucuuccguuguugaggauguugacagcaaccuugaagccaucucccaccucuccuagcacauucucugauggcaccuucacuccaucaaaguacaccucugacguguuagaugcuuugaugcccaucuucuuuucagggagcccacugaaaaggcagggcaggaaaguugagguaugaacagguugcugugggggaaaacggccuuuucgggucucaugaucaggggagaacuccccagacuauaaaaaggauacagggcacugccuaugugccccaggggcuacggauaucuagcuauggccuguuagccuguguucccccaguggaaacaaaacugcucaccuccugugggugccucuuguacagagauagccccagcguggccuguauugacuauuugcucuugagagcccagugcuguccccauccuugauucuguuuugccccauacucacuggguaaccccuccgaagcuccuuuccacuacaaaagcugugaucuucucuuucacggcccccgugg

SEQ ID NO: 6134 - RNA, 5248 nt, Mus musculus
agacagugacuugguagaaaauuuauuguuaaggcaauaaguacuccaucacccccauaaaggguuuuggcaucagagaaggcacaugaccuugccagggccugauugggagucucagauucccaggggguuaccggugaccaggccaccauucuccaccauggccuuggagaugcuucugaaguuccggaagagcuccugaugcugagggcuggacugcagacuggccauguuuucucggauccgaguugcagccuggggagagggaaggggagggacggucaggccguccuguacuggggagcuccaaggcccaccuguacuggggagcuccaaggcucaccucaaugcaccagcuaucacagagcauuuucucaugcugugccgucggguagcccucacucagggaccuugaggcucugugaggaaacagagguuaaaaugauccugagugcugguguuggcccagcuccucuguggcucuagccugccaagcgucccucgcugccgccuuaccuggacagaaccaccaccauggcauagaggucaauggcgccguccgccagucgcugcagcaggaacugcucgucugucagguagaugaggguggggcuguuagucggagggagggaaucagggagggaaggggguugcagagcucacucacugacaaucccuuucuuguguuucaccagcuuggccuccaccacgguggcaaauugauccagagccugcacugccugaagagacaagagucacagacagagcucaggagaggaaggcagcgcacagccaccgcaggcucugcuuuaaggcucacucaccaguucaccacugcgacuuaacucuggguggacaaucccugacagacucaaaccacugccgauuccuguccuccugagaggagauggaagagugacuggucaguugcggccucccaucuuguuugacccugacucugacccuggccccggcccaugagguaccgucucagcuguuugccugcuucucccaucaggaggccaacguuuccaaaaggauucuucagggcauugcccagcccagugaguuccuuuccuuuguccuguggagagaagggggacggcgacagugaggacucaguguccuccccagcugcucucucucauccuccuuccucuuaccauacagccuugcagagccacaaacagucgaagaaugucauuugccccuucaaagauccggaagauucgaauaucucggagcacacgcuccaccccugguuccuggcacgcaggaagacacagaaaccucuguugagaugugccuguccacucugaacagaugccccccccugccgaggaauacucuguaccuucaugaagcccaugccccccauuauuuggaugcacucaucugccacuuuccaggccgccuccugaggacagagaaccagaugaguuggauuuuugagcugagguccuaaucuggacuccgcccucccaucacaccuggguccucaccgagcaaaagauuuugcugauggcggcuucuaucuggaagucuuugaaucccugguccauguuggcacucagcauguaagccauggacuaagggagcauggucgggacauggggaagacaacagggaagggcugcaucagacagaauggcuaaugcucagaccuucaagaccagugcugaucuacuccuccaacccuugaauucacuuuagccuccuggucaggucaaauauguccaauaugugacccucugguauaucaggggcuucgaggcuuccgacuuuguaaagggguggguuaaaagucguguuuggugcaucugggcagcauuuagcagagcagcaccacccuccagaagagaacugacuaugccuccucgcauccccuagggcauugguguaaagcuggagacccacugccccaggugcugcuggggguuguagucugacccaacugugaagaaagccauagggcuccagggaaggggcccaggaggcccuuaccucagucacauacugcagaauagccauccgagccagcuuuuccuggaucaccccaaaguugugaauuuuguccccaaacuggguacgauuaguagcaugaucaaccugcaagagggcgcauguuaccccacugugguucuucaguuuccaccuggacgggcuggaggccuaacugugccgauggucgagugugcaugugugugugucggcgcucugaggcagucagggacaugugcuagcuagggacugggcugggacucaccgccuuggcaaugagggauuucauggugccugcgaggguugcagccaucccgaaucuuccguuguugaggauguugacagcaaccuugaagccaucucccaccucuccuagcacauucucugauggcaccuucacuccaucaaaguacaccucugacguguuagaugcuuugaugcccaucuucuuuucagggagcccacugaaaaggcagggcaggaaaguugagguaugaacagguugcugugggggaaaacggccuuuucgggucucaugaucaggggagaacuccccagacuauaaaaaggauacagggcacugccuaugugccccaggggcuacggauaucuagcuauggccuguuagccuguguucccccaguggaaacaaaacugcucaccuccugugggugccucuuguacagagauagccccagcguggccuguauugacuauuugcucuugagagcccagugcuguccccauccuugauucuguuuugccccauacucacuggguaaccccuccgaagcuccuuuccacuacaaaagcugugaucuucucuuucacggcccccguggcugcaucuuuaauuggcgucuuggcaaagacagugaaaaugucagccaggcccccauuacuguggaagagugaggugguuaguauaggguuuagagcagcagggucaggccacugggcugaaggguagaagagaaacggaagauugccugauccagaucuugcucccauugagaguguaauauuuuccacaggggcuggguauggcugagcuucggauggaggcuacaucggauccacucgagggcucuguuaggcagaaagcagccaaagccugcccugugggggagagaacgggcucacuggggauccugaccaccagaguugcacccccucauccccaggcaguuccuuguaacaccgugagcagugucacacuccuuaccccugggucucuuaagguugccuuaccagaugccacucugggaagguauuuuucucucugggccuuugugccauagagcaagaugccuuugaaaccgaugcucugaugagcucccaggguaacgcuaacaccaaggucaugcaugcccacaaucucugccaagcgagcauacuggagggaaaggaggcaucugggauuguagcuggcugcacugaacuuguccucaacaagaaugggcagcagggcagaccuggccuggggcuuggagcaucucuacucugagcauggggaguggaguggguuuggacagggcacagggaggcuggccauggggcucccagguaggcugcuucucuagcaugaaacccuggagucuuuccuaaggagacaggagcaggaacaucaaagggcuuagauaauccccccccccccuuuugaggcaguuucauuuuguagcuccagcuagccugaaacuuuguggguuucccugacuguccugaaacucccucuguagaccaugcuggccuugaacucgagauccgcccgccucugccuccauccuccaugcugggauuaaagaugagugccacugugcccagcugcccuuggucuugaugggaagguugccugcuguguugccucacacaguccccaaagaccugggaaccacaguuagguccacgguccuagugggcugcacacagaucauguuucaggggaaaaugugugagaaaaagggcaggcagguagacacuacucuggcuacuugcuuggcccuaguggugagucuaccaaaacuggagcacuguggaauguuaaccagggggauccucucaccuggguauuagagaggcccaaaccacccagcucgcuggguacuugcaggccaaaugcccccaguuccuugagucccugcaaagugucguccuccaccuucuccaaggcgucguucuuggcagggucauucacuuccugagcaaggaauaggaagaaucucauauucagaggcuccuuuaagcuccuuagcaucuuacuuagcccaggaggggcugagcucuggucaucccuuaccucaaagaaccgggccacuggucccaccagcucuuugagaaauugugccuguucuucacugagcacuguauaaugggagagaagagcaggcuagucaggcagagagggcuccccugcccacacugucagugacugacuaagccuuuacuuaccagauggguaugggaacaccugaucaaugguaagcuggccuuugaacauccccacagcaaaggacuucgauuccuaggcaaggaaggaaaggaucuuaggugggugccuggggugauucuacuccugguuuuuaagugucaguccaguuuccagucacuuacugcccuggcugguuuuucucugguggaagcaucagaggagaggguuucuggcuuguccagaacugccuggagggaagggcagagcaguuaggcuggagaugggucuuaaaaggugugcaggaagcgcuagcucuaggaagugcguuuggugcauguuccauuacuuucucacuagggcacccuggcgugcccuuuccccuacuuucagugacagaacugccaccaggugacugggucgaagagagagaccccugucggucgcaggcuagugggaacuggcaacucgcauuucuacguccgucucccucauccacugucacuuaccugaguggccucccuggcauaaagucgcugggcagagauaggccgggguugucccugaagcacaguaguagaucgcgagcuguaaggagucgggguucaguucugcccugguucccagacccaguguccccuugcuauauacggaccuucgggcccccagccgcagcagcugucgccccacacucggggucauccgagccgacugcaucuccaaagccgccgccgaagucuugaccacugaccucuucucuucgcgucucgccugcccaaagguugugugucugggcccugacucaugcuccacaaugcacug

SEQ ID NO: 6135 - RNA, 13546 nt, Mus musculus
ggacccagcucuugccuagauuggccccuccucccucucaccuagcuccacuagcaccaccugucccgucucccagguuuagccccucuuucucuuugggcucaggcugucuccgaaagccagagucagcucucuauaccuuuaacagguaacugagguagugggaggcaggugguacuggguucagggacucuggguggagggaugagagcauauagucugguccaugagaauauggaaggaaggcugcagagccaggucaccucuugggaaggaaggagccugcaguauuucaagucuuucccugucagcuacccacguccccucgguccuuccacagggauuccagucuuagcacaaacccaaguuccaucucuaaggaaaucucagcucagucucagaucugucuccagcccuuagggccaucauggagaaggacugucaagacauccagcagcuggacucugaggagaaugaccaucagcucaguggcgaugaugaacauggcucucaugugcaggauccuaggauagaaaauccacacuggaaaggcaaguguccaguuucuggggccucucugggauccuugccucagcugccaguuccucucucuuuuucugugaggacucucucauccugacucagugaccagugugcucccgagucuguccuacucaggguuauuacugcugcgaugagcaaagugacuugaagaggaaagggcuuauuugccuuaugcuucgucaucaucgaaguucaucaucaaagggauccaggacaggaacucacacagggcaggauccugggggcaggagcugauacagagguuauggaggggugcugcuuacuggcuugcuccucauagcuggcucagccuguuuuauuauagaacccaggaccacuagcccagagagagcaccacccacaaugggcugggccuuuccccacuaaucaccucauaagaaaaugcccuacaggcuugguuacagccaaauacuauggaggcauuuccuaacuugaggccuccuccucucugaugacacuagcuugugucaaguugacauaaaacuagccaacacagugaccuacaugugagcugcugauaccucugagugcagggucccaagaaaaguguguaugcuuagaagugaggggguaucugagaggaugagccucccccgagacugcacugugcauguguauauaugcguguacaugugugcaugugcgugcauguauguacaugucuguaucuaggaugaaugcagagccacagacuguguuaaggcgaugagcugagugugugaaugagcacagagauccugggugauuuccauuuguauccugccugaaucuucuugcacauuuugaacacaggccccacauaauugcaaaaagguuuuaggguaagagagauccugcccugggcaggcuacccaguguguuccagaugauguaguuucaucucagaagaaacuugggacuucuuuuguuguuauuuuaagacaggguuucucacuuuguagcucaggcuuccuggaacucacccuauagccuuggaaucucaaguagccucccuauuuuagccucaggaguguugggaucacagcugcgcguuaccacgcccaggcaacgugggacuuacaucucugucacauugcuaauguuuuaccugugugugguccagucacagcaucugugucagcauccugccugugcuagcaucagugucacuucugaguccuguucgaaagauccugggaucucauuuugauagguucauuuauugcuuauuuauuugugauacugccauuggaacccagggccuugcacauacaggcaagaauugaaucacugaacccccugucuguuuucucagucuauucaucucccuaguuugacuuguguuuuccuacucuauugugucuugugaccaacaauuggacacugagcacugugaguucuguguugcugggugcugggugcugggugcugggugcuuuuguauucuggugaguauuuaguuuccugggaugcaggaaagugguguaggaucugacuccuuaugcccuaacugucuugguuucaggcuuucaggcugucuccucaacuuggggagucuauuagacccugucccaauuucuccucucugcucaggggccugaaaaguuucucuaggcagugaauagugagcugggcaauuugaggacucauucauuuuccuggcuuucagggauuaaugcucuucacagccugauguucagugucuuaaaaauugauguuuaauauguacauguauauguguauauguaugcguguauauauauguguguauucauguauauguauguauauaugaauguguauguauguauguguauaugcauguguuuauauauguauguguauauauguauguguguauacauauaugcauauguauguauacauguauguguauguauguauauguguaugcauguguguguguucuaauuauuuuuuuucugaaauaagaaauaagucugacagcuucuguuuugucuugaguagagcauuucaaaccugccuacacaguacuucuguuuuaaucaauaauucccagaacagcugagucaggcagcuacuuuuugucauugcaucuuauacaugaggaaaaugggcucgcuaggagacugaaugaugccaggccuaacugguggcucagcugguggcuuucuccugggcugacaguguaggggcuucauaggccacagguuagcugggaaucaugacgagggucuccuguaugaacaguacuagcagaagcagucaggaguuaaguuguggauuuccagcuggggagaugggucagaaagugcuucuaguuggaauauauucuguaccuucccgugaugcuaaaacagaaugcaucugacuaggaaacuuauaccagggacguacuggagcaugguucuugagucuaggaagcccagaacagagggcugugucugucagggcaccaacaugaaacaggagaccccagggagggugaaggggacaccaaagacgaagccuuuaauaaaugcuauuuugcacugucaauaauccacugacgagggagagcccucaaaaccuaaucaccauucauucagguucuaccucccaacguugcugcccuggagaucagaccgagagguccauucccaucacagcagagagggccgugcuuuucgggagagugucagggaggugagaggcagggaaggcucugcuuaggggcuugggguuggggagaacucagaagcauauccuugcuagguuaaguugggguccuaaguacggcugucgugaaggaaggugacaggcauugguauggaaaauuggaauucuggauagccacucagagggaacauccuguauacacccucaguacaauggcaagaaaugaccucaggaagauuugaccucuaggaugugggguugcucuggcauggugguacugagacagagaaggcuacagagucacaggcugaugcagaggagucugugugcaggugggugguacaaaagcagauggggucugggagaggagucacucuccugguccuggcaaggcgaggcgagccaguucauguaggugugugagaagcaaauaacaguguguaauaguguguggaugucugugagugugagcaugugagcaaauguguguuagaguggugagaggaagcguggcugugggacagacaggucagcaggcaggagaggagacugugggaagauggagggcacagggaccgcaggccagugacauuggguuucagggcguugugaacaagggugguggaagcuggggggagguuuucacuuggaugagaugaguagauaggccggcacagcggcuuuuggguucgugcuguauggugggauuaguuggucuggagaaucccacugggauugugaagggaugggcuugugugaggaauauagggguauugacuaaggggagcucaugacauaucccgucacugcuccauucugaagggacagggacuguggaaggacagaggugaucugugggucucugacucaugggcaggaagaaaaaccaugcagaccuccuuuuggagggugucuaguccucuggaauugcuuucugacccacucucucucacagggcagccucuuuccaggcccuuuccucagcgccucugcuccacguuccgccucagucugcucgcccuggccuucaacauccuccuguugguggucaucugugugguuucaucucaaagugaggucauggccuggcaggaaugagagggcaaggauagagagaaguaaucugggcagugcuggggcagugaggaggaagagaaggagagguggaggcagguucugggugcagauggagaucaauggugggugaugaaugguagcaagaugaaugaugguagaagagaugggugacauggggucagucacauggacagugacgugggcacguugugacauaguuccacauccaucuggucccaaaugucucccaacaaggcauacagcugcaagaagaguuucggacccugaaagaaaccuucagcaacuuuuccuccagcacccugauggaguucggggcucuggacacccucggugaguugggcuggauaaguggcacucauuuaucugugcagauuugauggacguggugcugggucuacagcaggaauaugcucucgggcuguggggaugaaaaccugggcagaggaauaguucagccagaggaacccgcaaggcuuccggcaauacgggcccugaccugggcaaugagucugggcgggaggugacaugguggccauuaguccuaggcagagacaagcagaagccaugauggcuuuuagugugacaggaaguggugauugaugggcaguggggaguggucagagauacggaggggccaggccacacagcaagcugugugggcugaguggggcguggcuugagaacauggagauccauugaaggaauuuaaauagcaugcuguggccucccuugggcgaggcugggagucugggaaaagcggagaaguagcaugugggaugaggugacagacucucauagauacccaggaugugcagccagagaggcauucaggagcccgacggacggggaaaucauucagcagcccucuuuuucaggagguagcacaaacgccauacugacuuccugguuagcccaacuggaggagaagcagcaacagcuaaaggcaggucagagaccuccccucccucacgcuuguucggucauuauaaugugugguauggcaugccuaugaguguuuccccagacaguagcuggaacccugugccugcucucggcagguauggagucacaagccuaccgcaucucugcccauguguuugccccuuagaccauuccacauugcucuuucaccugaagcacuucccaauggaucugcgaacccugaccugucagcuggcguacuuccagagcaaugguaggguagggacagggaagucucggguucgaguguggcugucuccuccagcuggaucucauuucccucugaccuucucuucguucaggcacggaaugcugcccuguuaacuggguggaguucgggggaagcugcuacugguuuucucgggaugggcucaccugggcugaggcugaccaguacugccagcuggagaacgcccaccugcuggucaucaacuccagggaggagcagguaaggaaaccugaagguaggcuugaucaaguagccugaucaagucucuguacuuaccaauuauuauuuacuuuaacuuuuguuucuucuuuucuucuucuccuucuccuucuccuccuccuccuccuccuccuccuccuccuccuccuccuccuccuucuccuuuuccaucucugucuccuucugcuucuccuucuucuucuccuccaucuccuccuucuucuccaucuccuucuucuccaucuucucuaucuccuucuucuucuuguucuccuucucuuucuucuccaucuccucuuuuucuccaucuccuucuccuucugcuucucuucuucuccuucuucucugucuccuccuuugucuccuucuucaucuccuucucuuuuuccacauccuucuccuucuccuuuucuccucugucuccuucuuuuccuucuccaucuccuccuccuccuucauuuuuaaaaccaauguguucaauuagugauaccaguaugugcauggguauagagccauccauuggagcaagggcauucaaccagggcuucggcauguuucuggacaugacagggcuugcacacaugaucacacaguggcuguggcugcaugcacaagaccugcauaagaucaagccaaccacaaccccaguauggaugaaagccuuacaugaagggcucuuggcaguuggcugcugagugaggaaggggcaguuuucucccuggcugcauuucuuguuuguaaccuaaagaacaauacaggagaagagugugguaggggucuugauggcuuaugguggaacaguaacugucucuaagaggugggagccaggaggcagaaaaggcaugaagucagggccaggugaccaagugaugcuaagccagauaggaugcuagccaagaugacuucaagguuagagcaugggagccaauccagugcggggacugagagucccuucuuccuguauuggcuguaggcuguggcaaaaggaacagaaugagaagccuuaaauugcuccucgaaguggcuucuuggguccucauugaccauagguguccugugucuuccuuccaaacuacuguccccagauaguaaccugaagaccaaaguucauggugggaaaccaaucuguuagaguggauggaagaguuucucauaagaaggguaauaaugauagccuucacagcaucuggacaugcucaugaguucaugucuuuaguccuuacaaccccguugggugggcaccaggaaagagaugugcccaggagcuagcaagucaugauggagucaggaucaagaugcacgcggccucuuuggucaguguuuucacgacuguuuacaaugcuaaagcaauuaaagcauuugaugcagaagucagaauauauuuaguauuugcugucugucaggcuaagugauuuucaugguaacuucagacauauuuugcuuuacuggucagacugaaguugcugauauuuaguuaauuuugacaugaacuuuauguaacucagccaaagauguggcucaugaguucaugacuccaguuucuugguggaccuugcugucauucugaaggucccacuuacugcuuucugccuugaccucaucucuggcuggcagacagggugugguccuuggguuuaguucaucucuccguccaucauucaguuccaaccauuuuugggucucuguguuuuagauuagugguucucagccuuggguaacaaaugucacaaccccugccucuuauuuuugaacauucugauuuaaucuccagcuugcuuucagacuguccuguagagcgcugucaggaagccaagguuaagggguuucucucacugagaguuagacacugugguuuugauuaagagaaaauuuaacaagagcgaaauuucucaucauuuaggaggaucaugaggaagcuuuuucucagcccucccucucccucugccucugcccuaccacaaaugcucccccaacccuucccugacuucuguuccuuuccuacuuuggaacugaggucuuguuuuguuguccagccuagucucaaaccgcugggcuccacaguccacccuccaacuguucucuaucucauaccuccucccuacccccuguuuccaugaggaugucuucaccccccaacccccaacccacuugaucucuaaacucccuggggccuccagucucuugaggguuaggugcaucaucccugauugaacccagaccuggcaguccucugcuguacauauguugggggccucauaucagccugguguaugcugcuuaguuggucguccaguguucgagagaucucggggguccagguuaauugaaacuucugguccuccuccagggucacccuccucuucagcuucuuucagccuuccccuaauuuaaccccugggaucaucagcuucuguccauugguuggguacaaauaucuacauuugacucuuucaacaguuuguugggucuucuggacugcggucaugcuaggucaauuuuugugagugcuccauagccucaguaauagugucaggccuugggaucucccguugagcuggaucccacuuugggccuaccacuggaccuucuuuuccucaggcuccucuccauuuccaucccugcaguucuuucagucaggaacaauuaugagucagaguuuuaacugugggauggcaacccccucccucauuugauguccugucuuccagcuggagaugggcucuauaaguucccucucccuacugcugggcauuucaucuaaggucccuuccuuugaguccugggagucucuuaccucccagaucucuggugcauucugggguguucccccaaccuccuaucuccugaguuugucuguuuccauucuuucugcuggccuucagggcuucaguccuuuuccuucacccaauaccagaucagguuccccucuacccaccaaccccuguccacauucccucccaggucucucccucccuccccacuugugauugcuuucuucucucuccucaggcguccucacuugggcaauucauccuguugaacuuuuugaguccuguggacuguaucuuggguauucuguacuuuuuuuugggggggggggauaauauccacuuauuagugaauacauaccauucauguccuuuugagucugaguuaccucacucagaaugauauuuucuaguuccauccauuugccugcaaaacucaggauguccuuuaucuuaauagcugaguaguacuccauuguguaauugaaccacauuuucuguacccauucuucugucaugugacauauggguuguuuucagcuucuggcuaucacaaauaaggccacuaugaauauaaggccccuguggcauggugggacaucuuuuggguauauucccaagaauugcugggucuuuagguagaucuauuuucaacuuucugaggaaccuccagauugauuuccagggugguuguaccaguuugcaauuccaccagcaaugaaggaguguuccucuuucuccacauccucaccaacauguauugucaccugagguuuugaucuuagacauucugauugauguaagguggacucucagugucguuuuaauuugcauuucucugaucacuaaggacuuugaacacuucuuugggugccucucagccauucgagauuccucuguugugaauucucaguuuaguucgauaccccaguuuuugauuggguuguuugguuuuuuagugguuagcuucuugaguucuuuauauauuuuggauauuagcuuucugucggacgugggguuagugaagauuuuuuuucccaaucuguagguugucaauuugucuucuugacucuggccuuugccuuacagaagcuuuccaguuucauguggucccauuuaucaauucuugaucuuagagccugagccucugaaguucuguuuaggaaauuucucccucugccaaugaguucuaggcucuuuccccacuuucucuucuauuagauucaguguaucugguuuuacuuugagguccuuaauccacuuggauuugagcuuugugcagggugacaaauaugggucuauuuuucacaguuacucugauaccuaaaccacacaaagauccaaccaaaaaggagaacuucagaucaauaucgcuuaugaauaucaaugcaaaaauacucaauaaaauucuugcaaaccuaauccaagaacacuucaaaaccaucauugaccacaaucaaauaggcuucaucccagggaugcaagguugguucaauauaugacaauccaugaacauaaucuacuauauaaacaaacucgaaggaaaaaaaucacauuaucuccuuagauacagaaaaagcauuugacaaaauacaacaccccuucauguuaaaaguauuggagagaucagaaauucaaggucuaacuggcugucuguauguagaaaaauggaaauagacccauauuugucaccuugcacaaagcucaaguuuucaggauuuuauuacauguauuuauuuaggugugugugugugugugugugugugugugugugugcauguguguacuccugugugggagugcagggcugugugugcauagaccugccauguguacagaggcuagagaggauguuguaugcccucuuccaggaugcuuugcuuuuuccucccaggcagagucuuuuucugacccuggaggcucacauuuuugcuagacugaagucuggaagucucagauauugucuuauuucuggcuacuauuggaagugagguuacaggcgucuguggaggaugccuggcuuguucugcaguugccggauucugaacuuaggucuguaugcugacggagcaaauguucuugacuacugagcccucucucuagccccaucccccaucucuuacauuugcuugugaaaugagcuuguguguguguuuucucaugguguuguggaauaugggugguuuguuuuuaguuacuguagaggugaccuguauaacucuaaaugguggacugagauuuauuggcuucaggaaccaagagugcaagcagccagagagaugggucagcaauuaagagcagagggcuaagauucaguucccagcacccauaugaugguucccaacaucuguagcuucaguuccaggagauuugauaccaucuucugaccuccuugggcaccaggcacacacacacagugcacagacauaugugugggggaaaaaaacccuauacccauaaaauaaauauaaaaauuuaaaaauaaaaaaaaacccuaagaguuuauauaacucuccauaugaaagaugggaaaagugucuccccuguccccucgcccugagauaagaucucauguagcucagguuagccuugaacuugcuacauagccagaggaggucuugaacuccugauugcccugccuucgacuccugguucauacugugccggcgggaacagacuuagggauuugugcacacuagacaaguacagugccagcuugguugagccauccacucuagcacacgucuccuuagcgugcguuguccuaaaaaacaacaaucaaaggucuuuggaacgaguggcuuguaugcucagcugucaguacuguguggccagcugcuugugauguccaccccagcucccacccugaggggagggguauguguuccuagaggguuucauuauugucaauguuucgagugggcgcgguuucuucuugcauucacuuaggaaagggcagaugagugauccggacuauuuucuuuggcccucuagcacuauuugaugacucccccucccggccuugaacucaggaacugggauuuuguacauuugucuuaguuauucaguuucuauggcgaugggauuagugacuacagagagcaucagguagcagcaacuugaauauccugucuuugcuccaucccuguugauacgucugaaucugugggguaaccucgauggcccuugcagcugcuuccucacacacaggccucuguccuacaugcagaauucuagauuuuuaugggugcugcugucacagguucuguucuuggauaagaaacccuggucucuagggagcgugaggggaauuggacaguuuuucuccaaauguggguggggccuccuuuacauguuaucaaaggagauuguuagagugugugcuguucaaauggacccucugcuucccuuauaaaaccggguggccguacauucccuugcaaccauacaaaaacaacgggaccuaaauuccaggaacaaccaccucuguaagagcaagucccuuggaacgguuuuaguccuagggagaugcaggggcauuugcacagaaggcccugucaguuccugacugggcuggcugccuuguacccaagcaucuuucuauguucaguggaggcagucaggccccauguagucaggucaagaugcaauucugggccaugggcccaaguuuggaaaugcuggggucugacaaaccucaggaaaugacaucaaaaucgcagcaagagaacgaggggccaacagagggaugacugaaaccaaggugcuucauggguucugagaucugcgggccagcaggggcaggaucccaaagaugcugugugcaaaagauugggaggagaugucguugccauagcagccaugcuaggaauggagugaaaagugggcccaggcuggaaacaggaugguugucacaagcuagauacugguuggcuuucuagguucuaauaacuaccuugcaaaaagaguuacuaugacaccagacuugcagagcuacugaggcuuggaagagauaaucccuacagagcccucagcacaacaccuagcuuagugaaaguucauuuaacacuagccacucuuauagaggaaaaagcaaggacagggcuguugguagcugaggcuucagcuuggggcaggcugggcugggcugggcugggcugggcuggcgugcggucccucggauguaugcauggaugagggaugaagcauuuugcucucucacuuguuuuuccaggacuuuguuguaaagcacaggagccaguuucauauuuggauaggucuuaccgacagggauggcuccuggaaauggguggauggaacugauuauagaagcaacuacaggugagugccucccucaucuccuugugaguuugcuccagguucaagcaccuggccuuucaccccaauguauuccuguagggccaguuuccccgaucuuccucccgauccuacucccccaucucaaagccuguacaucuucaacccuugaacccucccaagacugugcuuuuuugaggcaggggacaggguugugaggcgguggggagguuggaccuugaccuuucuuuggcuuaccuucuuaggaauugggccuucacucagccagauaacuggcagggccaugaacaggguggaggugaagacugugcugaaauccugucagauggccauuggaaugacaacuucugccagcaggugaaccgcuggguaugcgaaaagagacggaacaucacccacuaggagucggcucgaccaaucccccaccccgcccccacccccacaucccccacuaggagucugcucaaucaugccucugcccuaccuccagccccacaccaccccaacauccucacuggggauacuggagcaaggaagagagacagggucccaagcaugaggagggguuauggaaaacuggaaagggcauggcucuauggucucauaccuuaggaagacugagaauccccccuucugcacaauuuauugcaauuguuauaaauuucggccuucugaauggaguaggaaaaaaaagagaaagacuugaaac

SEQ ID NO: 6136 - RNA, 1887 nt, Mus musculus
uggcgaaccaaguguuggauguuggcccacuuaggcagguguuaaauccucaaagauaacauaauccacaaccagacuaccucucguuaggguuguggcccgaaccugguuuuauuuucugaccacuaaagaaaucaucuggcuggagucuggaucucagcugcggucuaacccggcccugugucgguggcaggucccgguuuauagggccuccuuccucuuggggaaaggcgcaggcgccacaugcuuuaucaguaacuuccuagcuaccagccccagcuuagcgcugagcguccugcaggguaggugggagggccaaagugagcgauuuaaagcccagaucaggcaggggcucuuaggaguugccccuuuguuccuuucggaauggugcgcagggcugagccccccgacgggggcuggggauggaugguggugcucucagcguucuuccagucggcgcucguguuugggguacuccguuccuucggugucuucuucguggaauuuguggcggcguuugaggagcaggcagccagagucuccuggaucgcuuccauagggaucgcggugcagcaguuugggagugagugcggcguccgggugcgguggccugccacccucggagaaaagagggaauuuggggaccagaaaggggaaagggucgggaggaugcugagggaggguggcggagaccaccucgcagaacccauuccaauucccuaggcccaauaggcagugcccugagcacgaagcuggggcccaggccuguggugaugacugggggcaucuuggcugcgcuggggaugcugcuugcuucauuugcuaccuccuugacccaccuauaccugaguauugggcugcugucaggugagacccugggcaagggcagaagucuaaggccuguaucucaagcuucuggguuuuucaccuucuuccaccucuuuccaaaaaggcucagggagaaccuaugcccugaagggaauucuuaaacugaaugacuaagucagagauaauccagaaaacacaagcccaaacccaucggacuggaggguagaagggagguuguuauuaagauugcgcuagguagagaccgaaauagauaucauugcuuacuuaaaaaauuaauagugacgcuuucgaugcuuacauacccgggcaauggaagauuaauguagccaaaaacaguagagauggggcucuuauuccaaaguucuguguuagguacuuuaggaacacuaucuuuugucuucccagaucccauagagcagcgguucucaacacguagguagcgaucccguugggagaguugcucaauucuuucaugggggggggggguggucacauagcagaugcucugacuucagauauuuucauuacgauucguaacaguagaaaaaauacaguuaggaaguaguaaugaaaauaaucuucugguuugggggaggagggucaccacaacauguauugaagagucaaaacauuaggaaggucaggacccacuguuauaagguguguuaaccccauuuugcagaugaggugguugagccugggagaguaagcagaacacacaaagucacacagcuagaaaguguuaaaacccagcacugugaacacccaggucugugggcgugcaaagcaggggcuagucugcuccaagguugugcugggauuacuggguguucugagcaccuccaaagcccacagccucccgccuuguucuccuuuugacaggcucuggcugggcccugaccuucacuccgaccauggccugccuuucccguuacuucucucagcgucgaucucuggccauggggcuggcccugacuggagugggcaucuccucuuuugcauuugccccccucuuccaguggcugaucaacaacuaug

SEQ ID NO: 6137 - RNA, 5676 nt, Mus musculus
caucccggcugaauaaaggagcagagaccgaaagaggagagagaccccgccccccucgagaagagaagccgcagccccugcgggacagggguaagaaccaaacccugaggguaucagauuucugagucuccaaagagggcuugggguuaguugauaguaauaagaccugaaccccaggaacugugcuaagaagagauggaaaguauugggucuagcgauaggagucgcguagaugggugugggcugcagaucauauuuggucccccagguaaagucugguaccugugacccaggcgcccggggagcagaggaaaggaagguaguggaugagguaacuagagucgaaccaacgcacggcgcgcgggagugcgggauuccucacgcucgcccuccaagcgguggaacgagaguuucuaacuugcuccaagaucuccgcgauccagcaaagggaaggaaggaagcaaccguuuagggcagaaugaacgagaggaauuaaguggugaugcugaguccgcuaucugauggcguugguuggcucuagggguaucccagguagaaaacaucagagaagaaaggaaucuguuuuaguaaugccuagauccucuaacuuuuucgguggcugucgcaggcuuaggucgcuauggguuccacagcggccccagagggagcucugggcuacguccgagaguucacccgccacuccuccgacgugcuuagcaaucugaaugagcugcgccugcgcgggauccucacugacgucacgcugcugguuggcgggcaaccccuaagagcgcacaaggcaguucuuaucgcuugcagguucgaggggguagggcaccuggggacuaacuggggaaaaaacagaguaacauggcuguugagagguaauccaaagcaugagggaagcugggaauaaugguccacaccggcaaucccagaacuggagaguaagaaggggggaggaaggaagaagggagggggaagcuugggagagcauccaaaaauugaggcagcagugcuaguggggaggcaagacucuccuuuggucucccggcuccuaacaugaccaacccaucugcccucucuccaguggcuucuucuauucaauuuuccggggccgagcgggacucgggguggauguacucucucugccgggggggccagaagccagaggcuuugcuccucuucuggacuucauguauacuucaaggcuucgccucucuccagccacugccccagcuguccucgcagcugccaccuauuugcagauggaacacguaguccaggcgugucaccguuucauccaagccagguaaaggaaccauggauuuguauucucccuagcagaacuagugccgggaauaagggcaaaggcaacgacuaggagacgguguuaaugaucauccuacuuuuucuagcuaugaaccucuaggcaucuccuugcgaccuguggagguagaacccccaagacccccaacagucgcuccaccaggcagucccaggcgcucagaaggacacccagacccaccuacugagucucgaagcugcagucaagguuccccaaguccagccagcccagaccccaaggccugcaacuggaaaaaauacaaauuuauugugcuaaauucucagaccucacaagcaggaagccugguuggggagaguucaggucaaccuuguccccaggccaggcucccuaguggagaugaagccuguagcagcagcagcagcagugaagaaggaaccacgccuggucuccaaagcagguauagaaucuauaacucccaagaguuuuagagucugguccacucuaggaggcagagccauugaguaggccauuguggcacccucugaaccagguuucagggauacuaacccagcuuagggaguuggccaaaggccaaaggugggacuuaaugaucaauauuggcucacuuccagaagacaggccuugaagucuguauauuccagaaaaggggcagggcggggggagccagugccccacccccaaucccuaaccuuuucuauggcucuuaacuucugccuagacuaucucuagcuacuaccacugcacgauucaaguguggagcucuagcaaauaacuccuaccucuucacaccccgggcucaagagacuucucugccagcuucuaagcaggcuaauccaccgccagguaagaggcuuucucuucuggcuucucuccuguagcugauccaggucgauuuggaccaaaaagaccucagaauagaccuauugaauagucccaaacuugacugcauuggacccccucuggguaacguucaccccagcagucagaaugucugagggugaggaccaaucauaaauauuuuuaagcucucuauguacuuccaaaaagcagcacaguuugggaauuucuggcccacccaauccaagacugaacgaucugcccagaguuuggcagggccucucuggcaagccagaaggaggcaagaaaggaaagaaacagaaagcuccacccacuccacacacugucagcaccauugaaauuagcagcaugcuacuaaaucagucguaucuuacugacugacuggccacgaacaagccaagugaccgccaguagccuccacaauaauuuagggguuaaaagggccagcagacccuacuaguguacuguuguagauuuauggguaccuggggggaguccucaguaaauaacuaagauugucauuguucccuacccuuaggaagugaguuuuucagcugccagaacugugaggcuguggcugggugcucaucggggcuggagcucuuagcuccaggggacgaggacaagcccuauaaaugccagcugugccgaucugccuuccguuauaagggcaacuuggcuagucaccgcacggugcacacagguaggagggggucuuggucuuccugaccaccgcucccguagggcgaucugacugucuuccaacuugcaggggaaaagcccuaccgcugcuccaucugcggagcacguuuuaaccgaccugcuaaccuaaaaacacacagccgcauccauuccggagagaaaccguacaagugugagaccugcggcucgcguuuuguucagguaaggagaaggcuggaaggcaaaugggaggagcgaagaggguuccgccccuccccaaggugaucucaaggcucugcccuuuagguggcacaccuacgcgcacacgugcucauccacaccggagagaagcccuauccgugucccaccugcggaacccgcuuccgccaucuacagacccucaaaagccacguucgcauccacaccggggagaagccauaccacguggguacccuauacagccuaauaauggaauuaucccucguauacgcagggacgagucuugccagaagugcuaggaauaagcgacagccuaaagagcccuagugaaucagaggcuugcacccgggagaagggguggagguaauuaugugccuggacuaggugcuguugucccaaggaccuaacaguuguugaugcuuuuguuaagaaaggcaaggccuaucuccugggcgcccccagaggacauagaaaggcugauugucagcggagagcuagacaguucccgaguccuaaaugaaaggugguuauggaaagguugggaccugacagaccuguccucccacagugugaccccugcggccugcauuuucggcacaagagucaacugcggcugcaucugcgucagaaacacggggcagcuaccaacacuaaagugcgcuaccacauccucgggggaccauagcugaguucccccccacccccagccaaacuucgcucccuaggggcagugaaagcuguaggcucaggcuugauuucccugaugguccugauaugggggugugccggguuacccugguauuagaaacugcugacaccuuaauuuuguacuggggaagagcgggagguggcagauccuggcuagaucugccucuguuuugcuggucaaaaccucuuccucauaauccagauuggguagcuaggggcuugggggguugggggggacuugcucucuuuaagggaacuucccccuccauuucaaaugguuuaucuguaaauauaauuuauugaggccuguaguugguaccagggccuuuauucuguuugcauuuccgacuuucuucuuccacaagugugaucaaaaaagacuggaaacacagaaggggagggcaccacucugcuggcagagauaccuagugcuuggcucucuccuuuggcuugagugucuuacauuguuuuguuuuguuuuuuccccccccuuuuccuuucuaacuuuucuuucuggaauuguccugucuuucccucccuuuguuugcuuguugguuucucuccaguucuagaacuggauccuuuaguuuuccugggcuuagcccugagaauaucgaagguuggguaauuuugguauuuuggaugaugaaagcccuguagcaggccagacauggaaagaaaccuuucagcuuuuugagggugaugggaaccuuuuguaaugaacccaaaauguagauaauaaacucccccugaaggcugggaaggugggagccagagcccgcaucuuccuaaauggaggugaguugucuccaccaaggaggcccagcaucaacgguuugccuggguucgaaugcacuaaguucauccaucagaccaagcuugccuaaggguuuguauuaaacccauaauccucucaccgggccugacuuaguaucuccugaagauccuuacuagagacuacaggaccguuucuuaucugucuggguucugagaaugcuaugaccuagagagaauuaauggcauuccuugacucggagucugaguccuuuacugcaugaacagcuggguuugaaugucccuuggcccuccuucuuugaauguguuuuuuguuuguuuguuuguuuuguguuuggacagcuucuggcaaguguccagauuccaaaacguucaucuuucaugggugcuugguagcuuucuuaacuuagaaaaucugggucugagacucagacuacccaacauuccauuccugucugggaccagugaauguacuaggacuuuacaccggaagaaaagagggcugccuucaaugcugcauuuguugucauuggggauuguugcugggauuauauacuuaaaagccuuugauggauuggccaaaggccccuuccacuugaacaaguuaccagagaguguuacaagguuggugagggcugcauuuucugguguggaacaugguagauaaagauguuagggauggaguuucaugguuagacggagugucuggaauguuaguauuugggagccucgauguacaguccugcuccugcugcccugggaccuauuugauuauaguacuuggguaaacgguaaaacgacuuaaauuuauaggacagagacuccugaaugaagguggucccuguggccagcagcuggggacaggugagaaagccauucauucuuccuguucccaucuaacugcccuaucaccugaaugcagacuugaacugugugugggcugggggcgccgacagaggagacaugagaaggugguuugauuucuguuuagcagacuggcugggcacgugggaagcgccagggugagauguuagaugcugcaagaucagauucuuggaauaaagaagcccuucuuugugccaucu

SEQ ID NO: 6138 - RNA, 4651 nt, Mus musculus
auguugagagaaucuuuuuuaauuauaauuuucuguauaaaaauguccaucacacagaagucaaagggcgagggcacaugguuaucaggaacgagguggauggcuccagcagcccucugacccucucucaggcaguccuugcuuagagucccaggugauccacagguccagggugaacaaugagggucagagguggaaggcucagcaggagaggagaggagcaucagcggagguggugaggaggccagaguccagggucaggcugucuggaacaggaaggaaaacggacagagauggagcaagcguggaggauuuuuccaagaaaacccucaccuccucaaacgccguauuacuaacugacccauuccccugcacugaaucuuccuucugaggccccugcaccagaaagggguuuucuguggggacccuccccuaccauccaggugaguauguuccccacccccagccagcgugggaggaggaggacuccuacccuggucaaaguugaguuucuuggcuggaggaguuucuccuagcccuucgacauccaccaggucacuguuggcgucggagucguucagagcacugagugucacaucugggagggggcauaggcuaaguucuagguuucccugacugcugucuuucccuccucccagucugccaaagcuucaugcucuacacaucccucuacccacucuggaaucaccagcguacagaagagaagcgucucuccuucuuugacccaggcccaauucucuuauugaaucucagauaggaccuuuaaccccuacccuaggcagcaacuccacagcccucaccagccuucuguuucuuuaugggaggaaccccagcuucagggacacuggagcugcuggguggaggggcguuuggaggugagaggacaccggacgucaucuucuuggguccuuucuugggugacucagcuggaagggggaugccggagucuucauacacuuuucgcuucacaguggucuuuaucugagcccugaagaugagagagagcagauuagggugucaucagagaagccgagggaagaggggaggggagggaauaaugggccacucugaaggaauucuaggaguuccuuuguagauauccaggucaaggccccaguucauguguaauaaggguccucccccccccccccacguucagaacuuuugcauccacuuagggcuaauagauuaagaugaauggagucccugaacugaguggccagaaaggcccuuuucaugauccucugggagagaugcaugguuuuguaggaccaccagguauguuguggugacauaaagguagacugagacugucauagaaccugaccaacuaauuaguucagaaugcauccccuggacaugccaguuucaaaggauuuacauaaauagcuagggaacucuuaucaucaaacacaaccacugaguaucugggcaccaugaaaauaaaguucucugcaggcccuagugaccacugcauuuccugaucuuccgaccaacugccacagugacagucucucagucuucaaggaaaugcuaacaaaacuaggaacaaaguaggaaagaugcugagcugggaguucugagagagaacaaugggucaggaggaagaaaguugcccacccuccccuuucucugccagccacccucccucacacuguccguuccuugaugacacagcugaugugauuaagaucguccccaaagcgcuucacagcagcccucagcaucucuaucuccgucuccguccacuuggcacugucggaaggggagaagggugauaacaaaaguggaagagggauguguggaaccagcccacaggcuauuccguccacagccagcagccucuucccccuagucucuaggggcaccuuucaaagauucauaaaaaggaccuccuuuuaaaaaaaaaaaagcccuggggacaaaucgcuggccacaugaaauuacauccagggccacuugaaaacaucacuucaucauguaacagcuuccauaaacaacccaacggaaaccaaugaaacaaguaggggccuuacaaacacaacccuugaaagauguguggcagcaguuugagggaguccacagggcuugggguagguggcagacauucugucgguuugcaguggagggcuguggccucgguagucucuuuaccugucauccacuaauucaacaauuaccaccuacacugagcugggccaggcacaggggaauuacucuaucucccugcucuagagagggucgugucugugacuugaguccaagcgucugaucucggaguccagguccuaggcuggucucacguacccggcaggggaagaguccgagacuggaugcagcugcaucgucaacuccccgagcuucgugaaggcggcgccggccgcggagaagaucucuccaaccugggggcggagcagcauuacggggggccggcagcgcgccgucccaccccagccucggauccgcccgccccccgcccagcgcgcaccagccgggagccaggcagggggcccacccucccguggccgccagggagcgcaguccgcgagggaggucgaaccuugguggacgcugacgucauggccccgcgcaccuccucacggagacgcuccgccgccaccaccaccacgcgagcuggaaaccacggagagcccggcagccggccgcucgggcucccgcgcaggaagucccgcccucccugcagcugauuggccgagacccgaccucuccccagucacucaaggggccucgccgcgcggaggaagacgagguggaagacguugcuucacuuccggcuagcuucauuccacuuccgucggaggguccggacuccucgaugaggccggucucagccccuuccagcccgggcccgccccucccugaaagcacagacagcaagcuuagggggaaccgcuucuuuuuauuguaguucagaacggggcgcggucacccucggucuccuccagaggcugggcgcaguuuugcagggccagggaugacgucucgcuagggucacaagucccaaaggacgccagaugagugggacggagucugcggagucuuuaaauagagaagggggcuggggagggagaggcggaccgcgcucuagcgcaccauguauuccuugcgcuuguugagacgaacuuggcagaaggagaagccuccgaggaggagguagaggcccgcggcgaugaaacaguuguagcugacuugcucguacagguuguauauguucugaggaccguuccugaagguggcgagcgagcagggaaaugucagccauucagagcauccaauaugcaaguucuaugcaucagacaccaugcuaaagcacuuuaacuccuauuagucuucccaagaagcauaccaaaugaauucuaucaugguaaccauuuuacagagguagaccaaggagcaggaaggcaaaauauuggaagaggccacaucuaagcuggugggcuuggguagccauggaaacguggcuugcaagacugcuccuaaguacaugccuuucugugucucugucucucgcgcuggggauugaaacuaggacccugcgugcugccacccaacuacuuuguagagagcagcccucuucuugaaguccccaaccuagggccacaaauguccagucuucagaaguguccuccccauaaacccaaaccaugcuacuccucauccacgcccaacucgcccaaguacccgaccacuuacucaaaaucuuucucugugaagggaacguccucaauuaacacagcagaauggacauugaaaaauaucccgagcauuaucuggaagaguaaggaauagauagguugucaaauucuuaccuuacuucuuuggucgcucccuaggcuccuccccugucuaauguuggcccaacacuugcgccagagaugaacuagaaagggcuaguuguaucuggugguuguaucuggauucggacucagccauguggaacagggcgugagguaggaccuugggaagagugacuggguauagggagguauauggcaaacagcucuccgaggcgcgucauuaucaugggagcagauggagaugaaacacuucauauuucuggaaguggcggccuugagggcccuggggaagcaaggccucagcuaccguuuucgggggcaagcacacuucacccucgccuccauucaacucacgcaagucucagggaccucgcucuuguuuaccuuggggaguccgcaaauuugcccgagcuggcucccauucccaggguccugccccagcacccuuucgcuccaguuccccaguugucuggaucugaguuccgucucguuuuccagcggcuauuuagucagccccuuaaucagucugcugcuuccuaaggcuugcgguuccucgugucccagcccuucaaccccagaaccccucagacccguucgcggguuaguccccucaccaacaugaucacuccccaggcgcugaggacgaugccacaggcggccagcuuaggcccacagcacaggagcgacgccauggagggcggagguagggagggaucgcuggagacugagcggagcacagaagccgggagagggaacccuggaaaugcuaggacaggagcuggauuuggggacuugcgcggcgcagagcgacg

SEQ ID NO: 6139 - RNA, 4651 nt, Mus musculus
cgucgcucugcgccgcgcaaguccccaaauccagcuccuguccuagcauuuccaggguucccucucccggcuucugugcuccgcucagucuccagcgaucccucccuaccuccgcccuccauggcgucgcuccugugcugugggccuaagcuggccgccuguggcaucguccucagcgccuggggagugaucauguuggugaggggacuaacccgcgaacgggucugagggguucugggguugaagggcugggacacgaggaaccgcaagccuuaggaagcagcagacugauuaaggggcugacuaaauagccgcuggaaaacgagacggaacucagauccagacaacuggggaacuggagcgaaagggugcuggggcaggacccugggaaugggagccagcucgggcaaauuugcggacuccccaagguaaacaagagcgaggucccugagacuugcgugaguugaauggaggcgagggugaagugugcuugcccccgaaaacgguagcugaggccuugcuuccccagggcccucaaggccgccacuuccagaaauaugaaguguuucaucuccaucugcucccaugauaaugacgcgccucggagagcuguuugccauauaccucccuauacccagucacucuucccaagguccuaccucacgcccuguuccacauggcugaguccgaauccagauacaaccaccagauacaacuagcccuuucuaguucaucucuggcgcaaguguugggccaacauuagacaggggaggagccuagggagcgaccaaagaaguaagguaagaauuugacaaccuaucuauuccuuacucuuccagauaaugcucgggauauuuuucaauguccauucugcuguguuaauugaggacguucccuucacagagaaagauuuugaguaaguggucggguacuugggcgaguugggcguggaugaggaguagcaugguuuggguuuauggggaggacacuucugaagacuggacauuuguggcccuagguuggggacuucaagaagagggcugcucucuacaaaguaguuggguggcagcacgcaggguccuaguuucaauccccagcgcgagagacagagacacagaaaggcauguacuuaggagcagucuugcaagccacguuuccauggcuacccaagcccaccagcuuagauguggccucuuccaauauuuugccuuccugcuccuuggucuaccucuguaaaaugguuaccaugauagaauucauuugguaugcuucuugggaagacuaauaggaguuaaagugcuuuagcauggugucugaugcauagaacuugcauauuggaugcucugaauggcugacauuucccugcucgcucgccaccuucaggaacgguccucagaacauauacaaccuguacgagcaagucagcuacaacuguuucaucgccgcgggccucuaccuccuccucggaggcuucuccuucugccaaguucgucucaacaagcgcaaggaauacauggugcgcuagagcgcgguccgccucucccuccccagcccccuucucuauuuaaagacuccgcagacuccgucccacucaucuggcguccuuugggacuugugacccuagcgagacgucaucccuggcccugcaaaacugcgcccagccucuggaggagaccgagggugaccgcgccccguucugaacuacaauaaaaagaagcgguucccccuaagcuugcugucugugcuuucagggaggggcgggcccgggcuggaaggggcugagaccggccucaucgaggaguccggacccuccgacggaaguggaaugaagcuagccggaagugaagcaacgucuuccaccucgucuuccuccgcgcggcgaggccccuugagugacuggggagaggucgggucucggccaaucagcugcagggagggcgggacuuccugcgcgggagcccgagcggccggcugccgggcucuccgugguuuccagcucgcgugguggugguggcggcggagcgucuccgugaggaggugcgcggggccaugacgucagcguccaccaagguucgaccucccucgcggacugcgcucccuggcggccacgggagggugggcccccugccuggcucccggcuggugcgcgcugggcggggggcgggcggauccgaggcuggggugggacggcgcgcugccggccccccguaaugcugcuccgcccccagguuggagagaucuucuccgcggccggcgccgccuucacgaagcucggggaguugacgaugcagcugcauccagucucggacucuuccccugccggguacgugagaccagccuaggaccuggacuccgagaucagacgcuuggacucaagucacagacacgacccucucuagagcagggagauagaguaauuccccugugccuggcccagcucaguguaggugguaauuguugaauuaguggaugacagguaaagagacuaccgaggccacagcccuccacugcaaaccgacagaaugucugccaccuaccccaagcccuguggacucccucaaacugcugccacacaucuuucaaggguuguguuuguaaggccccuacuuguuucauugguuuccguuggguuguuuauggaagcuguuacaugaugaagugauguuuucaaguggcccuggauguaauuucauguggccagcgauuuguccccagggcuuuuuuuuuuuuaaaaggagguccuuuuuaugaaucuuugaaaggugccccuagagacuagggggaagaggcugcuggcuguggacggaauagccugugggcugguuccacacaucccucuuccacuuuuguuaucacccuucuccccuuccgacagugccaaguggacggagacggagauagagaugcugagggcugcugugaagcgcuuuggggacgaucuuaaucacaucagcugugucaucaaggaacggacagugugagggaggguggcuggcagagaaaggggagggugggcaacuuucuuccuccugacccauuguucucucucagaacucccagcucagcaucuuuccuacuuuguuccuaguuuuguuagcauuuccuugaagacugagagacugucacuguggcaguuggucggaagaucaggaaaugcaguggucacuagggccugcagagaacuuuauuuucauggugcccagauacucagugguuguguuugaugauaagaguucccuagcuauuuauguaaauccuuugaaacuggcauguccaggggaugcauucugaacuaauuaguuggucagguucuaugacagucucagucuaccuuuaugucaccacaacauaccuggugguccuacaaaaccaugcaucucucccagaggaucaugaaaagggccuuucuggccacucaguucagggacuccauucaucuuaaucuauuagcccuaaguggaugcaaaaguucugaacgugggggggggggggaggacccuuauuacacaugaacuggggccuugaccuggauaucuacaaaggaacuccuagaauuccuucagaguggcccauuauucccuccccuccccucuucccucggcuucucugaugacacccuaaucugcucucucucaucuucagggcucagauaaagaccacugugaagcgaaaaguguaugaagacuccggcaucccccuuccagcugagucacccaagaaaggacccaagaagaugacguccgguguccucucaccuccaaacgccccuccacccagcagcuccagugucccugaagcugggguuccucccauaaagaaacagaaggcuggugagggcuguggaguugcugccuaggguagggguuaaagguccuaucugagauucaauaagagaauugggccugggucaaagaaggagagacgcuucucuucuguacgcuggugauuccagaguggguagagggauguguagagcaugaagcuuuggcagacugggaggagggaaagacagcagucagggaaaccuagaacuuagccuaugcccccucccagaugugacacucagugcucugaacgacuccgacgccaacagugaccugguggaugucgaagggcuaggagaaacuccuccagccaagaaacucaacuuugaccaggguaggaguccuccuccucccacgcuggcuggggguggggaacauacucaccuggaugguaggggaggguccccacagaaaaccccuuucuggugcaggggccucagaaggaagauucagugcaggggaaugggucaguuaguaauacggcguuugaggaggugaggguuuucuuggaaaaauccuccacgcuugcuccaucucuguccguuuuccuuccuguuccagacagccugacccuggacucuggccuccucaccaccuccgcugaugcuccucuccucuccugcugagccuuccaccucugacccucauuguucacccuggaccuguggaucaccugggacucuaagcaaggacugccugagagagggucagagggcugcuggagccauccaccucguuccugauaaccaugugcccucgcccuuugacuucugugugauggacauuuuuauacagaaaauuauaauuaaaaaagauucucucaacau

SEQ ID NO: 6140 - RNA, 1519 nt, Mus musculus
aaugagcugcaccauugagaaagcacuugcugucgcuaaagcccuuguugaaagauugagagaucaugaugaugcagcggagucucucaucgagcagaccacugcccucagcaagcgaguggaagcgaugaagcaguaucaggaagaaauccaagaacuuaaugaaguagcaagauaucagccacgauccacacuaguuaugggaauccaacaagaaaacagacaaaucagagaauuaacaacaagagaacaaagaacugcggacaucccuggaagagcaccagucugcccuggaacugauaaugagcaaguaccgagagcagauguucagacugcucauggccagcaagaaagaugacccagguauaauaaugaaguuaauagagcagcacucaaaggaguugcaagcacauguugaccaaaucaccgagauggcagcaguaaugagaaaagauauugaaauugacgagcaacaggguugcaaggaacaggagcgggauauuucaacuugaacaagaaaauaaaggcuugagagagacccuucagauaacuugagaauccuuuuuaaaccuucggaaggaugaugcgucagagaguacaucucugucccccuuagugacuaacagugaccugagucugaggaagagcugaguggcuuucugcauggucacuagaacgggcccaaagugaguagaugagugaacauaaaacccaacuucaggcagccuuuucugucugguauguacagggacacuggcaaagagacggcagcagaaaguauaaccaguggucauaaacuagaucccagucacagucagaaaggagacgcugagccacagagugaacagcgagucuucaaggugcugcugagcacugcaguuucagaagugcuguuggcuucuuagaugcuacaaagaucacccugaauacuccuaauagauguuggaaagccuaaauuaucaccauuuuaaaaguaagguuggugugguuuucugaauggaagacguucuaagucuuaccuuccuguucagugucagaguuggcauagcuuguguacauaaagcugcugcguuggugcucaccugcccauuugcucggcccucaucaaaggcaguucaugcuuaaaggcuauaggaauaugucacuugcaucacaaacagaaggaauauacuuacaccuaauucccauagcucuuaccuagcaguuauucaugacuuacuuacguguaugcaccucaggaaggaaagacaaagaauauacuuucuaagaaagacagccauagauaagacacauuuaguagguugaacuacuuugaaagauuauguuuugguucucuguuaacaaugaaccugguucuuccuccucuuuucaugauguuuaaggaaacaagacaguucaccgauagaaaagaguugacaguuuaaugagauagguauggucauuuccaaguuaauugggaauuucuuuauuguuacuuaagaaauuacucuucauacacuuacaaaguagauacagguuc

SEQ ID NO: 6141 - RNA, 17731 nt, Mus musculus
cgccauugcucgagccugugaagauggcggcggccguucuuaguggggccucugcgggcuccccagcuggggcuccuggcgggcccgggggucucucugcggugggauccggcccgcgucugcgucugcugcuguuagagagcauuuccggguuguuacagccgcgaacggcgucccccguggccccugugcaucccccaauccagugggccccgcauuugcccgggcucaugugcuuauugaggcugcaugggacggcagguggggcgcagguaagucuguggcucccgcggucaccguggaaaggcuggugaggcggcugggcaccguggucccgccuuccugaagcugacacuggagcugugagcucgaggagagccgagaguggagaauagagccacuuaaccauugaggacgcgauccacagacuucauuaccugcgcguuccccagagcaguauuaggccccuuuucuguuaggucauugauaagcacaaagcaaugaaggggcucgguuccaucccagguccccugacuaguucaguccucagcgaaacuucuuuuggcggcguuuucccaggguaauugaacacaaacauuuacuagcucucagccaagggccuaccccuuccuacucggcgcuccaauuccagucauaguggcgaugagcaaaaugccauaacacgaaacuaaaucugguaugaguuuccuaaaccgguguagagagaguauuuagagauuucuccaaaagaccuggaguuuaagaugaacagggguuagguagugaaagaaaauuagaagggguaguugaaacguuagaggaacacucguguaggacggguuggaaaaugagggcaauguuuggguucgggguuuaggugguuaaagagaguggguagaguugaggcuggugagguaggcgguagacaauauguugucuaccugguuaggagccugugcacaaaauauucacaugcguucaguuccuacaagcuagaaacccaagugccauccucgauaugugguuucuuacacacuuccauaagcagucugugaaguucugccuuuuuuuuuuuuuuuuuuuuuuucuuauggaggcaaagucucacuauguggcucuggcuggucuggaacuauguagaccaggcuggccuagaacuccccgagauccagcugccuguggcugggcauccgccaucuuguucagcuguauguguguuuauguuagugguuaugggccaaggguagcaacggugcacacaucaaagucauaggaacguuuagguccuaagguuccugugucaagacaaggucucuugccagugguggacugucuagcccgaguguuuauguugaugcucuuugguuuuaccuuguguuucucaguaggggacgcugcgauuauagaugcuuauacuacuauggcuggcuuucggaugggcucuggaaggcaggauuggguggcuuauauucauuguacuccucagacaguugggaauacuacaguuaaaucugcccuccuaauggucuuuuguuuguuuuguguguuuuagaaaucucucugauuuuuuuucagugaccugaguuuuuguugugaugcacuuuuacuucaguaagcccugcacacaugugcacacguguuccccaauaggcaguuggcacguuucuauaauguuauguccucuucacgacugcugugaucuacuguggcuaucaccugggcuuugggcagccacuugugcugcuuucuuccugguguuaccuuagaggugucugcggccucucugucucucugucucuuucucucugacauacauuuaugccgcaaagcagagaaaaggggaaaaaagcaauuccuagugaauaaugcacuuagauuuaugugaugcauuaugggggaguagcuguugaccacucuggccguugaacgugcguuuuauuauccuuuguguguagagaucguggaaaagcuguaucacuaaggagcugagugggucuuuuuguuuccccuggcaaaugcugaauaaaugugaaccugugggguuuuuuuguuucuauuucuauuuuuuuagguuuauucauuuuauguauauuuugccugaauguaguacacgcacaaacguguguguuuguauacuuggugcccauggaggucagaagggcaucagauccacuggaacuggaguugcagauaaguuugaaccacuaccugggagcuggcaauugaaccuguguccuuugcaagagcaacaaguguucuagccuuuguuuauguauuccuggcugggauuaucugugcagcccuggcuguccuggaacuugcuguguagaucaggcuggccccugccucugccucccaaaugcuagaauuaaaggcuugugcuauuaccagcaccugacuucaccuguguuuuaauguccagucaggugagucaggugugggguucccacuugagucuggucccuagaacucacucgugucuugguuuaggagcauuuggguugucuagcuauggaugcucagcccguguugaccguauggauuguuuguguccacuuuccuccgucugggagguaggcugccagcaccuaaagcaaugcuucuccuggaguagccgacuacauguguacuggacagauggauggacacucucuacauguguacuggacagauggauggacacucucugccaccugacuaaggacuuucuuucuuuucuucuguuuugguuuuucaagacaggguuucuuuguguuaacagagcccugguuaucugggacuugcuuuguggaccaggcuggccucgaacucauagagaucuuccugucuuugcuucuggauacugagauuaaaggcaugcggcaccacaagcaggcuuuuuuuuuuuuuuuuuaaauuuagaagucacauuuauuuuguauacguacagguguaugcaugccuucgugcacaaguggaggucagaggacaccuuugggagucgauuauccuaggauguggguucuaggaaucacgugcagguugucaggcuugguggcaugugucuuuaugugcugacccaugccacugguuguggacucuuguuuuauucaguugugccuuccuuuaucugagcgguacugaugugggauuagaaaggagggaugauuuguggccuuuggagauguaggucuccugaguggagucuggugcuuggguuauguguaaaggggcugacgaaggaacuugcuucugugugagggagggcuuggaaggaggauagguugagucuguguugguguguucuugccucuacggaaggcagaaccaggaggaagagacuuguuucuucuaagugacuaaagaaggguuaugaaugaucuguguucauucagccgguauuccuggaagucuuuaugcuaaggaaggucugcugaggugagcaagcuuuauuguugaaaucuaguagaugaguugggguguccucuuguuagcccugaagucccccucccccuuacaccuguggggcaugagggaggaggccagcaagauagaauuugagaaaacagacugacagacagacagcugauggccuuuuuguacugagaaggugcgccuugagaaaaucuucucgggcguggggguuggggggggcaaugagggauuggugaauuucuugugcaucuuuagugaccuuugccucauucgcuccugguuuuucccuuccacaucuagaaucuuucagcucuuggggcauuggugaaucucaguaaugcacaucuuggcuccaucaaaacucgguaagucauuauucuuuaauccccuuucuucagggcgaugugccuuuagaaaguggguugagucgggcaguggugaugcacgccuuuaauccuagcacuugggaggcagaggcagguggauuucugaauucaaggccaaccuggucuacagagugaguuccaggacagccaggggcagugugugugugggguggguugagcguguauuugccuauccuuuguccccacuccauggauucaagagauuuuuuuccauuccaggagcugcagggaguuuucuuuuugugagcucagcauuuccaucuccuaggucuccuguuccuacaugagauuggcccugccuccuucuuugcuugcuacucuaccucucucugagucuuccaugucuugugagguagaaaaaaauaggaaaucuggggauggagucuuaugaacaacaauaaaaauacaaggaaaguaaaaggacagucaggaggcuucugaagucuagcccacauccucgucacccucuucuugcuugucagguuugaaggccugugucugcuguccuuguugauaggggagagccccacagaguuauuccagcaacauuguguuucuuggcuucggagcauccagcaggugcugcagguaaggcuuugcuguccucuguccugccuagugugggucaggcauggacauuuagcguggacacgagcuccggggcagaaugguugaacacaguuuucugcuuuguggacagaggagguuaagcuuccaauagagaucuuauaguuuuaccuguuagcuuacuuuacuucguuugcccuuucacucucagcuucaccuggcuuccuuacccaaggagugacagcucugaaguuccuucuguaaggguguguguguguguauugcuuuguuaaucuuuucaaguuuuagucucucucgaauaucugcugugcuuucugugcuuagcuauugcauaagcacuuucugagcacauuggcaagcuguguacuaaacucagaggggcuuggaguccacuuggaugacucuuaagucuaauacaggggcugggauauuuucuuaugagcuaggacuuugcagauaucaauuuagagucaugagccauauggcuuccauuaaaugcuauuuuuauaucuuuaaaagugggggaaaaaccauucuuaguuuaugggcaaaaccagauauucacauuacaguugguaaauucuguucuaauggaagucacuugaacugaucaugauguaaccaacuguggagugacaccuguuacaguaaauagagacugagacucugacccuauccaggguagugugaguuagugauuagagccaucaguuuacaaaaugcauuucuauucugaucaauacuuacuuuggcuguaaaguauucuaagaguguaaaagccccacaggggaggaagcugaucauuggaagagcugcaaacauggcagauuggggagguaaaggugggguugggaagcuggcuggagaagagccaagccauggauuuuuuuuuuuuuuaauaagaauuuuggcuuuuauucuuuaaguagugggaguucauuagagguucuaaguagauuuuuuuuccugcgauaacacagugccacagauugagcagugcauaaagaacaguuuugucugagucacggcucuggaagcugggagugaaaguuaaaggggaggcaucucuugagggucugcuugcuccauuauaacaugguggaugacaucagugggaaauggggcuggggugggaaugagugugugcuaagccuccuucuuuagcagaccuacuccugcaguaacugucucucugacuuaggggauuaagaguccaguagagggaauuuggagauugugcaaaccauaguggugacagugaagcaguagugaugacauuaucacauuugagaauuucucucuggguucuggguaaagaaccggaauggagaggccugaagcagagggaccagauaggugguauaagagagcacuggcaguggccugcaggagaacugauggguagguggguuugagggagccaagugagcagucucaugauugauuggcuuuugggagaagauaugaccagcgugaucuguggucuucagaacauuggaaggcagccaaggcucagggaauaaaggaaaacacugaguguggccuggaguguagaguagcaacccuuucaguagaccugaagaggacuucuguugguauauuuuacuagggaauugauuaccagugcuuagccagcagugaggauggggguggguuuuaguguguguccuggccagaacugggcucuaagcgcaaacugugcugaagcacucugugggaggaggaguuuucugcagagucugagucugacacagagcaagccaagaagauaaccaggauugagaguuggauggaaucuaaaggaagagggaggagugaguuagauugugggguuggauggacuccagggagaguacagaaggaacgagggaggggugacuuguguuuauacucaguagagcuggaauaagacugacuuggagucauuuucuguaaaagcaaacuuaggagccaagcuagacuggauugggagcagagggauggacaugguuaacagcaguucuugggauuugggggguggaguuuguaucggcucaagaaaagaauuucuaagaugggagcaaaguaagcuugugcccaugccagugagaagagaagaaaggauaguauuaagcccagugaaggggucaguuauggacaggaggagggguuuguaagccaggaagaagggagacuaaugagaaagaaugagggagaauggggguacuuaaagaucucagggcuuuguuuugcuuuguuuuuuaccuacauuuucagguuugggaguuauaaccuaaaguagccccugucuuuggcuucaguuuucucugccauaauaaaggcaagaccaugcaagguggcacugguuggggaaguugggauuugcaaguucauuggagaaagcuagcuaaaaagaaauguaggauugcuggacagugucaaaagcuuguuuguaguccauggccccaacuauucuuucauuguaaaauuaacggauugguuaagaugacucaguggguaaagccacuugcugccaagccuggcaaccuuaguucaguccuggacaugauaggaggaaaaacuggcuccugaaagauguccucugacuucugugcuucugccuucauaaacaaacaaacaaacaaacaaacaaacaaauggggaggagaagaagaaaaaaaaguaagugauuucugagauagcccaggcuguccucaaaguccugugcacaagccacccucuugccuuagcccuuuugauagcuaggacuacaggcaugacaauaugcucggcuguucaccuuucuuagugaacauuccuguauguguuguuggcacauggcuuccucuggcuuagaaguagguauaugccaaauuauuuuuuuuuucccuuagguucuucugaauuuuccagaaaguccugaaaccccugaguuccaggguggguguauaucaaacuuggagagaugaggcagagaaaugcaguaugggagaauaaagauuauuguaaucuccuaagcacucagaucuuuuaaguguggcuuuguuauuuuuuuuucuucaaacaaauuccugggacccaaauacauucuuauuuuauaauuuauucuuaauuuuugagguucuggggauggagcccaguggcuccugugugccaggcgcuggguacuaggauauaaauacguccuuucuauagacaccuagguucccuuuguagccuccuuauccucuuuccugucugugguaaugugaugguaacagugacauuugcugugguguuuccauuuaucuucucugucuguccguccauccauccauccgauuaaugugcauugguguuuugcuuacauguaugucugugugaggcugucugaucuccuggaacuggauuuauagacaguugugagcuuccaugugagugcagagaauugaacccucuagaagagcagccagugcucuuaaucacugagccguuucucuaccaagcugugguauuucuuaaaagcccugugcuauuguuaccuccugucccucuucuggugacagugaagguaagguuugcagcaugggugcuguuuuuagucucaggacucaccguccaccauggagcuggcuguggcuguccugagggaucugcuccgacaugcaucccagcuuccuacccuguuucgggacaucuccaccaaccaccuuccugggcuucuuacuuccuugcugggccucagaccagaggugagacuuugcaguucugguucuugcuuauacuguuuggauuaaaaaauguuaugggaacugcuuagggaguagguguaaggauaagaggauagugacugccuggagaaggggccuuaugggcugaggaugggauagaaguauaugggcuauuggugcuuggccucuccagacggaauucuguuuuuccuacagugugaacaaucagcuuuggagggaaugaaggcuugugugaccuauuuuccucgggccuguggcucucuaaaaguaaguacuucugaaacuuuuaaaacucucaaccuuagaguccaucccuggcauuucuaaguucuuaucacaacaagcaugguauaacaauacuaccauggaauaguaucauuuaguccucacagugaagauauugacuuaaauuaccuacucaagaugaagagggcuggagcuuugucugucugaugccagaccuuuugucuaacccguaaacuucuuuccucaucucucccucccuucuggcacagcccauucauucauucacucauucauucauuuguuuauuuacuuauuuauuuugguuuuucgagacaggguuucucuguguagcccuggcuguccuggagcucacuuuguagaccaggcuggccucgaacucagaaauccgccugccucugccucccgagugcugggauuaaaggcgugcgccaccacacccggcuccuuuuauuuauuuuuaaauuuagauuuuuuuaaguuauguguguaaguguuuugccugcauauaucucuuugagccuugugugccccuggugccugcagaggucaaagguguuggauuccucuggaacugaagcuaacagaugguugguuugugagcugccaugugggugcugggaaucaaacuugaggccucugcaagggcagccagugugcuuauggaggaaccaucuauccagccgcuaccaccuuugcucccucuuuuuaaugacccccacugagcuacccucaggccccaccccucagccccuuucucuuucggucuugccuauuuuggcucucuagaucugacuuuguuccugaagcaccaggaguuuccuucaggaagaacgugcuacagaggcucauuaccuccucaccccaauuucugguuuuguuuuucgugauuuuagcugucuuuguucaggcagcaaaaauagcauggauuugucauggguaagagacuugccaccaagccugacuugucucucccugccaauccuacugauagaagauuuguucuuacacuggcuaaccugcacucuuuuccuguccucauugagucaaaaacuuuuucaccuuuucacuuaaagggaguacuuuauggcuucucuuuagccugccugaauugacaucacuugagaucaccguaaaguaaaguaaagguugugugaguacaggcccugugcugcuguaacuguuugcuaauggagggagcagcuaagcugcugagagggaguggucucacucgaaaagucgucagucuguuauaauuguucugcuuuauuauuaaguuguuaaauucuuuccguacccagauugugagguaaacuuuaugauaggucaguguguacacgaaaaguauaggcugggguggugguacacucucauggcugaagcaagaguuuggaguuaguguaaauuguauagugagauuaaaaaaaaaacccaaaacaaaauaaacauaaaaucuauuaguauuugggauuauuuaugauuucaaccauuugcuggagauguugauacauauuccuuguggauacggguguuugugucacuguugccuccaguaugugacgccucaaagcagguaauuuuagugaaccuauguguacugagucuucauuugcauauggcugcucuuauccacagcuaauagaaguuauaaguggagcugaguguggcggcacacaccuuuaaucccagcacacgggagcccauggcaggcagauuucugaguuuaaggccagccuggucuacagagugaguuccaggauagccagggcuacacagagaaacccugucucgaaaaacaaaacaaaauaaaacaaaaaguuguaagugggcaggacaggauuucuguuuuuuguuuuguacuguggagugaacucaguccaaucacugaguucuauccuuggcucccucagaguuaaaauuuaauuuuauaaaacaaaaauaucuggaaucacaaacuuucuguuuguauuaaguucuguuucaauuaaaguguuccaaaacaguuuauaaaguauugauagggcuggcgagaugcuuaguagauaaggcguaagcccgaugacuugaguuugauucccuagaacuucugcauaguggaaguugcagaugaucagucacuguggcagaucugcuccaucugcuugugaggucagcagggucuugggucaagcaagcuagaucuagggagcuggucucuaguaagaaguuauggaaagcaaguaucaggcuugcucacaucaaggaacuagaacggaagggagaccuggaaacucgggguggcugaacccugcuucugguaggagcaagucuaacauauuuacaauggcaccauuacgguauagaguuagaauucacuauagagcuaggugguguuaauucuuugauuugaauuuguggugcguguagcugguaggguaagguguucccuuuagacuuggaaaggaacagugagcucaucacugacagccacaguccucucaugagcauagcuguuugcaguuaaaaugagagauacacuacauuuuacuuacaggucacugaaacuaaugguggccuuuucccuauuacuauucacacguucaugagcuccuuuuauucuaccccaaauaaauuguggaccuuagguugaacacuuacucuaggcucucucguaucaggcagagguuugcugauagacaguggaaacucugagauugauugccuucguuuugcugucuagccuguccuugugacccaguccucuauccaucccccuggguagugcauucauuuuagcugggccucauuuaugcucaucaugcagaguuagucuguaggcaguucuguuuuucagaacugucauuuugacuucagaaagaaaggugacugucacuugcaaaaacuagcagagggagcccaguuguuuuuauggcaggaaggagguucuuucucccaguaaggaggcuuagaaccagagcucaugugcugggucucuaccccagaaacauacuguuaauggcugucaucaccccauggaugcaucaugucuauaggaaagucaaaccucagguagaaggacugcuauggacacucggcauuguuccauggccucuuccuuucuccccuccuccagggaaagcuggcuuccuuuuuccugucucgauuggauucccugaacccucagcuccaacagguaaagggaagggagaggcacuaaguacggggaucuggucugaggcaucguuuacagcuuauucuuagcuguuaauugcacagcauuuggacccucuuuucaauuucuuccuccuaacacacacaauuacuggcuuucguacucuuagggauucugccucacuguuacuugaacuuguugagcuuuguuuucugggccauuaguggggugggagacccauggccaagcuagucccucucugaccagcuuucugcccuucugcagcuggccugcgaguguuacuccagguugcccucguuaggugcuggcuuuucccagggacugaagcacacagagaacugggaacaggagcugcacagccugcugaccucacugcacagcuuacuggggucccuguuugaggaaacagagccugguagggaacagggcuguagucuggagauggguuggagagcguggcaggagggaacaagugugguccacagaggccgggcaguggguuucugggugacauggaugagaacauaaguggguaaucuagcauaaaugaaagagugggggcuggagagggguucaguggugaaggacacuggcuguucuuccagaggacugggaauugauucucagcacccacauggcagcucguacaaagggaaaaggagggaugggagaaaggcagaguguauaggugguuguauugcugcccagcuccugugcagagugaaggcccuggaauagagaugcugcuuucccacucagaagaugguaacacccauguccuccuccagcuucggcagagguuuucaggccuggcccguugccuggggcucaugcucagguguguggcuauugaagggaacgggcuuggggcuggaaggugcgguggguguguggagucagcuagggugacugcucugagggucucuuuguucugguucucuagcucugaguuuggggcuccuguguccguuccugugcaggaaauccuggaccucaucugccggauccuugguaucaguagcaagaauauugugaguggauuuugccuuccuuugcauuguagucuugcuuaagacccuggccacuuggacaauacccagcugucaucucugaaagugucccugaggcauaugcaagugucguggacucccucacacaggguagagccaccuguggucagggcagacagugcugguuggggaugagccaaggcgucguuaaagggcucacucauggucaagcucuccuacaggaugggagaugggagaugggcuuggguugagcugggccagggaguugguucauguuauauaaucugauauaccugcuauguuucugucuuucuuuuccaucuuacuguugcugaauuuccuccagaacuugcuuggagaugguccccucagguugcugcugcugccuucucugcaccuugaggccuuggacuugcucucugcccugauccuugcguaaguaaacuuggucaugguguggagaagggaacgaacauacuggaaaugaaggccaccguuccguccucugccccuagguguggaagucgacuuuugcguuuuggugcccugaucagccggcugcuuccccagguucucaaugccuggagcacugggagggauacucuagcuccaggccaggagaggccuuacaggugauuguccacgagggcggauagaguggagaggguggaugagaacaucaggggccccggggcucuggcaugucagcucucguucauacccugcuuuccuuauuccuucuccagcaccauucggaccaaaguguaugcuaucuuagagcuaugggugcagguuuguggggccucagcagguaugcuucagggaggagccucuggagaagccuugcucacccaccugcucagugacaucuccccuccagcugaugcucuuaagguuagugagaccuuggcuccuguuccccuggcuccugugccuauuuccugacugacuguccugacuuccuguuugccuguacaugugacuguguuuccuuuuaccacaagcuaugcaguaccaggggaagcucugauggagguuugcaaagugggaagccaagugcuccuaagaagcucaagcucgauaugggggaagcuuuggcuccacccagccaaaggaaaggagauaggaaugccaacagugacgugugcgcagcugcacugagagguggguuggugugagcuggucagccagucggcagaguagagcacauaggcgcagaggcagccgugcaaccuugagagcauucugcccugcuuuuaguuuggggaucugguaguuucuucugaucuuccaagaucucaguuuaauuuagucaagcacuuuacauaugcgcuguguguggcagggacaguaugagcacuugugggugggaauccagggauccaugccagugggguucaugugcaggguagagcaggaugcugguggggauucccugcaucuaaugcaucugcgaauggagccagaguuaguggaugccgugauguuaggugacucuccuucggguagucuuacuaccugcuaucucucucauuguccaaggugaggccaguccuccucaguguauacauguaguaaauuaccagcauuaucuaucauccccauuuuauacugggggaagaaacugaggguaaaugccuugcccaggguagacaguaacagaacuggaugcucccugcuaggcugugugcccuugccuuccugucugccuuugacacaccauucucuucucaggccucagucggaccauccuuaugugcgggccucucaucaaggaggagacucacaggguuaguuaguagggaccgauccugauggaggggaggggccacuguucugugcauugggaguguuuaccccaaagguggauccacugaaagcugggaacgaggcacuggcuuugaaggugauguuucuagacucacacuauuuucuuuucagagacuucaugaucuaguccugccccuggucaugaguguccagcagggugagguccugggcagcucuccuuacaacaguuccugcugucgccucgggcucuaccgccugcugcuggcuuuauugcuggcaccuuccccucggugcccuccuccucuugccugugcccugaaagcuuucucucuuggccaaugggaagauagucuugagguaauugcugacuugagucagaucugauccuggguucucuuguucugaugcuugcuucgugagacccuguguuccugacauucuugccucuccuuccuuccuuucucaggucuccucuuuuugcucagaagcucuggugaccugugcugcucugacacacccccgaguaccuccucuacagagcucaggcccugccugccccacuccugcccccgucccuccuccugaggccccaucuucauucagggccccggccuuccauccuccaggccccaugcccuccauaggugcugugccauccacaggcccauuacccucagcaggccccauucccacaguaggcucuauggcguccacaggccaagugcccucucgcccuggaccuccagcaacagccaaccauuuaggccucucugucccaggccugguaucuguuccacccaggcuccuuccuggcccugaaaaccaccgugcaggcuccggugaggauccuguccuugcuccuagugggaccccuccgccuagcauaccuccagaugaaacuuuuggggggagaguaccuaggccagccuuuguccacuacgauaaggaggaggcaucugauguagagaucuccuuggaaagcgacucugaugacaguguggugauuguaccugaggggcuucccucccugccaccugcaccacccucaggcacuccucccccugcggcuccugccggcccaccaacagccucaccuccugugccagcuaaggaggauucugaagaacugccugcaaccccagggccuccacccccacccccacccccacccccaccggccucugguccugugacacuuccuccaccccagcuggucccugaagggacuccuggagggggaggacccacagccauggaagaagauuugacaguuauuaauaucaacagcagugaugaagaggaggaggaggaagaggaagaggaggaagaagaugaagaugaggaagaagaagacuuugaggaagaggaagaagaugaagaagaauauuuugaagaggaagaagaggaagaagaguuugaggaggaauuugaggaggaagaaggugaauuagaagaggaagaagaagaggaggaagaagaguuagaugagguagaagauguggaguuugguucagcaggggagguggaagaagguggaccuccacccccaacacugccaccugcucugccaccuucagacucgcccaaaguacagccugaggcagaaccugaaccugggcucuuauuggaaguugaggagccagggccagaggaggugccugggccugagacugcuccuacccuggccccugaagugcuccccucccaggaggagggggagcaggaagugggaagcccugcagcagggccaccucaggagcuuguugaagaguccucugcucccccugcccugcuggaagaggggacugaggguggaggugacaaagugccacccccaccggagacaccugcagaagaaauggagacagaagcagaaguuccagcuccucaggaaaaggugagaggauuagcuguggaggacccugcgugaggaguggagcuggcaaggcagcucugcuggggaaccgguacuacagucaggcuguguguguguauagauacauacauaucuaucagguucuguguguguguauagauauauagauaucuaucagguucuguguguguguauagauacauagauaucuaucagguucuguguguguguguauagauacauagauaucuaucagguucuguguguguguauagauacauagauaacuaucagguucuguguguguguguauagauacauagauaucuaucagguucuguguguguguguguguauguguauagauacauagauaucuaucagguucuguguguguguguguguauguguauagauacauagauaucuaucagguucucuguguguguguauagauacauagauaucuaucagguucucugucuguguguguguauauagauacauagauaucuaucagguucucuguguguguguguguguagauacauagaugaaaucuaucuccaguuguuggggacccacauggagacugagcugcaaguuuguuaugggggcagggcacaaaggagaaugugauggggagggacucugggagggauagaaauaaauaaauguaaagggucauggugagggcuggggguugcuccagucugacuucugugugugacuuugaauuuugugccuuugucccuaaaaggagcaagaugauacagcugccaugcuggcugauuucaucgauugucccccugacgaugagaagccaccaccugcuacagagccugacucguagccccuucugcaccccgucacuuuguauccaauaaaguucugucuguagacccugugcugcuuuggcucugccacacuucccagccucaagccugagugagugcuggaccugcugcacccccucugauguccccacuguugucuucagggacccgaggaagagccgcuggcuaagagaagcacucagccaacugccugucacuaaguuaguguuggaguuuucaguucuuguccucugcucuuuucugcaggugcuagcuauguagcccaggcuggccauaaauccagucuuggguaaacuuuccuuguuccaggggcugaaguuguagaugugcccccgcgcaagcaugucugcuuuucuaauguuaugucugagcggaauugcugguagguaaggcugcggagaggucuguuuugcuuuuguuuuuguuuuuguagugcaaggcuagcauuuuaaggggguuaacaguugaauuaauugguugaaaagugaauagguuuaaggauaaaauucuccccuaguuauuuugaaaaauuuuaaguuuucaaagaaauuguaaauauauucaguauuuauucagauuucuuugucuuuacauaggugcuauuuacagguaggcauauau

SEQ ID NO: 6142 - RNA, 8424 nt, Mus musculus
caaucuaguucuaaaagcuugaggaggggcggggagaucgggaguagggacggcgcggggaggcuuccccgagggaaacggagggcggaggcguggggcggagccagcucgaggagggcgggcugcgccgcggcgcgcgggauccggcugacgcagcuggccccggcuccccgagacccagaccgcgaggggaggggaaggaggagaaagagugaggacgcgcgugcgcaguggcgcggggaggagcggggaccuggcagcaggcgaggaggcugcgagcgagccgcgaacccggcgggcggagggcggcgagcgcgcgcgcaccaugggagaaaaacccgggaccagguaagggagguggggccgugccgcggggcaugggcggcugcucguggggugugccagguugauccacagacaaggacaccggggaagaaaccccggggccggacgccugggucccuagaggguagcgguccggggccgcaagccuugguccuugagauauuggaguggagcgugcgugcuagggcuccugcaaaaagcaagaccugauggggaucgggaaacccacgccuggguucucgcagagauguaggagucggacuacuggguucucugugcaggcugugaugcaagggcggaggaaggaggagcagguggccggccccgagggguugugugcugggagacuggaugcugggaagggauuccccuagacucgugcccaaccaauggaaagccuccugcccaauaccccacagucugauugcucccaccugucccaagggcccgauagcucugcuaccaaacuucugccuucuagguugcuaggagcaacagcuucuucuugagagagaagaguguguagggacccucgcugaaauuggacuguauuccucuccuggggguggaggggagagguaguaucuccccuggacacacauccucuccccggauguucucugugcaaucgaagcuccuuccuuccacugauaccagaguucucuuuuuuggucuauagcaaaauccacuuccuguugugacccaacacccccaagaggacauggggugaaugcuugaguuccaaaggagcaagagcuaaagaauagguaggggcuaugugccucaagccggagaggaccaagaauaagggccugauuaugagcagugacuucugcaaaacaugggaucaaccccaccacucccacugcccuuagaguaugagaaaguaggcaucucagcauuaagaagaccaauaucugagagagauguccacagggaagacugaccuccuggauuugagguuaaacaccccagagaaaggggaagucacuuacuuggggggaggcccccaaauuuccguuguguacuucagggaggggguagaugguccagagaaagacugcugacuuggcauaauucccuaccaucucaucaaauucugggccacaggaaauggagagaauggcaggaagugcuaagaggcaucugcuuuagcugcacccccccccccaagcuggguaccucccuggucauucccuuacucugccuccuuggccagccucaguaugugcccacugcccgcucccuaaccaggcaagagguggcuggggaagauguagagagcagaugcucuguaguuaccccagggcaauugccugagacacacugguuauggcugucacaggcucugucagggcucccauugggggaaaauacagggcaggaagaaaccagagguagaagagcuagccagccuaggugaugucugagcugucagcccuaauugggacagaaauuagagugauuguucuaacugccaccaugucccaaugugccuuauuacuuggggauacguaggggcgcccuauguauaugccauaugacccuaaguaugacccugugauguauggacagcuuggcuuuuggggaggaagagacaagugguuuucugagcagacauuuacauggugcuugaagggaggauggaacacggggcauuauucaguguguuaccugggguccuuucccaggaauugccccuggggcagcaugccucacagggggcagaaugacacuuggaagaauaagccaccgaguagccagagcccuggggucacuagacaguuuccuacuaaugcucccagcagcggguggagucuaggcuuagguuguugcaguacccguguaaaaaaauccccuuugacuugacaaacugugacaggcaagcgccgccacuauguagugguugagaacagggucuugaagccaagguaccuuccuuaaguuuauauccgagucccacccuguacauucucugugaccuuugacagaauucuuguucgauguaaaacagggauguuucagucucagccauugggcuauaagagcaauagaugcaguuggaacagagcagccccccuguaccauguuagccgcaucaccaucuuugccauaggaugcugcuguguugggaccacaguggauuuuuuuuuaagcugcgaggcuguuggagguucacgaaauagucagacuugggcaaaaaccaucugaggggcagagacuaggcucugcuccgggagucacuguaugggucccugaagcuagaggucaguugaaaagauuaucugagugugaugguuugugccuuucauccucgcaccaaggaggcagggacaaauggaucugaguuggggccagccuggucuauaugucaagauccacgcuagccagaguuacauacgaaggccaaggucaaaaaagggggguggggagggguguuaggugugacccagacaguguguauccauccaguucgcucucaguuuuggagaggguccccuggggaggagagccuggguaguuccugggguagcuaguggccauuauuguaagaggaggagugaguuauguagcaucgaacagcaaaggagcaaaggcucgcucgcccugacaguuggcuucgaggggcugccaugugggaaauacugggacuuuauaaaaaagcagugggaaggguagggcagggauccaggcugaauucccuucucaggcuggggagggauaaguccugguguggugguccuugcccagccuaagggaggcaguggggucuuccuuucuguuuuguuagggucuucaagaagucgagcccuaacugcaaggugagucccccucgaugcuuacccuuugauccucccugggcccgaucaaagcccucgaugauccccaagccuuugcuccccacuuccugugacagcuaaaagcagacugacuuccuucccuccuuaagccccuugccgcagucugaagaagccacagggcuggguggggucuggguuccuaagcaagcuuguaacucucuuagaaaccaacccagggugccugagcuaggaauaguuaauaguuucccaggcugugggcuguuuaucucagagcccuuuguggggacagcugcuaccugccuggucuggcugaguguucccugaagacauagaaacacacauaaacacacacuuauguguaccgacccuccgugggugggcagagguguggaaagcagguaaaagcuuaaacgaaaguuuuacuaaguugucuggaaaacucuaccaaucucaccuuccagucauacugggagacaauccuuccugauaacccacccaaggggagcccagaacaggacacccaccuuugagaacucugguggcuugccaccauccuccccaauuuccccugugacccuugaccuccucagcucaccguguacuugggcaagcgcgacuuuguagaucaccuggacaaaguggacccuguggguaaguuugccuagauggcaccaacacaucaccccugcaagaggggaggugauuccugggucugggaguggcccccuucagaaaaugaauccaucucucuuuccuagauggcguggugcuuguggauccugacuacuugaaggaccggaaagguacuacauguaugcuggaggggagaagacaacauuagaugggcugacauugauaagagaggaaaggaaggcagcaucagaggcagggaauaggauuccgggaagucuguuaugccgaagaaggaugugggugccgugaagaaaggggcuucuccuaaucacccugacucacccuuacuugucaguguucgugacccucaccugugccuuccgcuauggccgagaagaccuggauguacugggccugucuuuccgcaaagaucuguucaucgccaccuaccaggccuucccccccaugcccaacccaccucggccccccacccgccuacaggaccgacugcugaagaaguugggccaacacgcccaccccuucuuuuucacggugaggaugcucuccauuucccgcagggcuuggggucuggggcucuuugggauugacaugggaugaggcaccuguuaccaguugaaacgccuccuuuuuccucugccacagauaccccaaaauuugccuugcuccgucacacugcagccaggaccagaggacacagggaagguacgggagggacgacucucacaauaugugaauagaaccaggcucagcuagauacacaaagcacagcugagcuggagggugaaguguagggggcuccugaggacagggugguauccccagggagguguguggucacugaaucuguucucugaccugcauguaccuggcuggguauggggucuccucugugcacugccaugagccagccucugccagaugccaggcuagagagagagacaguggggcaagagaguuccucuguuuccaugaugaggcaaaaaauccacaccaacaggaaugaagcaaggaggaaggaggggguguguuggaugugguaccgggagccuuggguaagagguggccuuuccuccucuucccaaggcuuguggaguagacuuugagauucgagcuuucugugccaaaucaauagaagaaaaaagucacaagagguaagagaaacagcucucucacucacucucucucucuuucugucucucucucucucucucucucucucucucucugguuuaacggcucccacccagccucacagcgccccagaccccagugggagguaggaaucugaauuggcuugugguaucuugaaucuaagucuuuccccuccuccaaccccugacucaggaacucugugcggcuuaucaucagaaagguacaguuugcuccugagacacccgguccccagcccucagcugaaaccacacgccacuuccucaugucugaccggaggucccuccaccuagaggcuucccuggacaaagaggugaggugugagagggugacaaagaugucacaaagcaggccagacuccugggaggaggggugaagccacaggcaagauggugauuugggaggcuuuuuguuguuuuuuuuuuucuuaaggcuauugccuuacuuggguagagguacuguggguaggaguuggggguggagcaggccaguggggucaguaaaaaaaaaaacagguacaagcgaugcaaucucuucucuucaaaagcuguacuaccacggggagccccuuaaugucaacguccaugucaccaacaauucugccaagaccgucaagaagaucagagugucugguaggaggugggggugggcauggggauagggaaggaagucccuacuuagaaaggcugcugcugccaugucagcccaggccgugucgcagugugggaaaccuaccgggccauaaagaauugagucuguuccagaagagauacauggcccuaguguuuacuauaguaggucuguuggccagggguggaagguggaggugugcugcccccaugggguuuccaccauguggucggggguuguggugccgaauugucugugucacccaaagccacuugguccccugcccccacagugagacaguacgccgacauuugccucuucagcaccgcgcaguacaagugucccguggcucagcuagaacaagagugaguaaggguuagaggugggacccaagcgccggucuucagaacccaucucacuucuaagggugucucuauagccagggggcuccaagcuguuaacucucucgaacagguugaaccagaaccuacccccuccuaaucugugcccaaauggacagugagggaggagagacugccugagggugguaagaugagccuccccuagcccaggcucuccaacaaucuuguucccaaccccccaccccaccccaccccccagugaccaggugucuccuaguuccacguucugcaagguguacaccaucaccccgcugcucagugacaaccgagagaagcguggccuugccuuggaugggcagcucaaacaugaagacaccaaccuggcuuccagcaccaugugagaggggagaggggggugggggacaggggacaggggacaggcuuccgcugagagcaggccucgugccaggcucugugcugggugccaggaagguaucagugaacagaaaugacaaaaacuucucacauucuaagggagggaagacagacaauuagauaagugguaaacuagauaggguguuaggaacaaguguuaaacagagcuguauaaaguagagagagauagaguacggcagagaaaguagaggaagggguggggugugcugauuuuaagugaaggacccagaggaaggaggcauuguggauggcuccaggcagagagaccugcaaacugaaggacaggugggaugguccccagugugcaugagaaauugugaugugucacuguggccuugggcauguguagcccuggaaaggccagagcuucacccaguuguugccucugcacuggguacacacgacaccaccucccaggcccacacggcgagaagagacacaaagagaacuagguaaagggggcugcacgugcugugcugcagaccaaagcaccccugugaguggcagagaugaggccccaggagauucugcauccaggaugccaugagccuguauggccaugucugcauagcuggugccgcaggagcccuggaucccugaccucagcuucccuccucccaaaugcagugugaaggagggagccaacaaggaggugcuggggauccugguauccuacagggucaaggugaagcugguggugucucgaggcgggugaguacagcguggggguggggggaugugcagggccaccggguucucuguggauccauggguugugguaguuguccucuucacacagcuccucucccucccgcagagaugucuccguggagcuacccuucguccuaaugcaccccaagccccaugaccacaucacccuucccagaccccagucaggugagugccacccacacgcugagccccgcagagaggagcugagccagggucaguggagaagugaugguccuuucagcgcccauccacccaccccuucucugcccuucagccccccgggaaacagacgugccuguggauaccaaccucaucgaauucgauaccaaguaagaaacacccccugccuucuucauugauccucuaggauagagauucccaugccauucagauccaccccccuaccuugugggucguuuccuccugcuuauagaggcuguggcuacugcccugggucuccugugaaccccucugggucuuuuaccgcuuaagugcuugacucuaggauggggugggaggaaggcagagugggaggcccaaggaagggucagaagcuuuuauuacaucuccuccucacucucaccaagcuaugccacagacgaugacaucguguuugaggacuuugcccggcuccggcugaagggaaugaaggaugaugacugugaugaccaguuuugcuaggacgaggggcugggagagguaggggcgggcaggacucaggucccacggcccucgagggugggagggucccagccucuccuccuuccccgucuguccgucuguccacccgagauacacacuggacccaucacuuguugaaagugggcauuaaucuucugacuucagcucgcugccccagccccgcucccuagggcggcaagcuguguacacaccuaaaguuuugggaagggaacagugaacgcaaggagugaauguagagaaaagguguagaaagaacgcccauguuuggccucacaccaacucgcccccagucaccacuucugccucccaauccuugaagacgagacuuuggggaggggugagcaaggccauuucuuuguuucugagcauagggaagaaauaaaccuuuuaauaggcaugaauguguauguguucugucagcggaguuuaagggguguccaguguacccauccaugaugcuuuuuucuacaucugcaggguaccuuacuuggguuaucaauaaauguuugcuggaugacugugcuaugccaguguuccaagguaaauauuga

SEQ ID NO: 6143 - RNA, 1835 nt, Mus musculus
acucuuagcuuuauaaaaaaauacagcuuuuauuauuaaaacacuuaguuccuguuuuguuucuuccaaugaggaacauaacuuccccuuuugaaggagggucccucuauguacuuagcccagguuggucucaaacuacagcaaucuucccaccucuacuucccaaguaccgggccuacaggugugagccacugugugugcuuauaagaacacauuuauuuuuauugggccaagucuucugaaacuccagggcagggugcacaugaggaaguggguugggaguugaccucugaccucugucugaucuugcauaguggaaaacagggccgucuugcuggaagagucagaagagauguguguacacuggggcuuuggauucuucaguucuccuuucugccuugugguccucgucugcccugaccaguagggcacguguaugaugcacugcuccccauccuacggucucuggugcagggcacacucuggaucauccgaacucaguucuccagcaucugcucacagguucucgccacaucacuaaucuugaggcgggcguagucuacucgcuuuagagccauuugacaguccuuccuggaagaguagcuggagcccucaugcggcugcccuguggccaccuacaagucagaucaaucaaugggguacugccucucuuuaccacccacaaccgggcaguauuauuucucuggucucacaucuuucccaaguuugaucuacauuaguugacugguaacucaguguucuaaggcaacaacaacaacaacaaaaaaaaaaaaaaaagaaaaagcuuaaccacugugugaaccucaucuaugaaauagggaccacagcgaauacuuccuagaguuuuaggauaugcccagcacaccacagaugucaguaaacaguagcagcuggaguaaagacucuggaagccucuuagcgaugucugucuucuuaguccccaagcaaauauggccucacaaguuucugggaacaacguucgguagcuucaguauuuauuuauuuauuuauuuuuauuuauuuauuucaguaccugggccucuuuaugguagguaagugcucuaacacagagcuccaacucucuuucugaccuacugggucugaauugcccagacaaguuuugaacuugugaucuuccagccucaggcacuuaaguagcucagaauaccggccugugccagcugguaugccuaggguauuguuuauacacccuagacauuuuuaauccuuuccuuuuagaggacuaaaccagcccugaaaugaaaguaccuaucgcguaagaggcagucuuaccuagcuaaagcucagggaauccccaaggcuagggcguugguucagagcugggguccccgcccagcaccuucuagacacacccaccugagugagguagcggauuugagcggauagcucugccuccacgugcugcacagaaguggugaaggcugccgccugccggucgaggagccgcucguuagucuuuuccuuggacaguuccaggaucgccguuccugccagggcggggagagggcgaugucagacccaggcuucagacucagccccgcccuaaggcuagcauucaggucccgccccaacugcacgcagagucccgggcuggucuucaccccuugccgucugccccucgcuucccgaaccugcguucuggaggauggcgccgauuucacgcucgauauccuccagggcgcgcagccgcucguucgccagacuguagguagccaucguuccaguggaaagccccacaggccgucuuuugcgagguguggcgccacagcccggaaaugccuguuaaugugcgc

SEQ ID NO: 6144 - RNA, 1103 nt, Mus musculus
cauaggucaugcaggauggaguugcaggcuggagccaggcuguuacugcugcugggggugaugugcuauggacaugcacagauucaaguucacguagaaccacgcuaugcaucgaucguugacgugaccaacggugguaccuggggugauugggccuggccugagauguguccugauggauacuuugccaguggguucucugucaaggugaagguucagaccugggucuuagaaagggcaaagaugugccagauugcagagcugaacgugagaaggagaauccucucaguggaccucacuucugcuucccuccugaccuagguggagcccccucaaggcauuccuggagaugacacagcucugaaugggauccggcuacacugcacucgagggaacucacagaaaaacacccacgucguggagucccaguccggaaggugagauuagggaccaaagacccaacgggguagaaagcauuuaucuaguguuuguaaagcucuggguucacuccugaaugggaaggacacucuccuaggacaaagguauacauaccccuucccuucuguuagugcccuucccugagauaaacuccacuaagguuauagaggugugggguggaaguccacccguguacucagggaaacacaggagauuagaucuagcccauccuuuauuggcagugcuggguuuggaaguccccaggguggguaggacgugcuugaagaaccauuacaacucuccuucucuugcagcugggguucauggagugagccucugugguguccuggcacuagcuucuuaguggcuuucugccuccggguggagccauuuacauucccaggggacaacacuggagugaacaacgugcgcuuccguugcucagacggcguggagcuggaggggccugggcugaacuggggagacuacggagaguggagcaacucaugucccaaaggugucuguggcuugcagaccaaaauccagaagccaagaggccuccgagaugacacugcacuuaaugacaucagaauauucugcugugccagcugaugcggucgcucugccaguacugucuuuuaccauuaaagcuucuuggccuuggc

SEQ ID NO: 6145 - RNA, 1565 nt, Mus musculus
gucgacagcuacuaaagcauucuuuauucuucauugcuucuuccagcuuccagaggcugaagaugagaggaucucacacaucacugagacugcccugcugggggugggccuuaacuguggugacuucacuaaagaggaccgcuagcuacucucaggccgccgguaacccugaguauguacaucccuucccagaaaugccuuucuggucggucucuugaugccgcggccaucaagccagcuggagcaggccguggccggccagcaggcccuggguacgauuguacacauccuccaggacgccggcggcccgggccagagcaacccgcgcguccgccucuccuguuccgggacacgccagcuggagcaggcgaccgcgacucgggagggccaagaucgccaggcgagcggccugacggauaagccauggauggugcggggccagggcggugcuguaggcuuccccgcacugcgugcccgcaucuggaccuccaagcgucccugucgccacccuguggaggcagagcugggaccagcgcagcgcgcgaugcaacaaaaguagcguucgagagcccgaggacccggcugaaugcccagguucgguucccgggcgcuguagcaauccugcuccccgcucccaugugaucauagucaucagcgauguguagugugaagcauuggggccgugcacacgagccucgaggucggucaccuuguugaaggccucgcugguggcaaaggcgaagacagugccaaggggaguuaggaaccuguuuggugguggaaguggggagaugacuugcgaaaccacagaaucauuuggaggaagaugggcuuggggaagggagaccacucaccuaaguaguucucuccauccugccagauacugagacaacgccacauccccuucagggcucauacaggccaggaaggggcucaccaugcgacccagcgccccaugaggcccuagacagggaagcucuuccuucucugggaccacuaggggucuggccgcugggccagucugggagauagauauaagagauacaugaaaaguuccuagccugcuaggccuacuuagccacuguugggcccugaagaaugucccucagguuuagcugggguuccuccugguuauucuugacaucugaaggggggagggaacagagagggaggagccuccuuucauucgauucucagucugguuccccuguuucuuuguugcagaguccccagacucuggccuuaaaacucaaacauaccugggaagguagcggucucucuggauugcaggacugcaccccugccgggaaacuaagcagggagccgaggacuggagaaggagaagggaguuugaguccccgcaggccggacugcuggguucucugagcugguaaggggaagggccacucauagaagaaccauauacugauguaaagaaguaacagcguuaagauagcgaagggaauugcauggcggaaccagcgucccagggcuggggacagugagacccccaugaccaucgcuggugcaccucaccuagcuaguugguggccuuucccuucccg

SEQ ID NO: 6146 - RNA, 2543 nt, Mus musculus
ugcacauaaaacaaaccauuuuauuuaaaaacauaaugcaaccagccauccccaaaauaauccaauaaugcuaguaaugauaaaagaacagcgcacugauaaaccuuccuuaccucucuaauuccuaccgagcucagugcaauaguuuacgcaagacaaugguuuuggcaaguugaaguugaagucaagaaccuucacacagaaacgucucuuuaacaaacuguuuauuagcuucugcgucgguauggaccauccuuuacuacucccuagaacaccaggccucagggagguggcaacguggcaauggugaacuuggggauuuggucucccaaaagcaccugccgcucuaccccugacuccugaauggcugccaagcggaucaccccuccacuggagccgucgcguuccauggccaaagcgagagcuguagauaaaacgaggacaguggguuuggaguuaguagcugaacgugaggacccuuggcacagcuugggaacgagggcugaaguucacaggcguggaagcacagagucucaccauuggcagugaacugcagacauucguccuuggucaugccuucccgauacguagcaucaacauagccauagauguacgagcucccggagccuccgauggcaaaggacugucuuaccaucauaccccccaugggaacagaguacaccugccagaugggaggggggagaaaagccaccaguugcacccuuucccaacacauucacccaucccuuuugauuuuggucucgggaaaguuaauggugagguagagacagaaagagaaacuuaaaaaaaaaaagguguuuggaguggggacuagggauggcuugggugguaaagggccugcuaaggcaaguaugaagaccugauuucaaauccccagcacuuauguaaaagcugggcauguguaucuguaaccccagcucugggaguagggugcaggguguauaauugcuagagcucauuggauaggcagccuagcuaaaagugagcucuaucuucagugagacugucucaugaggaagacaacccuggcacaccucuggccuccacacacauguacccauaaggauacaugcauacaggacggacagacagacagacaaacaaaauggccgaagggguggagcaucagaggugugacuccaguacucuggugaggagggccugaccugcccuccuucuugagggucccagccugcaaugaugauuccugccaucagaucuucucuguaccgguaacacaucuccuuaaagagacuggcggcuguguggacuaguggaggcucguucaguucaauacuagaaggugggguuggaagaucacaaacaaagcaauaucaggaucuggagucaggccuuuuagugccuuauguuccagagccuucagggucguuguuccuccccugcccacaaguaccuguggaaaccaagcugguaagugacagcgucugccacugcuuggguaucagcggcugagccugagcggcagcagaagaugugaucguggauaggggucagcuugucagucacucgauuggcgauguaggaccugcaggauggcggaaacagugagaaggagcccacuugccucccuccuccaccacaucaccgucuacucccugcagcuccagggauacaaauacugcuaccaccuacuaguccucauggaaaaugaagccggaugaauggagaacagaccuuuacugguaguucaccaaagggugagggggccuggaaaccacagaauuaggaacaaguccuuauuaucuccagguaguggagaaacuucucuugccacaguggucugaggaggguaaggaugggcugacaggcaggaaugguauauguuuggaguaggggaaacgggaagacuuucuguuuugagcucacccagugguuguccuggaguccgcuccuagaaccacgcccccauuaaacugcacagccaugaucguggucugggaagaauaguguaaaaaagguaacucuuuuagccuuaccgcauucucgaguauauaccgaccucaauaauucuucacccggauuuuauaaugcaaaauucgugcuccgcgaaccuauuaucaaaucuuaagggggcucaacacgucagagaauauaaaaacuacaaucuccaaaccccaggauucagacucuuaugcuucagccuacuguucaccucucaucacgaaagguaucaccccacgccagcauucaaggaaucccucucccucucgcagaacacagcgcucccccccccccaacccacucagucaaacccacucgggcuucauguuuuuccucccgucaggccuaguacaugucuuccgaacucuggcucuuuccucaccccuguggagacuucccgguuuucccagucuggggugagagccuccggcccaaaggccggugcagaccccgcucgacgaacagcuaaggcggccgccaucuuccucugcuacucugccacaaagcaaccgucguaaagcgcuccgucacucucuuuaguccgccucuguggccuucug

SEQ ID NO: 6147 - RNA, 8121 nt, Mus musculus
ugggggggaggggguuucucagaguggcugagagauugaggcagagggggaacugcugagugguggagacaggccuuggccaggccuuggccucuggcucaggcccucuuaaccucagcgcgccucuguucccgagucuccccucagaggcucugaugugcccagaugagauggagggcauaggaguagaaauaaccacugagggcugcagcccacccgcccuccucuuuggcagcccuaguggguggagaagguggucgccuugaucaacugcaguucgaugugaggaagggcucuguggucaacgucaaucccaccaacacccgagcucauagugaaacuccugaaauucgcaaguacaagaagcgauucaacucagagauccuaugugcagcucucugggguaagucagaacugaaaaagguggaaguggucugggcacagccuccauacuccuggucaggguagagcuuggaucugccucugaccuauccaaggauucccguugcaggggucaaccuccuagugggcacagagaaugggcugauguugcuggaccgaagugggcagggcaagguguauggacuuauugggcgacgacgcuuccagcaaauggaugucuuagaagggcucaacuugcucaucaccaucucagguguguguauggaguuuggggacaaggggcuuaauugcuugcguaucuucauccugggaggagaacaaccucggucagacaguagugugggaagcaggaacugggccuuugauaagaaugaguguuuagggcuagugagauggcucagcgguuaagaacgcugacugcucuuccaaagguccugaguucaaaucccaaccauaugguggcucacaaccauccauaacgaaaucugaugccguuuucuggagugucugaagacagcuacagcguacaguguauaaauaaauaaauauuuuuuaaaaaaugacuguuuaugugccaggcaugguggcgcacaccuuuaaucccagcacuugggaggcagaggcagguggauuucugaguucgaggccagccuggucuacagagugaguucuaggacacccagggcuacacagagaaacccugucuugaaaaaaaaaaaaaaaguguuuauguguccacauaugucuguccaucucacagggaaaaggaacaaacugcggguauauuaccuguccuggcuucggaacaagauccuacacaaugacccagagguggaaaagaagcagggguggaccaccgugggggacauggagggcugcggccacuaccguguuggugaggaugccacagcacaguagccagggagcagcaaggucugggcuaacuacugagauccucaagcugacaguggaagucacugcgucuccccuuuccugcccuccagugaaauaugaacggauuaaguuccuggucauugcccugaagaacuccguggagguuuaugccugggcucccaaacccuaccacaaauucauggccuucaagguaauccccgccucagccaccaguauguucccagguuccgaacgcuccugcaccugucuucccugagccuucucuccuccacaguccuuugcugaccucccucaccgcccucuacugguggaccugacaguagaggagggacagcggcucaaggucaucuauggcuccagugcuggcuuccaugcuguggauguugauucugggaacagcuaugacaucuacaucccuguacaugugagcuuagcagggcuauggggcgagggagaccaacccauucuggucaucagacaugaggaccccacccaguccaccuucuucucccuagauccagagccagaucacaccccacgccaucaucuuccuccccaacacugauggcauggagaugcugcugugcuaugaagaugagggugucuaugucaacacuuacgggcggaucaucaaggauguggugcugcaguggggagagaugcccaccucuguggguaagugaagagccaccccaagcugcuuguuccgaggugacuaggacugaaaccuccuuacagcccuuccaccaucuucucucuucagccuacaucugcuccaaccagauaaugggcuggggugagaaggccauagagauccgcucuguggagacaggccaccuagauggggucuucaugcacaaacgagcccagaggcucaaguuccugugugagcgcaaugacaaggugaggcaguguaucucugaaaggagccuagcccaggggaugggcugccucuccagaccuugcucugggcaggcaucuggggguuuggaaugguucugcuguucugagcugucagagccacacccuccuucccugugggcucuguugccuuuaccccagggaccugguaacacuuuuuugccuuuccuuggggauagagagaaacaggugucauucacuuccucucucucccccagugucaaccucgucucucuucccagcauaccccucccccccgcccccacaccacacacacacacuuagcccuuggugaugucucuucuacuuuauucagguguuuuuugccucuguccgcucuggaggaagcagccaaguuuacuuuaugacucugaaccguaacugcaucaugaacuggugacgaggccccugggcuggggcuccccacauggacccagcucucuucccacagccagacuacccaggccgccccugcccucccacccccuugggcuuuugcuuuuacugguuugauucacuggagccugcugggaacgugaccucauaucccugaagcuuucgugaucacgugaccacccuuucccccaacauucucaaaacugugccuuuccccaacuuguggggaaugacacagcuuccuuccccuuaccaggaauugagugggacuugcuccuccccuuuucuccacagaagaggagagcgcuuggggcuuggaccccuuaccccauugcugcugaaugagcagggcccugaccccuuuauuugcacgccaggggagccggcuccccccuugaauguaccagacucugggggggggguguucacugggcccuggguucuggaggcggggcggucaccagccacuccaggggcagggaccauuccucauuuucugaaagcacuuuaaugauucccccccaacccccagggaauggaggagggaccccauagccaaaacauuccccccuuuccuccccacucccaccccuucuagccucuccccuucccuagaaggagagagcucagagcucccagccuuuauccucccuugcuugcaucuguauauagugugagcagcaaguagcccuucucccuccuguauccuuucucaauguaguggccuuggauauauccccuuuguuaauaaagacaauucaaccagcuuccaccauuuugagauccuacuauuguucucucucaauccuggagagauuugagaguugagaaugcagaggguagaggaaaggcauuaggcucugugaaguuacugugauaauagagacgaaguaagguggaugaauaggccagggaucaguccugacacgguaggacccuuugagaauaguuuuuaccagccccagcagggccaggccagacuucuggcuucaguguuucuauaucugggucuuguaaaaaccucauuggcuaucaacuagauaaacauucuuuagguuagaaggagccaagagcaaaauugaaccaauugccuccaagugccugaccaaaccacccacccaucuucuacuucccugaggaguuggacccacccacaugaccacacaaccccuccugcaaguucacaaaccagauuuauugucagcggccuguuuucaaaaucucuuucuuggggggugggggagaggugggugccagugcaggcucaugguuggaugcacgguggguaagggagaucaggaacuugguugaaguaacccccaaggaagaugagaguagaaccaacgcugaagagcaccaaagcugcccaaaaacagacauuguccagggccuuccccauacgcacccagucggacaguuccugugagagagagcuuagcgagggaggagccuggagggcggggcaucuagcacugcuccgccucaaccucccaacccaccucuccaguggcuuccuggucucuugugcucucagccacaaaguucacagcauccacacagcagcggauuucuggggcugcagcacccagguucuggcagagggcugcugcuaaggcaacagcaagcgcuaggucauuaaaagagcgucccuaacggcgaguguaugccuuugacccaagagcagugcuuaccgguccaaguuccgugccgaugccucugacccucaaacacgaguucgcuccgcggcuuuuucaagaugagcuccuccgcucugagcagaaugcccacagacgaggcacgccucgcuggugaggcaguucggggauccucugggggugggcucgagcccaggagacgcggcagcagcucuaauaaaaucugcagccggggcagagagagguuccaagcccgcuucccaccccugggcaguacuuucuccaaccagcgcuuaccuggcgcagccgaggggauguagcaugagucguuggcguccucaaagauacguugagcacgaugacgcaauucaugacaaugagcguggcaaccaccaugacgaauauaagauaccugauauacagaagccugaugucacagcaccccacaaacaaggcacuagcugcccucuaccucacaaauaccaccuccgcacagcugguggcguuacuucuugauccuccucaacgaugccaguauuguccuggcccuucugcauauaccaucuguugcggacaugaaggggauucccagcaauuuggacacccugcugugggucuaccacuuccacagcuccaccgaggugaggguauuagaauggcagaaucuggagagguccccagcucuuccugcuauggcccuuuccaugugaucauuccacucacuacccuugcuccuccagguggccuuacagccuccacuucuaucuucccuggaacuugcuguggccgcagcucacgaauaucuggugcaaagguucagagagcuuaagucccaggacccccuggaauccgacaagucgcccacccagaaggccacccuagggcuggugcuaagagaagcugcagccagcaucaugagcuuuggagccaccuuguuagaggugcugcucugggaggcugagggaugggaauaaaagggggagagggcuaggccaacaaaagcaaggaccucuagcccauaugccccaauguagaucucggcccuguggcugcagcaggaggugcagcgacuggacggcggcaacgacugcccaggcccagccccagacacuggggauccugguagggcgcuggcccguguagcccuggccgcagggcaggggauucggcaagcuggaacggcagcuggcgcaagugcccgguaccugauccagggggcgugguuguaccuguguggacgagguuugcacgggucuaccucaucucugccacaaacccuaugccaacugggccuuggggucccuggggauccggugcguuugggauaaagggugcgacaugggucagaggagguaugauuaaggagaugcugaacuauacuguccucuuaacagagagacucgggaaaccucaaggugucgcccagcagcagugaggagaaugggggaacagauaauccaucacugucccaguccaacccuguguccaaauaaaaguccagaacgggacaacaccaggucccuaugcaagccuucuuuggcuacauucuccaugcaugccccuaucucugugggauccacuuugagauuaccugcccagcaguggcacgcucagagaagucucuggaauuuucugggcaauuagaaacaagaagacagucugggcuagcaggacguugauagagaccgugcauuucuggccaccagcuagagggagcaagcugugagaggcaagccagggagcaagcccagccugggguucaggagucagggucaccccuuacccugcgcaggcaggaaguaagcgagcagcaccaagccagaaaugagcacgcaaggcacaaugauguuaaugacguaaaaaagcggcuuccggcggaugaugagcguauagaugacgucaguuucuccaggaccuucuguggaaccucccucauagcggcgaaucaugccugggcaguagucuauggcccauucuccauucucugcaggacauagggcacagucagcccgcacaccugcaacuccaggccaagagggcugcuugaaaccugggcuguuagcacgggggcagaaugguagagaggggcauuucugguggggguguggaaacaacacaucuagacugacuucaagaagcucagcuuccgguugugugguucaggccaagcccuacccugaacguccccccuugaaccuuaucugggagaagaauuuuuggaaaggggguauaucccuucaccgguaaaagcugccgugucaaugucaaucuuguugaugguauugccgucgucauccacggcaaagaugaacuccaccuccucagcauuguaggucugggagcugugaaacagggccagucuuuaccccagaagcuggcagccaucuuaguuccacccuggaagcuucaaucuggcaggguaauauggcucucuucuuuugcccacauuccccagcgcguucccaauccugcuuccuuuucuguucuguuuuggguugcugaugggcuuaccgugcuauccaagggauuccuggacucaaguaauuuuuaugccucagacuccuccuggggaauagcugcgacuaugcgcucaaacuacaagauggcagcaagaaaccugugcccacgccuacugcaaaccuacaccagcuucccaccccuucacuccagugccucacuccaacuccuucccaaagaccuuccaaagaagaccccaccuaucccuccuuagcaggcccuguccccugcucuaggcccuucucaauaucaugauugaagugauucuuccuaccgaaaaaugagagagcaguucugccagucaaaggggaaauaggugaccuccacugcgcaggugcugcgguagauggcugggggcaaccagcucacauagccucccucauagacuagaacauugcugucguaggccacuccaaacugcccaucaauacuguggaaaccaagcuuuucacaugucugaaccuccuucaccaaccaaaucccccaaagccaguucccuuugcagccugcccucuugggugauccucacuuguuuucuagaacaaucucuggcagccauacauguucugaagggacccggaggauuccuacaccugcaaaaucguccuugcuguaguugagccgauagucgugccaguccuaagaggugggggcgagagagagugugugcucuccggcucccaccuggcagaagagaaggggcuuggcuggggacccucccacugcuccccaggucugacucacaaugccaauccagacacugguggucagaguuucuucuuucucguucuacaacagaaagaagccugcugaagccaggaguuaggggguagaagugaggguauaggauuagaauugggggaaggucuuaccagugagaugagguugguuagggugaccuugagggugauggugacaguguccucaggucuccuaacuggccggcauucuggaucauaauugucgaagagauggugauacaggcuaagcucuucauucuuucccuggcuucugccuaugauucaagaagaaagggucauuguacacgaagcagcagcccgaaaggcuucucugcccccacccccaggccauugcaccccuccuguguuuauauuucuagauuuuuccuaaaccaacaauacugcaucuggggaccaaguacugucucagucuccacccuggucucagaccuuuucccacuccauguugacauacggauccaccuggcuccccugaccccugucccuaccaaagagugucaggagaagcagggcaccaagcagagccccugccauccugaugucugguucucagg

SEQ ID NO: 6148 - RNA, 1045 nt, Mus musculus
caccuccgcacagcugguggcguuacuucuugauccuccucaacgaugccaguauuguccuggcccuucugcauauaccaucuguugcggacaugaaggggauucccagcaauuuggacacccugcugugggucuaccacuuccacagcuccaccgaggugaggguauuagaauggcagaaucuggagagguccccagcucuuccugcuauggcccuuuccaugugaucauuccacucacuacccuugcuccuccagguggccuuacagccuccacuucuaucuucccuggaacuugcuguggccgcagcucacgaauaucuggugcaaagguucagagagcuuaagucccaggacccccuggaauccgacaagucgcccacccagaaggccacccuagggcuggugcuaagagaagcugcagccagcaucaugagcuuuggagccaccuuguuagaggugcugcucugggaggcugagggaugggaauaaaagggggagagggcuaggccaacaaaagcaaggaccucuagcccauaugccccaauguagaucucggcccuguggcugcagcaggaggugcagcgacuggacggcggcaacgacugcccaggcccagccccagacacuggggauccugguagggcgcuggcccguguagcccuggccgcagggcaggggauucggcaagcuggaacggcagcuggcgcaagugcccgguaccugauccagggggcgugguuguaccuguguggacgagguuugcacgggucuaccucaucucugccacaaacccuaugccaacugggccuuggggucccuggggauccggugcguuugggauaaagggugcgacaugggucagaggagguaugauuaaggagaugcugaacuauacuguccucuuaacagagagacucgggaaaccucaaggugucgcccagcagcagugaggagaaugggggaacagauaauccaucacugucccaguccaacccuguguccaaauaaaaguccagaacgggacaacaccaggucccuaugca

SEQ ID NO: 6149 - RNA, 1045 nt, Mus musculus
ugcauagggaccugguguugucccguucuggacuuuuauuuggacacaggguuggacugggacagugauggauuaucuguucccccauucuccucacugcugcugggcgacaccuugagguuucccgagucucucuguuaagaggacaguauaguucagcaucuccuuaaucauaccuccucugacccaugucgcacccuuuaucccaaacgcaccggauccccagggaccccaaggcccaguuggcauaggguuuguggcagagaugagguagacccgugcaaaccucguccacacagguacaaccacgcccccuggaucagguaccgggcacuugcgccagcugccguuccagcuugccgaauccccugcccugcggccagggcuacacgggccagcgcccuaccaggauccccagugucuggggcugggccugggcagucguugccgccguccagucgcugcaccuccugcugcagccacagggccgagaucuacauuggggcauaugggcuagagguccuugcuuuuguuggccuagcccucucccccuuuuauucccaucccucagccucccagagcagcaccucuaacaagguggcuccaaagcucaugaugcuggcugcagcuucucuuagcaccagcccuaggguggccuucugggugggcgacuugucggauuccaggggguccugggacuuaagcucucugaaccuuugcaccagauauucgugagcugcggccacagcaaguuccagggaagauagaaguggaggcuguaaggccaccuggaggagcaaggguagugaguggaaugaucacauggaaagggccauagcaggaagagcuggggaccucuccagauucugccauucuaauacccucaccucgguggagcuguggaagugguagacccacagcaggguguccaaauugcugggaauccccuucauguccgcaacagaugguauaugcagaagggccaggacaauacuggcaucguugaggaggaucaagaaguaacgccaccagcugugcggaggug

SEQ ID NO: 6150 - RNA, 2939 nt, Mus musculus
auuuuuaaaaauauuuuuauuauacaaaugauaacauugguagaaaaccagaaaguguuaaacagggaaaaaauacucaugauauuuagggauagugcucccauccuggcuaauggcuuuccaaguuuucuuccaaguaugaaugagcgggagccaugcuccauuucuguuugcuuuuucuagcuuuuucccucacaaagugguaguagugaccauguagccugacaauguucugaguggaggcucaaugugggaggcugauccugugaccacccaguuccaucaccucuaccucuugauuugugaggucuggaucugggugccuagauguagagggggcuucagauaaaggagaaauggcuaggauguccuguaauugucucagccucccaucccaguuagauccuaguagaguccagugaagucguaggaucuccacucacugucacagacuauggccugaguaccuaaugcccacugugcccaauagguccugaccacgacccugacucagagcugagggucgccguccugcuaccagaggccccacucgcccauuaggccuuacccacaggaaaaggcuagaccggaaaguagggagugauccuugaaggaagagcagccaggcccggggcauaguuacuugccuugcccucugcaccuccaggcuuguggugugagugcuuguggccaaugcagcagauuguuccauguccagacuauguggugucacaugccagguccaggucagcaacaagaugaggaccacagaggcaaauaggagccagaggagaccaaggacauagaagcccagggggaggaagcagcaaaagucagaauugagaaaaggacugcuuucagaaguaucagagcuuacuagagcuaccucugggagauugagaaagcuguucugcucugggauuauuguggugguggauucuaagguagggaguaaagugagcucugugguaaaaaauuguucuaaaauugucucaauugggguagacucuggaguggucagggugguagugagcacuggggagauaguggacacuagauuaguuaaaguggugcugggcucugggguagucaggguggcaguagugggcacugggguggugcugugcucugggguagucagaguggcaguagugggcacugggguggugcugugcucugggguagucaggguggcaguaguggguaccaggguggugcugggcucugggguaguuaagguggcaguagugggcacugggguggugcugggcucuaggguagucaggguggcaguagugggcacugggauggugcugggcuuugggguagucaggauggcaguagugggcacugggauggugcugugcucugggguugucaggaugguaguagugggcacugggguggugcugugcucugggguagucaggguggaggugguaagcauugguuggauguugggcucugggguagccuggguggaggugggcucuagggugguuggggaggggaugaguacaguauugaguuuuagacuguagaagguuggguuagauuccauggucucugggaguguggugaaaccugggcucuguguguggaugaauguagauuguuucuuaguggguuuaugaguuggaggcaaagaaaucauuuggcugucuugagaaguagaaggugcugcggcgaguaggcuccaguggguaguaugaacuuuaguguuaguagagaacuugaccucaguucuuguggcagggacgucagggauaucaucauagucaucauagucugugucaccacuacuaguagggcagcccuucccuggguaggaguagacaggcgcauuguccaaguuggcacaucguacacuggccacguuaggaguuguguccuugacauccacacccugcuuccauaaguagacauuguuggcauuuuccuggagccagugacggaaguagaggauuucacaaucacaguaccagcuguuggcguggagaaaaacaaaaggcaagaggagggucccaaagaagcccuuugguauugugcgaagccaguuccuuugaagguagaggguaucaagauccuccagcccaucuaggagcccagagggcagcucacgcaauuuguuguuggccagauugaguuucuucagcuuggucguuggcaacaagagcccggggggcagacucuuaagaucauuguucugcaaguagagcucuuggaguuggcuuaggccauccaggacaccaggagacagugagcccaacuuguugaaggagacgucuagaguagugagugcaggcaaugcccauccuagggagggcaggcuuuucagguuauuaugggauaaguccagguuuuccagcuuuaucaguuuaccauuggucugcaggcucgucagcucacaucuauccagguacagauaagugaggugagugaaaugcaccagugaugcuguggagaagguacccaguugguucucgcccagguggaggaugccugugucugcuggcaggucugcaggcagugcugucagcuucuuguucucacaguuuacuuccagcaggcuggucacuuuggagauacuacaagugugcugggaaugcaagggacuuggcagcaggaagagcaagaugaggagagccauaugaaccugugggcaaagggaugccacccauuacaucauuuucccagcuuuuagcccuucacugcugcaguucuuaggaucccaucuagaaacagcuuccacaccucccagacuuuucucuccuuuuccaccccugccuccagcccuugguucuuauucccuccuuagaaccuucuccaccucuggucccagccccagcuuacagucagacagacaguccuuuggaggaacagagcuucuuccaggcuaugacucgguccuucucucuacuagcugcaaggagagccag

SEQ ID NO: 6151 - RNA, 897 nt, Mus musculus
ggaucagaaaaggugucagggcagagagguaaggaugggguuagaaccugugucggcagcgccgcaggaaccucauuauuuuccgggcugccuggucuugcuucuuggugagaaaggugccccuggugggaaagaagaguccccacuuuaagaccauuguagggaaaggcuggagggccgauagagguagugggcauuaacaaagagguaaacugagggcuguauaggggcaggaagggguggucccuacuuguuucgagcaggaagggggccugagggccggugaggaggccccggccugcggcgguaggagcgguagugcugcuggauaagcaccgcugcucggcggcucugcugaaaccgcuucuguucauaguagcuucggaacuugcucugaaucaggauggccgccugagucauuuucuuauagagugcaaacugcagggaaggagaggggggacaggagcugaaauggagagacagaaauccaaaccucugaaggucacccuucaauuaggcugauguagagcccguucucugacccacccacggcugaaucagacuacucacacccagaucucaugccuaauaccuuaagugcaauccaggucagcuuguggaaagagaggggacguuagggcucucauagcacagagauagauagguuagguggacgcguguugguauacuuuugagaaaaugcucuaaccugcuuguacuuccgauaacaacguuggaucaccgcugcggcuaccuccugcugcuccuucagccuccgacccuaaaggaagagaaugaggccccgucugagccucucaaggcccaccuaguagacucuggaccaccucuuccucccagagucuccuccuuaaaacuuuuuaaaaaccauuuacuuau
